US010835585B2

(12) United States Patent
Fritsch et al.

(10) Patent No.: US 10,835,585 B2
(45) Date of Patent: Nov. 17, 2020

(54) SHARED NEOANTIGENS

(71) Applicants: THE BROAD INSTITUTE INC., Cambridge, MA (US); DANA-FARBER CANCER INSTITUTE, INC., Boston, MA (US); THE GENERAL HOSPITAL CORPORATION, Boston, MA (US)

(72) Inventors: Edward F. Fritsch, Cambridge, MA (US); Nir Hacohen, Brookline, MA (US); Michael S. Rooney, Boston, MA (US); Sachet Ashok Shukla, Natick, MA (US); Catherine J. Wu, Brookline, MA (US); Pavan Bachireddy, Boston, MA (US); Jing Sun, Brookline, MA (US)

(73) Assignees: The Broad Institute, Inc., Cambridge, MA (US); Dana Farber Cancer Institute, Inc., Boston, MA (US); The General Hospital Corporation, Boston, MA (US)

( * ) Notice: Subject to any disclaimer, the term of this patent is extended or adjusted under 35 U.S.C. 154(b) by 41 days.

(21) Appl. No.: 15/575,328

(22) PCT Filed: May 20, 2016

(86) PCT No.: PCT/US2016/033452
§ 371 (c)(1),
(2) Date: Nov. 17, 2017

(87) PCT Pub. No.: WO2016/187508
PCT Pub. Date: Nov. 24, 2016

(65) Prior Publication Data
US 2018/0153975 A1 Jun. 7, 2018

Related U.S. Application Data

(60) Provisional application No. 62/179,877, filed on May 20, 2015, provisional application No. 62/389,377, filed on Feb. 23, 2016.

(51) Int. Cl.
| | | |
|---|---|---|
| A61K 39/00 | (2006.01) | |
| A61P 35/00 | (2006.01) | |
| C07K 14/47 | (2006.01) | |
| C12Q 1/6886 | (2018.01) | |

(52) U.S. Cl.
CPC .. *A61K 39/0011* (2013.01); *A61K 39/001104* (2018.08); *A61K 39/001151* (2018.08); *A61K 39/001152* (2018.08); *A61K 39/001162* (2018.08); *A61K 39/001164* (2018.08); *A61P 35/00* (2018.01); *C07K 14/4748* (2013.01); *C12Q 1/6886* (2013.01); *A61K 2039/515* (2013.01); *A61K 2039/70* (2013.01); *C12N 2320/31* (2013.01); *C12N 2320/34* (2013.01); *C12Q 2600/158* (2013.01); *G01N 2800/56* (2013.01); *G01N 2800/60* (2013.01); *G01N 2800/7028* (2013.01)

(58) Field of Classification Search
None
See application file for complete search history.

(56) References Cited

U.S. PATENT DOCUMENTS

| | | |
|---|---|---|
| 3,854,480 A | 12/1974 | Zaffaroni |
| 3,870,790 A | 3/1975 | Lowey et al. |
| 4,210,644 A | 7/1980 | Ewing et al. |
| 4,226,859 A | 10/1980 | Stach |
| 4,369,172 A | 1/1983 | Schor et al. |
| 4,379,454 A | 4/1983 | Campbell et al. |
| 4,452,775 A | 6/1984 | Kent |
| 4,588,585 A | 5/1986 | Mark et al. |
| 4,603,112 A | 7/1986 | Paoletti et al. |
| 4,656,127 A | 4/1987 | Mundy |
| 4,675,189 A | 6/1987 | Kent et al. |

(Continued)

FOREIGN PATENT DOCUMENTS

| | | |
|---|---|---|
| EP | 2390363 A1 | 11/2011 |
| EP | 2569633 A2 | 3/2013 |

(Continued)

OTHER PUBLICATIONS

Pietras et al (2006, 11:704-717).*

(Continued)

*Primary Examiner* — Laura B Goddard
(74) *Attorney, Agent, or Firm* — Foley Hoag LLP

(57) ABSTRACT

Disclosed herein in one aspect is a pharmaceutical composition comprising a plurality of neoantigenic peptides and a pharmaceutically acceptable carrier, each neoantigenic peptide comprising a tumor-specific neoepitope capable of binding to an HLA protein in a subject, each tumor-specific neoepitope comprising a tumor-specific mutation present in a tumor, wherein (a) the composition comprises neoantigenic peptides comprising tumor-specific mutations present in at least 1% of subjects in a population of subjects suffering from cancer; (b) the composition comprises neoantigenic peptides comprising tumor-specific neoepitopes which bind to HLA proteins present in at least 5% of subjects in the population; and (c) the composition comprises at least one neoantigenic peptide capable of eliciting an immune response against a tumor present in at least 5% of the subjects in the population of subjects suffering from cancer.

35 Claims, No Drawings
Specification includes a Sequence Listing.

(56) References Cited

U.S. PATENT DOCUMENTS

| | | |
|---|---|---|
| 4,683,195 A | 7/1987 | Mullis et al. |
| 4,683,202 A | 7/1987 | Mullis |
| 4,690,915 A | 9/1987 | Rosenberg |
| 4,722,848 A | 2/1988 | Paoletti et al. |
| 4,743,249 A | 5/1988 | Loveland |
| 4,751,180 A | 6/1988 | Cousens et al. |
| 4,769,330 A | 9/1988 | Paoletti et al. |
| 4,816,540 A | 3/1989 | Onishi |
| 4,842,866 A | 6/1989 | Horder et al. |
| 4,844,893 A | 7/1989 | Honsik et al. |
| 4,906,169 A | 3/1990 | Chien et al. |
| 4,935,233 A | 6/1990 | Bell et al. |
| 4,973,468 A | 11/1990 | Chiang et al. |
| 5,023,084 A | 6/1991 | Chien et al. |
| 5,035,891 A | 7/1991 | Runkel et al. |
| 5,110,587 A | 5/1992 | Paoletti et al. |
| 5,133,974 A | 7/1992 | Paradissis et al. |
| 5,174,993 A | 12/1992 | Paoletti |
| 5,185,146 A | 2/1993 | Altenburger |
| 5,198,223 A | 3/1993 | Gale et al. |
| 5,204,253 A | 4/1993 | Sanford et al. |
| 5,217,720 A | 6/1993 | Sekigawa et al. |
| 5,279,833 A | 1/1994 | Rose |
| 5,364,773 A | 11/1994 | Paoletti et al. |
| 5,407,686 A | 4/1995 | Patel et al. |
| 5,422,119 A | 6/1995 | Casper |
| 5,494,807 A | 2/1996 | Paoletti et al. |
| 5,541,171 A | 7/1996 | Rhodes et al. |
| 5,580,859 A | 12/1996 | Felgner et al. |
| 5,589,466 A | 12/1996 | Felgner et al. |
| 5,658,785 A | 8/1997 | Johnson |
| 5,686,281 A | 11/1997 | Roberts |
| 5,705,190 A | 1/1998 | Broad et al. |
| 5,736,152 A | 4/1998 | Dunn |
| 5,756,101 A | 5/1998 | Paoletti et al. |
| 5,762,938 A | 6/1998 | Paoletti et al. |
| 5,766,597 A | 6/1998 | Paoletti et al. |
| 5,766,882 A | 6/1998 | Falkner et al. |
| 5,770,212 A | 6/1998 | Falkner et al. |
| 5,811,104 A | 9/1998 | Dale et al. |
| 5,833,975 A | 11/1998 | Paoletti et al. |
| 5,843,728 A | 12/1998 | Seed et al. |
| 5,849,303 A | 12/1998 | Wasmoen et al. |
| 5,849,589 A | 12/1998 | Tedder et al. |
| 5,851,828 A | 12/1998 | Seed et al. |
| 5,858,358 A | 1/1999 | June et al. |
| 5,883,223 A | 3/1999 | Gray |
| 5,906,936 A | 5/1999 | Eshhar et al. |
| 5,912,170 A | 6/1999 | Seed et al. |
| 5,912,172 A | 6/1999 | Eshhar et al. |
| 5,942,235 A | 8/1999 | Paoletti |
| 5,989,562 A | 11/1999 | Wasmoen et al. |
| 5,990,091 A | 11/1999 | Tartaglia et al. |
| 5,994,136 A | 11/1999 | Naldini et al. |
| 6,004,777 A | 12/1999 | Tartaglia et al. |
| 6,004,811 A | 12/1999 | Seed et al. |
| 6,013,516 A | 1/2000 | Verma et al. |
| 6,090,393 A | 7/2000 | Fischer |
| 6,130,066 A | 10/2000 | Tartaglia et al. |
| 6,156,567 A | 12/2000 | Fischer |
| 6,159,477 A | 12/2000 | Audonnet et al. |
| 6,165,782 A | 12/2000 | Naldini et al. |
| 6,214,353 B1 | 4/2001 | Paoletti et al. |
| 6,228,846 B1 | 5/2001 | Audonnet et al. |
| 6,258,595 B1 | 7/2001 | Gao et al. |
| 6,265,189 B1 | 7/2001 | Paoletti et al. |
| 6,277,558 B1 | 8/2001 | Hudson |
| 6,284,240 B1 | 9/2001 | Seed et al. |
| 6,309,647 B1 | 10/2001 | Paoletti et al. |
| 6,312,682 B1 | 11/2001 | Kingsman et al. |
| 6,352,694 B1 | 3/2002 | June et al. |
| 6,392,013 B1 | 5/2002 | Seed et al. |
| 6,406,705 B1 | 6/2002 | Davis et al. |
| 6,410,014 B1 | 6/2002 | Seed et al. |
| 6,428,953 B1 | 8/2002 | Naldini et al. |
| 6,475,769 B1 | 11/2002 | Wilson et al. |
| 6,489,458 B2 | 12/2002 | Hackett et al. |
| 6,534,055 B1 | 3/2003 | June et al. |
| 6,537,540 B1 | 3/2003 | Burstein et al. |
| 6,537,594 B1 | 3/2003 | Paoletti et al. |
| 6,569,457 B2 | 5/2003 | Ullah et al. |
| 6,638,534 B1 | 10/2003 | Ishibashi et al. |
| 6,682,743 B2 | 1/2004 | Mayr |
| 6,713,068 B1 | 3/2004 | Audonnet et al. |
| 6,753,162 B1 | 6/2004 | Seed et al. |
| 6,761,893 B2 | 7/2004 | Chaplin et al. |
| 6,780,407 B1 | 8/2004 | Paoletti et al. |
| 6,780,417 B2 | 8/2004 | Kaslow et al. |
| 6,793,926 B1 | 9/2004 | Rasty et al. |
| 6,797,514 B2 | 9/2004 | Berenson et al. |
| 6,821,515 B1 | 11/2004 | Cleland et al. |
| 6,867,041 B2 | 3/2005 | Berenson et al. |
| 6,869,794 B2 | 3/2005 | Vogels et al. |
| 6,887,466 B2 | 5/2005 | June et al. |
| 6,893,865 B1 | 5/2005 | Lockert et al. |
| 6,905,680 B2 | 6/2005 | June et al. |
| 6,905,681 B1 | 6/2005 | June et al. |
| 6,905,874 B2 | 6/2005 | Berenson et al. |
| 6,913,752 B2 | 7/2005 | Chaplin et al. |
| 6,913,922 B1 | 7/2005 | Bout et al. |
| 6,923,973 B1 | 8/2005 | Cox et al. |
| 6,924,128 B2 | 8/2005 | Allen |
| 6,936,466 B2 | 8/2005 | Feldhaus |
| 6,943,019 B2 | 9/2005 | Wilson et al. |
| 6,953,690 B1 | 10/2005 | Gao et al. |
| 6,955,808 B2 | 10/2005 | Curiel |
| 6,974,695 B2 | 12/2005 | Vogels et al. |
| 6,991,797 B2 | 1/2006 | Andersen et al. |
| 7,029,848 B2 | 4/2006 | Vogels et al. |
| 7,045,313 B1 | 5/2006 | Moss et al. |
| 7,097,842 B2 | 8/2006 | Suter et al. |
| 7,115,391 B1 | 10/2006 | Chen et al. |
| 7,144,575 B2 | 12/2006 | June et al. |
| 7,148,203 B2 | 12/2006 | Hackett et al. |
| 7,160,682 B2 | 1/2007 | Hackett et al. |
| 7,172,893 B2 | 2/2007 | Rabinowitz et al. |
| 7,175,843 B2 | 2/2007 | June et al. |
| 7,189,536 B2 | 3/2007 | Chaplin et al. |
| 7,198,784 B2 | 4/2007 | Kingsman et al. |
| 7,232,566 B2 | 6/2007 | June et al. |
| 7,255,862 B1 | 8/2007 | Tartaglia et al. |
| 7,259,015 B2 | 8/2007 | Kingsman et al. |
| 7,283,337 B2 | 10/2007 | Sakai et al. |
| 7,303,910 B2 | 12/2007 | Bebbington et al. |
| 7,335,364 B2 | 2/2008 | Chaplin et al. |
| 7,351,585 B2 | 4/2008 | Mitrophanous et al. |
| 7,384,644 B2 | 6/2008 | Chaplin et al. |
| 7,445,924 B2 | 11/2008 | Chaplin et al. |
| 7,459,270 B2 | 12/2008 | Chaplin et al. |
| 7,572,631 B2 | 8/2009 | Berenson et al. |
| 7,608,279 B2 | 10/2009 | Parisot et al. |
| 7,628,980 B2 | 12/2009 | Suter et al. |
| 7,705,120 B2 * | 4/2010 | Lillie .................. C12Q 1/6886 530/350 |
| 7,708,949 B2 | 5/2010 | Stone et al. |
| 7,741,465 B1 | 6/2010 | Eshhar et al. |
| 7,767,449 B1 | 8/2010 | Paoletti |
| 7,892,533 B2 | 2/2011 | Suter et al. |
| 7,897,156 B2 | 3/2011 | Ackermann et al. |
| 7,923,017 B2 | 4/2011 | Chaplin et al. |
| 7,939,086 B2 | 5/2011 | Chaplin et al. |
| 7,964,395 B2 | 6/2011 | Chaplin et al. |
| 7,964,396 B2 | 6/2011 | Chaplin et al. |
| 7,964,398 B2 | 6/2011 | Chaplin et al. |
| 7,985,739 B2 | 7/2011 | Kay et al. |
| 8,034,334 B2 | 10/2011 | Dudley et al. |
| 8,088,379 B2 | 1/2012 | Robbins et al. |
| 8,163,293 B2 | 4/2012 | Chaplin |
| 8,211,422 B2 | 7/2012 | Eshhar et al. |
| 8,227,432 B2 | 7/2012 | Hackett et al. |
| 8,236,560 B2 | 8/2012 | Chaplin et al. |
| 8,268,325 B2 | 9/2012 | Chaplin et al. |
| 8,268,329 B2 | 9/2012 | Chaplin et al. |
| 8,278,036 B2 | 10/2012 | Kariko et al. |

(56) References Cited

U.S. PATENT DOCUMENTS

| | | |
|---|---|---|
| 8,309,098 B2 | 11/2012 | Howley et al. |
| 8,372,622 B2 | 2/2013 | Suter et al. |
| 8,399,645 B2 | 3/2013 | Campana et al. |
| 8,404,658 B2 | 3/2013 | Hajjar et al. |
| 8,454,972 B2 | 6/2013 | Nabel et al. |
| 8,470,598 B2 | 6/2013 | Chaplin et al. |
| 8,697,854 B2 | 4/2014 | Schendel et al. |
| 8,796,414 B2 | 8/2014 | Johnston |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,115,402 B2 | 8/2015 | Hacohen et al. |
| 9,909,159 B2 | 3/2018 | Marras et al. |
| 10,426,824 B1 | 10/2019 | Hacohen et al. |
| 2003/0104008 A1 | 6/2003 | Loosmore et al. |
| 2004/0013648 A1 | 1/2004 | Kingsman et al. |
| 2004/0053304 A1 | 3/2004 | Markowitz |
| 2006/0008468 A1 | 1/2006 | Chiang et al. |
| 2006/0163385 A1 | 7/2006 | Link et al. |
| 2006/0252077 A1 | 11/2006 | Buzby |
| 2006/0258607 A1 | 11/2006 | Jarosch et al. |
| 2007/0003442 A1 | 1/2007 | Link et al. |
| 2007/0025970 A1 | 2/2007 | Kingsman et al. |
| 2007/0055049 A1 | 3/2007 | Grey et al. |
| 2007/0083334 A1* | 4/2007 | Mintz .................... G16B 40/00 702/19 |
| 2007/0134197 A1 | 6/2007 | Eichner et al. |
| 2007/0184489 A1 | 8/2007 | Griffiths et al. |
| 2007/0195127 A1 | 8/2007 | Ahn et al. |
| 2008/0003142 A1 | 1/2008 | Link et al. |
| 2008/0014222 A1 | 1/2008 | Simmons et al. |
| 2008/0014589 A1 | 1/2008 | Link et al. |
| 2008/0254008 A1 | 10/2008 | Dropulic et al. |
| 2009/0005254 A1 | 1/2009 | Griffiths et al. |
| 2009/0026082 A1 | 1/2009 | Rothberg et al. |
| 2009/0111106 A1 | 4/2009 | Mitrophanous et al. |
| 2009/0131543 A1 | 5/2009 | Weitz et al. |
| 2009/0136494 A1 | 5/2009 | Ponath et al. |
| 2009/0186042 A1 | 7/2009 | Johnston et al. |
| 2009/0220980 A1 | 9/2009 | Hoon et al. |
| 2010/0137143 A1 | 6/2010 | Rothberg et al. |
| 2010/0137163 A1 | 6/2010 | Link et al. |
| 2010/0158951 A1 | 6/2010 | Randolph et al. |
| 2010/0210529 A1 | 8/2010 | van der Burg et al. |
| 2010/0282617 A1 | 11/2010 | Rothberg et al. |
| 2010/0297071 A1 | 11/2010 | Ishibashi et al. |
| 2010/0304989 A1 | 12/2010 | Von Hoff et al. |
| 2011/0097312 A1 | 4/2011 | Molldrem |
| 2011/0257890 A1 | 10/2011 | Weinschenk et al. |
| 2011/0293571 A1 | 12/2011 | Widdowson et al. |
| 2011/0293637 A1* | 12/2011 | Hacohen ................. A61P 35/00 424/173.1 |
| 2012/0082691 A1 | 4/2012 | Rammensee et al. |
| 2012/0219947 A1 | 8/2012 | Yurkovetsky et al. |
| 2012/0244133 A1 | 9/2012 | Rosenberg et al. |
| 2012/0288539 A1 | 11/2012 | Eber |
| 2012/0295960 A1 | 11/2012 | Palfi et al. |
| 2013/0071414 A1 | 3/2013 | Dotti et al. |
| 2013/0210014 A1 | 8/2013 | Sharman |
| 2013/0295110 A1 | 11/2013 | Binder et al. |
| 2014/0056986 A1 | 2/2014 | Desai et al. |
| 2014/0178438 A1 | 6/2014 | Sahin et al. |
| 2014/0256595 A1 | 9/2014 | Link et al. |
| 2014/0322716 A1 | 10/2014 | Robins |
| 2015/0140041 A1 | 5/2015 | Vitiello |
| 2015/0224182 A1 | 8/2015 | Hunt et al. |
| 2016/0008447 A1 | 1/2016 | Hacohen et al. |
| 2016/0101170 A1 | 4/2016 | Hacohen et al. |
| 2016/0310584 A1 | 10/2016 | Fritsch et al. |
| 2016/0326593 A1 | 11/2016 | Clement et al. |
| 2016/0331822 A1 | 11/2016 | Hacohen et al. |
| 2016/0339090 A1 | 11/2016 | Hacohen et al. |
| 2017/0160269 A1 | 6/2017 | Linnemann et al. |
| 2017/0233821 A1 | 8/2017 | Lianidou et al. |
| 2017/0298441 A1 | 10/2017 | Wu et al. |
| 2018/0000913 A1 | 1/2018 | Hacohen et al. |
| 2018/0055922 A1 | 3/2018 | Hacohen et al. |
| 2018/0127803 A1 | 5/2018 | Lei et al. |
| 2018/0153975 A1 | 6/2018 | Fritsch et al. |
| 2019/0060428 A1 | 2/2019 | Fritsch |
| 2019/0060432 A1 | 2/2019 | Hacohen et al. |
| 2019/0099475 A1* | 4/2019 | Benz .................... C07K 16/30 |

FOREIGN PATENT DOCUMENTS

| | | |
|---|---|---|
| EP | 2574346 A1 | 4/2013 |
| FR | 2650840 A1 | 2/1991 |
| JP | 2003/517274 A | 5/2003 |
| JP | 2003/523365 A | 8/2003 |
| JP | 2003/535024 A | 11/2003 |
| JP | 2005/505271 A | 2/2005 |
| JP | 2005/529187 A | 9/2005 |
| JP | 2006/526628 A | 11/2006 |
| JP | 2009/532664 A | 9/2009 |
| JP | 2012/522500 A | 9/2012 |
| JP | 2013/530943 A | 8/2013 |
| WO | WO-2014/184744 A1 | 0/0000 |
| WO | WO-9102087 A1 | 2/1991 |
| WO | WO-9106309 A1 | 5/1991 |
| WO | WO-92/15672 A1 | 9/1992 |
| WO | WO-9215322 A1 | 9/1992 |
| WO | WO-9215712 A1 | 9/1992 |
| WO | WO-9324640 A2 | 12/1993 |
| WO | WO-95/27780 A1 | 10/1995 |
| WO | WO-95/30018 A2 | 11/1995 |
| WO | WO-96/18372 A2 | 6/1996 |
| WO | WO-00/20587 A2 | 4/2000 |
| WO | WO-00/66153 A1 | 11/2000 |
| WO | WO-2001/89788 A2 | 11/2001 |
| WO | WO-2003020763 A2 | 3/2003 |
| WO | WO-2003/057171 A2 | 7/2003 |
| WO | WO-03/086459 A1 | 10/2003 |
| WO | WO-03/106692 A2 | 12/2003 |
| WO | WO-2004/002627 A2 | 1/2004 |
| WO | WO-2004026897 A1 | 4/2004 |
| WO | WO2004030615 * | 4/2004 |
| WO | WO-2004033685 A1 | 4/2004 |
| WO | WO-2004044004 A2 | 5/2004 |
| WO | WO-2004/058801 A2 | 7/2004 |
| WO | WO-2004074322 A1 | 9/2004 |
| WO | WO-2004/091763 A2 | 10/2004 |
| WO | WO-2005/021151 A2 | 3/2005 |
| WO | WO-2005087261 A2 | 9/2005 |
| WO | WO-2005/113595 A2 | 12/2005 |
| WO | WO-2005114215 A2 | 12/2005 |
| WO | WO-2006000830 A2 | 1/2006 |
| WO | WO-2006/040551 A2 | 4/2006 |
| WO | WO-2006/040554 A1 | 4/2006 |
| WO | WO-2006/096571 A2 | 9/2006 |
| WO | WO-2006/121168 A1 | 11/2006 |
| WO | WO-2006125962 A2 | 11/2006 |
| WO | WO-2007015540 A1 | 2/2007 |
| WO | WO-2007/059033 A1 | 5/2007 |
| WO | WO-2007/089541 A2 | 8/2007 |
| WO | WO-2007/095033 A2 | 8/2007 |
| WO | WO-2007/101227 A2 | 9/2007 |
| WO | WO-2007/124090 A2 | 11/2007 |
| WO | WO-2007/133710 A2 | 11/2007 |
| WO | WO-2008/011344 A2 | 1/2008 |
| WO | WO-2008038002 A2 | 4/2008 |
| WO | WO-2008039818 A2 | 4/2008 |
| WO | WO-2008/063227 A2 | 5/2008 |
| WO | WO-2008/096831 A1 | 8/2008 |
| WO | WO-2008/109075 A2 | 9/2008 |
| WO | WO-2009/014708 A1 | 1/2009 |
| WO | WO-2009032477 A2 | 3/2009 |
| WO | WO-2009043520 A1 | 4/2009 |
| WO | WO-2009/126306 A2 | 10/2009 |
| WO | WO-2010033949 A1 | 3/2010 |
| WO | WO-2010/045345 A2 | 4/2010 |

(56) References Cited

FOREIGN PATENT DOCUMENTS

| | | |
|---|---|---|
| WO | WO-2011/051489 A2 | 5/2011 |
| WO | WO-2011/079176 A2 | 6/2011 |
| WO | WO-2011/143656 A2 | 11/2011 |
| WO | WO-2011134944 A2 | 11/2011 |
| WO | WO-2011146862 A1 | 11/2011 |
| WO | WO-2012027379 A2 | 3/2012 |
| WO | WO-2012/079000 A1 | 6/2012 |
| WO | WO-2012/095639 A2 | 7/2012 |
| WO | WO-2012/101112 A1 | 8/2012 |
| WO | WO-2012/159643 A1 | 11/2012 |
| WO | WO-2012/159754 A2 | 11/2012 |
| WO | WO-2013/026027 A1 | 2/2013 |
| WO | WO-2013/036201 A1 | 3/2013 |
| WO | WO-2013039889 A1 | 3/2013 |
| WO | WO-2013040371 A2 | 3/2013 |
| WO | WO-2013/086464 A1 | 6/2013 |
| WO | WO-2013/123031 A2 | 8/2013 |
| WO | WO-2013133405 A1 | 9/2013 |
| WO | WO-2013/173223 A1 | 11/2013 |
| WO | WO-2013166321 A1 | 11/2013 |
| WO | WO-2013176915 A1 | 11/2013 |
| WO | WO-2014/009535 A2 | 1/2014 |
| WO | WO-2014/012051 A1 | 1/2014 |
| WO | WO-2014011987 A1 | 1/2014 |
| WO | WO-2014018863 A1 | 1/2014 |
| WO | WO-2014047561 A1 | 3/2014 |
| WO | WO-2014/056986 A1 | 4/2014 |
| WO | WO-2014/059173 A2 | 4/2014 |
| WO | WO-2014/083173 A1 | 6/2014 |
| WO | WO-2014085802 A1 | 6/2014 |
| WO | WO-2014/133567 A1 | 9/2014 |
| WO | WO-2014/133568 A1 | 9/2014 |
| WO | WO-2014/150924 A2 | 9/2014 |
| WO | WO-2014134165 A1 | 9/2014 |
| WO | WO-2014/168874 A2 | 10/2014 |
| WO | WO-2014172606 A1 | 10/2014 |
| WO | 2014/197369 A1 | 12/2014 |
| WO | WO-2014191128 A1 | 12/2014 |
| WO | WO-2015/085233 A1 | 6/2015 |
| WO | WO-2015/095811 A2 | 6/2015 |
| WO | WO-2016/020710 A1 | 2/2016 |
| WO | WO-2016/100975 A1 | 6/2016 |
| WO | WO-2016/201049 A2 | 12/2016 |
| WO | WO-2017/173321 A1 | 10/2017 |
| WO | WO-2017/184590 A1 | 10/2017 |
| WO | WO-2018/140391 A1 | 8/2018 |

OTHER PUBLICATIONS

Song et al (2013, Cellular & Molecular Immunology, 10:490-496).*
IEDB Analysis Resource for MHC-I binding predictions (printed Oct. 2019).*
IEDB Analysis Resource for MHC-II binding predictions (printed Oct. 2019).*
McCleskey et al (American J Clinical Pathology, 2015, 144:756-763; published Jan. 11, 2015).*
Jiang et al (Cancer, 2014, 120:1329-1337).*
Alvarez, "Present and future evolution of advanced breast cancer therapy," Breast Cancer Research, 12(Suppl 2):S1 (2010).
Backert et al., "Immunoinformatics and epitope prediction in the age of genomic medicine," Genome Medicine, 7:119 (2015).
Behrends et al., "Network organization of the human autophagy system," Nature, 466(7302):68-76 (2010).
Berg et al., "Detection of artifacts and peptide modifications in liquid chromatography/mass spectrometry data using two-dimensional signal intensity map data visualization," Rapid Commun Mass Spectrom, 20(10):1558-1562 (2006).
Boen et al., "Identification of T Cell Ligands in a Library of Peptides Covalently Attached to HLA-DR4," J Immunol, 165:2040-2047 (2000).
Boon et al., "Human T Cell Responses Against Melanoma," Annu Rev Immunol, 24: 175-208 (2006).

Carreno et al., "A dendritic cell vaccine increases the breadth and diversity of melanoma neoantigen-specific T cells," Science, 348(6239):803-808 (2015).
Chen et al., Molecular Pharmaceutics, 3:109-111 (2010).
Declaration by Professor John Haanen, M.D., Ph.D.
Di Stasi et al., "Inducible apoptosis as a safety switch for adoptive cell therapy," New England Journal of Medicine, 365(18):1673-1683 (2011).
Dössinger et al., "MHC multimer-guided and cell culture-independent isolation of functional T cell receptors from single cells facilitates TCR identification for immunotherapy," PloS one, 8(4):e61384 (2013).
Extracts from the USPTO patent register.
Final Rejection for U.S. Appl. No. 13/108,610, "Compositions and Methods of Identifying Tumor Specific Neoantigens," dated May 12, 2014.
Final Rejection for U.S. Appl. No. 14/794,449, "Compositions and Methods of Identifying Tumor Specific Neoantigens," dated Sep. 13, 2017.
Final Rejection for U.S. Appl. No. 14/877,125, "Compositions and Methods for Personalized Neoplasia Vaccines," dated Oct. 25, 2017.
Final Rejection for U.S. Appl. No. 15/038,504, "Compositions and Methods for Diagnosing, Evaluating and Treating Cancer by Means of the DNA Methyl," dated Apr. 30, 2018.
Final Rejection for U.S. Appl. No. 15/038,504, "Compositions and Methods for Diagnosing, Evaluating and Treating Cancer by Means of the DNA Methyl," dated Dec. 21, 2018.
Final Rejection for U.S. Appl. No. 15/102,129, "Formulations for Neoplasia Vaccines," dated Sep. 14, 2018.
Final Rejection for U.S. Appl. No. 15/105,961, "Combination Therapy With Neoantigen Vaccine," dated Jul. 5, 2018.
Final Rejection for U.S. Appl. No. 15/187,174, "Compositions and Methods of Identifying Tumor Specific Neoantigens," dated May 25, 2017.
Final Rejection for U.S. Appl. No. 15/187,174, "Compositions and Methods of Identifying Tumor Specific Neoantigens," dated Oct. 12, 2018.
Friedberg et al., "Inhibition of Syk with fostamatinib disodium has significant clinical activity in non-Hodgkin lymphoma and chronic lymphocytic leukemia," Blood, 115:2578-2585 (2011).
Gazdar, "Activating and resistance mutations of EGFR in non-small-cell lung cancer: role in clinical response to EGFR tyrosine kinase inhibitors," Oncogene, 28:S24-S31 (2009).
Han et al., "Linking T-Cell Receptor Sequence to Fucntional Phenotype at the Single-Cell Level," Nat Biotechnol, 32:684-692 (2014).
Hombrink et al., "Identification of Biological Relevant Minor Histocompatibility Antigens within the B-lymphocyte-Derived HLA-Ligandome Using a Reverse Immunology Approach," Clin Cancer Res, 21(9):2177-2186 (2015).
Illumina, "Immunotherapy, the Next Generation of Cancer Treatment, NGS-guided assessment of interactions between tumors and the immune system leads to new discoveries in immuno-oncology," (2016).
Jarmalavicius et al., "High Immunogenicity of the Human Leukocyte Antigen Peptidomes of Melanoma Tumor Cells," J Biol Chem, 287(40):33401-33411 (2012).
Johnson et al., "Discovery of Naturally Processed and HLA-Presented Class I Peptides from Vaccinia Virus Infection using Mass Spectrometry for Vaccine Development," Vaccine, 28(1):38-47 (2009).
Kalaora et al., "Use of HLA peptidomics and whole exome sequencing to identify human immunogenic neo-antigens," Oncotarget, 7(5):5110-5117 (2016).
Kandoth et al., "Mutational landscape and significance across 12 major cancer types," Nature, 502:333-339 (2013).
Keskin et al., "Neoantigen vaccine generates intratumoral T cell responses in phase lb glioblastoma trial," Nature, 565(7738):234-239 (2019).
Kim et al., "mTOR inhibitors radiosensitize PTEN-deficient non-small-cell lung cancer cells harboring an EGFR activating mutation by inducing autophagy," J Cell Biochem, 114(6):1248-1256 (2013).

(56) References Cited

OTHER PUBLICATIONS

Kim et al., "Positional Bias of MHC Class I Restricted T-Cell Epitopes in Viral Antigens Is Likely due to a Bias in Conservation," PLoS Comput Biol, 9:el002884 (2013).
Klug et al., "Characterization of MHC Ligands for Peptide Based Tumor Vaccination," Current Pharmaceutical Design, 15(28): 3221-3236 (2009).
Lata et al., "MHCBN 4.0: A database of MHC/TAP binding peptides and T-cell epitopes," BMC Research Notes, 2(1): 61 (2009).
Linardou et al., "Assessment of somatic k-RAS mutations as a mechanism associated with resistance to EGFR-targeted agents: a systematic review and meta-analysis of studies in advanced non-small-cell lung cancer and metastatic colorectal cancer," Lancet Oncol, 9(10):962-972 (2008).
Linardou et al., "Somatic EGFR mutations and efficacy of tyrosine kinase inhibitors in NSCLC," Nat Rev Clin Oncol, 6(6):352-366 (2009).
Lucas et al., "About human tumor antigens to be used in immunotherapy," Semin Immunol, 20(5):301-307 (2008).
Luo et al. "Machine learning methods for Predicting hla—Peptide Binding activity," Bioinformatics and Biology Insights, 9(s3):21-29 (2015).
Mosmann et al., "TH1 and TH2 Cells: Different Patterns of Lymphokine Secretion Lead to Different Functional Properties," Ann Rev Immunol, 7:145-173 (1989).
Nielsen et al., "NetMHCpan-3.0; improved prediction of binding to MHC class I molecules integrating information from multiple receptor and peptide length datasets," Genome Medicine, 8:33 (2016).
Non-Final Office Action for U.S. Appl. No. 13/108,610, "Compositions and Methods of Identifying Tumor Specific Neoantigens," dated Aug. 15, 2013.
Non-Final Office Action for U.S. Appl. No. 13/108,610, "Compositions and Methods of Identifying Tumor Specific Neoantigens," dated Dec. 3, 2014.
Non-Final Office Action for U.S. Appl. No. 14/794,449, "Compositions and Methods of Identifying Tumor Specific Neoantigens," dated Dec. 29, 2016.
Non-Final Office Action for U.S. Appl. No. 14/794,449, "Compositions and Methods of Identifying Tumor Specific Neoantigens," dated Jul., 24, 2018.
Non-Final Office Action for U.S. Appl. No. 14/877,125, "Compositions and Methods for Personalized Neoplasia Vaccines," dated Mar. 27, 2017.
Non-Final Office Action for U.S. Appl. No. 14/877,125, "Compositions and Methods for Personalized Neoplasia Vaccines," dated Nov. 2, 2018.
Non-Final Office Action for U.S. Appl. No. 15/038,504, "Compositions and Methods for Diagnosing, Evaluating and Treating Cancer by Means of the DNA Methyl," dated Sep. 6, 2017.
Non-Final Office Action for U.S. Appl. No. 15/102,129, "Formulations for Neoplasia Vaccines," dated Dec. 17, 2018.
Non-Final Office Action for U.S. Appl. No. 15/102,129, "Formulations for Neoplasia Vaccines," dated Jul. 28, 2017.
Non-Final Office Action for U.S. Appl. No. 15/102,129, "Formulations for Neoplasia Vaccines," dated Mar. 7, 2018.
Non-Final Office Action for U.S. Appl. No. 15/105,961, "Combination Therapy With Neoantigen Vaccine," dated Jan. 8, 2019.
Non-Final Office Action for U.S. Appl. No. 15/105,961, "Combination Therapy With Neoantigen Vaccine," dated Nov. 20, 2017.
Non-Final Office Action for U.S. Appl. No. 15/187,174, "Compositions and Methods of Identifying Tumor Specific Neoantigens," dated Dec. 5, 2016.
Non-Final Office Action for U.S. Appl. No. 15/187,174, "Compositions and Methods of Identifying Tumor Specific Neoantigens," dated Jan. 22, 2018.
Non-Final Office Action for U.S. Appl. No. 15/513,127, "Use of Clonal Evolution Analysis for Ibrutinib Resistance in Chronic Lymphocytic Leukemia Patients," dated Nov. 26, 2018.
Non-Final Office Action for U.S. Appl. No. 15/537,785, "Methods for Profiling the T Cell Repertoire," dated Dec. 21, 2018.
Non-Final Office Action for U.S. Appl. No. 16/181,098, "Compositions and Methods of Identifying Tumor Specific Neoantigens," dated Jan. 31, 2019.
Notice of Allowance for U.S. Appl. No. 13/108,610, "Compositions and Methods of Identifying Tumor Specific Neoantigens," dated Jun. 11, 2015.
Notice of Allowance for U.S. Appl. No. 13/108,610, "Compositions and Methods of Identifying Tumor Specific Neoantigens," dated May 12, 2015.
Notice of Allowance for U.S. Appl. No. 15/102,129, "Formulations for Neoplasia Vaccines," dated Oct. 12, 2018.
Assignment Register extract (accessed Oct. 20, 2016).
Prints-outs from the UniProtKB database concerning the CEP170, PARVA and FLT3 genes.
Restriction Requirement for U.S. Appl. No. 13/108,610, "Compositions and Methods of Identifying Tumor Specific Neoantigens," dated Mar. 7, 2013.
Restriction Requirement for U.S. Appl. No. 14/794,449, "Compositions and Methods of Identifying Tumor Specific Neoantigens," dated Oct. 26, 2016.
Restriction Requirement for U.S. Appl. No. 14/877,125, "Compositions and Methods for Personalized Neoplasia Vaccines," dated Nov. 18, 2016.
Restriction Requirement for U.S. Appl. No. 15/038,504, "Compositions and Methods for Diagnosing, Evaluating and Treating Cancer by Means of the DNA Methyl," dated Jun. 22, 2017.
Restriction Requirement for U.S. Appl. No. 15/102,129, "Formulations for Neoplasia Vaccines," dated May 8, 2017.
Restriction Requirement for U.S. Appl. No. 15/105,961, "Combination Therapy With Neoantigen Vaccine," dated Jul. 13, 2017.
Restriction Requirement for U.S. Appl. No. 15/187,174, "Compositions and Methods of Identifying Tumor Specific Neoantigens," dated Sep. 9, 2016.
Restriction Requirement for U.S. Appl. No. 15/513,127, "Use of Clonal Evolution Analysis for Ibrutinib Resistance in Chronic Lymphocytic Leukemia Patients," dated Aug. 13, 2018.
Restriction Requirement for U.S. Appl. No. 15/537,785, "Methods for Profiling the T Cell Repertoire," dated Mar. 22, 2018.
Restriction Requirement for U.S. Appl. No. 15/575,328, "Shared Neoantigens," dated Feb. 7, 2019.
Robinson et al., "DNA vaccines for viral infections: Basic studies and applications," Adv Virus Res, 55:1-74 (2000).
Rubin et al., "Mutation patterns in cancer genomes," PNAS, 106(51):21766-21770 (2009).
Sahin et al., "Personalized RNA mutanome vaccines mobilize poly-specific therapeutic immunity against cancer," Nature, 547(7662):222-226 (2017).
Srivastava et al., "Modeling the Repertoire of True Tumor-Specific MHC I Epitopes in a Human Tumor," PLoS One, 4(7):e6094 (2009).
Srivastava, "Therapeutic Cancer Vaccines," Curr Opin Immunol, 18: 201-205 (2006).
Stranzl et al., "NetCTLpan: pan-specific MHC class I pathway epitope predictions," Immunogenetics, 62(6):357-368 (2010).
Sun et al., Material bionics and Thinking Innovation, 176-177 (2012).
Tang et al., "NeoantigenR: An annotation based pipeline for tumor neoantigen identification from sequencing data," bioRxiv preprint first posted online Aug. 8, 2017.
Trolle et al., "Automated benchmarking of peptide-MHC class I binding predictions," Bioinformatics, 31(13):2174-2181 (2015).
Turchaninova et al., "Pairing of T-cell receptor chains via emulsion PCR," Eur J Immunol, 43:2507-2515 (2013).
Van Buuren et al., "High sensitivity of cancer exome-based CD8 T cell neo-antigen identification," Oncolmmunology, 3(5):e28836 (2014).
Vogel et al., "Mass Spectrometry Reveals Changes in MHC I Antigen Presentation After Lentivector Expression of a Gene Regulation System," Molecular Therapy—Nucleic Acids, 2:e75 (2013).
Wang et al., Functional Polymeric Material, 1-44 (2010).
Wraith, "The Future of Immunotherapy: A 20-Year Perspective," Front Immunol, 8:1668 (2017).

(56) References Cited

OTHER PUBLICATIONS

Zhang et al., "The impact of next-generation sequencing on genomics," J Genet Genomics, 38(3):95-109 (2011).
Zhang et al., Oncology, 1-44 (2005).
U.S. Appl. No. 16/188,737, filed Nov. 13, 2018, Pending.
U.S. Appl. No. 15/102,129, filed Jun. 6, 2016, 2016-0310584, Pending.
U.S. Appl. No. 15/537,839, filed Jun. 19, 2017, Pending.
U.S. Appl. No. 15/735,566, filed Dec. 11, 2017, Pending.
11781409.5 (opposition therin), May 16, 2011, 2569633, 2569633, Granted-opposition pending.
"CT-011 and p53 Genetic Vaccine for Advance Solid Tumor," National Library of Medicine, updated:Jun. 30, 2011, XP002738554, https://clinicaltrials.gov/archive/NCT01386502/2011_06_30, Clinical Trials Identifier NCT01386502.
"Monoclonal Antibody Therapy and Vaccine Therapy in Treating Patients with Stage IV Melanoma That Has Been Removed by Surgery," National Library of Medicine, 2010, XP002738553, https:clinicaltrials.gov/archive/NCT01176474/2010_08_05.
Acknowledgment of Receipt dated Jun. 28, 2017 for Response to Notices of Opposition of EP2569633.
Albert et al., "Direct Selection of Human Genomic Loci by Microarray Hybridization," Nat Methods, 4(11): 903-905 (2007).
Allison, "The Mode of Action of Immunological Adjuvants," Dev Biol Stand, 92: 3-11 (1998).
Alyea et al., "Toxicity and Efficacy of Defined Doses of CD4+ Donor Lymphocytes for Treatment of Relapse After Allogeneic Bone Marrow Transplant," Blood, 91(10):3671-3680 (1998).
Amara et al., "Control of a mucosal challenge and prevention of AIDS by a multiprotein DNA/MVA vaccine," Science, 292(5514):69-74 (2001).
Amato et al., "Vaccination of metastatic renal cancer patients with MVA-5T4: a randomized, double-blind, placebo-controlled phase III study," Clin Can Res, 16(22):5539-47 (2010).
Amato et al., "Vaccination of renal cell cancer patients with modified vaccinia ankara delivering tumor antigen 5T4 (TroVax) administered with interleukin 2: a phase II trial," Clin Cancer Res, 14(22):7504-10 (2008).
Anderson et al., "Next Generation DNA Sequencing and the Future of Genomic Medicine," Genes, 1:38-69 (2010).
Annunziata et al., "Frequent Engagement of the Classical and Alternative NF-KB Pathways by Diverse Genetic Abnormalities in Multiple Myeloma," Cancer Cell, 12(2):115-130 (2007).
Antoine et al., "The complete genomic sequence of the modified vaccinia Ankara strain: comparison with other orthopoxviruses," Virology, 244(2):365-96 (1998).
Antonis et al., "Vaccination with recombinant modified vaccinia virus Ankara expressing bovine respiratory syncytial virus (bRSV) proteins protects calves against RSV challenge," Vaccine, 25(25):4818-4827 (2007).
Applicant's Authorization and Release Form of the Massachusetts General Hospital, Aug. 12, 2008; and Supplemental Release to Applicant of the Partners Healthcare System, Aug. 13, 2008.
Attia et al., "Autoimmunity Correlates With Tumor Regression in Patients With Metastatic Melanoma Treated with Anti-Cytotoxic T-Lymphocyte Antigen-4," J Clin Oncol, 23.(25): 6043-6053 (2005).
Aucouturier et al., "Adjuvants designed for veterinary and human vaccines," Vaccine, 19(17-19):2666-2672 (2001).
Austen et al., "Mutations in the ATM Gene Lead to Impaired Overall and Treatment-Free Survival that is Independent of IGVH Mutation Status in Patients with B-CLL," Blood, 106(9):3175-3182 (2005).
Avogadri et al. "Modulation of CTLA-4 and GITR for Cancer Immunotherapy," Curr Top Microbiol Immunol, 344:211 (2011).
Azvolinsky et al., "PD-1 Inhibitor MK-3475 Again Shows Promise in Advanced Melanoma," Cancer Network, 2013. [Retrieved online] http://www.cancernetwork.com/melanoma/pd-1-inhibitor-mk-3475-again-shows-promise-advanced-melanoma.

Bachem et al., "Superior antigen cross-presentation and XCR1 expression define human CD11c+ CD141+ cells as homologues of mouse CD8+ dendritic cells," Journal of Experimental Medicine, 207(6):1273-1281 (2010).
Bachireddy et al., "Reversal of in situ T cell exhaustion during effective human anti-leukemia responses to donor lymphocyte infusion," Blood, 123(9):1412-1421 (2013).
Baden et al., "First-in-human evaluation of the safety and immunogenicity of a recombinant adenovirus serotype 26 FflV-1 Env vaccine (IPCAVD 001)," J Infect Dis, 207(2):240-247 (2012).
Balagaan et al., "Stable and efficient intraocular gene transfer using pseudotyped EIAV lentiviral vectors," J Gene Med, 8:275-285 (2005).
Balakrishnan et al, "Novel Somatic and Germline Mutations in Cancer Candidate Genes in Glioblastoma, Melanoma, and Pancreatic Carcinoma," Cancer Res, 67: 3545-3550 (2007).
Baskar et al., "Autologous Lymphoma Vaccines Induce Human T Cell Responses Against Multiple, Unique Epitopes," J Clin Invest, 113:1498-1510 (2004).
Baurain et al., "High Frequency of Autologous Anti-Melanoma CTL Directed Against an Antigen Generated by a Point Mutation in a New Helicase Gene," J Immunol, 164: 6057-6066 (2000).
Beck et al., "Enterocolitis in Patients With Cancer After Antibody Blockade of Cytotoxicity TLymphocyte-Associated Antigen 4," J Clin Oncol, 24(15): 2283-2289 (2006).
Bellucci et al., "Complete Response to Donor Lymphocyte Infusion in Multiple Myeloma is Associated with Antibody Responses to Highly Expressed Antigens," Blood, 103: 656-663 (2004).
Bentley et al., "Accurate Whole Human Genome Sequencing using Reversible Terminator Chemistry," Nature, 456(7218): 53-59 (2008).
Bettelli et al., "TH-17 cells in the circle of immunity and autoimmunity," Nat Immunol, 8:345-350 (2007).
Bhardwaj et al., "TLR AGONISTS: Are They Good Adjuvants?," Cancer J, 16:382-391 (2010).
Bisht et al., "Severe acute respiratory syndrome coronavirus spike protein expressed by attenuated vaccinia virus protectively immunizes mice," Proc Natl Acad Sci, 101:6641-46 (2004).
Blanchard et al., "Modified vaccinia virus Ankara undergoes limited replication in human cells and lacks several immunomodulatory proteins: implications for use as a human vaccine," Journal of General Virology, 79(5):1159-1167 (1998).
Boisguerin et al., "Translation of genomis-guided RNA-based personalised cancer vaccaines: towards the bedside," British J Cancer, 111:1469-1475 (2014).
Boni et al. "Adoptive transfer of allogeneic tumor-specific T cells mediates effective regression of large tumors across major histocompatibility barriers," Blood, 112(12):4746-4754 (2008).
Boon, "Toward a Genetic Analysis of Tumor Rejection Antigens," Adv Cancer Res, 58:177-210 (1992).
Bowerman et al., "Engineering the binding properties of the T cell receptor:peptide:MHC ternary complex that governs T cell activity," Mol Immunol, 46(15):3000-3008 (2009).
Brandle et al., "A Mutated HLA-A2 Molecule Recognized by Autologous Cytotoxic T Lymphocytes on a Human Renal Cell Carcinoma," J Exp Med, 183: 2501-2508 (1996).
Brinckerhoff et al., "Melanoma Vaccines," Curr Opin Oncol, 12:163-173 (2000).
Broad Institute Article, Jan. 29, 2009, "Turning Cancer's Strength Into Weakness," (2009).
Brochier et al., "Large-scale eradication of rabies using recombinant vaccinia-rabies vaccine," Nature, 354:520-552 (1991).
Brown et al., "Neo-antigens predicted by tumor genome meta-analysis correlate with increased patient survival," Genome Res, 24(5):743-750 (2014).
Brunsvig et al., "Telomerase Peptide Vaccination: A Phase I/II Study in Patients with Non-Small Cell Lung Cancer," Cancer Immunol Immunother, 55(12): 1553-1564 (2006).
Buchschacher et al., "Human immunodeficiency virus vectors for inducible expression of foreign genes." Journal of virology, 66(5):2731-2739 (1992).
Buckwalter et al., "'It is the antigen(s), stupid' and other lessons from over a decade of vaccitherapy of human cancer," Seminar in Immunology, 20(5):296-300 (2008).

(56) References Cited

OTHER PUBLICATIONS

Buller et al., "Decreased virulence of recombinant vaccinia virus expression vectors is associated with a thymidine kinase-negative phenotype," Nature, 317:813-815 (1985).
Buller et al., "Deletion of the vaccinia virus growth factor gene reduces virus virulence," Journal of virology, 62(3):866-874 (1988).
Burger et al., "Safety and activity of ibrutinib plus rituximab for patients with high-risk chronic lymphocytic leukaemia: a single-arm, phase 2 study," Lancet Oncology, 15(10):1090-1099 (2014).
Böhm et al., DNA vector constructs that prime hepatitis B surface antigen-specific cytotoxic T lymphocyte and antibody responses in mice after intramuscular injection. Journal of immunological methods 193(1): 29-40 (1996).
Cai et al., "Peptides Derived From Mutated BCR-ABL Elicit T Cell Immunity in CML Patients," Blood, 116(21): 388-388 (2010).
Carpten et al., "A transforming mutation in the pleckstrin homology domain of AKT1 in cancer," Nature, 448(26):439-444 (2004).
Carreno et al., "IL-12p70-producing patient DC vaccine elicits Tc1-polarized immunity," Journal of Clinical Investigation, 123(8):3383-94 (2013).
Carter et al., "Identification and validation of cell surface antigens for antibody targeting in oncology," Endocrine-Related Cancer, 11:659-687 (2004).
Caskey et al., "Synthetic double-stranded RNA induces innate immune responses similar to a live viral vaccine in humans," The Journal of experimental medicine, 208(12):2357-2366 (2011).
Certified Priority Document for U.S. Appl.n No. 61/334,866, filed May 14, 2010.
Chang et al., "Peptide length-based prediction of peptide-MHC class II binding," Bioinformatics, 22(22): 2761-2767 (2006).
Chatila, "The Regulatory T Cell Transcriptosome: E Pluribus Unum," Immunity, 27(5):693-695 (2007).
Chen et al., "Recombinant modified vaccinia virus Ankara expressing the spike glycoprotein of severe acute respiratory syndrome coronavirus induces protective neutralizing antibodies primarily targeting the receptor binding region," Journal of virology, 79.5:2678-2688 (2005).
Chen et al.,"Induction of CD8+ T cell responses to dominant and subdominant epitopes and protective immunity to Sendai virus infection by DNA vaccination," The Journal of Immunology, 160(5):2425-2432 (1998).
Chianese-Bullock et al., "Multi-peptide vaccines vialed as peptide mixtures can be stable reagents for use in peptide-based immune therapies," Vaccine, 27(11):1764-1770 (2009).
Chiari et al., "Two Antigens Recognized by Autologous Cytolytic T Lymphocytes on a Melanoma Result from a Single Point Mutation in an Essential Housekeeping Gene," Cancer Res, 59: 5785-5792 (1999).
Child et al., "Insertional inactivation of the large subunit of ribonucleotide reductase encoded by vaccinia virus is associated with reduced virulence in vivo," Virology, 174(2):625-629 (1990).
Chinese Office Action dated Jun. 12, 2017 in corresponding CN Application No. 2014800322910.
Chroboczek et al., "The Sequence of the Genome of Adenovirus Type 5 and Its Comparison with the Genome of Adenovirus Type 2," Virology, 186:280-285 (1992).
Ciofani et al., "A Validated Regulatory Network for Th17 Cell Specification," Cell, 151(2):289-303 (2012).
Clinical trial NCT 01970358, Patrick Ott, A Phase I Study With a Personalized NeoAntigen Cancer Vaccine in Melanoma, p. 1-6, Retrieved from https://clinicaltrials.gov/ct2/show/NCT01970358 downloaded Jun. 20, 2017.
Coffman et al., "Vaccine Adjuvants: Putting Innate Immunity to Work," Immunity 33:492-503 (2010).
Conlon et al., "Mouse, but not Human STING, Binds and Signals in Response to the Vascular Disrupting Agent 5,6-Dimethylxanthenone-4-Acetic Acid," Journal of Immunology, 190:5216-25 (2013).
Consolidated Table of Documents filed in Opposition to date in Response to Notices of Opposition of EP2569633 dated Jun. 28, 2017.

Corbett et al., "Aerosol immunization with NYVAC and MVA vectored vaccines is safe, simple, and immunogenic," Proc Natl Acad Sci, 105(6):2046-51 (2008).
Cox et al., "Induction of cytotoxic T lymphocytes by recombinant canarypox (ALVAC) and attenuated vaccinia (NYVAC) viruses expressing the HIV-1 envelope glycoprotein," Virology, 195(2):845-850 (1993).
Crozat et al., "The XC chemokine receptor 1 is a conserved selective marker of mammalian cells homologous to mouse CD8α+ dendritic cells," Journal of Experimental Medicine, 207(6):1283-1292 (2010).
Daheshia et al., "Suppression of ongoing ocular inflammatory disease by topical administration of plasmid DNA encoding IL-10," The Journal of Immunology 159(4):1945-1952 (1997).
De Plaen et al., "Immunogenic (tum-) Variants of Mouse Tumor P815: Cloning of the Gene of Tum-Antigen P91A and Identification of the Tum-Mutation," PNAS, 85: 2274-2278 (1988).
Declaration by Stephen Johnston filed during the prosecution of granted U.S. Pat. No. 8,796,414 Nov. 20, 2013.
Declaration of Dr Nir Hacohen on Feb. 16, 2014.
Declaration of Dr. John C. Castle executed on Nov. 9, 2016.
Dengjel et al., "Glycan side chains on naturally presented MHC class II ligands," J. Mass Spectrom, 40:100-104 (2005).
Dermer et al., "Another Anniversary for the War on Cancer," Biotech, 12:320 (1994).
Didierlaurent et al., "Attenuated poxviruses expressing a synthetic HIV protein stimulate HLA-A2-restricted cytotoxic T-cell responses," Vaccine, 22(25-26):3395-3403 (2004).
Ding et al., "Genome remodelling in a basal-like breast cancer metastasis and xenograft," Nature, 464:999-1005 (2010).
Dreicer et al., "Mva-MUC1-IL2 vaccine immunotherapy (TG4010) improves PSA doubling time in patients with prostate cancer with biochemical failure," Investigational new drugs, 27(4):379-386 (2009).
Dudley et al., "Cancer Regression and Autoimmunity in Patients After Clonal Repopulation with Antitumor Lymphocytes," Science, 298: 850-854 (2002).
DuPage et al., "Expression of tumour-specific antigens underlies cancer immunoediting," Nature, 482(7385):405-409 (2012).
Dupuis et al., "Dendritic Cells Internalize Vaccine Adjuvant after Intramuscular Injection," Cell Immunol, 186(1): 18-27 (1998).
Earl et al., "Immunogenicity of a highly attenuated MVA smallpox vaccine and protection against monkeypox," Nature, 428:182 (2004).
Engelhard, "Structure of peptides associated with MHC class I molecules," Curr Opin Immunol, 6(1):13-23 (1994).
Erlich et al., "Next-generation sequencing for HLA typing of class I loci," BMC Genomics, 12:42 (2011).
Esteban, "Attenuated poxvirus vectors MVA and NYVAC as promising vaccine cadidates against HIV/AIDS," Human vaccines, 5(12):867-871 (2009).
Estep et al., "Mutation Analysis of BRAF, MEK1 and MEK2 in 15 Ovarian Cancer Cell Lines: Implications for Therapy," PLoS One, 12:e1279 (2007).
Extended European Search Report dated Apr. 11, 2016, which issued during prosecution of EP Application No. 15198284.0.
Extended European Search Report received for EP patent application No. EP11781409, dated Apr. 10, 2014.
Extended Search Report in Corresponding European Application No. 11781409.5, dated Apr. 14, 2014.
Ezzell, "Cancer 'Vaccines': An idea whose time has come?," J NIH Res, 7:46 (1995).
Farsaci et al., "Consequence of dose scheduling of sunitinib on host immune response elements and vaccine combination therapy," Int J Cancer, 130:1948-1959 (2012).
Felgner et al., "Lipofection: A Highly Efficient, Lipid-Mediated DNA-Transfection Procedure," PNAS, 84(21): 7413-7417 (1987).
Ferrier-Rembert et al., "Short-and long-term immunogenicity and protection induced by non-replicating smallpox vaccine candidates in mice and comparison with the traditional 1st generation vaccine," Vaccine, 26(14):1794-1804 (2008).
Finke et al., "Sunitinib Reverses Type-1 Immune Suppression and Decreases T-Regulatory Cells in Renal Cell Carcinoma Patients," Clin Cancer Res, 14(20):6674-6682 (2008).

(56) References Cited

OTHER PUBLICATIONS

Flexner et al., "Prevention of vaccinia virus infection in imiminodeficient mice by vector-directed IL-2 expression," Nature, 330(6145):259-262 (1987).
Frederick et al., "BRAF inhibition is associated with enhanced melanoma antigen expression and a more favorable tumor microenvironment in patients with metastatic melanoma," Clin Cancer Res, 19:1225-1231 (2013).
Fritsch et al., "Personal neoantigen cancer vaccines: The momentum builds," Oncoimmunology, 3(6):e29311 (2014).
Fynan et al., "DNA vaccines: protective immunizations by parenteral, mucosal, and gene-gun inoculations," PNAS, 90 (24): 11478-82 (1993).
Gabrilovich et al., "IL-12 and Mutant P53 Peptide-Pulsed Dendritic Cells for the Specific Immunotherapy of Cancer," J Immunother Emphasis Tumor Immunol, 19(6): 414-418 (1996).
Gallego-Gomez et al., "Differences in virus-induced cell morphology and in virus maturation between MVA and other strains (WR, Ankara, and NYCBH) of vaccinia virus in infected human cells," Journal of virology, 77(19):10606-10622 (2003).
Gallois et al., "A needle in the 'cancer vaccine' haystack," Nature medicine, 16(8):854-856 (2010).
Garcia-Marco et al., "Frequent Somatic Deletion of the 13q12.3 locus Encompassing BRCA2 in Chronic Lymphocytic Leukemia," Blood, 88: 1568-1575 (1996).
Gherardi et al., "Prime-boost immunization schedules based on influenza virus and vaccinia virus vectors potentiate cellular immune responses against human immunodeficiency virus Env protein systemically and in the genitorectal draining lymph nodes," Journal of virology, 77(12):7048-7057 (2003).
Ghiringhelli et al., "Metronomic cyclophosphamide regimen selectively depletes CD4+CD25+ regulatory T cells and restores T and NK effector functions in end stage cancer patients," Cancer Immunol Immunother, 56:641-648 (2007).
Gibney et al., "Safety and efficacy of adjuvant anti-PD1 therapy (nivolumab) in combination with vaccine in resected high-risk metastatic melanoma.," J Clin Oncol, Abstract 9056 (2013).
Gilboa, "The Makings of a Tumor Rejection Antigen," Immunity, 11: 263-270 (1999).
Gluzman, "SV40-transformed simian cells support the replication of early SV40 mutants," Cell, 23:175-182 (1981).
Gnirke et al., "Solution Hybrid Selection with Ultra-Long Oligonucleotides for Massively Parallel Targeted Sequencing," Nat Biotechnol, 27(2): 182-189 (2009).
Goebel et al., "The complete DNA sequence of vaccinia virus," Virology, 179(1):247-266 (1990).
Gomez et al., "Efficient CD8+ T cell response to the HIV-env V3 loop epitope from multiple virus isolates by a DNA prime/vaccinia virus boost (rWR and rMVA strains) immunization regime and enhancement by the cytokine IFN-γ," Virus research, 105:11-22 (2004).
Gomez et al., "Head-to-head comparison on the immunogenicity of two HIV/AIDS vaccine candidates based on the attenuated poxvirus strains MVA and NYVAC co-expressing in a single locus the HIV-1 BX08 gp120 and HIV-1IIIB Gag-Pol-Nef proteins of Glade B," Vaccine, 25(15):2863-2885 (2007).
Gomez et al., "MVA and NYVAC as vaccines against emergent infectious diseases and cancer," Current gene therapy, 11(:3):189-217 (2011).
Gomez et al., "The poxvirus vectors MVA and NYVAC as gene delivery systems for vaccination against infectious diseases and cancer," Current gene therapy, 8(2):97-120 (2008).
Gomez et al., "Virus distribution of the attenuated MVA and NYVAC poxvirus strains in mice," Journal of General Virology, 88(9):2473-2478 (2007).
Gotter et al., "Medullary Epithelial Cells of the Human Thymus Express a Highly Diverse Selection of Tissue-specific Genes Colocalized in Chromosomal Clusters," J Exp Med, 199(2):155-166 (2004).
Goya et al., "SNVMix:predicting single nucleotide variants from next-generation sequencing of tumors," Bioinformatics, Original Paper, 26(6): 730-736 (2010).
Greco et al., "Improving the safety of cell therapy with the TK-suicide gene," Front Pharmacol, 6:95 (2015).
Greenman et al., "Patterns of somatic mutation in human cancer genomes," Nature, 446:153-158 (2007).
Gregoriadis et al., "Improving the therapeutic efficacy of peptides and proteins: A role for polysialic acids," Int J Pharmaceutics, 300(1-2):125-30 (2005).
Gubin et al., "Checkpoint blockade cancer immunotherapy targets tumor-specific mutant antigens," Nature, 515:577-581 (2014).
Gueguen et al., "An Antigen Recognized by Autologous CTLs on a Human Bladder Carcinoma," J Immunol, 160(12): 6188-6194 (1998).
Guo et al., "Different length peptides bind to HLA-Aw68 similarity at their ends but bulge on in the middle," Nature, 360:364-366 (1992).
Hacohen et al., "Getting Personal with Neoantigen-Based Therapeutic Cancer Vaccines," Cancer Immunol. Res, 1(1):11-15 (2013).
Halabi et al., "Prognostic model for predicting survival in men with hormone-refractory metastatic prostate cancer," Journal of Clinical Oncology, 21(7):1232-1237 (2003).
Hel et al., "Potentiation of simian immunodeficiency virus (SIV)-specific CD4+ and CD8+ T cell responses by a DNA-SIV and NYVAC-SIV prime/boost regimen," The Journal of Immunology, 167(12):7180-7191 (2001).
Herbst et al., "Predictive Correlates of Response to the Anti-PD-L1 Antibody MPDL3280A in Cancer Patients," Nature, 515(7528):563-567 (2014).
Herman et al., "Differences in the Recognition by CTL of Peptides Presented by the HLAB* 4402 and the HLA-B*4403 Molecules Which Differ by a Single Amino Acid," Tissue Antigens, 53: 111-121 (1999).
Hersey et al., "Phase I/II study of treatment with dendritic cell vaccines in patient with disseminated melanoma," Cancer Immunol Immunoother, 53:125-134 (2004).
Hocker et al., "Ultraviolet Radiation and Melanoma: A Systematic Review and Analysis of Reported Sequence Variants," Hum Mutat, 28(6): 578-588 (2007).
Hodi et al., "Biologic Activity of Cytotoxic T Lymphocyte-Associated Antigen 4 Antibody Blockade in Previously Vaccinated Metastatic Melanoma and Ovarian Carcinoma Patients," PNAS, 100: 4712-4717 (2003).
Hodi et al., "Immunologic and Clinical Effects of Antibody Blockade of Cytotoxic T Lymphocyte-Associated Antigen 4 in Previously Vaccinated Cancer Patients," PNAS, 105: 3005-3010 (2008).
Hodi et al., "Improved Survival with Ipilimumab in Patients with Metastatic Melanoma," New Engl J Med, 363:711-723 (2010).
Honig et al., "Phase 1 clinical trial of a recombinant canarypoxvirus (ALVAC) vaccine expressing human carcinoembryonic antigen and the B7.1 co-stimulatory molecule," Cancer Immunol Immunother, 49:504-514 (2000).
Huang et al., "Mucosal priming with replicative Tiantan vaccinia and systemic boosting with DNA vaccine raised strong mucosal and systemic HIV-specific immune responses," Vaccine, 25(52):8874-8884 (2007).
Huang et al., "T Cells Associated With Tumor Regression Recognize Frameshifted Products of the CDKN2A Tumor Suppressor Gene Locus and a Mutated HLA Class I Gene Product," J Immunol, 172(10):6057-6064 (2004).
Humphries et al., "Lineage tracing reveals multipotent stem cells maintain human adenomas and the pattern of clonal expansion in tumor evolution," PNAS, 110(27):e2490-e2499 (2013).
Hutchings et al., "Combination of protein and viral vaccines induces potent cellular and humoral immune responses and enhanced protection from murine malaria challenge," Infect Immun, 75(12):5819-26 (2007).
Intellectual Property Policy for Partners-Affiliated Hospitals and Institutions, Aug. 15, 2002.
International Preliminary Report on Patentability for International Application No. PCT/US2011/036665 dated Nov. 20, 2012.
International Preliminary Report on Patentability for International Application No. PCT/US2014/033185 dated Oct. 22, 2015.

(56) References Cited

OTHER PUBLICATIONS

International Preliminary Report on Patentability for International Application No. PCT/US2014/067146 dated May 31, 2016.
International Preliminary Report on Patentability for International Application No. PCT/US2014/068746 dated Jun. 7, 2016.
International Preliminary Report on Patentability for International Application No. PCT/US2014/068893 dated Jun. 7, 2016.
International Preliminary Report on Patentability for International Application No. PCT/US2014/071707 dated Jun. 21, 2016.
International Preliminary Report on Patentability for International Application No. PCT/US2015/067143 dated Jun. 20, 2017.
International Search Report and Written Opinion for International Application No. PCT/US/2015/051340 dated Dec. 21, 2015.
International Search Report and Written Opinion for International Application No. PCT/US/2016/033452 dated May 20, 2016.
International Search Report and Written Opinion for International Application No. PCT/US/2016/036605 dated Jan. 16, 2017.
International Search Report and Written Opinion for International Application No. PCT/US2011/036665 dated Jul. 2, 2012.
International Search Report and Written Opinion for International Application No. PCT/US2014/033185 dated Nov. 5, 2014.
International Search Report and Written Opinion for International Application No. PCT/US2014/067146 dated Mar. 31, 2015.
International Search Report and Written Opinion for International Application No. PCT/US2015/067143 dated Apr. 12, 2016.
International Search Report for International Application No. PCT/US2014/068746 dated Mar. 23, 2015.
International Search Report for International Application No. PCT/US2014/068893 dated Apr. 9, 2015.
International Search Report for International Application No. PCT/US2014/071707 dated Sep. 10, 2015.
Invention Agreement of the Dana-Farber Cancer Institute, 1 Jul. 1997.
Itoh et al., "Personalized peptide vaccines: A new therapeutic modality for cancer," Cancer Sci, 97:970-976 (2006).
Japanese Office Action dated Jan. 22, 2018, which issured during prosecution of JP 2016-507587.
Japanese Office Action from Application No. 2013-510360 dated Apr. 28, 2015.
Jensen et al., "Design and implementation of adoptive therapy with chimeric antigen receptor-modified T cells," Immunol Rev, 257(1):127-144 (2014).
Ji et al., "An immune-active tumor microenvironment favors clinical response to ipilimumab," Cancer Immunol Immunother, 61(7):1019-1031 (2011).
Jocham et al., "Adjuvant Autologous Renal Tumour Cell Vaccine and Risk of Tumour Progression in Patients with Renal-Cell Carcinoma After Radical Nephrectomy: Phase III, Randomised Controlled Trial," Lancet, 363: 594-599 (2004).
Johann et al., "GLVR1, a receptor for gibbon ape leukemia virus, is homologous to a phosphate permease of Neurospora crassa and is expressed at high levels in the brain and thymus," Journal of Virology, 66(3):1635-1640 (1992).
Jun et al., "Progress in T cell adoptive Immunotherapy for Malignant Solid Tumors," Chin Med Biotechnol, 3(1):1-7 (2008).
Kanduri et al., "Differential genome-wide array-based methylation profiles in prognostic subsets of chronic lymphocytic leukemia," Blood, 115(2):296-305 (2010).
Kantoff et al. "Overall survival analysis of a phase II randomized controlled trial of a Poxviral-based PSA-targeted immunotherapy in metastatic castration-resistant prostate cancer," Journal of Clinical Oncology, 28(7):1099-1105 (2010).
Kanzler et al., "Therapeutic Targeting of Innate Immunity with Toll-like Receptor Agonists and Antagonists," Nat Med, 13: 552-559 (2007).
Karanikas et al., "High frequency of cytolytic T lymphocytes directed against a tumor-specific mutated antigen detectable with HLA tetramers in the blood of a lung carcinoma patient with long survival," Cancer Res, 61:3718-3724 (2001).

Kaufman et al., "Phase II randomized study of vaccine treatment of advanced prostate cancer (E7897): a trial of the Eastern Cooperative Oncology Group," Journal of Clinical Oncology, 22(11):2122-2132 (2004).
Kawakami et al., "Identification of human tumor antigens and its implications for diagnosis and treatment of cancer," Cancer Sci, 95(10): 784-791 (2004).
Keats et al., "Promiscuous Mutations Activate the Noncanonical NF-KB Pathway in Multiple Myeloma," Cancer Cell, 12: 131-144 (2007).
Kenter et al., "Phase I Immunotherapeutic Trial with Long Peptides Spanning the E6 and E7 Sequences of High-Risk Human Papillomavirus 16 in End-Stage Cervical Cancer Patients Show Low Toxicity and Robust Immunogenicity," Clin. Cancer Research, 14(1):169-177 (2008).
Keogh et al., "Identification of New Epitopes from Four Different Tumor-Associated Antigens: Recognition of Naturally Processed Epitopes Correlates with HLA-A□201-Binding Affinity," J Immunol, 167:787-796 (2001).
Kessler et al., "Identification of T-cell epitopes for cancer immunotherapy," Leukemia, 21:1859-1874 (2007).
Khalili et al., "In silico prediction of tumor antigens derived from functional missense mutations of the cancer gene census," Oncoimmunology, 1(8):1281-1289 (2012).
Kim et al., "Anticancer flavonoids are mouse-selective STING agonists," ACS chemical biology, 8(7):1396-1401 (2013).
Kim et al., "TroVax, a recombinant modified vaccinia Ankara virus encoding 5T4: lessons learned and future development," Human vaccines, 6(10):784-791 (2010).
Kobayashi et al., "Peptide epitope identification for tumor-reactive CD4 T cells," Current opinion in immunology, 20(2):221-227 (2008).
Koh et al., "Immunological consequences of using three different clinical/laboratory techniques of emulsifying peptide-based vaccines in incomplete Freund's adjuvant," J Translational Med, 4:42 (2006).
Komarova et al., "Evolution of Ibrutinib Resistance in Chronic Lymphcytic Leukemia (CLL)," Proceedings of the National Academy of Sciences, 111(38):13906-13911 (2014).
Kornher et al., "Mutation Detection Using Nucleotide Analogs That Alter Electrophoretic Mobility," Nucleic Acids Res, 17(19): 7779-7784 (1989).
Kotwal et al., "Vaccinia virus encodes two proteins that are structurally related to members of the plasma serine protease inhibitor superfamily," Journal of virology, 63(2):600-606 (1989).
Kreiter et al., "Mutant MHC Class II epitopes drive therapeutic immune responses to cancer," Nature, 520:692 (2015).
Krieg, "Therapeutic potential of Toll-like receptor 9 activation," Nature reviews Drug discovery, 5(6):471-484 (2006).
Kronenberger et al., "A Polyvalent Cellular Vaccine Induces T-cell Responses Against Specific Self-antigens Overexpressed in Chronic Lymphocytic B-cell Leukemia," J Immunother, 31(8):723-730 (2008).
Kuppuswamy et al., "Single Nucleotide Primer Extension to Detect Genetic Diseases: Experimental Application to Hemophilia B (Factor IX) and Cystic Fibrosis Genes," PNAS, 88(4): 1143-1147 (1991).
Kyte et al., "Telomerase Peptide Vaccination Combined with Temozolomide: A Clinical Trial in Stage IV Melanoma Patients," Clin Cancer Res, 17(13):4568-4580 (2011).
Ladetto et al., "Real-Time Polymerase Chain Reaction in Multiple Myeloma: Quantitative Analysis of Tumor Contamination of Stem Cell Harvests," Exp Hematol, 30: 529-536 (2002).
Landau et al., "Chronic lymphocytic leukemia: molecular heterogeneity revealed by high-throughput genomics," Genome Med, 5:47 (2013).
Landau et al., "Evolution and Impact of Subclonal Mutations in Chronic Lymphocytic Leukemia," Cell, 152:714-726 (2013).
Landau et al., "Increased Local Disorder of DNA Methylation Forms the Basis of High Intra-Leukemic Epigenetic Heterogeneity and Enhances CLL Evolution," Blood, 122:596 (2013).

(56) References Cited

OTHER PUBLICATIONS

Le et al., "Next-Generation Cancer Vaccine Approaches: Integrating Lessons Learned From Current Successes With Promising Biotechnologic Advances," J Natl Compr Cancer Network, 11:766-772 (2013).
Le Mercier et al., "Beyond CTLA-4 and PD-1, the generation Z of negative checkpoint regulators," Front Immunol, 6:418 (2015).
Leitner et al., "Immune responses induced by intramuscular or gene gun injection of protective deoxyribonucleic acid vaccines that express the circumsporozoite protein from Plasmodium berghei malaria parasites," J Immunol, 159(12):6112-6119 (1997).
Lemmel et al., "Differential quantitative analysis of MHC ligands by mass spectrometry using stable isotope labeling," Nature Biotechnology, 22(4):450-454 (2004).
Lennerz et al., "The Response of Autologous T Cells to a Human Melanoma is Dominated by Mutated Neoantigens," PNAS, 102(44):16013-10618 (2005).
Letter from Mathys & Squire dated Jun. 28, 2017 accompanying Response to Notices of Opposition of EP2569633.
Letter from Mathys & Squire dated Jun. 29, 2017+B245:B256.
Lewin et al., "DNA is the Genetic Material: Mutations Change the Sequence of DNA," Genes IV, 4:68-69 (1990).
Lewis et al., "DNA Vaccines: A Review," Advances in Virus Research, 54:129-88 (1999).
Ley et al., "DNA sequencing of a cytogenetically normal acute myeloid leukaemia genome," Nature, 456: 66-72 (2008).
Ley et al., "DNMT3A Mutations in Acute Myeloid Leukemia, The New England Journal of Medicine," 363: 2423-2433 (2010).
Li et al., "Cancer Genome Sequencing and Its Implications for Personalized Cancer Vaccines," Cancers 3(4):4191-4211 (2011).
Lin et al., "Evaluation of Mhc-II Peptide Binding Prediction Servers: Applications for Vaccine Research," BMC Bioinformatics, 9: S22 (2008).
Linard et al., "A ras-Mutated Peptide Targeted by CTL Infiltrating a Human Melanoma Lesion," J Immunol, 168:4802-4808 (2002).
Lindhout et al., "Site-specific enzymatic polysialylation of therapeutic proteins using bacterial enzymes," PNAS, 108(18):7397-7402 (2011).
Linnemann et al., "High-throughput identification of antigen-specific TCRs by TCR gene capture," Nat Med, 19(11):1534-1541 (2013).
Liu et al., "Athlates:accurate typing of human leukocyte antigen through exome sequencing," Nucleic Acids Res, 41(14):e142 (2013).
Luckow al.,"Trends in the Development of Baculovirus Expression Vectors," Nat Biotechnol, 6:47-55 (1988).
Lundegaard et al., "NetMHC-3.0: accurate web accessible predictions of human, mouse and monkey MHC class I affinities for peptides of length 8-11," Nucleic Acids Research, 36: W509.W512 (2008).
Lundegaard et al., "Prediction of epitopes using neural network based methods," J Immunol Methods, 374(1-2):26-34 (2011).
Lundegaard et al., "State of the art and challenges in sequence based T-cell epitope prediction," Immunome Research, 6(Suppl 2): S3 (2010).
Macconaill et al., Profiling Critical Cancer Gene Mutations in Clinical Tumor Samples, PLoS One, 4(11):e7887 (2009).
Machiels et al., "Peptide-Based Cancer Vaccines," Seminars in Oncology, 29(5):494-502 (2002).
Mackett et al., "Vaccinia virus: a selectable eukaryotic cloning and expression vector," PNAS, 79:7415-7419 (1982).
Maeurer et al., "New treatment options for patients with melanoma: review of melanoma-derived T-cell epitopebased peptide vaccines," Melanom Research, 6:11-24 (1996).
Maker et al., "Intrapatient Dose Escalation of Anti-CTLA-4 Antibody in Patients With Metastatic Melanoma," J Immunother, 29: 455-463 (1997).
Malavota et al., "Interpretation of the dissolution of insoluble peptide sequences based on the acid☐base properties of the solvent," Protein Sci, 15(6):1476-1488 (2006).

Malcikova et al., "Identification of somatic hypermutations in the TP53 gene in B-cell chronic lymphocytic leukemia," Molecular Immunol, 45(5):1525-1529 (2008).
Mandelboim et al., "Regression of Established Murine Carcinoma Metastases Following Vaccination with Tumor-Associated Antigen Peptides," Nature Medicine, 1(11):1179-1183 (1995).
Mandl et al., "Immunotherapy with MVA-BN®-HER2 induces HER-2-specific Th1 immunity and alters the intratumoral balance of effector and regulatory T cells," Cancer Immunol Immunother, 61(1):19-29 (2012).
Mandruzzato et al., "A CASP-8 Mutation Recognized by Cytolytic T Lymphocytes on a Human Head and Neck Carcinoma," J Exp Med, 186: 785-793 (1997).
Mannino et al., "Liposome Mediated Gene Transfer," Biotechniques, 6(7): 682-690 (1988).
Maratea et al. "Deletion and fusion analysis of the phage φX174 lysis gene E," Gene 40(1):39-46 (1985).
Mardis et al., "Cancer genome sequencing: a review," Human Molecular Genetics, 18(2):R163-R168 (2009).
Mardis et al., "Recurring Mutations Found by Sequencing an Acute Myeloid Leukemia Genome," New Engl J Med, 361:1058-1066 (2009).
Margulies et al., "Genome Sequencing in Open Microfabricated High Density Picoliter Reactors," Nature, 15:437(7057): 376-380 (2005).
Marijt et al., "Hematopoiesis-Restricted Minor Histocompatibility Antigens HA-1-or HA-2-specific T Cells can Induce Complete Remissions of Relapsed Leukemia," PNAS, 100: 2742-2747 (2003).
Marina et al., "Serologic Markers of Effective Tumor Immunity Against Chronic Lymphocytic Leukemia Include Nonmutated B-Cell Antigens," Cancer Res, 70(4): 1344-1355 (2010).
Mark et al., "Site-specific mutagenesis of the human fibroblast interferon gene," PNAS, 81(18):5662-5666 (1984).
Marshall et al., "Phase I Study in Cancer Patients of a Replication-Defective Avipox Recombinant Vaccine That Expresses Human Carcinoembryonic Antigen," J Clin Oncol, 17:332-337 (1999).
Matsushita et al., "Cancer Exome Analysis Reveals a T Cell Dependent Mechanism of Cancer Immunoediting," Nature, 482(7385):400-404 (2012).
Maus et al., "Adoptive Immunotherapy for Cancer or Viruses," Annual Review of Immunology, 32:189-225 (2014).
Mayr et al., "Abstammung, Eigenschaften and Verwendung des attenuierten Vaccinia-Stammes MVA (Translated Summary)," Infection, 3(1):6-14 (1975).
Mayr, "The smallpox vaccination strain MVA: marker, genetic structure, experience gained with the parenteral vaccination and behavior in organisms with a debilitated defence mechanism (author's transl)," Zentralbl Bakteriol 167(5-6):375-9 (1978).
McCurdy et al., "Modified Vaccinia Ankara: Potential as an Alternative Smallpox Vaccine," Clin Infect Dis, 38:1749-1753 (2004).
Melief et al., "Immunotherapy of established (pre)malignant disease by synthetic long peptide vaccines," Nature Rev Cancer, 8:351-360 (2008).
Men et al., "Assessment of Immunogenicity of Human Melan-A Peptide Analogues in HLA-A*0201/Kb Transgenic Mice," J Immunol, 162:3566-3573 (1999).
Merrifield, "Solid Phase Peptide Synthesis. I. The Synthesis of a Tetrapeptide," J Am Chem Soc, 85(14):2149-2154 (1963).
Meyer et al., "Mapping of deletions in the genome of the highly attenuated vaccinia virus MVA and their influence on virulence," J Gen Virol, 72:1031-1038 (1991).
Meyerson et al., "Advances in understanding cancer genomes through second-generation sequencing," Nat Rev Genetics, 11:685-696 (2010).
Midgley, "Vaccinia virus strain NYVAC induces substantially lower and qualitatively different human antibody responses compared with strains Lister and Dryvax," J Gen Virol, 89:2992-2997 (2008).
Miller et al., "Construction and properties of retrovirus packaging cells based on gibbon ape leukemia virus," Virol, 65:2220-2224 (1991).

(56) References Cited

OTHER PUBLICATIONS

Mooij, "Differential CD4+ versus CD8+ T-Cell Responses Elicited by Different Poxvirus-Based Human Immunodeficiency Virus Type 1 Vaccine Candidates Provide Comparable Efficacies in Primates," J Virol, 82(6):2975-2988 (2008).
Mor et al., "Complexity of the cytokine and antibody response elicited by immunizing mice with Plasmodium yoelii circumsporozoite protein plasmid DNA," J Immunol, 155(4):2039-2046 (1995).
Moss, "Reflections on the early development of poxvirus vectors," Vaccine, 31(39): 4220-4222 (2013).
Mullally et al., "Beyond HLA: The Significance of Genomic Variation for Allogeneic Hematopoietic Stem Cell Transplantation," Blood, 109: 1355-1362 (2007).
Murphy et al., "Antigen Presentation to T Lymphocytes," Janeway's Immunobiology, 7th Edition, 5:182-83 & 197 (2008).
Murphy et al., "Genetic construction, expression, and melanoma-selective cytotoxicity of a diphtheria toxin-related alpha-melanocyte-stimulating hormone fusion protein," PNAS, 83:8258-8262 (1986).
Murphy et al., "Phase I Clinical Trial: T-Cell Therapy for Prostate Cancer Using Autologous Dendritic Cells Pulsed with HLA-A0201-Specific Peptides from Prostate-Specific Membrane Antigen," Prostate, 29(6): 371-380 (1996).
Musey et al., "HIV-1 Vaccination Administered Intramuscularly Can Induce Both Systemic and Mucosal T Cell Immunity in HIV-1-Uninfected Individuals," J Immunol, 171(2):1094-1101 (2003).
Najera et al., "Cellular and Biochemical Differences between Two Attenuated Poxvirus Vaccine Candidates (MVA and NYVAC) and Role of the C7L Gene," J Virol, 80(12):6033-6047 (2006).
Nam et al., "Different contribution of co-stimulatory molecules B7.1 and B7.2 to the immune response to recombinant modified vaccinia virus ankara vaccine expressing prM/E proteins of Japanese encephalitis virus and two hepatitis B virus vaccines," Acta Virol, 51:125-30 (2007).
Nishimura et al, "Distinct Role of Antigen-Specific T Helper Type 1 (Th1) and Th2 Cells in Tumor Eradication in Vivo," J Ex Med, 190(5):617-27 (1999).
Nocentini et al., "A new member of the tumor necrosis factor/nerve growth factor receptor family inhibits T cell receptor-induced apoptosis," PNAS, 94(12):6216-6221 (1997).
Notice of Opposition to European Patent No. EP2569633—Agenus Inc. (Opponent) dated Nov. 9, 2016.
Notice of Opposition to European Patent No. EP2569633—Dr. Christian Muller (Opponent) dated Nov. 9, 2016.
Notice of Opposition to European Patent No. EP2569633—Gritstone Oncology, Inc. (Opponent) dated Nov. 7, 2016.
Notice of Opposition to European Patent No. EP2569633—James Poole Limited (Opponent) dated Nov. 9, 2016.
Notice of Opposition to European Patent No. EP2569633—Strawman Limited (Opponent) dated Nov. 10, 2016.
Novellino et al., "A listing of human tumor antigens recognized by T cells: Mar. 2004 update," Cancer Immunol Immunother, 54(3):187-207 (2005).
Nyren et al., "Solid Phase DNA Minisequencing by an Enzymatic Luminometric Inorganic Pyrophosphate Detection Assay," Anal Biochem, 208(1): 171-175 (1993).
O'Shea et al., "Signal transduction and Th17 cell differentiation," Microbes Infect, 11(5):599-611 (2009).
Oakes et al., "Evolution of DNA Methylation Is Linked to Genetic Aberrations in Chronic Lymphocytic Leukemia," Cancer Discov, 4(3):348-361 (2014).
Oakes et al., "Heterogeneity and Evolution of DNA Methylation in Chronic Lymphocyctic Leukemia," Blood, 122(21):1626 (2013).
Ofran et al., "Identification of Human Minor Histocompatibility Antigens (MHA) by Combining Bioinformatic Prediction of Peptide Epitopes with Validation of T Cell Reactivity in Patient Blood Samples after Allogeneic Hematopoietic Stem Cell Transplantation," Biol Bone Marrow Transplant, 14:1 (Abstract #2) (2008).
Opaysky et al., CpG Island Methylation in a Mouse Model of Lymphoma Is Driven by the Genetic Configuration of Tumor Cells, PLoS Genetics, 3(9):e167 (2007).
Opposition Letter—Agenus Inc. (Opponent) in European Patent 2569633, dated Nov. 9, 2016.
Opposition Letter—Dr. Christian Muller (Opponent) in European Patent No. 2569633, dated Nov. 9, 2016.
Opposition Letter—Gritstone Oncology Inc. (Opponent) in European Application No. 11781409.5 dated Nov. 7, 2016.
Opposition Letter—James Poole Limited (Opponent) in European Patent No. 2569633, dated Nov. 9, 2016.
Opposition Letter—Strawman Limited (Opponent) in European Patent No. 2569633 dated Nov. 10, 2016.
Ott et al., "An Immunogenic personal neoantigen vaccine for patients with melanoma," Nature, 547:217-221 (2017).
Ott et al., "Vaccines and Melanoma," Hematol Oncol Clin N Am, 28(3):559-569 (2014).
Oudard et al., "A phase II study of the cancer vaccine TG4010 alone and in combination with cytokines in patients with metastatic renal clear-cell carcinoma: clinical and immunological findings," Cancer Immunol Immunother, 60(2): 261-271 (2011).
Page et al., "Immune Modulation in Cancer with Antibodies," Annu Rev Med, 65:185-202 (2014).
U.S. Appl. No. 13/108,610, filed May 16, 2011.
Pan et al., "Epigenomic Evaluation in diffuse Large B-Cell Lymphomas," Blood, Nov. 15, 2013, 122(21) XP55174946.
Panicali et al., "Construction of live vaccines by using genetically engineered poxviruses: biological activity of recombinant vaccinia virus expressing influenza virus hemagglutinin," PNAS, 80(17):5364-5368 (1983).
Panicali et al., "Construction of poxviruses as cloning vectors: insertion of the thymidine kinase gene from herpes simplex virus into the DNA of infectious vaccinia virus," 79(16):4927-4931 (1982).
Pantaleo et al., "Poxvirus vector-based HIV vaccines," Curr Opin HIV-AIDS, 5:391-396 (2010).
Paoletti, "Applications of pox virus vectors to vaccination: an update," PNAS, 93(21):11349-53 (1996).
Parker et al., "Scheme for Ranking Potential HLA-A2 Binding Peptides Based on Independent Binding of Individual Peptide Side-Chains," J Immunol, 152(1): 163-175 (1994).
Parkhurst et al., "Improved induction of melanoma-reactive CTL with peptides from the melanoma antigen gp100 modified at HLA-A*0201-binding residues", The Journal of Immunology, 157: 2539-2548 (1996).
Parmiani et al., "Unique Human Tumor Antigens: Immunobiology and Use in Clinical Trials," J Immunol, 178: 1975-1979 (2007).
Pasmant et al., "Characterization of a Germ-Line Deletion, Including the Entire INK4/ARF Locus, in a Melanoma-Neural System Tumor Family: Identification of ANRIL, an Antisense Noncoding RNA Whose Expression Coclusters with ARF," Cancer Res, 67(8):3963-3969 (2007).
Perez et al., "A new era in anticancer peptide vaccines," Cancer, 116(9):2071-2080 (2010).
Perkvs et al., "Poxvirus□based vaccine candidates for cancer, AIDS, and other infectious diseases," J Leukocyte Biol, 58(1):1-13 (1995).
Perreau et al., "DNA/NYVAC Vaccine Regimen Induces HIV-Specific CD4 and CD8 T-Cell Responses in Intestinal Mucosa," J Virol, 85(19):9854-9862 (2011).
Peters et al., "The Immune Epitope Database and Analysis Resource: From Vision to Blueprint," PLoS Biol, 3(3): e91 (2005).
Peters et al., "The many faces of TH-17 Cells," Curr Opin Immunol, 23(6):702-706 (2011).
Petsch et al., "Protective efficacy of in vitro synthesized, specific mRNA vaccines against influenza A virus infection," Nat Biotechnol, 30(12):1210-1216 (2012).
Phan et al., "Cancer regression and autoimmunity induced by cytotoxic T lymphocyte-associated antigen 4 blockade in patients with metastatic melanoma," PNAS, 100(14):8372-8377 (2003).
Pilla et al., "Multipeptide vaccination in cancer patient," Expert Opin Biol Ther, 9(8):1043-1055 (2009).
Piros et al., "Market Opportunity for Molecular Diagnostics in Personalized Cancer Therapy," Handbook of Clinical Nanomedicine: Law, Business, Regulation, Safety and Risk, Chapter 14:1-29 (2016).

(56) References Cited

OTHER PUBLICATIONS

Pleasance et al., "A comprehensive catalogue of somatic mutations from a human cancer genome," Nature, 463:191-196 (2010).
Pleasance et al., "A small-cell lung cancer genome with complex signatures of tobacco exposure," Nature, 463: 184-190 (2010).
Poirot et al., "Multiplex genome edited T-cell manufacturing platform for "off-the-shelf" adoptive T-cell immunotherapies," Cancer Res, 75(18):3853 (2015).
Policy Reallocating Ownership of Intellectual Property Covered by the Intellectual Property Policy, Sep. 18, 2002.
Poulet, "Development and registration of recombinant veterinary vaccines: The example of the canarypox vector platform," Vaccine, 25(30):5606-5612 (2007).
Prezant et al., "Trapped-Oligonucleotide Nucleotide Incorporation (TONI) Assay, a Simple Method for Screening Point Mutations," Hum Mutat, 1(2): 159-164 (1992).
Provan et al., "Eradication of Polymerase Chain Reaction-Detectable Chronic Lymphocytic Leukemia Cells is Associated with Improved Outcome After Bone Marrow Transplantation," Blood, 88: 2228-2235 (1996).
U.S. Appl. No. 61/334,866, filed May 14, 2010.
Rajasagi et al., "Systematic Identification of Personal Mutated Tumor-Specific Neoantigens in CLL," Blood, 120(21):954 (2012).
Rajasagi et al., "Systematic identification of personal tumor-specific neoantigens in chronic lymphocytic leukemia," Blood, 124(3): 453 (2014).
Rammensee et al., "Cancer Vaccines: Some Basic Considerations," Genomic and Personalized Medicine, 5:573-589 (2009).
Rammensee et al., "MHC ligands and peptide motifs: first listing," Immunogenetics, 41:178 (1995).
Rammensee et al., "SYFPEITHI: Database for MHC Ligands and Peptide Motifs," Immunogenetics, 50(3-4): 213-219 (1999).
Rammensee et al., "Towards Patient-Specific Tumor Antigen Selection for Vaccination," Immunological Reviews, Blackwell Publishing Munksgaard, 188:164-176 (2002).
Ramos et al., "An Inducible Caspase 9 Suicide Gene to Improve the Safety of Mesenchymal Stromal Cell Therapies," Stem Cells, 28(6):1107-1115 (2010).
Reifenberger et al., "Frequent Alterations of Ras Signaling Pathway Genes in Sporadic Malignant Melanomas," Int J Cancer, 109: 377-384 (2004).
Response to Notices of Opposition of EP2569633, dated Jun. 28, 2017.
Ressing et al., "Human CTL epitopes encoded by human papillomavirus type 16 E6 and E7 identified through in vivo and in vitro immunogenicity studies of HLA-A*0201-binding peptides.," J Immunol, 154(11):5934-5943 (1995).
Restifo et al., "Adoptive immunotherapy for cancer: harnessing the T cell response," Nat Rev Immunol, 12(4):269-281 (2015).
Ribas et al., "Antitumor Activity in Melanoma and Anti-Self Responses in a Phase I Trial with the Anti-Cytotoxic T Lymphocyte-Associated Antigen 4 Monoclonal Antibody CP-675,206," J Clin Oncol, 23(35): 8968-8977 (2005).
Rifenberger et al., "Frequent Alterations of Ras Signaling Pathway Genes in Sporadic Malignant Melanomas," Int J Cancer, 109:377-384 (2004).
Rizvi et al., "Mutational landscape determines sensitivity to PD-1 blockade in non-small cell lung cancer," Science, 348(6230):124-128 (2015).
Robbins et al., "A mutated beta-catenin gene encodes a melanoma-specific antigen recognized by tumor infiltrating lymphocytes," J Exp Med, 183(3):1185-1192 (1996).
Rolph et al., "Recombinant viruses as vaccines and immunological tools," Curr Opin Immunol, 9(4):517-524 (1997).
Ronchetti et al., "Frontline:GITR, a member of the TNF receptor superfamily,is costimulatory to mouse T lymphocytesubpopulations," Eur J Immunol, 34(3):613-622 (2004).
Rondon et al., "Graft-versus-Leukemia Effect After Allogeneic Bone Marrow Transplantation for Chronic Lymphocytic Leukemia," Bone Marrow Transplant, 18: 669-672 (1996).
Rooney et al., "Molecular and Genetic Properties of Tumors Associated with Local Immune Cytolytic Activity," Cell, 160(1-2):48-61 (2015).
Rosenberg et al., "Adoptive cell transfer as personalized immunotherapy for human cancer," Science, 348(6230):62-68 (2015).
Rosenberg et al., "Cancer Immunotherapy: Moving Beyond Current Vaccines," Nat Med, 10:909-915 (2004).
Rubinfeld et al., "Stabilization of Beta-Catenin by Genetic Defects in Melanoma Cell Lines," Science, 275(5307):1790-1792 (1997).
Rupprecht et al., "Oral immunization and protection of raccoons (*Procyon lotor*) with a vaccinia-rabies glycoprotein recombinant virus vaccine," PNAS, 83:7947-7950 (1986).
Sabado et al., "Preparation of Tumor Antigen-loaded Mature Dendritic Cells for Immunotherapy," J Vis Exp, 78:50085 (2013).
Sabbatini et al., "Phase I trial of overlapping long peptides from a tumor self-antigen and Poly-ICLC shows rapid induction of integrated immune response in ovarian cancer patients," Clin Cancer Res, 18:6497-6508 (2012).
Sadelain, "Eliminating Cells Gone Astray," New Engl J Med, 365:1735-1737 (2011).
Sampson et al., "An epidermal growth receptor variant III-targeted vaccine is safe and immunogenic in patients with glioblastomas multiforme," Mol Cancer Ther, 8(10):2773-2779 (2009).
Sampson et al., "Greater chemotherapy-induced lymphopenia enhances tumor-specific immune responses that eliminate EGFRvIII-expressing tumor cells in patients with glioblastoma," Neuro-Oncology, 13(3):324-333 (2011).
Sampson et al., "Immunologic Escape After Prolonged Progression-Free Survival With Epidermal Growth Factor Receptor Variant III Peptide Vaccination in Patients With Newly Diagnosed Glioblastoma," J Clin Oncol, 28(31):4722-4729 (2010).
Sancho, "The Block in Assembly of Modified Vaccinia Virus Ankara in HeLa Cells Reveals New Insights into Vaccinia Virus Morphogenesis," J Virol, 76(16):8313-8334 (2002).
Sanderson et al., "Autoimmunity in a Phase I Trial of a Fully Human Anti-Cytotoxic T-Lymphocyte Antigen-4 Monoclonal Antibody With Multiple Melanoma Peptides and Montanide ISA 51 for Patients With Resected Stages III and IV Melanoma," J Clin Oncol, 23(4):741-750 (2005).
Saterdal et al., "Frameshift-mutation-derived peptides as tumor-specific antigens in inherited and spontaneous colorectal cancer," Proceedings of the National Academy of Sciences 98(23): 13255-13260 (2001).
Sato et al., "Intraepithelial CD8+ tumor-infiltrating lymphocytes and a high CD8+/regulatory T cell ratio are associated with favorable prognosis in ovarian cancer," PNAS, 102(51):1838-18543 (2005).
Schaffner et al., "Somatic ATM Mutations Indicate a Pathogenic Role of ATM in B-Cell Chronic Lymphocytic Leukemia," Blood, 94: 748-753 (1999).
Scheibenbogen et al., "Analysis of the T Cell Response to Tumor and Viral Peptide Antigens by an IFNγ-Elispot Assay," Int. J. Cancer, 71:932-936 (1997).
Schietinger et al., "Specificity in cancer immunotherapy," Semin. Immunol, 20(5)276-285 (2008).
Schneider et al, "Induction of CD8+ T cells using heterologous prime-boost immunisation strategies," Immunol Rev, 170(1):29-38 (1999).
Schuh et al., "Monitoring chronic lymphocytic leukemia progression by whole genome sequencing reveals heterogeneous clonal evolution patterns," Blood, 120(20):4191-4196 (2012).
Schwitalle et al., "Immunogenic peptides generated by frameshift mutations in DNA mismatch repair-deficient cancer cells," Cancer Immunity, 4(1):14 (2004).
Scriba et al., "Modified vaccinia Ankara☐expressing Ag85A, a novel tuberculosis vaccine, is safe in adolescents and children, and induces polyfunctional CD4+ T cells," Eur J Immunol, 40(1):279-290 (2010).
Sedegah et al., "Protection against malaria by immunization with plasmid DNA encoding circumsporozoite protein," PNAS, 91(21):9866-9870 (1994).
Segal et al., "Epitope Landscape in Breast and Colorectal Cancer," Cancer Res, 68: 889-892 (2008).

(56) References Cited

OTHER PUBLICATIONS

Sensi et al., "Unique Tumor Antigenesis: Evidence for Immune Control of Genome Integrity and Immunogenic for T Cell-Mediated Patient-Specific Immunotherapy," Clin Cancer Res, 12(7): :5023-5032 (2006).
Sette et al., "Peptide binding to the most frequent HLA-A class I alleles measured by quantitative molecular binding assays," Molecular Immunology, 31(11): 813-822 (1994).
Sette et al., "The relationship between class I binding affinity and immunogenicity of potential cytotoxic T cell epitopes," J Immunol, 153:5586-5592 (1994).
Shames et al., "A Genome-Wide Screen for Promoter Methylation in Lung Cancer Identifies Novel Methylation Markers for Multiple Malignancies," PLoS Med, 3(12):e486 (2006).
Sharei et al., "Ex Vivo Cytosolic Delivery of Functional Macromolecules to Immune Cells," PLoS One, 10(4):e0118803 (2015).
Sharma et al., "Novel cancer immunotherapy agents with survival benefit: recent successes and next steps," Nat Rev Cancer, 11(11):805-812 (2011).
Shastri et al., "Presentation of endogenous peptide/MHC class I complexes is profoundly influenced by specific C-terminal flanking residues," J Immunol, 155:4339 (1995).
Shida, "Effects and virulences of recombinant vaccinia viruses derived from attenuated strains that express the human T-cell leukemia virus type I envelope gene," J Virol, 62(12):4474-4480 (1988).
Shukla et al., "Topics in Cancer Genomics," Graduate Theses and Dissertations, Paper 13796 (2014). [accessed online] https://search.proquest.com/docview/1558874754.
Sidney et al., "Measurement of MHC/Peptide Interactions by Gel Filtration or Monoclonal Antibody Capture," Curr Protoc Immunol: 18.3.1-18.3.36 (2013).
Siegmund et al., "Inferring clonal expansion and cancer stem cell dynamics from DNA methylation patterns in colorectal cancers," PNAS, 106(12):4828-4833 (2009).
Singh-Jasuga et al., "Correlation of T-cell response, clinical activity and regulatory T-cell levels in renal cell carcinoma patients treated with IMA901, a novel multi-peptide vaccine," J Clin Conology, 25:18S, Abstract #3017 (2007).
Sizemore, "Attenuated Shigella as a DNA Delivery Vehicle for DNA-Mediated Immunization," Science, 270(5234):299-303 (1995).
Sjoblom et al., "The Consensus Coding Sequences of Human Breast and Colorectal Cancers," Science, 314(5797):268-274 (2006).
Slingluff et al., "Immunologic and Clinical Outcomes of a Randomized Phase II Trial of Two Multipeptide Vaccines for Melanoma in the Adjuvant Setting," Clin Cancer Res, 13(21):6386-6395 (2007).
Smith et al., "Construction and characterization of an infectious vaccinia virus recombinant that expresses the influenza hemagglutinin gene and induces resistance to influenza virus infection in hamsters," PNAS, 80(23):7155-7159 (1983).
Smith et al., "Infectious vaccinia virus recombinants that express hepatitis B virus surface antigen," Nature, 302:490-495 (1983).
Snyder et al., "Genetic Basis for Clinical Response to CTLA-4 Blockade in Melanoma," New Engl J Med, 371(23):2189-2199 (2014).
Snyder et al., "Immunogenic peptide discovery in cancer genomes," Cuff Opin Genet Dev, 30:7-16 (2015).
Soiffer et al., "Vaccination with irradiated autologous melanoma cells engineered to secrete human granulocyte-macrophage colony-stimulating factor generates potent antitumor immunity in patients with metastatic melanoma," PNAS, 95(22):13141-13146 (1998).
Soiffer et al., "Vaccination With Irradiated, Autologous Melanoma Cells Engineered to Secrete Granulocyte-Macrophage Colony-Stimulating Factor by Adenoviral-Mediated Gene Transfer Augments Antitumor Immunity in Patients With Metastatic Melanoma," J Clin Oncol, 21(17):3343-3350 (2003).
Sokolov., "Primer Extension Technique for the Detection of Single Nucleotide in Genomic DNA," Nucleic Acids Res. 18(12): 3671 (1990).

Sommnerfeit et al., "Receptor interference groups of 20 retroviruses plating on human cells," Virol, 176:58-59 (1990).
Speiser et al., "Molecularly defined vaccines for cancer immunotherapy, and protective T cell immunity," Semin Immunol, 22(3):144-154 (2010).
Spitler, "Cancer Vaccines: The Interferon Analogy," Cancer Biother, 10:1-3 (1995).
Staehler et al., "An open label study to evaluate the safety and immunogenicity of the peptide based cancer vaccine IMA901," ASCO meeting 2007; Abstract No. 3017.
Stahl-Hennig et al., "Synthetic double-stranded RNAs are adjuvants for the induction of T helper 1 and humoral immune responses to human papillomavirus in rhesus macaques," PLoS pathogens, 5(4):e1000373 (2009).
Stankovic et al., "Microarray Analysis Reveals that TP53- and ATM-Mutant B-CLLs Share a Defect in Activating Proapoptotic Responses after DNA Damage but are Distinguished byMajor Differences in Activating Prosurvival Responses," Blood, 103:291-300 (2004).
Stover et al., "New Use of BCG for Recombinant Vaccines," Nature, 351(6326): 456-460 (1991).
Stratton et al., "The Cancer Genome," Nature, 458(7239):719-724 (2009).
Su et al., "Immunological and Clinical Responses in Metastatic Renal Cancer Patients Vaccinated with Tumor RNA-Transfected Dendritic Cells," Cancer Res, 63: 2127-2133 (2003).
Submission in opposition proceedings of EP 2569633, dated Jun. 28, 2017.
Sullivan et al., "Expression and Characterization of Herpes Simplex Virus Type 1 (HSV-1) Glycoprotein G (gG) by Recombinant Vaccinia Virus: Neutralization of HSV-1 Infectivity with Anti-gG Antibody," Gen Vir, 68:2587-2598 (1987).
Syvanen et al., "A Primer-Guided Nucleotide Incorporatiopn Assay in the Genotyping of Apoliprotein E," Genomics, 8(4): 684-692 (1990).
Syvanen et al., "Identification of Individuals by Analysis of Biallelic DNA Markers, Using PCR and Solid-Phase Minisequencing," Am J Hum Genet, 52(1): 46-59 (1993).
Table S4 Somatic mutations Identified in Breast or Colorectal Cancers filed on Nov. 7, 2016 in Notice of Opposition by Gritstone Oncology Inc. to EP 2569633.
Table S5 Breast CAN-genes, filed on Nov. 7, 2016, in Notice of Opposition by Gritstone Oncology Inc., to EP Patent No. 2569633.
Table S6 Colorectal CAN-genes, filed on Nov. 7, 2016 in Notice of Opposition by Gritstone Oncology Inc. to EP Patent No. 2569633.
Tartaglia et al., "NYVAC: A highly attenuated strain of vaccinia virus," Virology, 188(1):217-232 (1992).
Thomas et al., "High-Throughput Oncogene Mutation Profiling in Human Cancer," Nat Genet, 39: 347-351 (2007).
Thompson et al., "Aberrations of the B-Cell Receptor B29 (CD79b) Gene in Chronic Lymphocytic Leukemia," Blood, 90(4):1387-1394 (1997).
Thornton et al., "Characterisation of TP53 Abnormalities in Chronic Lymphocytic Leukaemia," Hematol J, 5: 47-54 (2004).
Timmerman et al., "Idiotype-Pulsed Dendritic Cell Vaccination for B-Cell Lymphoma: Clinical and Immune Responses in 35 Patients," Blood, 99: 1517-1526 (2002).
Tjoa et al., "Follow-Up Evaluation of Prostate Cancer Patients Infused with Autologous Dendritic Cells Pulsed with PSMA Peptides," Prostate, 32(4): 272-278 (1997).
Tjoa et al., "Follow☐up evaluation of prostate cancer patients infused with autologous dendritic cells pulsed with PSMA peptides," The Prostate, 32(4):272-278 (1997).
Tong et al., "Methods and protocols for prediction of immunogenic epitopes, Briefings in Bioinformatics," 8(2): 96-108 (2008).
Tourdot et al., "A general strategy to enhance immunogenicity of low-affinity HLA-A2.1-associated peptides: implication in the identificatiioonn of cryptic tumor epitopes," Eur. J. Immunol, 30:3411-3421 (2000).
Toze et al., "Myeloablative Allografting for Chronic Lymphocytic Leukemia: Evidence for Potent Graft-versus-Leukemia Effect Associated with Graft-versus-Host Disease," Bone Marrow Transplant, 36: 825-830 (2005).

(56) References Cited

OTHER PUBLICATIONS

Tumeh et al., "PD-1 blockade induces responses by inhibiting adaptive immune resistance," Nature, 515(7528):568-571 (2014).
U.S. Final Office Action dated May 25, 2017 and issued in U.S. Appl. No. 15/187,174.
U.S. Final Rejection dated Sep. 13, 2017 and issued in U.S. Appl. No. 14/794,449.
U.S. Non-Final Office Action dated Jan. 22, 2018 and issued in U.S. Appl. No. 15/187,174.
U.S. Non-Final Office Action dated Dec. 5, 2016 and issued in U.S. Appl. No. 15/187,174.
U.S. Non-Final Office Action dated Dec. 29, 2016 and issued in U.S. Appl. No. 14/794,449.
Ueda et al., "Germ Line and Somatic Mutations of BRAF V599E in Ovarian Carcinoma," Int J Gynecol Cancer, 17: 794-797 (2007).
Ugozzoli et al., "Detection of Specific Alleles by Using Allele-Specific Primer Extension Followed by Capture on Solid Support," Genet Anal Tech AppL, 9(4): 107-112 (1992).
UniProtKB Printouts—Q5SVV79 filed on Nov. 2016 in Muller Opposition to EP 2569633.
Van de Roemer et al., "P1737:IVAC: Individualized vaccines for cancer," Immunology 137(Suppl. 1):715, Sep. 2012.
Van der Bruggen et al., "A Gene Encoding an Antigen Recognized by Cytolytic T Lymphocytes on a Human Melanoma," Science, 254: 1643-1647 (1991).
Van Pel et al., "Tumor Cell Variants Obtained by a Mutageneis of a Lewis Lung Carcinoma Cell Line: Immune Rejection by Syngeneic Mice," PNAS, 76(10): 5282-5285 (1979).
Van Rooij et al., "Tumor Exome Analysis Reveals Neoantigen-Specific T-Cell Reactivity in an 1pilimumab-Responsive Melanoma," Journal of Clinical Oncology, 31(32):e439-e442 (2013).
Van Trappen et al., "Somatic Mitochondrial DNA Mutations in Primary and Metastatic Ovarian Cancer," Gynecol Oncol, 104: 129-133 (2007).
Verardi et al., "A vaccinia virus renaissance: new vaccine and immunotherapeutic uses after smallpox eradication," Human vaccines & immunotherapeutics, 8(7):961-970 (2012).
Verhoef et al., "Des-enkephalin-γ-endorphin (DEγE): Biotransformation in rat, dog and human plasma," Eur J Drug Metab Ph, 11(4):291-302 (1986).
Vogelstein et al., "Cancer Genome Landscapes," Science, 339(6127): 1546-1558 (2013).
Volpe et al., "Alternative BCR/ABL Splice Variants in Philadelphia Chromosome-Positive Leukemias Result in Novel Tumor-Specific Fusion Proteins that May Represent Potential Targets for Immunotherapy Approaches," Cancer Res, 67(11):5300-5307 (2007).
Von Krempelhuber et al., "A randomized, double-blind, dose-finding Phase II study to evaluate immunogenicity and safety of the third generation smallpox vaccine candidate IMVAMUNE®," Vaccine, 28(5):1209-1216 (2010).
Von Mehren et al., "Pilot study of a dual gene recombinant avipox vaccine containing both carcinoembryonic antige (CEA.) and B7.1 transgenes in patients with, recurrent CEA-expressing adenocarcinomas," Clin Cancer Res, 6:2219-28 (2000).
Walter et al., "DNA Methylation Profiling Defines Clinically Relevant Biological Subsets of Non-small Cell Lung Cancer," Clin Cancer Res, 18(8):2360-2373 (2012).
Walter et al., "Multipeptide immune response to cancer vaccine IMA901 after single-dose cyclophosphamide associates with longer patient survival," Nature medicine, 18(8):1254 (2012).
Wang, "Tumor Antigens Discovery: Perspectives for Cancer Therapy", Molecular Medicine, 3(11): 716-731 (1997).
Watson et al., "SHP-1: the next checkpoint target for cancer immunotherapy?," Biochem Soc Trans, 44(2):356-362 (2016).
Weber et al., "Safety, Efficacy, and Biomarkers of Nivolumab With Vaccine in Ipilimumab-Refractory or—Naive Melanoma," J Clin Oncol, 31:4311-4318 (2013).
Webster et al., "Enhanced T cell-mediated protection against malaria in human challenges by using the recombinant poxviruses FP9 and modified vaccinia virus Ankara," Proceedings of the National Academy of Sciences, 102(13):4836-4841 (2005).
Weiner et al., "Genetic vaccines," Scientific American, 281(1):50-57 (1999).
Weinschenk et al., "Integrated Functional Genomics Approach for the Design of Patientindividual Antitumor Vaccines," Cancer Res, 62: 5818-5827 (2002).
Weyer et al., "Generation and evaluation of a recombinant modified vaccinia virus Ankara vaccine for rabies," Vaccine, 25(21):4213-4222 (2007).
Weyer et al., "Poxvirus-vectored vaccines for rabies—a review," Vaccine, 27(51):7198-7201 (2009).
Whelan et al., "Safety and immunogenicity of boosting BCG vaccinated subjects with BCG: comparison with boosting with a new TB vaccine, MVA85A," PLoS One, 4(6):e5934 (2009).
Wiktor et al., "Protection from rabies by a vaccinia virus recombinant containing the rabies virus glycoprotein gene," Proceedings of the National Academy of Sciences, 81(22):7194-7198 (1984).
Willmore-Payne et al., "Human Malignant Melanoma: Detectection of BRAF- and c-kit-Activating Mutations by High-Resolution Amplicon Melting Analysis," Hum Pathol, 36: 486-493 (2005).
Wilson et al., "Formation of infectious hybrid virions with gibbon ape leukemia virus and human T-cell leukemia virus retroviral envelope glycoproteins and the gag and pol proteins of Moloney murine leukemia virus," Journal of virology, 63(5):2374-2378 (1989).
Wolfel et al., "A p16INK4a-insensitive CDK4 mutant targeted by cytolytic T lymphocytes in a human melanoma," Science, 269(5228):1281-1284 (1995).
Wolff et al., "Direct Gene Transfer into Mouse Muslce in Vivo," Science, 247(4949):1465-1468 (1990).
Wood et al., "The Genomic Landscapes of Human Breast and Colorectal Cancers," Science, 318: 1108-1113 (2007).
Woodbury et al., "Introduction to Macromolecular Binding Equilibria," CRC Press, 13:978 (2007).
Wu et al., "Detection of a potent humoral response asscoiated with immune-induced remission of chronic myelogenous leukemia," J Clin Invest, 106(5):705-714 (2000).
Wu et al., "Graft-versus-Leukemia Target Antigens in Chronic Myelogenous Leukemia Are Expressed on Myeloid Progenitor Cells," Clin Cancer Res, 11(12):4504-4511 (2005).
Wu et al., "Induction of Tumor Immunity Following Allogeneic Stem Cell Transplantation," Adv Immunol, 90: 133-173 (2006).
Wu et al., "Mouse Model of Human Ovarian Endometrioid Adenocarcinoma Based on Somatic Defects in the Wnt/6-Catenin and PI3K/Pten Signaling Pathways," Cancer Cell, 11: 321-333 (2007).
Wu et al., "Reconstitution of T-Cell Receptor Repertoire Diversity Following T-Cell Depleted Allogeneic Bone Marrow Transplantation is Related to Hematopoietic Chimerism," Blood, 95: 352-359 (2000).
Wyatt et al., "Marker rescue of the host range restriction defects of modified vaccinia virus Ankara," Virology, 251(2):334-342 (1998).
Wyatt et al., "Multiprotein HIV type 1 Glade B DNA and MVA vaccines: construction, expression, and immunogenicity in rodents of the MVA component," AIDS research and human retroviruses, 20(6):645-653 (2004).
Yang et al. "CML66, a broadly immunogenic tumor antigen, elicits a humoral immune response associated with remission of chronic myelogenous leukemia," PNAS, 98(13):7492-7497 (2001).
Yao et al., "Advances in targeting cell surface signalling molecules for immune modulation," Nature Rev Drug Discov, 12:130-146 (2013).
Yilma, "Prospects for the total eradication of rinderpest," Vaccine, 7(6):484-485 (1989).
Yokoyama et al., "Matrilysin (MMP-7) Is a Novel Broadly Expressed Tumor Antigen Recognized by Antigen-Specific T Cells," Clin Cancer Res, 14(17): 5503-5511 (2008).
Yosef et al., "Dynamic regulatory network controlling TH17 cell differentiation," Nature, 496(7446):461-468 (2013).
You et al., "Understanding Prediction Systems for HLA-Binding Peptides and T-Cell Epitope Identification," Pattern Recognition in Bioinformatics, Lecture Notes in Computer Science, 4474: 337-348 (2007).

(56) References Cited

OTHER PUBLICATIONS

Zhang et al., "Graft-versus-Leukemia Antigen CML66 Elicits Coordinated B-Cell and T-Cell Immunity after Donor Lymphocyte Infusion," Clin Cancer Res, 16: 2729-2739 (2010).
Zhang et al., "Intratumoral T Cells, recurrence, and survival in epithelial ovarian cancer," New Engl J Med, 348(3):203-213 (2003).
Zhang et al., "Machine learning competition in immunology-prediction of HLA class I molecules," J Immunol Methods 374:1-4 (2009).
Zhou et al., "Diverse CD8+ T-Cell Responses to Renal Cell Carcinoma Antigens in Patients Treated with an Autologous Granulocyte-Macrophage Colony-Stimulating Factor Gene-Transduced Renal Tumor Cell Vaccine," Cancer Res, 65: 1079-1088 (2005).
Zhou et al., "Long-term outcome after haploidentical stem cell transplant and infusion of T cells expressing the inducible caspase 9 safety transgene," Blood, 123(25):3895-3905 (2014).
Zhou et al., "Transcriptional regulatory networks in Th17 cell differentiation," Curr Opin Immunol, 21(2):146-152 (2009).
Zhou et al., Persistance of Multiple Tumor-Specific T-Cell Clones is Associated with Complete Tumor Regression in a Melanoma Patient Receiving Adoptive Cell transfer Therapy, J Immunother, 28(1):53-62 (2005).
Zitvogel et al., "Immunological aspects of cancer chemotherapy," Nature reviews immunology, 8:59 (2008).
A. Cai, et al., Mutated BCR-ABL Generates Immunogenic T-Cell Epitopes in CML Patients, Clinical Cancer Research) Aug. 21, 2012) vol. 18, No. 20, p. 5761-5772.
L. Van Den Broeke, et al., Identification and Epitope Enhancement of a PAX-FKHR Fusion Protein Breakpoint Epitope in Alveolar Rhabdomyosarcoma Cells Created by a Tumorigenic Chromosomal Translocation Inducing CTL Capable of Lysing Human Tumors, Cancer Research, American Association for Cancer Research, US (Feb. 1, 2006) vol. 66, No. 3, p. 1818-1823.
E. Fritsch, et al., HLA-Binding Properties of Tumor Neoepitopes in Humans, Cancer Immunology Research (Jun. 2014) vol. 2, No. 6, p. 522-529.
Acevedo et al., "Analysis of the mechanisms mediating tumor-specific changes in gene expression in human liver tumors," Cancer Res, 68(8):2641-2651 (2008).
Adams, "Toll-like receptor agonists in cancer therapy," Immunotherapy, 1(6):949-964 (2009).
Akiyama et al., "GATA-4 and GATA-5 transcription factor genes and potential downstream antitumor target genes are epigenetically silenced in colorectal and gastric cancer," Mol Cell Biol, 23:8429-8439 (2003).
Alarcon et al., "DNA vaccines: technology and application as anti-parasite and anti-microbial agents," Advances in Parasitology, 42:343-410 (1999).
Ali et al., "In situ regulation of DC subsets and T cells mediates tumor regression in mice," Cancer Immunotherapy, 1(8):1-10 (2009).
Ali et al., "Infection-mimicking materials to program dendritic cells in situ," Nat Mater, 8:151-8 (2009).
Almeida et al., "CTdatabase: a knowledge-base of high- throughput and curated data on cancer-testis antigens," Nucleic acids research, 37:D816-819 (2008).
Altman et al., "Phenotypic analysis of antigen-specific T lymphocytes," Science, 274(5284):94-6 (1996).
Anders et al., "HTSeq-A Python framework to work with high-throughput sequencing data," Bioinformatics, 31(2):166-169 (2015).
Andersen et al., "Parallel detection of antigen-specific T cell responses by combinatorial encoding of MHC multimers," Nature protocols, 7(5):891-902 (2012).
Ausubel, "A botanical macroscope," Proceedings of the National Academy of Sciences, 106(31):12569-12570 (2009).
Balazsi et al., "Cellular decision making and biological noise: from microbes to mammals," Cell, 144(6):910-925 (2011).
Balch et al., "Final version of 2009 AJCC melanoma staging and classification," Journal of clinical oncology, 27(36):6199-6206 (2009).
Barbie et al., "Systematic RNA interference reveals that oncogenic KRAS-driven cancers require TBK1," Nature, 462:108-112 (2009).

Barretina et al., "The Cancer Cell Line Encyclopedia enables predictive modelling of anticancer drug sensitivity," Nature, 483:603-607 (2012).
Baylin, "A decade of exploring the cancer epigenome-biological and translational implications," Nat Rev Cancer, 11:726-734 (2005).
Baylin, "DNA methylation and gene silencing in cancer," Nat Clin Pract Oncol 2, Suppl 1, S4-11 (2005).
Benson, "Tandem repeats finder: a program to analyze DNA sequences," Nucleic acids research, 27(2):573-580 (1999).
Benton et al., "Screening lambdagt recombinant clones by hybridization to single plaques in situ," Science, 196(4286):180-182 (1977).
Berger et al., "The genomic complexity of primary human prostate cancer," Nature, 470:214-220 (2011).
Berger et al.,"Melanoma genome sequencing reveals frequent PREX2 mutations," Nature, 485(7399):502 (2012).
Berman et al., "Regions of focal DNA hypermethylation and long-range hypomethylation in colorectal cancer coincide with nuclear lamina-associated domains," Nat Genet, 44:40-46 (2012).
Bindea et al., "Spatiotemporal dynamics of intratumoral immune cells reveal the immune landscape in human cancer," Immunity, 39:782-795 (2013).
Bird, "DNA methylation patterns and epigenetic memory," Genes Dev, 16:6-21 (2002).
Birrell et al., "A genome-wide screen in *Saccharomyces cerevisiae* for genes affecting UV radiation sensitivity," Proceedings of the National Academy of Sciences 98(22):12608-12613 (2001).
Bishop et al., "APOBEC-mediated editing of viral RNA," Science, 305:645 (2004).
Bock et al., "BiQ Analyzer: visualization and quality control for DNA methylation data from bisulfite sequencing," Bioinformatics, 21:4067-4068 (2005).
Bock et al., "Reference Maps of human ES and iPS cell variation enable high-throughput characterization of pluripotent cell lines," Cell, 144:439-452 (2011).
Bogunovic et al., "TLR4 engagement during TLR3-induced proinflammatory signaling in dendritic cells promotes IL-10-mediated suppression of antitumor immunity," Cancer Res, 71(16):5467-5476 (2011).
Boller et al. "Characterization of the antibody response specific for the human endogenous retrovirus HTDV/HERV-K," Journal of virology, 7I(6):4581-4588 (1997).
Boquest et al., "Isolation and transcription profiling of purified uncultured human stromal stem cells: alteration of gene expression after in vitro cell culture," Molecular biology of the cell, 16(3):1131-1141 (2005).
Boscardin et al., "Antigen targeting to dendritic cells elicits long-lived T cell help for antibody responses," Journal of Experimental Medicine, 203(3):599-606 (2006).
Boyle et al., "Gel-free multiplexed reduced representation bisulfite sequencing for large-scale DNA methylation profiling," Genome Biol, 13:R92 (2012).
Boyle et al., "Tapasin-related protein TAPBPR is an additional component of the MHC class I presentation pathway," Proceedings of the National Academy of Sciences, 110: 3465-3470 (2013).
Bozic et al., "Dynamics of targeted cancer therapy," Trends Mol Med, 18:311-316 (2012).
Bozic et al., "Evolutionary dynamics of cancer in response to targeted combination therapy," Elife, 2:e00747 (2013).
Brahmer et al., "Safety and activity of anti-PD-L1 antibody in patients with advanced cancer," N Engl J Med, 366(26):2455-2465 (2012).
Brown et al., "Integrative genomic analysis implicates gain of PIK3CA at 3g26 and MYC at 8q24 in chronic lymphocytic leukemia," Clin Cancer Res, 8:3791-802 (2012).
Burger et al., "B cell receptor signaling in chronic lymphocytic leukemia," Trends Immunol, 34:592-601 (2013).
Burkhardt et al., "Autologous CLL cell vaccination early after transplant induces leukemia-specific T cells," The Journal of clinical investigation, 123(9):3756-3765 (2013).
Buser et al., "Unique composite hematolymphoid tumor consisting of a pro-T lymphoblastic lymphoma and an indeterminate dendritic

(56) References Cited

OTHER PUBLICATIONS cell tumor: evidence for divergent common progenitor cell differentiation," Pathobiology, 81:199-205 (2014).
Byrd et al., "Targeting BTK with ibrutinib in relapsed chronic lymphocytic leukemia," The New England journal of medicine, 369:32-42 (2013).
Bystryn et al., "Double-blind trial of a polyvalent, shed-antigen, melanoma vaccine," Clin Cancer Res, 7(7):1882-1887 (2001).
Cahill et al., "450K-array analysis of chronic lymphocytic leukemia cells reveals global DNA methylation to be relatively stable over time and similar in resting and proliferative compartments," Leukemia, 27:150-158 (2013).
Cancer Genome Atlas Network, "Comprehensive molecular characterization of human colon and rectal cancer," Nature, 487:330-337 (2012).
Cancer Genome Atlas Network, "Comprehensive molecular portraits of human breast tumours," Nature, 490:61-70 (2012).
Cancer Genome Atlas Research Network, "Comprehensive genomic characterization defines human glioblastoma genes and core pathways," Nature, 455(7216):1061-1068 (2008).
Cancer Genome Atlas Research Network, "Comprehensive genomic characterization of squamous cell lung cancers," Nature, 489, 519-525 (2012).
Cancer Genome Atlas Research Network, "Comprehensive molecular characterization of clear cell renal cell carcinoma," Nature, 499:43-49 (2013).
Cancer Genome Atlas Research Network, "Comprehensive molecular characterization of gastric adenocarcinoma," Nature, 513:202-209 (2014).
Cancer Genome Atlas Research Network, "Genomic and epigenomic landscapes of adult de novo acute myeloid leukemia," New England Journal of Medicine, 368(22):2059-2074 (2013).
Cancer Genome Atlas Research Network, "Integrated genomic analyses of ovarian carcinoma," Nature, 474: 609-615 (2011).
Carter et al., "Absolute quantification of somatic DNA alterations in human cancer," Nat Biotechnol, 30:413-21 (2012).
Carter et al., "Accurate estimation of homologue-specific DNA concentration-ratios in cancer samples allows long-range haplotyping," Nature Precedings, 59-87 (2011).
Castle et al., "Exploiting the mutanome for tumor vaccination," Cancer research, 72(5):1081-1091 (2012).
CBOL Plant Working Group, "A DNA barcode for land plants," PNAS, 106(31):12794-12797 (2009).
Chang et al., "Immune selection of hot-spot beta 2-microglobulin gene mutations, HLA-A2 allospecificity loss, and antigen-processing machinery component down-regulation in melanoma cells derived from recurrent metastases following immunotherapy," Journal of immunology, 174:1462-1471 (2005).
Chapman et al., "Initial genome sequencing and analysis of multiple myeloma," Nature, 471:467-472 (2011).
Cheever, "Twelve immunotherapy drugs that could cure cancers," Immunological reviews, 222:357-368 (2008).
Chen et al., "Impact of replication timing on non-CpG and CpG substitution rates in mammalian genomes," Genome Res, 20:447-457 (2010).
Chen et al., "Langerhans Cell Sarcoma Arising from Chronic Lymphocytic Lymphoma/Small Lymphocytic Leukemia: Lineage Analysis and BRAF V600E Mutation Study," N Am J Sci, 5:386-91 (2013).
Chen et al., "Molecular mechanisms of T cell co-stimulation and co-inhibition," Nature reviews Immunology, 13:227-242 (2013).
Chim et al., "Epigenetic dysregulation of the Wnt signalling pathway in chronic lymphocytic leukaemia," J Clin Pathol, 61:1214-1219 (2008).
Chiron et al., "Cell-cycle reprogramming for PI3K inhibition overrides a relapse-specific C481S BTK mutation revealed by longitudinal functional genomics in mantle cell lymphoma," Cancer Discov, 4:1022-35 (2014).
Christian et al., "Targeting DNA double-strand breaks with TAL effector nucleases," Genetics, 186(2):757-761 (2010).

Church, "Genomes for all," Sci Am, 294(1):46-54 (2006).
Cibulskis et al., "ContEst: estimating cross-contamination of human samples in next-generation sequencing data," Bioinformatics, 27:2601-2602 (2011).
Cibulskis et al., "Sensitive detection of somatic point mutations in impure and heterogeneous cancer samples," Nat Biotechnol, 31:213-9 (2013).
Cleveland, "LOWESS: A program for smoothing scatterplots by robust locally weighted regression," The American Statistician, 35:54 (1981).
Coulie et al., "A mutated intron sequence codes for an antigenic peptide recognized by cytolytic T lymphocytes on a human melanoma," Proc Natl Acad Sci USA, 92(17):7976-7980 (1995).
De et al., "Aberration in DNA methylation in B-cell lymphomas has a complex origin and increases with disease severity," PLoS Genet. 9:e1003137 (2013).
De Magalhaes et al., "Next-generation sequencing in aging research: emerging applications, problems, pitfalls and possible solutions," Ageing Research Reviews, 9(3):315-323 (2010).
DeLuca et al., "Rna-SeQC: RNA-seq metrics for quality control and process optimization," Bioinformatics, 28:1530-2 (2012).
DePristo et al., "A framework for variation discovery and genotyping using next-generation DNA sequencing data," Nature Genetics, 43:491-498 (2011).
Ding et al., "Somatic mutations affect key pathways in lung adenocarcinoma," Nature, 455:1069-1075 (2008).
Dohner et al., "Genomic aberrations and survival in chronic lymphocytic leukemia," The New England journal of medicine, 343:1910-1916 (2000).
Doody et al., "PRDMI/BLIMP-1 Modulates IFN—Dependent Control of the MHC Class I Antigen-Processing and Peptide-Loading Pathway," The Journal of Immunology, 179:7614-7623 (2007).
Dubey et al., "The immunodominant antigen of an ultraviolet-induced regressor tumor is generated by a somatic point mutation in the DEAD (SEQ ID No: 62) box helicase p68," The Journal of experimental medicine, 185(4):695-705 (1997).
Eckhardt et al., "DNA methylation profiling of human chromosomes 6, 20 and 22," Nat Genet, 38:1378-1385 (2006).
Eden et al., "Discovering motifs in ranked lists of DNA sequences," PLoS computational biology, 3, e39 (2007).
Eden et al., "GOrilla: a tool for discovery and visualization of enriched GO terms in ranked gene lists," BMC bioinformatics, 10:48 (2009).
Eggermont et al., "Ulceration and stage are predictive of interferon efficacy in melanoma: results of the phase III adjuvant trials EORTC 18952 and EORTC 18991," Eur J Cancer, 48(2):218-225 (2012).
Ehrlich, "DNA hypomethylation in cancer cells," Epigenomics, 1:239-259 (2009).
Engler et al., "A one pot, one step, precision cloning method with high throughput capability," PloS one 3(11):e3647 (2008).
Engler et al., "Golden gate shuffling: a one-pot DNA shuffling method based on type IIs restriction enzymes," PloS one, 4(5):e5553 (2009).
Escobar et al., "Bayesian density estimation and inference using mixtures," Journal of the American Statistical Association, 90:577-588 (1995).
Fais et al., "Chronic lymphocytic leukemia B cells express restricted sets of mutated and unmutated antigen receptors," The Journal of clinical investigation, 102:1515-25 (1998).
Fan et al., "The multi substrate adapter Gabl regulates hepatocyte growth factor (scatter factor)-c-Met signaling for cell survival and DNA repair," Molecular and cellular biology, 21:4968-4984 (2001).
Fantom Consortium et al., "A promoter-level mammalian expression atlas," Nature, 507:462-470 (2014).
Feigner et al., "Lipofection: a highly efficient, lipid-mediated DNA-transfection procedure," PNAS, 84(21):7413-7414 (1987).
Fisher et al., "A scalable, fully automated process for construction of sequence-ready human exome targeted capture libraries," Genome Biol, 12:R1 (2011).
Flaherty et al., "From genes to drugs: targeted strategies for melanoma," Nat Rev Cancer, 12(5):349-361 (2012).

(56) References Cited

OTHER PUBLICATIONS

Flynn et al., "Immunization with HIV Gag targeted to dendritic cells followed by recombinant New York vaccinia virus induces robust T-cell immunity in nonhuman primates," Proc Natl Acad Sci, 108(17):7131-7136 (2011).
Forconi et al., "Genome-wide DNA analysis identifies recurrent imbalances predicting outcome in chronic lymphocytic leukaemia with 17p deletion," British journal of haematology, 143:532-6 (2008).
Fransen et al., "Controlled local delivery of CTLA-4 blocking antibody induces CD8+ T-cell-dependent tumor eradication and decreases risk of toxic side effects," Clin Cancer Res, 19(19):5381-5389 (2013).
Fritsch et al., "Translational repression of MCL-1 couples stress-induced eIF2 alpha phosphorylation to mitochondrial apoptosis initiation," The Journal of biological chemistry, 282:22551-62 (2007).
Furman et al., "Ibrutinib resistance in chronic lymphocytic leukemia," The New England journal of medicine, 370(24):2352 (2014).
Furman et al., "Idelalisib and rituximab in relapsed chronic lymphocytic leukemia," The New England journal of medicine, 370:997-1007 (2014).
Gao et al., "Integrative analysis of complex cancer genomics and clinical profiles using the cBioPortal," Science signaling, 6(269):pi1 (2013).
Garimella et al., "Identification of novel molecular regulators of tumor necrosis factor-related apoptosis-inducing ligand (TRAIL)-induced apoptosis in breast cancer cells by RNAi screening," Breast cancer research, 16(2):R41 (2014).
Garofalo et al., "miR-221&222 regulate TRAIL resistance and enhance tumorigenicity through PTEN and TIMP3 downregulation," Cancer Cell, 16(6):498-509 (2009).
Garraway et al., "Lessons from the cancer genome," Cell, 153:17-37 (2013).
Gaucher et al., "Yellow fever vaccine induces integrated multilineage and polyfunctional immune responses," The Journal of experimental medicine, 205(13):3119-3131 (2008).
Gevaert et al., "Protein identification methods in proteomics," Electrophoresis: An International Journal, 21(6):1145-1154 (2000).
Giaever et al., "Functional profiling of the Saccharomyces cerevisiae genome," Nature, 418(6896):387-391 (2002).
Giannopoulos et al., "Peptide vaccination elicits leukemia-associated antigen-specific cytotoxic CD8+ T-cell responses in patients with chronic lymphocytic leukemia," Leukemia, 24(4):798-805 (2010).
Gibbs et al., "Abundant quantitative trait loci exist for DNA methylation and gene expression in human brain," PLoS genetics, 6:e1000952 (2010).
Gros et al., "PD-1 identifies the patient-specific CD8+ tumor-reactive repertoire infiltrating human tumors," The Journal of clinical investigation, 124(5):2246-2259 (2014).
Grunstein et al., "Colony hybridization: a method for the isolation of cloned DNAs that contain a specific gene," PNAS, 72(10):3961-3965 (1975).
GTEx Consortium, The Genotype-Tissue Expression (GTEx) project, Nature genetics, 45:580-585 (2013).
Guo et al., "Droplet microfluidics for high-throughput biological assays," Lab Chip, 12:2146-55 (2012).
Guthals et al., "Shotgun Protein Sequencing with Meta-contig Assembly," Molecular and Cellular Proteomics, 1(10):1084-96 (2012).
Hadrup et al., "Parallel detection of antigen-specific T-eeil responses by multidimensional encoding of MHC multimers," Nature Methods, 6(7):520-26 (2009).
Hall, "Advanced sequencing technologies and their wider impact in microbiology," Journal of experimental biology, 210(9):1518-1525 (2007).
Hanahan et al., "Hallmarks of cancer: the next generation," Cell, 144:646-674 (2011).
Hansen et al., "Increased methylation variation in epigenetic domains across cancer types," Nat Genet, 43:768-775 (2011).
Hanzelmann et al., "GSVA: gene set variation analysis for microarray and RNA-Seq data," BMC bioinformatics, 14:7 (2013).
Harris et al., "Comparison of sequencing-based methods to profile DNA methylation and identification of monoallelic epigenetic modifications," Nat Biotechnol, 28:1097-1105 (2010).
Harris et al., "RNA editing enzyme APOBECI and some of its homologs can act as DNA mutators," Molecular cell, 1095):1247-1253 (2002).
Heemskerk et al., "The cancer antigenome," EMBO Journal, 32(2):194-203 (2013).
Herbeuval et al., "HAART reduces death ligand but not death receptors in lymphoid tissue of HIV-infected patients and simian immunodeficiency virus-infected macaques," AIDS, 23:35-40 (2009).
Herman et al., "ibrutinib-induced lymphocytosis in patients with chronic lymphocytic leukemia: correlative analyses from a phase II study," Leukemia, 28:2188 (2014).
Hinrichs et al., "Exploiting the curative potential of adoptive T-cell therapy for cancer," Immunological reviews, 257:56-71 (2014).
Hombrink et al., "High-Throughput Identification of Potential Minor Histocompatibility Antigens by MHC Tetramer-Based Screening: Feasibility and Limitations," Plos One, 6(8):1-11 (2011).
Honigberg et al., "The Bruton tyrosine kinase inhibitor PCI-32765 blocks B-cell activation and is efficacious in models of autoimmune disease and B-cell malignancy," PNAS, 107:13075-13080 (2010).
Illingworth et al., "Orphan CpG islands identify numerous conserved promoters in the mammalian genome," PLoS Genet, 6(9):e1001134 (2010).
Inokuchi et al., "DCC protein expression in hematopoietic cell populations and its relation to leukemogenesis," J Clin Invest, 97:852-857 (1996).
Izeradjene et al., "Casein kinase II (CK2) enhances death-inducing signaling complex (DISC) activity in TRAIL-induced apoptosis in human colon carcinoma cell lines," Oncogene, 24:2050-2058 (2005).
Jaatinen et al., "Global gene expression profile of human cord blood-derived CD133+ cells," Stem Cells, 24:631-641 (2006).
Jemal et al., "Cancer statistics, 2007," CA: a cancer journal for clinicians, 57:43-66 (2007).
Jennewein et al., "Sumoylation of peroxisome proliferator-activated receptor gamma by apoptotic cells prevents lipopolysaccharide-induced NCoR removal from kappaB binding sites mediating transrepression of proinflammatory cytokines," Journal of immunology, 181:5646-5652 (2008).
Johnson et al., "Single-cell perforin and granzyme expression reveals the anatomical localization of effector CD8+ T cells in influenza virus-infected mice," PNAS, 100:2657-2662 (2003).
Jones et al., "Functions of DNA methylation: islands, start sites, gene bodies and beyond," Nat Rev Genet, 13:484-492 (2012).
Jones et al., "InterProScan 5: genome-scale protein function classification," Bioinformatics, 30:1236-1240 (2014).
Jones et al., "The epigenomics of cancer," Cell, 128:683-692 (2007).
Kannan et al., "Vaccination strategies in follicular lymphoma," Current hematologic malignancy reports, 4(4):189-195 (2009).
Karnani et al., "Pan-S replication patterns and chromosomal domains defined by genome-tiling arrays of ENCODE genomic areas," Genome research, 17:865-876 (2007).
Karolchik et al., "The UCSC Table Browser data retrieval tool," Nucleic acids research, 32:D493-496 (2004).
Kawai et al., "TLR signaling," Seminars in immunology, 19(1):24-32 (2007).
Kenter et al., "Vaccination against HPV-16 oncoproteins for vulvar intraepithelial neoplasia," New England Journal of Medicine, 361(19):1838-1847 (2009).
Khong et al., "Natural selection of tumor variants in the generation of "tumor escape" phenotypes," Nature immunology, 3:999-1005 (2002).
Kim et al., "A Myc network accounts for similarities between embryonic stem and cancer cell transcription programs," Cell, 143:313-324 (2010).
Kim et al., "TopHat2: accurate alignment of transcriptomes in the presence of insertions, deletions and gene fusions," Genome biology, 14:R36 (2013).

(56) References Cited

OTHER PUBLICATIONS

Kimmel et al., "[54] Identification and characterization of specific clones: Strategy for confirming the validity of presumptive clones," Methods in enzymology, 152:507-511 (1987).
Kirkwood et al., "High- and Low-dose Interferon Alpha-2b in High-isk Melanoma: First Analysis of Intergroup Trial E1690/S9111/C9190," J Clin Oncol, 18:2444-2458 (2000).
Kirkwood et al., "Interferon alfa-2b Adjuvant Therapy of High-Risk Resected Cutaneous Melanoma: The Eastern Cooperative Oncology Group Trial EST 1684," J Clin Oncol, 14:7-17 (1996).
Klebanoff et al., "Therapeutic cancer vaccines:are we there yet?," Immunol Rev, 239(1):27-44 (2011).
Klein et al., "Droplet Barcoding for Single-Cell Transcriptomics Applied to Embryonic Stem Cells," Cell, 161:1187-1201 (2015).
Kloor et al., "Immune evasion of microsatellite unstable colorectal cancers," International journal of cancer, 127:1001-1010 (2010).
Koch, "Combining morphology and DNA barcoding resolves the taxonomy of Western Malagasy Liotrigona Moure, 1961," African Invertebrates, 51(2):413-421 (2010).
Kreso et al., "Variable clonal repopulation dynamics influence chemotherapy response in colorectal cancer," Science, 339:543-548 (2013).
Kress et al., "DNA barcodes: Genes, genomics, and bioinformatics," PNAS, 105(8):2761-2762 (2008).
Kress et al., "Use of DNA barcodes to identify flowering plants," PNAS, 102(23):8369-8374 (2005).
Kulis et al., "Epigenomic analysis detects widespread gene-body DNA hypomethylation in chronic lymphocytic leukemia," Nat Genet, 44:1236-1242 (2012).
Lahaye et al., "DNA barcoding the floras of biodiversity hotspots," PNAS, 105(8):2923-2928 (2008).
Landan et al., "Epigenetic polymorphism and the stochastic formation of differentially methylated regions in normal and cancerous tissues," Nat Genet, 44:1207-1214 (2012).
Landau et al., "Clonal evolution in hematological malignancies and therapeutic implications," Leukemia, 28:34-43 (2014).
Landau et al., "Evolution and impact of subclonal mutations in chronic lymphocytic leukemia," Cell, 152(4):714-726 (2013).
Langmead et al., "Fast gapped-read alignment with Bowtie 2," Nature methods, 9:357-359 (2012).
Langmead et al., "Ultrafast and memory-efficient alignment of short DNA sequences to the human genome," Genome Biology, 10:R25 (2009).
Lawrence et al., "Discovery and saturation analysis of cancer genes across 21 tumour types," Nature, 505:495-501 (2014).
Lawrence et al., "Mutational heterogeneity in cancer and the search for new cancer-associated genes," Nature, 499:214-218 (2013).
Le et al., "Evaluation of Ipilimumab in combination with allogeneic pancreatic tumor cells transfected with a GM-CSF gene in previously treated pancreatic cancer," J Immunother, 36(7):382-389 (2013).
Lee et al., "Sequential amplification of cloned DNA as tandem multimers using class-IIS restriction enzymes," Genetic Analysis: Biomolecular Engineering, 13(6):139-145 (1996).
Leffers et al., "Immunization with a P53 synthetic long peptide vaccine induces P53☐specific immune responses in ovarian cancer patients, a phase II trial," Int J Cancer, 125(9):2104-2113 (2009).
Leffers et al., "Long☐term clinical and immunological effects of p53☐SLP☐ vaccine in patients with ovarian cancer," Int J Cancer, 130(1):105-112 (2012).
Lemay et al., "Dok-3, a Novel Adapter Molecule Involved in the Negative Regulation of Immunoreceptor Signaling," Mol Cell Biol, 20:2743-2754 (2000).
Lewintre et al., "Analysis of chronic lymphotic leukemia transcriptomic profile: differences between molecular subgroups," Leuk Lymphoma, 50:68-79 (2009).
Li et al., "Fast and accurate short read alignment with Burrows-Wheeler Transform," Bioinformatics, 25(14):1754-1760 (2009).
Li et al., "Inactivating mutations of the chromatin remodeling gene ARID2 in hepatocellular carcinoma," Nature Genetics, 43:828-829 (2011).
Li et al., "Mapping short DNA sequencing reads and calling variants using mapping quality scores," Genome Res, 18:1851-1858 (2008).
Li et al., "RSEM: accurate transcript quantification from RNA-Seq data with or without a reference genome," BMC Bioinformatics,12:323 (2011).
Li et al., "The Sequence Alignment/Map format and SAMtools," Bioinformatics, 25(16):2078-2079 (2009).
Li et al.,"Fast and accurate long-read alignment with Burrows-Wheeler transform," Bioinformatics, 26(5):589-595 (2010).
Liggins et al., "MORC4, a novel member of the MORC family, is highly expressed in a subset of diffuse large B-cell lymphomas," Brit J Haematol, 138:479-486 (2007).
Lim et al., "Transcriptome analyses of mouse and human mammary cell subpopulations reveal multiple conserved genes and pathways," Breast Cancer Res, 12:R21 (2010).
Lin et al., "Relevance of the immunoglobulin VH somatic mutation status in patients with chronic lymphocytic leukemia treated with fludarabine, cyclophosphamide, and rituximab (FCR) or related chemoimmunotherapy regimens," Blood, 113:3168-71 (2009).
Link et al., "Electric control of droplets in microfluidic devices," Angew Chem Int Ed Engl, 45(16):2556-2560 (2006).
Liu et al., "Systematic identification of type I and type II interferon-induced antiviral factors," PNAS, 109(11):4239-4244 (2012).
Livak et al. "Methods for qPCR gene expression profiling applied to 1440 lymphoblastoid single cells," Methods, 59(1):71-79 (2013).
Llobet et al., "CK2 controls TRAIL and Fas sensitivity by regulating FLIP levels in endometrial carcinoma cells," Oncogene, 27:2513-2524 (2008).
Lohr et al., "Discovery and prioritization of somatic mutations in diffuse large B-cell lymphoma (DLBCL) by whole-exome sequencing," PNAS, 109(10):3879-3884 (2012).
Lu et al., "Mutated regions of nucleophosmin 1PPP1R3B Is Recognized by T Cells Used to Treat a Melanoma Patient Who Experienced a Durable Complete Tumor Regression," J Immunol, 190(12):6034-6042 (2013).
Lund et al., "Coordination of early protective immunity to viral infection by regulatory T cells," Science, 320(5880):1220-1224 (2008).
Macosko et al., "Highly Parallel Genome-wide Expression Profiling of Individual Cells Using Nanoliter Droplets," Cell, 161(5):1202-1214 (2015).
Maegawa et al., "Age-related epigenetic drift in the pathogenesis of MDS and AML," Genome Res, 24:580-591 (2014).
Manghera et al, "Endogenous retrovirus-K promoter: a landing strip for inflammatory transcription factors?," Retrovirol, 10:16 (2013).
Marabelle et al., "Depleting tumor-specific Tregs at a single site eradicates disseminated tumors," J Clin Invest, 1123(6):2447-2463(2013).
Marcais et al., "A fast, lock-free approach for efficient parallel counting of occurrences of k-mers," Bioinformatics, 27(6):764-770 (2011).
Mayer et al., "A revised nomenclature for transcribed human endogenous retroviral loci," Mobile DNA, 2:7 (2011).
Mazutis et al., "Single-cell analysis and sorting using droplet-based microfluidics," Nat Protoc, 8:870-891 (2013).
McCormack et al., "HLA-A*3101 and Carbamazepine-Induced Hypersensitivity Reactions in Europeans," New Engl J Med, 364:1134-1143 (2011).
McDermott et al., "Immune Therapy for Kidney Cancer: A Second Dawn?," Semin Oncol, 40(4):492-498 (2013).
McFadden et al., "Genetic and clonal dissection of murine small cell lung carcinoma progression by genome sequencing," Cell, 156(6):1298-1311 (2014).
McKenna et al., "The Genome Analysis Toolkit: a MapReduce framework for analyzing next-generation DNA sequencing data," Genome Res, 20(9):1297-1303 (2010).
Medema et al., "Immune Escape of Tumors in Vivo by Expression of Cellular Flice-Inhibitory Protein," J Exp Med, 190:1033-1038 (1999).

(56) References Cited

OTHER PUBLICATIONS

Meissner et al., "Genome-scale DNA methylation maps of pluripotent and differentiated cells," Nature, 454:766-770 (2008).
Menke et al., "Genetic interactions between the Wilms' tumor 1 gene and the p53 gene," Cancer Res, 62(22):6615-6620 (2002).
Mermel et al., "GISTIC2.0 facilitates sensitive and confident localization of the targets of focal somatic copy-number alteration in human cancers," Genome Biol, 12:R41 (2011).
Messmer et al., "In vivo measurements document the dynamic cellular kinetics of chronic lymphocytic leukemia B cells," J Clin Invest, 115(3):755-764 (2005).
Missale et al., "HLA-A31- and HLA-Aw68-restricted cytotoxic T cell responses to a single hepatitis B virus nucleocapsid epitope during acute viral hepatitis," J Exp Med, 177(3):751-762 (1993).
Mocellin et al., "Interferon Alpha Adjuvant Therapy in Patients With High-Risk Melanoma: A Systematic Review and Meta-analysis," JNCI, 102(7):493-501 (2010).
Morison et al., "A census of mammalian imprinting," Trends Genet, 21(8):457-465 (2005).
Morozov et al., "The Transmembrane Protein of the Human Endogenous Retrovirus—K (HERV-K) Modulates Cytokine Release and Gene Expression," PloS one 8(8):e70399 (2013).
Morton et al., "Prolonged Survival of Patients Receiving Active Immunotherapy With Canvaxin Therapeutic Polyvalent Vaccine After Complete Resection of Melanoma Metastatic to Regional Lymph Nodes," Ann Surg, 236(4):438-448 (2002).
Nielsen et al., "NetMHCpan, a Method for Quantitative Predictions of Peptide Binding to Any HLA-A and -B Locus Protein of Known Sequence," PloS one, 2:e796 (2007).
Novershtern et al., "Densely Interconnected Transcriptional Circuits Control Cell States in Human Hematopoiesis," Cell, 144(2):296-309 (2011).
Oh et al., "Neutrophil isolation protocol," J Vis Exp (2008).
Ohnishi et al., "Premature Termination of Reprogramming In Vivo Leads to Cancer Development through Altered Epigenetic Regulation," Cell, 156(4):663-677 (2014).
Okada et al., "Induction of CD8+ T-Cell Responses Against Novel Glioma-Associated Antigen Peptides and Clinical Activity by Vaccinations With α-Type 1 Polarized Dendritic Cells and Polyinosinic-Polycytidylic Acid Stabilized by Lysine and Carboxymethylcellulose in Patients With Recurrent Malignant Glioma," J Clin Oncol, 29(3):330-336 (2011).
Oshiumi et al., "DEAD/H BOX 3 (DDX3) helicase binds the RIG-I adaptor IPS-1 to up-regulate IFN-beta-inducing potential," Eur J Immunol, 40:940-948 (2010).
Ott et al., "CTLA-4 and PD-1/PD-L1 Blockade: New Immunotherapeutic Modalities with Durable Clinical Benefit in Melanoma Patients," Clin Cancer Res, 19(19):5300-5309 (2013).
Padgett et al., "Creating seamless junctions independent of restriction sites in PCR cloning," Gene, 168:31-35 (1996).
Pages, et al., "Effector Memory T Cells, Early Metastasis, and Survival in Colorectal Cancer," New Engl J Med, 353:2654-2666 (2005).
Pei et al., "Genome-wide DNA methylation analysis reveals novel epigenetic changes in chronic lymphocytic leukemia," Epigenetics, 7:567-578 (2012).
Peng et al., "DOK3 Negatively Regulates LPS Responses and Endotoxin Tolerance," PloS one 7:e39967 (2012).
Perez et al., "p63 consensus DNA-binding site: identification, analysis and application into a p63MH algorithm," Oncogene, 26:7363-7370 (2007).
Pieters et al., "On guard: coronin proteins in innate and adaptive immunity," Nat Rev Immunol, 13:510-518 (2013).
Pirard et al., "Interferon Alpha as Adjuvant Postsurgical Treatment of Melanoma: A Meta-Analysis," Dermatology, 208(1):43-48 (2004).
Powell et al., "NCoR1 Mediates Papillomavirus E8ΛE2C Transcriptional Repression," J Virol, 84:4451-4460 (2010).
Pujadas et al., "Regulated noise in the epigenetic landscape of development and disease," Cell, 148(6):1123-1131 (2012).
Qin et al., "Soft lithography for micro- and nanoscale patterning," Nat Protoc, 5:491-502 (2010).
Quesada et al., "Exome sequencing identifies recurrent mutations of the splicing factor SF3B1 gene in chronic lymphocytic leukemia," Nat Genet, 44:47-52 (2012).
Quezada et al.,"CTLA4 blockade and Gm-Csf combination immunotherapy alters the intratumor balance of effector and regulatory T cells," J Clin Invest, 116(7):1935-1945 (2006).
Ramskold et al., "Full-length mRNA-Seq from single-cell levels of RNA and individual circulating tumor cells," Nat Biotechnol, 30:777-782 (2012).
Rassenti et al., "Relative value of ZAP-70, CD38, and immunoglobulin mutation status in predicting aggressive disease in chronic lymphocytic leukemia," Blood, 112:1923-1930 (2008).
Raval et al., "Downregulation of Death-Associated Protein Kinase 1 (DAPK1) in Chronic Lymphocytic Leukemia," Cell, 129(5):879-890 (2007).
Ravi et al., "Sensitization of Tumor Cells to Apo2 Ligand/TRAIL-induced Apoptosis by Inhibition of Casein Kinase II," Cancer Res, 62(15):4180-4185 (2002).
Richter et al., "Mechanistic Determinants of Biotherapeutics Absorption Following SC Administration," The AAPS Journal, 14(3):559-568 (2012).
Rini et al., "Biology and Treatment of Advanced Renal Cell Carcinoma: A Global Perspective," Semin Oncol, 40(4):419-420 (2013).
Robbins et al., "Mining exomic sequencing data to identify mutated antigens recognized by adoptively transferred tumor-reactive T cells," Nat Med, 19(6):747-752 (2013).
Robinson et al., "A phase I-II trial of multiple-dose polyriboinosic-polyribocytidylic acid in patieonts with leukemia or solid tumors," J Natl Cancer Inst, 57(3):599-602 (1976).
Robinson et al., "edgeR: a Bioconductor package for differential expression analysis of digital gene expression data," Bioinformatics, 26(1):139-140 (2010).
Robinson et al., "Integrative genomics viewer," Nat Biotechnol, 29:24-26 (2011).
Rosenberg, "Raising the Bar: The Curative Potential of Human Cancer Immunotherapy," Sci Transl Med, 4(127):127ps128 (2012).
Rossi et al., "Integrated mutational and cytogenetic analysis identifies new prognostic subgroups in chronic lymphocytic leukemia," Blood, 121:1403-1412 (2013).
Rubio-Moscardo et al., "Characterization of 8p21.3 chromosomal deletions in B-cell lymphoma: TRAIL-R1 and TRAIL-R2 as candidate dosage-dependent tumor suppressor genes," Blood, 106:3214-3222 (2005).
Rutledge et al., "Tumor-Infiltrating Lymphocytes in Glioblastoma Are Associated with Specific Genomic Alterations and Related to Transcriptional Class," Clin Cancer Res, 19:4951-4960 (2013).
Salem et al., "Defining the Antigen-Specific T-Cell Response to Vaccination and Poly(I:C)/TLR3 Signaling: Evidence of Enhanced Primary and Memory CD8 T-Cell Responses and Antitumor Immunity," J Immunother, 28(3):220-228 (2005).
Samuels et al., "Oncogenic P13K and its role in cancer," Curr Opin Oncol, 18:77-82n (2006).
Sato et al., "Discovery of Novel Targets for Aberrant Methylation in Pancreatic Carcinoma Using High-Throughput Microarrays," Cancer Res, 63(13):3735-3742 (2003).
Saturno et al., "Combining TRAIL with PI3 Kinase or HSP90 inhibitors enhances apoptosis in colorectal cancer cells via suppression of survival signaling," Oncotarget, 4(8):1185-1198 (2013).
Saunders et al., "Strelka: accurate somatic small-variant calling from sequenced tumor-normal sample pairs," Bioinformatics, 28(14):1811-1817 (2012).
Schmitt et al., "Transcriptional Profiling of Human Endogenous Retrovirus Group HERV-K(HML-2) Loci in Melanoma," Genome Biol Evol, 5(2):307-328 (2013).
Schreiber et al., "Cancer Immunoediting: Integrating Immunity's Roles in Cancer Suppression and Promotion," Science, 331(6024):1565-1570 (2011).
Schumacher et al., "Prognostic Significance of Activated CD8+ T Cell Infiltrations within Esophageal Carcinomas," Cancer Res, 61(10):3932-3936 (2001).

(56) References Cited

OTHER PUBLICATIONS

Schuster et al., "Vaccination With Patient-Specific Tumor-Derived Antigen in First Remission Improves Disease-Free Survival in Follicular Lymphoma," J Clin Oncol, 29(20):2787-2794 (2011).
Seberg et al., "How Many Loci Does it Take to DNA Barcode a Crocus?," PLoS One 4(2):e4598 (2009).
Secchiero et al., "Aberrant expression of TRAIL in B chronic lymphocytic leukemia (B-CLL) cells," J Cell Physiol, 205(2):246-252 (2005).
Sensi et al., "Unique tumor antigens: evidence for immune control of genome integrity and immunogenic targets for T cell-mediated patient-specific immunotherapy," Clin Cancer, Res 12:5023-5032 (2006).
Shah et al., "Multiple BCR-ABL kinase domain mutations confer polyclonal resistance to the tyrosine kinase inhibitor imatinib (STI571) in chronic phase and blast crisis chronic myeloid leukemia," Cancer Cell, 2(2):117-125 (2002).
Shalek et al., "Single-cell RNA-seq reveals dynamic paracrine control of cellular variation," Nature, 510(7505):363-369 (2014).
Shannon, "A Mathematical Theory of Communication," Bell System Technical Journal, 27(3):379-423 (1948).
Shao et al., "Clonally related histiocytic/dendritic cell sarcoma and chronic lymphocytic leukemia/small lymphocytic lymphoma: a study of seven cases," Mod Pathol, 24:1421-1432 (2011).
Shendure et al., "Next-generation DNA sequencing," Nat Biotechnol, 26(10):1135-1145 (2008).
Shipony et al., "Dynamic and static maintenance of epigenetic memory in pluripotent and somatic cells," Nature, 513:115-119 (2014).
Sidney et al., "HLA class I supertypes: a revised and updated classification," BMC Immunol, 9:1 (2008).
Siegel et al., "Cancer statistics, 2013," CA, 63(1):11-30 (2013).
Simmons et al., "Local secretion of anti-CTLA-4 enhances the therapeutic efficacy of a cancer immunotherapy with reduced evidence of systemic autoimmunity," Cancer Immunol Immunother, 57(8):1263-1270 (2008).
Simpson et al., "Cancer/testis antigens, gametogenesis and cancer," Nat Rev Cancer, 5:615-625 (2005).
Simpson et al., "Fc-dependent depletion of tumor-infiltrating regulatory T cells co-defines the efficacy of anti-CTLA-4 therapy against melanoma," J Exp Med, 210(9):1695-1710 (2013).
Slingluff et al., "Randomized Multicenter Trial of the Effects of Melanoma-Associated Helper Peptides and Cyclophosphamide on the Immunogenicity of a Multipeptide Melanoma Vaccine," J Clin Oncol, 29(21):2924-2932 (2011).
Smith et al., "Comparison of biosequences," Adv Appl Math, 2(4):482-489 (1981).
Smoley et al., "Standardization of fluorescence in situ hybridization studies on chronic lymphocytic leukemia (CLL) blood and marrow cells by the CLL Research Consortium," Cancer Genet Cytogenet, 203(2):141-148 (2010).
Soares et al. "A subset of dendritic cells induces CD4+ T cells to produce IFN-gamma by an IL-12-independent but CD70-dependent mechanism in vivo," J Exp Med, 2215(11):1095-1106 (2007).
Soininen et al., "Analysing diet of small herbivores: the efficiency of DNA barcoding coupled with high-throughput pyrosequencing for deciphering the composition of complex plant mixtures," Front Zool, 6:16 (2009).
Song et al., "c-Cbl acts as a mediator of Src-induced activation of the PI3K-Akt signal transduction pathway during TRAIL treatment," Cellular Signalling, 22(3):377-385 (2010).
Sosman et al., "A phase 2 trial of complete resection for stage IV melanoma: results of Southwest Oncology Group Clinical Trial S9430," Cancer, 117(20):4740-4706 (2011).
Speetjens et al., "Induction of p53-Specific Immunity by a p53 Synthetic Long Peptide Vaccine in Patients Treated for Metastatic Colorectal Cancer," Clin Cancer Res, 15(3):1086-1095 (2009).
Spencer et al., "Non-genetic origins of cell-to-cell variability in TRAIL-induced apoptosis," Nature, 459:428-432 (2009).

Spranger et al., "Up-regulation of PD-LI, IDO, and Tregs in the melanoma tumor microenvironment is driven by CD8+ T cells," Sci Transl Med, 5(200):200ra116 (2013).
Stransky et al., "The Mutational Landscape of Head and Neck Squamous Cell Carcinoma," Science, 333:1157-1160 (2011).
Su et al., "Next-generation sequencing and its applications in molecular diagnostics" Exp Rev Mol Diagn, 11(3):333-343 (2011).
Subramanian et al., "Gene set enrichment analysis: a knowledge-based approach for interpreting genome-wide expression profiles," PNAS, 102:15545-15550 (2005).
Suzuki et al., "A Novel Glycosylphosphatidyl Inositol-Anchored Protein on Human Leukocytes: A Possible Role for Regulation of Neutrophil Adherence and Migration," J Immunol, 162(7):4277-4284 (1999).
Sykulev et al., "Evidence that a Single Peptide-MHC Complex on a Target Cell Can Elicit a Cytolytic T Cell Response," Immunity, 4:565-571 (1996).
Tang et al., "The landscape of viral expression and host gene fusion and adaptation in human cancer," Nat Commun, 4:2513 (2013).
Ten Bosch et al., "Keeping Up With the Next Generation: Massively Parallel Sequencing in Clinical Diagnostics," J Mol Diagn, 10(6):484-492 (2008).
Teng et al., "A human TAPBP (TAPASIN)-related gene, TAPBP-R," Eur J Immunol, 32:1059-1068 (2002).
Testori et al., "Phase III comparison of vitespen, an autologous tumor-derived heat shock protein gp96 peptide complex vaccine, with physician's choice of treatment for stage IV melanoma: the C-100-21 Study Group," J Clin Oncol, 26(6):955-962 (2008).
Textor et al., "Human NK cells are alerted to induction of p53 in cancer cells by upregulation of the NKG2D ligands ULBPI and ULBP2," Cancer Res, 71:5998-6009 (2011).
Timp et al., "Cancer as a dysregulated epigenome allowing cellular growth advantage at the expense of the host," Nat Rev Cancer, 13:497-510 (2013).
Topalian et al., "Safety, Activity, and Immune Correlates of Anti-PD-1 Antibody in Cancer," N Engl J Med, 366(26):2443-2454 (2012).
Topalian et al., "Survival, Durable Tumor Remission, and Long-Term Safety in Patients With Advanced Melanoma Receiving Nivolumab," J Clin Oncol, 32(10):1020-1030 (2014).
Tough et al., "Induction of bystander T cell proliferation by viruses and type I interferon in vivo," Science, 272(5270):1947-1950 (1996).
Tran et al., "Cancer Immunotherapy Based on Mutation-Specific CD4+ T Cells in a Patient with Epithelial Cancer," Science, 344(6184):641-645 (2014).
Trumpfheller et al., "Intensified and protective CD4+ T cell immunity in mice with anti-dendritic cell HIV gag fusion antibody vaccine," J Exp Med, 203(3):607-617 (2006).
Trumpfheller et al., "The microbial mimic poly IC induces durable and protective CD4+ cell immunity together with a dendritic cell targeted vaccine," PNAS, 105(7):2574-2579 (2008).
Tucker et al., "Massively Parallel Sequencing:The Next Big Thing in Genetic Medicine," Am J Hum Genet, 85(2):142-154 (2009).
Uderhardt et al., "12/15-lipoxygenase orchestrates the clearance of apoptotic cells and maintains immunologic tolerance," Immunity, 36(5):834-846 (2012).
Ushijima et al., "Fidelity of the methylation pattern and its variation in the genome," Genome research, 13:868-874 (2005).
Uyttenhove et al., "Evidence for a tumoral immune resistance mechanism based on tryptophan degradation by indoleamine 2,3-di oxygenase," Nature medicine, 9:1269-1274 (2003).
Vaishampayan et al., "Active immunotherapy of metastatic melanoma with allogeneic melanoma lysates and interferon alpha," Clin Cancer Res, 8(12):3696-3701 (2002).
Van Elsas et al., "Combination immunotherapy of B16 melanoma using anti-cytotoxic T lymphocyte-associated antigen 4 (CTLA-4) and granulocyte/macrophage colony-stimulating factor (GM-CSF)-producing vaccines induces rejection of subcutaneous and metastatic tumors accompanied by autoimmune depigmentation," Journal of Experimental Medicine, 190(3):355-366 (1999).

(56) References Cited

OTHER PUBLICATIONS

Van Poelgeest et al., "HPV16 synthetic long peptide (HPV16-SLP) vaccination therapy of patients with advanced or recurrent HPV16-induced gynecological carcinoma, a phase II trial," J Transl Med, 11:88 (2013).
Van Rooij et al., "Tumor exome analysis reveals neoantigen-specific T-cell reactivity in an ipilimumab-responsive melanoma," Journal of clinical oncology: official journal of the American Society of Clinical Oncology, 31:32 (2013).
Vermeij et al., "Potentiation of a p53-SLP vaccine by cyclophosphamide in ovarian cancer: a single-arm phase II study," Int J Cancer, 131(5):E670-680 (2012).
Wahl et al., "[43] Molecular hybridization of immobilized nucleic acids: Theoretical concepts and practical considerations," Methods in enzymology, Academic Press, 152:399-407 (1987).
Wang et al., "Role of protein kinase CK2 in the regulation of tumor necrosis factor-related apoptosis inducing ligand-induced apoptosis in prostate cancer cells," Cancer research, 66:2242-2249 (2006).
Wang et al., "SF3B1 and other novel cancer genes in chronic lymphocytic leukemia," N Engl J Med, 365:2497-2506 (2011).
Wang et al., "Widespread plasticity in CTCF occupancy linked to DNA methylation," Genome Res, 22:1680-1688 (2012).
Weber et al., "Assembly of Designer TAL Effectors by Golden Gate Cloning," PLoS One, 6:e19722 (2001).
Welters et al., "Induction of tumor-specific CD4+ and CD8+ T-cell immunity in cervical cancer patients by a human papillomavirus type 16 E6 and E7 long peptides vaccine," Clinical cancer research, 14(1):178-187 (2008).
Welters et al., "Success or failure of vaccination for HPV16-positive vulvar lesions correlates with kinetics and phenotype of induced T-cell responses," PNAS, 107(26):11895-11899 (2010).
Wheatley et al., "Does adjuvant interferon-alpha for high-risk melanoma provide a worthwhile benefit?A meta-analysis of the randomised trials," Cancer treatment reviews, 29(4):241-252 (2003).
Widschwendter et al., "Epigenetic stem cell signature in cancer," Nat Genet, 39:157-158 (2007).
Wierda et al., "Multivariable model for time to first treatment in patients with chronic lymphocytic leukemia," J Clin Oncol, 29:4088-4095 (2011).
Winzeler et al., "Functional characterization of the S. cerevisiae genome by gene deletion and parallel analysis," science, 285(5429):901-906 (1999).
Wolchok et al., "Nivolumab plus ipilimumab in advanced melanoma," N Engl J Med, 369(2):122-133 (2013).
Wong et al., "Module map of stem cell genes guides creation of epithelial cancer stem cells," Cell Stem Cell, 2:333-344 (2008).
Woodfine et al., "Quantitative analysis of DNA methylation at all human imprinted regions reveals preservation of epigenetic stability in adult somatic tissue," Epigenetics & chromatin, 4:1 (2011).
Woyach et al., "Resistance mechanisms for the Bruton's tyrosine kinase inhibitor ibrutinib," The New England journal of medicine, 370:2286-94 (2014).
Xi et al., "BSMAP: whole genome bisulfite sequence MAPping program," BMC bioinformatics, 10:232 (2009).
Xie et al., "Stepwise reprogramming of B cells into macrophages," Cell, 117(5):663-676 (2004).
Xu et al., "Design of 240,000 orthogonal 25mer DNA barcode probes," Proceedings of the National Academy of Sciences, pnas-0812506106 (2009).
Yan et al., "Pbaf chromatin-remodeling complex requires a novel specificity subunit, BAF200, to regulate expression of selective interferon-responsive genes," Genes & development, 19(14):1662-1667 (2005).
Yang et al., "Meta-analysis followed by replication identifies loci in or near CDKN1B, TET3, CD80, DRAM1, and ARID5B as associated with systemic lupus erythematosus in Asians," American journal of human genetics, 92:41-51 (2013).
Yoshihara et al., Inferring tumour purity and stromal and immune cell admixture from expression data,: Nature communications 4:2612 (2013).
Yoshitake et al., "Cross□linking of GPI□080, a possible regulatory molecule of cell adhesion, induces up□regulation of CD11b/CD18 expression on neutrophil surfaces and shedding of L□ selectin," Journal of leukocyte biology, 71(2):205-211 (2002).
Young et al., "Resurrection of endogenous retroviruses in antibody-deficient mice," Nature, 491(7426):774 (2012).
Yu et al., "Nucleic acid-sensing Toll-like receptors are essential for the control of endogenous retrovirus viremia and ERV-induced tumors," Immunity, 37(5):867-879 (2012).
Yuille et al., "TCL1 is activated by chromosomal rearrangement or by hypomethylation," Genes, Chromosomes and Cancer, 30(4):336-341 (2001).
Zeestraten et al., "Addition of interferon-alpha to the p53-SLP(R) vaccine results in increased production of interferon-gamma in vaccinated colorectal cancer patients: a phase I/11 clinical trial," Int J Cancer, 132(7):1581-1591 (2013).
Zhang et al., "Machine learning competition in immunology-prediction of HLA class I binding peptides," J Immunol Methods 374:1-4 (2009).
Zhou et al., "A hypermorphic missense mutation in PLCG2, encoding phospholipase Cgamma2, causes a dominantly inherited autoinflammatory disease with immunodeficiency," Am J Hum Genet, 91:713-20 (2012).
Zhu et al., "Toll like receptor-3 ligand poly-ICLC promotes the efficacy of peripheral vaccinations with tumor antigen-derived peptide epitopes in murine CNS tumor models," Journal of translational medicine, 5:10 (2007).
Ziller et al., "Charting a dynamic DNA methylation landscape of the human genome," Nature, 500:477-481 (2013).
Zorn et al., "A natural cytotoxic T cell response in a spontaneously regressing human melanoma targets a neoantigen resulting from a somatic point mutation," Eur J Immunol, 29(2):592-601 (1999).
Zwaveling et al., "Established human papillomavirus type 16-expressing tumors are effectively eradicated following vaccination with long peptides," J Immunol, 169(1):350-358 (2002).
U.S. Appl. No. 15/187,174, filed Jun. 20, 2016, 2016-0331822, Abandoned.
U.S. Appl. No. 16/181,098, filed Nov. 5, 2018, 2019-0060432, Published.
Andreatta et al., "Gapped sequence alignment using artificial neural networks: application to the MHC class I system," Bioinformatics 32(4):511-517 (2016).
Bassani-Sternberg et al., "Mass Spectrometry of Human Leukocyte Antigen Class I Peptidomes Reveals Strong Effects of Protein Abundance and Turnover on Antigen Presentation," Mol Cell Proteomics, 14:658-673 (2015).
Boisgerault et al., "Definition of the HLA-A29 peptide ligand motif allows prediction of potential T-cell epitopes from the retinal soluble antigen, a candidate autoantigen in birdshot retinopathy," PNAS, 93:3466-3470 (1996).
Bourdetsky et al., The nature and extent of contributions by defective ribosome products to the HLA peptidome, PNAS, III, E1591-E1599 (2014).
Bremel et al., "An integrated approach to epitope analysis I: Dimensional reduction, visualization and prediction of MHC binding using amino acid principal components and regression approaches," Immunome Res, 6:7 (2010).
Caron et al., "Analysis of MHC immunopeptidomes using mass spectrometry," Mol Cell Proteomics (2015), doi: 10.1074/mcp.OI 15.052431.
Chowell et al., "TCR contact residue hydrophobicity is a hallmark of immunogenic CD8($_+$) T cell epitopes," PNAS, 112:E1754-E1762 (2015).
Christianson et al., "Defining human ERAD networks through an integrative mapping strategy," Nat Cell Biol, 14:93-105 (2012).
Eichmann et al., "Identification and characterisation of peptide binding motifs of six autoimmune disease-associated human leukocyte antigen-class I molecules including HLA-B*39:06," Tissue Antigens 84(4):378-388 (2014).
Elias et al., Target-decoy search strategy for increased confidence in large-scale protein identifications by mass spectrometry, Nat Meth, 4:207-214 (2007).

(56) References Cited

OTHER PUBLICATIONS

Eyers et al., "CONSeQuence: prediction of reference peptides for absolute quantitative proteomics using consensus machine learning approaches," Mol Cell Proteomics (2011); 10(11):M110.003384. doi: 10.1074/mcp.MI 10.003384. Epub Aug. 3, 2011.
Fruci et al., "Altered expression of endoplasmic reticulum aminopeptidases ERAPI and ERAP2 in transformed non-lymphoid human tissues," J Cell Physiol, 2I6(3):742-749 (2008).
Fusaro et al., "Prediction of high-responding peptides for targeted protein assays by mass spectrometry" Nat Biotechnol, 27(2):190-198 (2009).
Guasp et al., "The Peptidome of Behcet's Disease-Associated HLA-B*51 :01 Includes Two Subpeptidomes Differentially Shaped by Endoplasmic Reticulum Aminopeptidase 1," Arthritis Rheumatol, 68:505-515 (2016).
Guruprasad et al., "Correlation between stability of a protein and its dipeptide composition: a novel approach for predicting in vivo stability of a protein from its primary sequence," Protein Eng, 4(2):155-161 (1990).
Harndahl et al., "Peptide-MHC class I stability is a better predictor than peptide affinity of CTL immunogenicity," Eur J Immunol, 42:1405-1416 (2012).
Harndahl et al., "Real-time, High-Throughput Measurements of Peptide-MHC-I Dissociation Using a Scintillation Proximity Assay," J Immunol Methods, 374:5-12 (2011).
Hickman et al., "Toward a Definition of Self: Proteomic Evaluation of the Class I Peptide Repertoire," J Immunol, 172:2944-2952 (2004).
Hoof et al., "NetMHCpan, a method for MHC class I binding prediction beyond humans," Immunogenetics, 61:1-13 (2009).
Hunt et al., "Characterization of peptides bound to the class I MHC molecule HLA-A2.1 by mass spectrometry," Science, 255:1261-1263 (1992).
Ishihama et al., "Exponentially Modified Protein Abundance Index (emPAI) for Estimation of Absolute Protein Amount in Proteomics by the Number of Sequenced Peptides per Protein," Mol Cell Proteomics, 4:1265-1272 (2005).
Jeffery et al., "The Influence of HLA Class I Alleles and Heterozygosity on the Outcome of Human T Cell Lymphotropic Virus Type I Infection," J Immunol, 165:7278-7284 (2000).
Jorgensen et al., "NetMHC stab—predicting stability of peptide-MHC-I complexes; impacts for cytotoxic T lymphocyte epitope discovery," Immunology 141:18-26 (2014).
Keskin et al., "Direct identification of an HPV-16 tumor antigen from cervical cancer biopsy specimens," Front Immunol, 2:75 (2011).
Keskin et al., "Physical detection of influenza A epitopes identifies a stealth subset on human lung epithelium evading natural CD8 immunity," PNAS, 112(7):2151-2156 (2015).
Kesmir et al., "Prediction of proteasome cleavage motifs by neural networks," Protein Eng, 15(4):287-296 (2002).
Kim et al., "Derivation of an amino acid similarity matrix for peptide:MHC binding and its application as a Bayesian prior," BMC Bioinformatics, 10:1-11 (2009).
Kronke et al. "Lenalidomide causes selective degradation of IKZFI and IKZF3 in multiple myeloma cells," Science, 343(6168): 301-305 (2014).
Kronke et al. "Lenalidomide induces ubiquitination and degradation of CKIa in del(5q) MDS," Nature, 523(7559):183-188 (2015).
Larsen et al., "Large-scale validation of methods for cytotoxic T-lymphocyte epitope prediction," BMC Bioinformatics, 8:424-424 (2007).
Linnemann et al., "High-throughput epitope discovery reveals frequent recognition of neo-antigens by CD4+ T cells in human melanoma," Nat Med, 21:81-85 (2015).
Llano et al., "Best-Characterized HIV-1 CTL Epitopes: The 2013 Update," HIV Mol Immunol , 3-25 (2013).
Lorente et al., "Diversity of Natural Self-Derived Ligands Presented by Different HLA Class I Molecules in Transporter Antigen Processing-Deficient Cells," PLoS One 8:e59118 (2013).

Ma, "Novor: Real-Time Peptide de Novo Sequencing Software," J Am Soc Mass Spectrom, 26:1885-1894 (2015).
McMurtrey et al., "Toxoplasma gondii peptide ligands open the gate of the HLA class I binding groove," eLife 5:e12556 (2016).
Milner et al., "The Effect of Proteasome Inhibition on the Generation of the Human Leukocyte Antigen (HLA) Peptidome," Mol Cell Proteomics, 12:1853-1864 (2013).
Milner et al., "The Turnover Kinetics of Major Histocompatibility Complex Peptides of Human Cancer Cells*," Mol Cell Proteomics, 5:357-365 (2006).
Mommen et al., "Expanding the detectable HLA peptide repertoire using electron-transfer/higher-energy collision dissociation (EThcD)," PNAS III, 4507-4512 (2014).
Mommen et al., "Sampling From the Proteome to the Human Leukocyte Antigen-DR (HLA-DR) Ligandome Proceeds Via High Specificity," Mol Cell Proteomics MCP, 15:1412-1423 (2016).
Muntel et al., "Abundance-based Classifier for the Prediction of Mass Spectrometric Peptide Detectability Upon Enrichment (PPA)," Mol Cell Proteomics, 14:430-440 (2015).
Ng et al., "Dereplication and de novo sequencing of nonribosomal peptides," Nat Meth, 6:596-599 (2009).
Nielsen et al., "The role of the proteasome in generating cytotoxic T-cell epitopes: insights obtained from improved predictions of proteasomal cleavage," Immunogenetics, 57:33-41 (2005).
Oates et al., "D(2)P(2): database of disordered protein predictions," Nucleic Acids Res, 41:D508-D516 (2013).
Osorio et al., "Stability Analysis of Antimicrobial Peptides in Solvation Conditions by Molecular Dynamics," Adv Comp Bio, 232:127-131 (2014).
Pritchard et al., "Exome Sequencing to Predict Neoantigens in Melanoma," Cancer Immunol Res, 3:992-998 (2015).
Rappsilber et al., "Protocol for micro-purification, enrichment, pre-fractionation and storage of peptides for proteomics using StageTips," Nat Protoc, 2(8):1896-1906 (2007).
Reche et al., "Elicitation from virus-naive individuals of cytotoxic T lymphocytes directed against conserved HIV-1 epitopes," Med Immunol, 5:1 (2006).
Robinson et al., "The IPD and FMGT/HLA database: allele variant databases," Nucleic Acids Res, 43:D423-D431 (2015).
Rock et al., "Re-examining class-I presentation and the DRiP hypothesis," Trends Immunol, 35(4):144-152 (2014).
Ruggles et al., "An analysis of the sensitivity of proteogenomic mapping of somatic mutations and novel splicing events in cancer," Cell Proteomics, 15(3):1060-1071 (2015).
Saveanu et al., "Concerted peptide trimming by human ERAPI and ERAP2 aminopeptidase complexes in the endoplasmic reticulum," Nat Immunol, 6:689-697 (2005).
Saxova et al., "Predicting proteasomal cleavage sites: a comparison of available methods," Int Immunol, 15:781-787 (2003).
Schumacher et al., "Neoantigens in cancer immunotherapy," Science, 348:69-74 (2015).
Searle et al., "Using Data Independent Acquisition (DIA) to Model High-responding Peptides for Targeted Proteomics Experiments," Mol Cell Proteomics, 14:2331-2340 (2015).
Shimizu et al., "Production of human cells expressing individual transferred HLA-A,-B,-C genes using an HLA-A,-B,-C null human cell line," J Immunol, 142(9):3320-3328 (1989).
Shimizu et al., "Transfer of cloned human class I major histocompatibility complex genes into HLA mutant human lymphoblastoid cells," Mol Cell Biol, 6(4):1074-1087 (1986).
Sidney et al., "Measurement of MHC/Peptide Interactions by Gel Filtration" Curr Prot Immunol, 31(1):18.3.1-18.3.19 (1999).
Sowa et al., "Defining the Human Deubiquitinating Enzyme Interaction Landscape," Cell, 138(2):389-403 (2009).
Trolle et al., "The Length Distribution of Class 1-Restricted T Cell Epitopes Is Determined by Both Peptide Supply and MHC Allele-Specific Binding Preference," J Immunol (2016), doi: 10.4049/jimmunol.1501721.
Tynan et al., "T cell receptor recognition of a "super-bulged" major histocompatibility complex class I-bound peptide," Nat Immunol, 6:1114-1122 (2005).

(56) References Cited

OTHER PUBLICATIONS

Udeshi et al., "Methods for quantification of in vivo changes in protein ubiquitination following proteasome and deubiquitinase inhibition," Mol Cell Proteomics, 11:148-159 (2012).
Vita et al., "The immune epitope database (IEDB) 3.0," Nucleic Acids Res, 43:D405-D412 (2015).
Walz et al., "The antigenic landscape of multiple myeloma: mass spectrometry (re)defines targets for T-cell-based immunotherapy," Blood 126:1203-1213 (2015).
Yewdell, "DRiPs solidify: progress in understanding endogenous MHC class I antigen processing," Trends Immunol, 32(11):548-558 (2011).
Zhang et al., "Dana-Farber repository for machine learning in immunology," J Immunol Methods, 374(1-2):18-25 (2011).
Dressman et al., "Gene expression profiles of multiple breast cancer phenotypes and response to neoadjuvant chemotherapy," Clin Cancer Res, 12(3):819-826 (2006).
Final Rejection for U.S. Appl. No. 15/102,129, "Formulations for Neoplasia Vaccines," dated Aug. 15, 2019.
Final Rejection for U.S. Appl. No. 15/105,961, "Combination Therapy With Neoantigen Vaccine," dated Aug. 23, 2019.
Final Rejection for U.S. Appl. No. 15/537,785, "Methods for Profiling the T Cell Repertoire," dated Jul. 18, 2019.
Haanen et al., "Immunotherapy of melanoma," Euro J Canc Supp 11:97-105 (2013).
Kim et al., "Inactivating mutations of caspase-8 in colorectal carcinomas," Gastroenterology, 125:708-715 (2003).
Loveridge et al., "The genetic contribution to human T-cell receptor repertoire," Immunology, 74:246-250 (1991).
Non-Final Rejection for U.S. Appl. No. 15/537,839, "Molecular Biomarkers for Cancer Immunotherapy," dated Oct. 8, 2019.
Notice of Allowance for U.S. Appl. No. 16/188,737, "Compositions and Methods of Identifying Tumor Specific Neoantigens," dated Jul. 25, 2019.
Soung et al., "Capase-8 gene is frequently inactivated by the frameshift somatic mutation 1225_1226delTG in hepatocellular carcinomas," Oncogene, 24:141-147 (2005).
Supplementary Materials from Third Party Observation in EP Application No. 15198284.0, 2009.
Chang et al., "Use of tumor genomic profiling to reveal mechanisms of resistance to the BTK inhibitor ibrutinib in chronic lymphocytic leukemia (CLL)," J Clin Oncol, 31(15S):Abstract 7014 (2013).
DeKosky et al., "High-throughput sequencing of the paired human immunoglobulin heavy and light chain repertoire," Nature Biotech 166-170 (2013).
Du et al., "The Significance and Therapeutic Potential of GATA3 Expression and Mutation in Breast Cancer: A Systematic Review," Med Res Rev, 35(6):1300-1315 (2015).
Final Rejection for U.S. Appl. No. 14/794,449, "Compositions and Methods of Identifying Tumor Specific Neoantigens," dated Apr. 5, 2019.
Final Rejection for U.S. Appl. No. 14/877,125, "Compositions and Methods for Personalized Neoplasia Vaccines," dated May 24, 2019.
Final Rejection for U.S. Appl. No. 15/513,127, "Use of Clonal Evolution Analysis for Ibrutinib Resistance in Chronic Lymphocytic Leukemia Patients," dated May 17, 2019.
Final Rejection for U.S. Appl. No. 16/181,098, "Compositions and Methods of Identifying Tumor Specific Neoantigens," dated Jun. 17, 2019.
Mackall et al., "Targeting tumor specific translocations in sarcomas in pediatric patients for immunotherapy," Clinical Orthopaedics and Related Research, 373:25-31 (2000).
Mardis, "The impact of next-generation sequencing technology on genetics," Trends in Genetics, 24(3):133-141 (2007).
Non-Final Office Action for U.S. Appl. No. 15/102,129, "Formulations for Neoplasia Vaccines," dated Apr. 26, 2019.
Non-Final Office Action for U.S. Appl. No. 15/575,328, "Shared Neoantigens," dated Jun. 27, 2019.
O'Mahony et al., "A Pilot Study of CTLA-4 Blockade after Cancer Vaccine Failure in Patients with Advanced Malignancy" Clin Canc Res 13(3):958-964 (2007).
Peters et al., "Accurate whole-genome sequencing and haplotyping from 10 to 20 human cells," Nature 487:190-195 (2012).
Restriction Requirement for U.S. Appl. No. 15/537,839, "Molecular Biomarkers for Cancer Immunotherapy," dated Jun. 20, 2019.
Vita et al., "The Immune Epitope Database 2.0," Nucleic Acids Res, 38:D854-D862 (2010).
U.S. Appl. No. 16/094,786, filed Oct. 18, 2018, Pending.
U.S. Appl. No. 13/108,610, filed May 16, 2011, 2011-0293637, U.S. Pat. No. 9,115,402, Granted.
U.S. Appl. No. 14/794,449, filed Jul. 8, 2015, 2016-00008447, Published.
U.S. Appl. No. 15/187,174, filed Jun. 20, 2016, 2016-0331822, Published.
U.S. Appl. No. 15/800,732, filed Nov. 1, 2017, 2018-0055922, Published.
U.S. Appl. No. 16/181,098, filed Nov. 5, 2018, Pending.
U.S. Appl. No. 16/188,737, filed Nov. 13, 2018, U.S. Pat. No. 10,426,824, Granted.
U.S. Appl. No. 16/381,791, filed Apr. 11, 2019, Pending.
U.S. Appl. No. 16/528,195, filed Jul. 31, 2019, Pending.
U.S. Appl. No. 14/877,125, filed Oct. 7, 2015, 2016-0101170, Published.
U.S. Appl. No. 15/102,129, filed Jun. 6, 2016, 2016-0310584, Published.
U.S. Appl. No. 15/038,504, filed May 23, 2016, 2016-0326593, Published.
U.S. Appl. No. 15/105,961, filed Jun. 17, 2016, 2016-0339090, Published.
U.S. Appl. No. 15/537,785, filed Jun. 19, 2017, 2018-0000913, Published.
U.S. Appl. No. 15/537,839, filed Jun. 19, 2017, 2019-0127803, Published.
U.S. Appl. No. 15/575,328, filed Nov. 17, 2017, 2018-0153975, Published.
U.S. Appl. No. 15/513,127, filed Mar. 21, 2017, 2017-0298441, Published.
U.S. Appl. No. 15/735,566, filed Dec. 11, 2017, 2019-0060428, Published.
U.S. Appl. No. 16/480,535, filed Jul. 24, 2019, Pending.
PCT/US18/14831, Jan. 23, 2018, WO2018/140391, Published.
11781409.5 (opposition therein), May 16, 2011, 2569633, 2569633, Granted-opposition pending.

* cited by examiner

SHARED NEOANTIGENS

RELATED APPLICATIONS AND INCORPORATION BY REFERENCE

This application is a § 371 of international patent application Serial No. PCT/US2016/033452 filed May 20, 2016, which published as PCT Publication No. WO 2016/187508 on Nov. 24, 2016, which claims priority and benefit of U.S. Provisional application Ser. No. 62/179,877 filed May 20, 2015 and U.S. Provisional application Ser. No. 62/389,377 filed Feb. 23, 2016.

The foregoing applications, and all documents cited therein or during their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

SEQUENCE LISTING

The instant application contains a "lengthy" Sequence Listing which has been submitted electronically in ASCII format and is hereby incorporated by reference in its entirety. Said ASCII format, created on Aug. 11, 2016, is named 47608_99_2007_SL.txt and is 10,252,288 bytes in size.

FIELD OF THE INVENTION

The present invention relates to methods and compositions for treating neoplasias, e.g. tumors, particularly using at least one neoantigenic peptide which is suitable for treating a significant proportion of subjects in a population suffering from cancer.

BACKGROUND OF THE INVENTION

Approximately 1.6 million Americans are diagnosed with neoplasia every year, and approximately 580,000 people in the United States are expected to die of the disease in 2013. Over the past few decades there been significant improvements in the detection, diagnosis, and treatment of neoplasia, which have significantly increased the survival rate for many types of neoplasia. However, only about 60% of people diagnosed with neoplasia are still alive 5 years after the onset of treatment, which makes neoplasia the second leading cause of death in the United States.

Currently, there are a number of different existing cancer therapies, including ablation techniques (e.g., surgical procedures, cryogenic/heat treatment, ultrasound, radiofrequency, and radiation) and chemical techniques (e.g., pharmaceutical agents, cytotoxic/chemotherapeutic agents, monoclonal antibodies, and various combinations thereof). Unfortunately, such therapies are frequently associated with serious risk, toxic side effects, and extremely high costs, as well as uncertain efficacy.

There is a growing interest in cancer therapies that seek to target cancerous cells with a patient's own immune system (e.g., cancer vaccines) because such therapies may mitigate/eliminate some of the herein-described disadvantages. Cancer vaccines are typically composed of tumor antigens and immunostimulatory molecules (e.g., cytokines or TLR ligands) that work together to induce antigen-specific cytotoxic T cells that target and destroy tumor cells. Current cancer vaccines may contain shared tumor antigens, which are native proteins (i.e.—proteins encoded by the DNA of all the normal cells in the individual) that are selectively expressed or over-expressed in tumors found in many individuals. While such shared tumor antigens are useful in identifying particular types of tumors, they are not ideal as immunogens for targeting a T-cell response to a particular tumor type because they are subject to the immune dampening effects of self-tolerance. Vaccines containing tumor-specific and patient-specific neoantigens can overcome some of the disadvantages of vaccines containing shared tumor antigens. However, the use of patient-specific neoantigens requires sequencing of individual subject's genomes, as well as the production of personalized compositions comprising a combination of neoantigens present in that individual subject. Accordingly, there is still a need for improved methods and compositions for delivering cancer vaccines.

Citation or identification of any document in this application is not an admission that such document is available as prior art to the present invention.

SUMMARY OF THE INVENTION

Preferred statements (features) and embodiments of this invention are set herein below. Each statements and embodiments of the invention so defined may be combined with any other statement and/or embodiments unless clearly indicated to the contrary. In particular, any feature indicated as being preferred or advantageous may be combined with any other feature or features or statements indicated as being preferred or advantageous. Hereto, the present invention is in particular captured by any one or any combination of one or more of the below statements and embodiments, with any other statement and/or embodiments.

It is an objective of the invention to provide methods and compositions for the treatment of a population of cancer patients by eliciting an immune response targeting the cancer. In one aspect, the present invention relates to a pharmaceutical composition comprising at least one neoantigenic peptide and a pharmaceutically acceptable carrier, each at least one neoantigenic peptide comprising a tumor-specific neoepitope capable of binding to an HLA protein in a subject, each tumor-specific neoepitope comprising a tumor-specific mutation present in a tumor. The composition may include one neoantigenic peptide. In other embodiments, the composition may include more than 100 neoantigenic peptides. Preferably, the composition includes about 20 neoantigenic peptides. The at least one neoantigenic peptide may include a tumor-specific mutation. The mutation may be recurrent. Preferably, the mutation is present in a large proportion of a population. A recurrent mutation may be based on the mutation being present in a tumor in at least 1% of subjects in a population of subjects suffering from cancer. The composition may include at least one neoantigenic peptide containing a tumor-specific neoepitope which binds to an HLA protein present in at least 5% of subjects in the population of subjects suffering from cancer. Additionally, the composition may contain at least one neoantigenic peptide capable of eliciting an immune response against a tumor present in at least 5% of the subjects in the population of subjects suffering from cancer. The ability to elicit an immune response refers to the ability of the immune system to present an antigen to a lymphocyte. In order for the immune system to present an antigen, the antigen needs to be presented by a subjects HLA proteins. In order to elicit an immune response against a tumor, the tumor needs to contain the mutations leading to expression of the antigen. In order for the composition to provide a benefit to a population in need thereof, the population has to include subjects that express an HLA allele capable of binding the at least one neoantigenic peptide present in the composition and the population has to include subjects containing tumors with mutations that lead to neoantigenic epitopes present in the neoantigenic peptides.

The composition may be specific to a population of subjects suffering from cancer that share a characteristic. The population may have cancer or may have a specific cancer. The population may share a common set of HLA subtypes. They may share HLA subtypes based on ethnicity. Not being bound by a theory the percentage of HLA types in a population can be predicted based on ethnicity without testing. Not being bound by a theory, different populations express different HLA types capable of binding different neoantigenic peptides. Therefore a composition can be formulated to provide a benefit to a large proportion of that population, whereas the composition would not provide a benefit to another population. Not being bound by a theory, different cancers contain different mutations and thus compositions tailored to specific cancers can be used to provide a greater benefit to a population with one type of cancer as compared to a population that includes more than one type. In one embodiment, the population is suffering from adrenocortical carcinoma (ACC), bladder urothelial carcinoma (BLCA), breast invasive carcinoma (BRCA), cervical squamous cell carcinoma and endocervical adenocarcinoma (CESC), colon adenocarcinoma (COAD), Chronic lymphocytic Leukaemia (CLL), colorectal cancer (CRC), Diffuse large B-cell lymphoma (DLBCL), glioblastoma multiforme (GBM), head and neck squamous cell carcinoma (HNSC), kidney chromophobe (KICH), kidney renal clear cell carcinoma (KIRC), kidney renal papillary cell carcinoma (KIRP), acute myeloid leukemia (LAML), liver hepatocellular carcinoma (LIHC), lung adenocarcinoma (LUAD), lung squamous cell carcinoma (LUSC), multiple myeloma (MM), ovarian serous cystadenocarcinoma (OV), pancreatic adenocarcinoma (PAAD), prostate adenocarcinoma (PRAD), rectum adenocarcinoma (READ), skin cutaneous melanoma (SKCM), stomach adenocarcinoma (STAD), testicular germ cell tumors (TGCT), thyroid adenocarcinoma (THCA), uterine corpus endometrioid carcinoma (UCEC), or uterine carcinosarcoma (UCS).

In one embodiment, the population of subjects is suffering from CLL; the at least one tumor-specific mutation comprises any combination of mutations in Table 8 with an exemplary disease of "CLL"; and at least one of a set of six of the at least one tumor-specific mutation will be found in 17.49?% of subjects in the CLL population. The population of subjects may be suffering from BLCA, the at least one tumor-specific mutation comprises any combination of mutations in Table 8 with an exemplary disease of "BLCA"; and at least one of a set of six of the at least one tumor-specific mutation will be found in 26.92% of subjects in the population. The population of subjects may be suffering from BRCA; the at least one tumor-specific mutation comprises any combination of mutations in Table 8 with an exemplary disease of "BRCA"; and at least one of a set of 18 of the at least one tumor-specific mutation will be found in 36.04% of subjects in the population. The population of subjects may be suffering from COAD; the at least one tumor-specific mutation comprises any combination of mutations in Table 8 with an exemplary disease of "COAD"; and at least one of a set of three of the at least one tumor-specific mutation will be found in 27.14% of subjects in the population. The population of subjects may be suffering from GBM; the at least one tumor-specific mutation comprises any combination of mutations in Table 8 with an exemplary disease of "GBM"; and at least one of a set of 14 of the at least one tumor-specific mutation will be found in 34.36% of subjects in the population. The population of subjects may be suffering from HNSC; the at least one tumor-specific mutation comprises any combination of mutations in Table 8 with an exemplary disease of "HNSC"; and at least one of a set of 10 of the at least one tumor-specific mutation will be found in 21.61% of subjects in the population. The population of subjects may be suffering from KIRC; the at least one tumor-specific mutation comprises any combination of mutations in Table 8 with an exemplary disease of "KIRC"; and at least one of a set of four of the at least one tumor-specific mutation will be found in 6% of subjects in the population. The population of subjects may be suffering from LAML; the at least one tumor-specific mutation comprises any combination of mutations in Table 8 with an exemplary disease of "LAML"; and at least one of a set of 11 of the at least one tumor-specific mutation will be found in 47.45% of subjects in the population. The population of subjects may be suffering from LUAD; the at least one tumor-specific mutation comprises any combination of mutations in Table 8 with an exemplary disease of "LUAD"; and at least one of a set of 11 of the at least one tumor-specific mutation will be found in 33.42% of subjects in the population. The population of subjects may be suffering from LUSC; the at least one tumor-specific mutation comprises any combination of mutations in Table 8 with an exemplary disease of "LUSC"; and at least one of a set of two of the at least one tumor-specific mutation will be found in 7.87% of subjects in the population. The population of subjects may be suffering from OV; the at least one tumor-specific mutation comprises any combination of mutations in Table 8 with an exemplary disease of "OV"; and at least one of a set of ten of the at least one tumor-specific mutation will be found in 22.78% of subjects in the population. The population of subjects may be suffering from READ; the at least one tumor-specific mutation comprises any combination of mutations in Table 8 with an exemplary disease of "READ"; and at least one of a set of two of the at least one tumor-specific mutation will be found in 20.51% of subjects in the population. The population of subjects may be suffering from SKCM; the at least one tumor-specific mutation comprises any combination of mutations in Table 8 with an exemplary disease of "SKCM"; and at least one of a set 64 of the at least one tumor-specific mutation will be found in 90.91% of subjects in the population. The population of subjects may be suffering from UCEC; the at least one tumor-specific mutation comprises any combination of mutations in Table 8 with an exemplary disease of "UCEC"; and at least one of a set of 30 of the at least one tumor-specific mutation will be found in 67.74% of subjects in the population. The population of subjects may be suffering from ACC; the at least one tumor-specific mutation comprises any combination of mutations in Table 8 with an exemplary disease of "ACC"; and at least one of a set of 161 of the at least one tumor-specific mutation will be found in 50% of subjects in the population. The population of subjects may be suffering from CESC; the at least one tumor-specific mutation comprises any combination of mutations in Table 8 with an exemplary disease of "CESC"; and at least one of a set of four of the at least one tumor-specific mutation will be found in 23.71% of subjects in the population. The population of subjects may be suffering from CRC; the at least one tumor-specific mutation comprises any combination of mutations in Table 8 with an exemplary disease of "CRC"; and at least one of a set of 15 of the at least one tumor-specific mutation will be found in 56.65% of subjects in the population. The population of subjects may be suffering from DLBCL; the at least one tumor-specific mutation comprises any combination of mutations in Table 8 with an exemplary disease of "DLBCL"; and at least one of a set of 2 of the at least one tumor-specific mutation will be found in 13.79% of subjects in the population. The population of subjects may be suffering from KICH; the at least one tumor-specific mutation comprises any combination of mutations in Table 8 with an exemplary disease of "KICH"; and at least one of a set of 24 of the at least one tumor-specific mutation will be found in 50% of subjects in the population. The population of subjects may be suffering from KIRP; the at least one tumor-specific mutation comprises any combination of mutations in Table 8 with an exemplary disease of "KIRP"; and at least one of a set of nine of the at least one tumor-specific mutation will be found in 42.24% of subjects in the population. The population of subjects may be suffering from LIHC; the at least one tumor-specific mutation comprises any combination of mutations in Table 8 with an exemplary disease of "LIHC"; and at least one of a set of 2 of the at least one tumor-specific mutation will be found in 6.57% of subjects in the population. The population of subjects may be suffering from MM; the at least one tumor-specific mutation comprises any combination of mutations in Table 8 with an exemplary disease of "MM"; and at least one of a set of 6 of the at least one tumor-specific mutation will be found in 23.9% of subjects in the population. The population of subjects may be suffering from PRAD; the at least one tumor-specific mutation comprises any combination of mutations in Table 8 with an exemplary disease of "PRAD"; and at least one of a set of 24 of the at least one tumor-specific mutation will be found in 39.85% of subjects in the population. The population of subjects may be suffering from STAD; the at least one tumor-specific mutation comprises any combination of mutations in Table 8 with an exemplary disease of "STAD"; and at least one of a set of 150 of the at least one tumor-specific mutation will be found in 48.79% of subjects in the population. The population of subjects may be suffering from TGCT; the at least one tumor-specific mutation comprises any combination of mutations in Table 8 with an exemplary disease of "TGCT"; and at least one of a set of 14 of the at least one tumor-specific mutation will be found in 51.61% of subjects in the population. The population of subjects may be suffering from THCA; the at least one tumor-specific mutation comprises any combination of mutations in Table 8 with an exemplary disease of "THCA"; and at least one of a set of five of the at least one tumor-specific mutation will be found in 69.88% of subjects in the population. The population of subjects may be suffering from UCS; the at least one tumor-specific mutation comprises any combination of mutations in Table 8 with an exemplary disease of "UCS"; and at least one of a set of two of the at least one tumor-specific mutation will be found in 16.07% of subjects in the population. The population of subjects may be suffering from PAAD; the at least one tumor-specific mutation comprises any combination of mutations in Table 8 with an exemplary disease of "PAAD"; and at least one of a set of 53 of the at least one tumor-specific mutation will be found in 50% of subjects in the population. The population of subjects may also be suffering from a solid tumor. The solid tumor may be clear cell Renal Cell Carcinoma (ccRCC), melanoma, sarcoma, or a cancer of the bladder, colon, brain, breast, head and neck, endometrium, lung, ovary, pancreas or prostate. The population of subjects may be suffering from a liquid tumor. The liquid tumor may be Non-Hodgkin's lymphoma or leukemia.

In another embodiment, the at least one tumor-specific mutation has an incidence of at least 500 patients a year in the population of subjects suffering from cancer, and wherein the at least one mutation may be a mutation listed for the population in Table 9. The at least one neoantigenic peptide may be at least one peptide listed in Table 9.

In another embodiment, the population suffering from cancer is being treated with a drug or therapy. The population suffering from cancer may have been previously treated with, is currently being treated with, or is selected to treated with ibrutinib, erlotinib, imatinib, gefitinib, crizotinib, trastuzumab, vemurafenib, RAF/MEK or antiestrogen therapy.

In another embodiment, the composition comprises at least one neoantigenic peptide capable of eliciting an immune response against a tumor present in at least 5%, 10%, 20%, 30%, 40%, 50%, 60%, 70%, 80%, 90%, 95% or 99% of subjects in a population of subjects suffering from cancer.

In another embodiment, at least 5%, 10%, 20%, 30%, 40%, 50%, 60%, 70%, 80%, 90%, 95% or 99% of subjects in the population has at least one tumor-specific mutation present in the composition; and at least 5%, 10%, 20%, 30%, 40%, 50%, 60%, 70%, 80%, 90%, 95% or 99% of subjects in the population has at least one HLA protein which binds to a tumor-specific neoepitope present in the composition.

In one embodiment, the tumor-specific mutations comprise splice-variant mutations, point mutations, and/or frameshift mutations. In another embodiment, the tumor-specific mutations comprise drug resistance mutations. In one embodiment, the neoantigenic peptides include not only the resulting mutated neoantigen protein sequence, but a long peptide region surrounding and including the mutation and includes all contiguous segments within it (see Tables 1-4). In one embodiment, the tumor-specific mutations are present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Abl, c-kit, PIK3CA, HER2, EML4-ALK, KRAS, ALK, ROS1, AKT1, BRAF, MEKJ, MEK2, NRAS, RAC1, and ESR1. In one embodiment, the tumor-specific mutations are present in one or more genes listed in any of the Tables presented herein. In one embodiment, the at least one tumor-specific mutation is derived from alternative splicing of PD-L1 or AR. In one embodiment, the at least one tumor-specific mutation is derived from splice variant sPD-L1, AR-V1 or AR-V7. In one embodiment, the least one tumor-specific mutation is a drug resistance mutation selected from the group consisting of BTK/C481S, EGFR/T790M, BCR-Abl/T315I, BCR-Abl/Y253H, BCR-Abl/E255K, BCR-Abl/E255V, c-kit/T670L PIK3CA/E545K, PIK3CA/E542K, HER2/G776(YVMA), HER2/E545K, EML4-ALK/G1269A, KRAS/G12V/D, ALK/L196M, ALK/G1202R, ALK/S1206Y, ALK/1151T(ins), ALK/F1174C, ROS1/G2032R, AKT1/E17K, BRAF/V600E, MEK1/Q56P, MEK1/E203K, MEK1/C121S, MEK1/V60E, MEK1/G128V, MEK1/V54I, MEK1/P124S, MEK1/P124L, NRAS/Q61K/L/R, NRAS/T58I, MEK2/C125S, RAC1/P29S, ESR1/S463P, AR/V534E, AR/P535H, AR/L536Q, AR/L536R, AR/Y537C, AR/Y537S, AR/Y537N, AR/D538G and AR/F876L. In one embodiment, the drug resistance mutation is induced by treatment with ibrutinib, erlotinib, imatinib, gefitinib, crizotinib, trastuzumab, vemurafenib, RAF/MEK or antiestrogen therapy. In another embodiment, a subject has a drug resistance mutation before treatment.

In another embodiment, the composition comprises at least 2, 3, 4, 5, 6, 7, 8, 9, 10, 11, 12, 13, 14, 15, 16, 17, 18, 19 or 20 neoantigenic peptides. The composition may include 15 to 20 neoantigenic peptides. The composition may include greater than 100, 200, or 300 neoantigenic peptides. Each neoantigenic peptide may be from about 5 to about 50 amino acids in length.

In another embodiment, the pharmaceutical composition is an immunogenic or vaccine composition. The pharmaceutical composition may further comprise an immunomodulator or adjuvant. The immunodulator or adjuvant may be selected from the group consisting of poly-ICLC, 1018 ISS, aluminum salts, Amplivax, ASIS, BCG, CP-870,893, CpG7909, CyaA, cyclic di-nucleotides such as STING, dSLIM, GM-CSF, IC30, IC31, Imiquimod, ImuFact IMP321, IS Patch, ISS, ISCOMATRIX, Juvlmmune, LipoVac, MF59, monophosphoryllipid A, Montanide IMS 1312, Montanide ISA 206, Montanide ISA 50V, Montanide ISA-51, OK-432, OM-174, OM-197-MP-EC, ONTAK, PepTel®, vector system, PLGA microparticles, resiquimod, SRL172, Virosomes and other Virus-like particles, YF-17D, VEGF trap, R848, beta-glucan, Pam3Cys, and Aquila's QS21 stimulon.

In another embodiment, the pharmaceutical composition comprises one or more neoantigenic peptides as defined in Table 1, 2, 3 or 4.

In one embodiment, each tumor-specific neoepitope binds to HLA-A, -B or -C or to HLADRB, HLADBM XXXXX with a $K_D$ of less than 500 nM.

In another aspect, the present invention relates to a method of treating or preventing a tumor in a subject in need thereof by administering to the subject any pharmaceutical composition as described herein.

In one embodiment, a method of treating or preventing a tumor in a patient in need thereof is provided, comprising administering to a patient a composition comprising at least one neoantigenic peptide and a pharmaceutically acceptable carrier, each at least one neoantigenic peptide comprising a tumor-specific neoepitope capable of binding to an HLA protein in a subject, each tumor-specific neoepitope comprising a tumor-specific mutation present in a tumor, wherein the composition comprises at least one neoantigenic peptide comprising a tumor-specific mutation present in a tumor in at least 1% of subjects in a population of subjects suffering from cancer; the composition comprises at least one neoantigenic peptide comprising a tumor-specific neoepitope which binds to an HLA protein present in at least 5% of subjects in the population of subjects suffering from cancer; and the composition comprises at least one neoantigenic peptide capable of eliciting an immune response against a tumor present in at least 5% of the subjects in the population of subjects suffering from cancer.

In one embodiment, the population of subjects is suffering from adrenocortical carcinoma (ACC), bladder urothelial carcinoma (BLCA), breast invasive carcinoma (BRCA), cervical squamous cell carcinoma and endocervical adenocarcinoma (CESC), colon adenocarcinoma (COAD), Chronic lymphocytic Leukaemia (CLL), colorectal cancer (CRC), Diffuse large B-cell lymphoma (DLBCL), glioblastoma multiforme (GBM), head and neck squamous cell carcinoma (HNSC), kidney chromophobe (KICH), kidney renal clear cell carcinoma (KIRC), kidney renal papillary cell carcinoma (KIRP), acute myeloid leukemia (LAML), liver hepatocellular carcinoma (LIHC), lung adenocarcinoma (LUAD), lung squamous cell carcinoma (LUSC), multiple myeloma (MM), ovarian serous cystadenocarcinoma (OV), pancreatic adenocarcinoma (PAAD), prostate adenocarcinoma (PRAD), rectum adenocarcinoma (READ), skin cutaneous melanoma (SKCM), stomach adenocarcinoma (STAD), testicular germ cell tumors (TGCT), thyroid adenocarcinoma (THCA), uterine corpus endometrioid carcinoma (UCEC), or uterine carcinosarcoma (UCS). In one embodiment, the population of subjects is suffering from a solid tumor. The solid tumor may be clear cell Renal Cell Carcinoma (ccRCC), melanoma, sarcoma, or a cancer of the bladder, colon, brain, breast, head and neck, endometrium, lung, ovary, pancreas or prostate. In one embodiment, the population of subjects is suffering from a liquid tumor. The liquid tumor may be Non-Hodgkin's lymphoma or leukemia.

In one embodiment, the population suffering from cancer was treated with, is being treated with, or is selected to treated with ibrutinib, erlotinib, imatinib, gefitinib, crizotinib, trastuzumab, vemurafenib, RAF/MEK or antiestrogen therapy.

In one embodiment, the at least one neoantigenic peptide is capable of eliciting an immune response against a tumor present in at least 5%, 10%, 20%, 30%, 40%, 50%, 60%, 70%, 80%, 90%, 95% or 99% of subjects in the population of subjects suffering from cancer. In one embodiment, at least 5%, 10%, 20%, 30%, 40%, 50%, 60%, 70%, 80%, 90%, 95% or 99% of subjects in the population has at least one tumor-specific mutation present in the composition and, at least 5%, 10%, 20%, 30%, 40%, 50%, 60%, 70%, 80%, 90%, 95% or 99% of subjects in the population has at least one HLA protein which binds to a tumor-specific neoepitope present in the composition.

In another embodiment, the tumor-specific mutations comprise splice-variant mutations, point mutations, and/or frameshift mutations. The tumor-specific mutations may be drug resistance mutations. The tumor-specific mutations may be present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Abl, c-kit, PIK3CA, HER2, EML4-ALK, KRAS, ALK, ROS1, AKT1, BRAF, MEK1, MEK2, NRAS, RAC1, and ESR1. The tumor-specific mutations may be present in one or more genes listed in any of the Tables. The at least one tumor-specific mutation may be derived from alternative splicing of PD-L1 or AR. The at least one tumor-specific mutation may be derived from splice variant sPD-L1, AR-V1 or AR-V7.

In one embodiment, the at least one tumor-specific mutation is a drug resistance mutation selected from the group consisting of BTK/C481S, EGFR/T790M, BCR-Abl/T315I, BCR-Abl/Y253H, BCR-Abl/E255K, BCR-Abl/E255V, c-kit/T670I, PIK3CA/E545K, PIK3CA/E542K, HER2/G776(YVMA), HER2/E545K, EML4-ALK/G1269A, KRAS/G12V/D, ALK/L196M, ALK/G1202R, ALK/S1206Y, ALK/I151T(ins), ALK/F174C, ROS1/G2032R, AKT1/E17K, BRAF/V600E, MEK1/Q56P, MEK1/E203K, MEK1/C121S, MEK1/V60E, MEK1/G128V, MEK1/V54I, MEK1/P124S, MEK1/P124L, NRAS/Q61K/L/R, NRAS/ T58I, MEK2/C125S, RAC1/P29S, ESR1/S463P, AR/V534E, AR/P535H, AR/L536Q, AR/L536R, AR/Y537C, AR/Y537S, AR/Y537N, AR/D538G and AR/F876L. The drug resistance mutation may be induced by treatment with ibrutinib, erlotinib, imatinib, gefitinib, crizotinib, trastuzumab, vemurafenib, RAF/MEK or antiestrogen therapy.

In another embodiment, the composition comprises at least 2, 3, 4, 5, 6, 7, 8, 9, 10, 11, 12, 13, 14, 15, 16, 17, 18, 19 or 20 neoantigenic peptides. In a preferred embodiment, the composition comprises 15 to 20 neoantigenic peptides.

In another embodiment, each neoantigenic peptide is from about 5 to about 50 amino acids in length.

In another embodiment, the composition is an immunogenic or vaccine composition. For instance, the immunogenic or vaccine composition may comprise an immunomodulator or adjuvant. The immunodulator or adjuvant may be selected from the group consisting of poly-ICLC, 1018 ISS, aluminum salts, Amplivax, AS15, BCG, CP-870,893, CpG7909, CyaA, cyclic di-nucleotides such as STING, dSLIM, GM-CSF, IC30, IC31, Imiquimod, ImuFact IMP321, IS Patch, ISS, ISCOMATRIX, JuvImmune, Lipo-Vac, MF59, monophosphoryllipid A, Montanide IMS 1312, Montanide ISA 206, Montanide ISA 50V, Montanide ISA-51, OK-432, OM-174, OM-197-MP-EC, ONTAK, PepTel®, vector system, PLGA microparticles, resiquimod, SRL172, Virosomes and other Virus-like particles, YF-17D, VEGF trap, R848, beta-glucan, Pam3Cys, and Aquila's QS21 stimulon.

In one embodiment, the composition comprises one or more neoantigenic peptides as defined in Table 1, 2, 3 or 4.

In one embodiment, each tumor-specific neoepitope binds to HLA-A, -B or -C or to HLADRB, HLADBM XXXXX with a $K_D$ of less than 500 nM.

In another aspect, the present invention provides a method of prophylactic cancer treatment comprising selecting a cancer drug for a patient in need thereof, the drug selected from the group consisting of ibrutinib, erlotinib, imatinib, gefitinib, crizotinib, trastuzumab, vemurafenib, RAF/MEK and antiestrogen therapy; and administering prophylactically to the subject, before drug resistant mutations can be detected, a pharmaceutical composition comprising neoantigenic peptides derived from drug resistant mutations associated with the selected cancer drug.

The shared neoantigen immunogenic composition can be administered via subcompositions, each containing a portion of the neoantigens, and sub-compositions can be administered to different places on the subject or patient; for instance, a composition comprising 20 different neoantigens, can be administered in four (4) subcompositions, each containing 5 of the 20 different neoantigens, and the four (4) subcompositions can be administered so as to endeavor to deliver each subcomposition to a separate set of draining lymph nodes of the patient, e.g., to each of the arms and legs (e.g., thigh or upper thigh or near buttocks or lower back on each side of the patient) so as to endeavor to deliver fewer neoantigens to each set of draining lymph nodes of the patient or subject and thereby limit competition between neoantigens. Of course, the number of locations and hence number of subcompositions can vary, e.g., the skilled practitioner could consider administration at or near the spleen to have a fifth point of administration, and the skilled practitioner can vary the locations such that only one, two or three are used (e.g., each arm and a leg, each of legs and one arm, each of the legs and no arms, or only both arms). The shared neoantigen immunogenic composition administered at the aforementioned various intervals can be different formulations, and the subcompositions administered at different places on the subject or patient during a single administration can be different compositions. For instance, a first administration can be of a whole shared neoantigen immunogenic composition and a next or later administration can be of a vector (e.g., viral vector or plasmid) that has expression of antigen(s) in vivo. Likewise, in the administration of different subcompositions to different locations on the patient or subject, some of the subcompositions can comprise a whole antigen and some of the subcompositions can comprise a vector (e.g., viral vector or plasmid) that has expression of antigen(s) in vivo. And some compositions and subcompositions can comprise both vector(s) (e.g., viral vector or plasmid) that has/have expression of antigen(s) in vivo and whole antigens. Some vectors (e.g., poxvirus) that have expression of antigen(s) in vivo can have an immunostimulatory or adjuvanting effect, and hence compositions or subcompositions that contain such vectors can be self-adjuvanting. Also, by changing up the nature of how the antigens are presented to the immune system, the administrations can "prime" and then "boost" the immune system. And in this text, when there is mention of a "vaccine" it is intended that the invention comprehends immunogenic compositions, and when there is mention of a patient or subject it is intended that such an individual is a patient or subject in need of the herein disclosed treatments, administrations, compositions, and generally the subject invention.

Moreover, the invention applies to the use of any type of expression vector, such as a viral expression vector, e.g., poxvirus (e.g., orthopoxvirus or avipoxvirus such as vaccinia virus, including Modified Vaccinia Ankara or MVA, MVA-BN, NYVAC according to WO-A-92/15672, fowlpox, e.g., TROVAX, canarypox, e.g., ALVAC (WO-A-95/27780 and WO-A-92/15672) pigeonpox, swinepox and the like), adenovirus, AAV, herpesvirus, and lentivirus; or a plasmid or DNA or nucleic acid molecule vector. Some vectors that are cytoplasmic, such as poxvirus vectors, may be advantageous. However adenovirus, AAV and lentivirus can also be advantageous to use in the practice of the invention.

In a ready-for-use, especially reconstituted, shared neoantigen immunogenic composition, the vector, e.g., viral vector, is present in the quantities within the ambit of the skilled person from this disclosure and the knowledge in the art (such as in patent and scientific literature cited herein).

Whole antigen or vector, e.g., recombinant live vaccines may exist in a freeze-dried form allowing their storage and are reconstituted immediately before use in a solvent or excipient, which can include an adjuvant as herein discussed.

The subject of the invention is therefore also a vaccination or immunization set or kit comprising, packaged separately, freeze-dried vaccine and a solution, advantageously including an adjuvant compound as herein discussed for the reconstitution of the freeze-dried vaccine.

The subject of the invention is also a method of vaccination or immunization comprising or consisting essentially of or consisting of administering, e.g., by the parenteral, preferably subcutaneous, intramuscular or intradermal, route or by the mucosal route a vaccine or immunogenic composition in accordance with the invention at the rate of one or more administrations. Optionally this method includes a preliminary step of reconstituting the freeze-dried shared neoantigen immunogenic composition (e.g., if lyophilized whole antigen or vector) in a solution, advantageously also including an adjuvant.

In one embodiment, the shared neoantigen immunogenic composition is administered at a dose of about 10 μg to 1 mg per 70 kg individual as to each neoantigenic peptide. In another embodiment, the shared neoantigen immunogenic composition is administered at an average weekly dose level of about 10 μg to 2000 μg per 70 kg individual as to each neoantigenic peptide. In another related embodiment, the administration is intravenous. In one embodiment, the shared neoantigen immunogenic composition is administered intravenously or subcutaneously.

In another embodiment, the method further comprises (a) obtaining a sample of tumor tissue from each subject; (b) detecting one or more of the tumor-specific mutations in the sample; and (c) selecting a subject from the population of subjects for treatment with the at least one neoantigenic peptides if at least one of the tumor-specific mutations are detected in the sample from the subject.

In another embodiment, the method further comprises (a) determining HLA allotypes present in each subject; and (b) selecting a subject from the population of subjects for treatment with the at least one neoantigenic peptides if one or more HLA allotypes present in the subject binds to one or more of the tumor-specific neoepitopes present in the at least one neoantigenic peptides.

Embodiments of the present invention relate to compositions and methods using shared neoantigens, which (unlike shared native (non-mutated) antigens derived from genes differentially expressed in tumors) have desirable properties such as not being subject to the immune-dampening effects of central tolerance and high tumor specificity. This is because the neoantigens are expressed only in tumor tissue, e.g. are generated by tumor-specific mutations or splicing defects. Such splice variants or mutations may generate immunogenic epitopes across a variety of HLA alleles, thus covering a significant proportion of the population. Moreover, because these mutations may be present in a significant proportion of subjects suffering from cancer, the compositions described herein do not require sequencing of whole genomes of subjects and may be used as an "off-the-shelf" product to treat multiple subjects. For instance, the method may simply involve detecting in a tumor sample from the subject one or more of the specific mutations present in the composition, and administering the composition to subjects in which at least one mutation is present. This is in contrast to methods using patient-specific neoantigen mixtures, which require whole genome or whole exome sequencing of each subject and the production of personalized treatment compositions.

Other embodiments relate to a combination therapy wherein the methods of treatment using a shared neoantigen composition of the present invention are used in concert with a current drug regimen. The shared neoantigen composition may be administered prophylactically. In one embodiment, a patient in need thereof is treated with chemotherapy and/or a targeted therapy in combination with a shared neoantigen immunogenic composition before a drug resistance mutation can be detected. The shared neoantigen immunogenic composition can be tailored to include neoantigen peptides specific to the resistance mutations associated with a chosen therapy. In another embodiment, the shared neoantigen composition is administered before the subject is treated with a chemotherapy and/or a targeted therapy, to generate an immune response to cells harboring a drug resistance mutation before such cells develop. The administering can be serially or sequentially or at substantially the same time or substantially simultaneously. For example, the administering of the shared neoantigen immunogenic composition and the administering of a cancer therapy can be at about the same time or substantially simultaneously. Alternatively, the administering of the shared neoantigen immunogenic composition can be on one time schedule, e.g., weekly, biweekly, every three weeks, monthly, bimonthly, every quarter year (every three months), every third of a year (every four months), every five months, twice yearly (every six months), every seven months, every eight months, every nine months, every ten months, every eleven months, annually or the like, and the administering of the cancer therapy can be on a different schedule that is typical for the therapy such that the subject or patient has two different treatment schedules running concomitantly and the administering of the shared neoantigen immunogenic composition and the administering of the cancer therapy can be sequentially or serially. In preferred embodiments the subject may be treated with ibrutinib, erlotinib, imatinib, gefitinib, crizotinib, trastuzumab, vemurafenib, RAF/MEK or antiestrogen therapy.

In another aspect the present invention provides a diagnostic method for early detection and tracking of cancer progression by determining the presence of at least one neoantigenic peptide of the present invention in a patient sample. The patient sample may be derived from blood, sputum, saliva, urine, tumor tissue, lymphatic fluid, semen or feces.

In one embodiment, the diagnostic method is used before administering the shared neoantigen composition as described herein. The diagnostic method may include comparing the amount of shared neoantigen mutations in a series of at least two samples taken during treatment with a cancer therapy and/or shared neoantigen composition. Not being bound by a theory, an increase or decrease in shared neoantigen mutations can be used to determine treatment efficacy.

In one embodiment, the mutated genes can be detected using PCR based methods or sequencing. Reverse transcription PCR (RT-PCR) can be used to detect mutations in transcribed neoantigen genes. Additionally, any sequencing technique can be used to determine the presence of a mutation. In a preferred embodiment, pyrosequencing is used. The present invention also provides for a kit that includes primers that are specific to sequences encompassing the neoantigen mutations.

In another embodiment the mutated genes are detected by immunological detection methods. Antibodies specific to the shared neoantigen mutations can be used to detect the mutations. The antibodies may be bound to an array. The array may include antibodies to detect more than one of the shared neoantigen mutations of the present invention. The antibodies can be configured for use in an ELISA assay. Therefore, a composition or kit may be provided that includes antibodies specifically recognizing the shared neoantigens of the present invention.

In another aspect the present invention provides a method of treating or preventing a tumor in a population of subjects in need thereof, comprising administering to a subject an agent comprising an extracellular ligand-binding domain recognizing a tumor-specific neoepitope comprising a tumor-specific mutation having an incidence of at least 1% of subjects in the population. The agent may be an antibody, antibody fragment, antibody drug conjugate, aptamer, CAR, or T cell receptor. The antibody or antibody fragment may be humanized, fully humanized, or chimeric. The antibody fragment may be a nanobody, Fab, Fab', (Fab')2, Fv, ScFv, diabody, triabody, tetrabody, Bis-scFv, minibody, Fab2, or Fab3 fragment. The tumor-specific mutation may be a mutation listed for any population in Table 9. The tumor-specific mutation may be within a gene containing an extracellular domain. The tumor-specific mutation may be FGFR3 S249C, ERBB3 V104M, EGFR L858R, MUC4 H4205Q, PDGFRA R483fs, TMEM52 23_26LLPL>L, or PODXL 28_30PSP>P. The tumor-specific mutation may be within the extracellular domain. The tumor-specific mutation comprises FGFR3 S249C or ERBB3 V104M. Not being bound by a theory, the presence of a neoepitope in a protein with an extracellular domain allows the neoepitope to be presented on the surface of a cell. Not being bound by a theory, the presence of a neoepitope in the extracellular domain allows the neoepitope to be presented on the surface of a cell.

The invention is further described by the following numbered paragraphs:

1. An isolated neoantigenic peptide comprising a tumor-specific neoepitope defined in Tables 1-9, wherein the isolated neoantigenic peptide is not a native polypeptide.
2. An isolated neoantigenic peptide 100 amino acids or less in length which comprises a tumor-specific neoepitope defined in Tables 1-9.
3. The isolated neoantigenic peptide of paragraph 1 or 2, which is between about 5 to about 50 amino acids in length.
4. The isolated neoantigenic peptide of any of paragraphs 1-3, which is between about 15 to about 35 amino acids in length.
5. The isolated neoantigenic peptide of paragraph 4, which is about 15 amino acids or less in length.
6. The isolated neoantigenic peptide of paragraph 5, which is between about 8 and about 11 amino acids in length.
7. The isolated neoantigenic peptide of paragraph 6, which is 9 or 10 amino acids in length.
8. The isolated neoantigenic peptide of any of paragraphs 1-7, which binds major histocompatibility complex (MHC) class I.
9. The isolated neoantigenic peptide of paragraph 8, which binds MHC class I with a binding affinity of less than about 500 nM.
10. The isolated neoantigenic peptide of any of paragraphs 1-3, which is about 30 amino acids or less in length.
11. The isolated neoantigenic peptide of paragraph 10, which is between about 6 and about 25 amino acids in length.
12. The isolated neoantigenic peptide of paragraph 11, which is between about 15 and about 24 amino acids in length.
13. The isolated neoantigenic peptide of paragraph 11, which is between about 9 and about 15 amino acids in length.
14. The isolated neoantigenic peptide of any of paragraphs 1-3 and 10-13, which binds MHC class II.
15. The isolated neoantigenic peptide of paragraph 14, which binds MHC class II with a binding affinity of less than about 1000 nM.
16. The isolated neoantigenic peptide of any of paragraphs 1-15, further comprising flanking amino acids.
17. The isolated neoantigenic peptide of paragraph 16, wherein the flanking amino acids are not native flanking amino acids.
18. The isolated neoantigenic peptide of any of paragraphs 1-17, which is linked to at least a second neoantigenic peptide.
19. The isolated neoantigenic peptide of paragraph 18, wherein peptides are linked using a poly-glycine or poly-serine linker.
20. The isolated neoantigenic peptide of paragraph 18 or 19, wherein the second neoantigenic peptide binds MHC class I or class II with a binding affinity of less than about 1000 nM.
21. The isolated neoantigenic peptide of paragraph 20, wherein the second neoantigenic peptide binds MHC class I or class II with a binding affinity of less than about 500 nM.
22. The isolated neoantigenic peptide of paragraph 20 or 21, wherein both of the neoepitopes bind to human leukocyte antigen (HLA)-A, -B, -C, -DP, -DQ, or -DR.
23. The isolated neoantigenic peptide of any of paragraphs 20-22, wherein the isolated neoantigenic peptide and the second neoantigenic peptide binds a class I HLA or the isolated neoantigenic peptide and the second neoantigenic peptide binds a class II HLA.
24. The isolated neoantigenic peptide of any of paragraphs 20-22, wherein the isolated neoantigenic peptide binds a class II HLA and the second neoantigenic peptide binds a class I HLA or the isolated neoantigenic peptide binds a class I HLA and the second neoantigenic peptide binds a class II HLA.
25. The isolated neoantigenic peptide of any of paragraphs 1-24, further comprising modifications which increase in vivo half-life, cellular targeting, antigen uptake, antigen processing, MHC affinity, MHC stability, or antigen presentation.
26. The isolated neoantigenic peptide of paragraph 25, wherein the modification is conjugation to a carrier protein, conjugation to a ligand, conjugation to an antibody, PEGylation, polysialylation HESylation, recombinant PEG mimetics, Fc fusion, albumin fusion, nanoparticle attachment, nanoparticulate encapsulation, cholesterol fusion, iron fusion, acylation, amidation, glycosylation, side chain oxidation, phosphorylation, biotinylation, the addition of a surface active material, the addition of amino acid mimetics, or the addition of unnatural amino acids.
27. The isolated neoantigenic peptide of paragraph 25, wherein the cells that are targeted are antigen presenting cells.
28. The isolated neoantigenic peptide of paragraph 27, wherein the antigen presenting cells are dendritic cells.
29. The isolated neoantigenic peptide of paragraph 29, wherein the dendritic cells are targeted using the CD141, DEC205, or XCR1 marker.
30. A pharmaceutical composition comprising at least one neoantigenic peptide and a pharmaceutically acceptable carrier, each at least one neoantigenic peptide comprising a tumor-specific neoepitope capable of binding to an HLA protein in a subject, each tumor-specific neoepitope comprising a tumor-specific mutation present in a tumor, wherein:
    (a) the composition comprises at least one neoantigenic peptide comprising a tumor-specific mutation present in a tumor in at least 1% of subjects in a population of subjects suffering from cancer;
    (b) the composition comprises at least one neoantigenic peptide comprising a tumor-specific neoepitope which binds to an HLA protein present in at least 5% of subjects in the population of subjects suffering from cancer; or
    (c) the composition comprises at least one neoantigenic peptide capable of eliciting an immune response against a tumor present in at least 5% of the subjects in the population of subjects suffering from cancer.
31. The pharmaceutical composition of paragraph 30, wherein the population of subjects is suffering from adrenocortical carcinoma (ACC), bladder urothelial carcinoma (BLCA), breast invasive carcinoma (BRCA), cervical squamous cell carcinoma and endocervical adenocarcinoma (CESC), colon adenocarcinoma (COAD), Chronic lymphocytic Leukaemia (CLL), colorectal cancer (CRC), Diffuse large B-cell lymphoma (DLBCL), glioblastoma multiforme (GBM), head and neck squamous cell carcinoma (HNSC), kidney chromophobe (KICH), kidney renal clear cell carcinoma (KIRC), kidney renal papillary cell carcinoma (KIRP), acute myeloid leukemia (LAML), liver hepatocellular carcinoma (LIHC), lung adenocarcinoma (LUAD), lung squamous cell carcinoma (LUSC), multiple myeloma (MM), ovarian serous cystadenocarcinoma (OV), pancreatic adenocarcinoma (PAAD), prostate adenocarcinoma (PRAD), rectum adenocarcinoma (READ), skin cutaneous melanoma (SKCM), stomach adenocarcinoma (STAD), testicular germ cell tumors (TGCT), thyroid adenocarcinoma (THCA), uterine corpus endometrioid carcinoma (UCEC), or uterine carcinosarcoma (UCS).

32. The pharmaceutical composition of paragraph 30 or 31, wherein the population suffering from cancer was treated with, is being treated with, or is selected to be treated with a cancer therapeutic, optionally ibrutinib, erlotinib, imatinib, gefitinib, crizotinib, trastuzumab, vemurafenib, RAF/MEK inhibitor or antiestrogen therapy.

33. The pharmaceutical composition of any of paragraphs 30-33, wherein the tumor-specific mutations comprise splice-variant mutations, point mutations, and/or frameshift mutations.

34. The pharmaceutical composition of any of paragraphs 30-33, wherein the at least one neoantigenic peptide comprises at least one neoantigenic peptide derived from a long peptide region flanking and including the tumor specific mutation, and wherein all contiguous segments within the long peptide are included.

35. The pharmaceutical composition of any of paragraphs 30-34, wherein the tumor-specific mutations are present in one or more genes listed in Tables 1-9.

36. The pharmaceutical composition of any of paragraphs 30-35, wherein the composition comprises at least one neoantigenic peptide as defined in any of Tables 1-9.

37. The pharmaceutical composition of any of paragraphs 30-36, wherein the tumor-specific mutations are present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Abl, c-kit, PIK3CA, HER2, EML4A-ALK, KRAS, ALK, ROS1, AKT1, BRAF, MEK1, MEK2, NRAS, RAC1, and ESR1.

38. The pharmaceutical composition of paragraph 37, wherein at least one tumor-specific mutation is derived from alternative splicing of PD-L1 or AR.

39. The pharmaceutical composition of paragraph 38, wherein at least one tumor-specific mutation is derived from splice variant sPD-L1, AR-V1 or AR-V7.

40. The pharmaceutical composition of any of paragraphs 30-39, wherein the tumor-specific mutations comprise drug resistance mutations.

41. The pharmaceutical composition of paragraph 40, wherein at least one tumor-specific mutation is a drug resistance mutation selected from the group consisting of BTK/C481S, EGFR/T790M, BCR-Abl/T315I, BCR-Abl/Y253H, BCR-Abl/E255K, BCR-Abl/E255V, c-kit/T670I, PIK3CA/E545K, PIK3CA/E542K, HER2/G776(YVMA), HER2/E545K, EML4-ALK/G1269A, KRAS/G12V/D, ALK/L1196M, ALK/G1202R, ALK/S1206Y, ALK/I1151T (ins), ALK/F1174C, ROS1/G2032R, AKT1/E17K, BRAF/V600E, MEK1/Q56P, MEK1/E203K, MEK1/C121S, MEK1/V60E, MEK1/G128V, MEK1/V154I, MEK1/P124S, MEK1/P124L, NRAS/Q61K/L/R, NRAS/T58I, MEK2/C125S, RAC1/P29S, ESR1/S463P, AR/V534E, AR/P535H, AR/L536Q, AR/L536R, AR/Y537C, AR/Y537S, AR/Y537N, AR/D538G and AR/F876L.

42. The pharmaceutical composition of any of paragraphs 30-41, wherein the at least one tumor-specific mutation has an incidence of at least 500 patients a year in the population of subjects suffering from cancer, and wherein the at least one mutation comprises a mutation listed for the population in Table 9.

43. The pharmaceutical composition of paragraph 42, wherein the at least one neoantigenic peptide comprises at least one peptide listed in Table 9.

44. The pharmaceutical composition of any of paragraphs 30-36, wherein:
(a) the population of subjects is suffering from CLL; and
(b) the at least one tumor-specific mutation comprises any combination of mutations selected from the group consisting of SF3B1:p.K700E, MYD88:p.L273P, NOTCH1:p.P2514fs, ABCA11P:p.E901D, AHNAK:p.D3823E, ZNF814:p.E348D, AHNAK:p.V1220I, AHNAK:p.H1203N, ANKRD30A:p.A232V, APOOL:p.138L, EGR2:p.H397N, MKI67:p.H2213D, NRAS:p.Q61R, PLIN4:p.M691V, XPO1:p.E571K, ZCRB1:p.L76F, ZNF700:p.N652H, ZNF700:p.Q654R, ZNF844:p.D458H, AHNAK:p.A4046V, ANKRD36:p.P337R, C1orf170:p.T203I, CAST:p.D639E, EGR2:p.E369K, GPR123:p.L630P, IKZF3:p.L162R, MUC4:p.P4224R, OR9Q1:p.M34L, PKD2:p.Y486F, PRAMEF11:p.R104Q, SYNJ1:p.I681F, TP53:p.R248Q, TP53:p.R248W, TRPV2:p.L627del, ZNF254:p.S498A, ZNF732:p.A459T, ZNF749:p.E530Q, ZNF845:p.M423I, ABCA11P:p.G900E, ACRC:p.E243D, ACRC:p.A244V, ACSL3:p.T188S, ADAMTS2:p.D948N, AGAP6:p.S127L AHNAK:p.A2114G, ANKRD36:p.D1014Y, ARID3A:p.G550fs, ARID4A:p.D1154E, ATP2B4:p.R183H, ATRNL1:p.L1244F, BNC1:p.Y937N, BRAF:p.K601N, BTLA:p.Q86K, C14orf177:p.G90V, C2orf44:p.N456K, C3orf15:p.R552Q, CACNA2D1:p.Y376N, CALD1:p.E340K, CCDC15:p.P488H, CCDC79:p.N440T, CCNB3:p.A932T, CD109:p.L470Q, CD209:p.Q189L, CKAP2:p.*684K, CMA1:p.I81K, CMIP:p.A230T, CNTNAP4:p.112F, CRYM:p.*315K, DICER1:p.E1705K, DPCR1:p.L716P, EIF3A:p.M1093L, EIF4G3:p.R8H, ETFDH:p.I281F, EWSR1:p.Y656C, F5:p.L1332P, F5:p.L1253F, FAM50A:p.H317R, FBXL13:p.S102R, FBXW7:p.R465H, FHL:p.D184E, FILIP1:p.1522K, FRG1B:p.Q39K, GNB1:p.I80T, GPR110:p.R443G, GPR98:p.Y6152F, HDGFL1:p.188_189insA, IGF2BP2:p.T186S, IL1R2:p.L364fs, KIAA1109:p.L4680P, KRAS:p.G13D, KRTAP19-1:p.G61 S, MAF:p.G53fs, MAGEC1:p.L609H, MAP2K1:p.K57N, MED12:p.L36R, MED12:p.G44S, METAP2:p.Y137N, METTL9:p.Y57F, MGP:p.V15L, MKI67:p.R2222K, MUC16:p.T11005I, MUC4:p.S3941N, MUC4:p.S3941G, MUC4:p.V3091L, MUC4:p.S2951Y, MUC4:p.A2841S, MUC4:p.S2760A, MUC4:p.T2335M, MUC4:p.T1627K, MUC4:p.T1547S, MUC4:p.H1133Q, MYD88:p.M240T, NEDD4L:p.P194del, NEFH:p.S704T, NRG4:p.G21fs, OR2A25:p.S105C, OR4C16:p.Y63F, OR4N4:p.L150fs, PABPC1:p.K254fs, PIWIL1:p.372fs, PLCD3:p.E499fs, PLEKHB1:p.S146P, PPIL4:p.S382R, PRDM4:p.*802K, PRG4:p.N675H, PRKAB1:p.P104H, R3HDM2:p.S592G, R3HDM2:

p.S588N, R3HDM2:p.R206W, RPS2:p.R200G, RPTN: p.G364S, SF3B1:p.K666E, SF3B1:p.N626Y, SF3B1: p.Y623C, SIX3:p.I27L, SLC39A7:p.L456fs, SLC6A9: p.R94K, TFG:p.A382V, TGOLN2:p.K83R, TGOLN2: p.T80S, TLR2:p.D327V, TNKS2:p.T619fs, TP53: p.R273H, TP53:p.C242F, TP53:p.R175H, TWISTNB: p.H306Q, UBXN7:p.A276V, WDR78:p.N110K, XIRP2:p.V3008E, ZNF382:p.H186Q, ZNF578: p.R306H, ZNF578:p.G311S, ZNF578:p.H334R, ZNF700:p.S649C, ZNF705A:p.D298N, ZNF836: p.K608Q, and ZNF836:p.I571N; and 45. The pharmaceutical composition of any of paragraphs 30-36, wherein:
(a) the population of subjects is suffering from BLCA; and
(b) the at least one tumor-specific mutation comprises any combination of mutations selected from the group consisting of PIK3CA:p.E545K, FGFR3:p.S249C, TP53:p.R248Q, PIK3CA:p.E542K, RXRA:p.S427F, ZNF814:p.D404E, FBXW7:p.R505G, NOTCH2: p.P6fs, TP53:p.E285K, ANKRD30A:p.A353P, C3orf70:p.S6L, EFCAB6:p.R379K, ERCC2:p.N238S, FAM47C:p.Q225E, FOXQ1:p.S135L, HLA-A: p.Q78R, MUC4:p.H4205Q, OTUD4:p.T909I, SLAMF1:p.S277fs, SPRED3:p.S128del, TMCO2: p.S15fs, TP53:p.R280T, TP53:p.E271K, TP53: p.A159V, ZNF706:p.I8N, ZNF706:p.R3P, ACACB: p.E2318Q, ACPP:p.E321K, ACRC:p.A264V, ADAMTS2:p.23_24insL, AFF3:p.E919K, AHNAK: p.S4150F, AHNAK:p.D2889H, AHNAK:p.V1940A, ALX4:p.R126Q, ANKRD12:p.E627K, ANKRD32: p.T999N, ARID1A:p.S614L, ASXL2:p.117_118SS>S, ATP12A:p.R858C, ATP9A:p.R519Q, BCAS3: p.T214M, BPI:p.M255I, CACNG8:p.V146G, CAMSAP1:p.T466fs, CDC27:p.I91fs, CDKN1A:p.E44fs, CEP192:p.S2058L, CGB8:p.T18A, CHRNA3: p.L23del, CHST4:p.D352N, CLIP 1:p.S018fs, COX6A1:p.S8L, CREBBP:p.D1435H, CRIPAK: p.M48fs, CSPG5:p.D119N, CUL1:p.E485K, DLC1: p.S741T, DLL3:p.D318H, DOPEY2:p.E1196K, ECM1:p.E266K, EEF1A2:p.Y418S, EEF2K:p.E673K, EMILIN1:p.R27G, ERBB2:p.S310F, ERBB3:p.M91I, ERBB3:p.V104L, ERBB3:p.D297Y, ERCC2:p.Y14C, FAM155A:p.Q86del, FAM43B:p.E272del, FASTKD3: p.Q625E, FBXW7:p.S546L, FGFR3:p.R248C, FGFR3:p.G380R, FGFRL1:p.H479fs, GBE1:p.M587I, GIMAP1-GIMAP5:p.S311C, GNA13:p.R200G, HiFOO:p.A214fs, HEATR7B2:p.E1109K, HISTIHID: p.I81M, HRAS:p.G12D, HRCT1:p.H92P, ILF3: p.E484K, KCNK2:p.S6W, KIAA0907:p.Q446P, KIF23:p.E350K, KLF5:p.S118L, KLHL15:p.D185G, LAMA4:p.E639K, LILRA1:p.H410Y, LILRB1: p.L479del, LLGL2:p.P955fs, LPIN1:p.S974L, LRRC16A:p.D227N, LRTM2:p.S139L, LURAP1L: p.55_56insGGG, MAGEC1:p.P553del, MCL1: p.E171del, MN1:p.S472L, MUC7:p.A191V, MVP: p.E412K, NBPF10:p.E3455K, NFE2L2:p.E79K, NFE2L2:p.R34G, NOS1AP:p.Q306del, OR2T35: p.V319fs, OR4N2:p.L150fs, PABPC3:p.K333fs, PAX3:p.S197L, PBX2:p.E70K, PBXIP1:p.H729del, PCDP1:p.E537K, PEX1:p.I370fs, PHLDA3:p.E82K, PLEKHM2:p.S459L, PLVAP:p.A321V, POLR3B: p.L372F, POTEC:p.R477Q, PPL:p.H326Y, PPP1R15A:p.E196K, PRDM16:p.E271Q, PRIC285: p.E1289Q, PRMT8:p.S31P, PUF60:p.S396L, RAB11FIP4:p.S596L, RAD51C:p.D167N, RAD51C: p.Y224H, RALGPS1:p.R381Q, RARS2:p.R6C, RBM26:p.P644A, RERE:p.K176N, RXRA:p.S427Y, SERPINA12:p.R211G, SF3B1:p.E902K, SLC6A9: p.R243W, SLC9A5:p.L447F, SPESP1:p.F121L, SRPRB:p.G14S, SYN2:p.A34del, SYTL2:p.I440M, TAB3:p.R211T, TAF1B:p.R292C, TAOK2:p.L981del, TAS1R3:p.E525K, TAS2R9:p.E163Q, TBC1D1: p.S71F, TBC1D2B:p.R920Q, TFPI2:p.R222C, TM6SF1:p.S15W, TMEM131:p.K640fs, TMEM19: p.G331fs, TP53:p.R273C, TP53:p.R248W, TP53: p.R175H, TP53:p.K132N, TRAM1:p.E41Q, TSKS: p.E513K, TTN:p.C20935G, UBOX5:p.S417L, UGP2: p.D262H, VGF:p.E433K, XAB2:p.E782K, XYLB: p.S87F, ZC3H4:p.E798K, ZNF208:p.K852E, ZNF208: p.I647S, ZNF626:p.G198E, ZNF749:p.Q457E, ZNF761:p.H373R, ZNF799:p.T43A, ZNF799: p.W41G, ZNF799:p.E589G, ZNF844:p.P503R, ZNF845:p.M423T, ZNF845:p.T479M, ZNF860: p.H464R, ZNF878:p.S181R, ZNF91:p.R333H, and ZNF91:p.H305R.

46. The pharmaceutical composition of any of paragraphs 30-43, wherein:
(a) the population of subjects is suffering from BRCA; and
(b) the at least one tumor-specific mutation comprises any combination of frameshift mutations selected from the group consisting of GATA3:p.L328fs, GATA3: p.N334fs, GATA3:p.L344fs, GATA3:p.H400fs, GATA3:p.S408fs, GATA3:p.S430fs, GATA3:p.H434fs, GATA3:p.H435fs, and GATA3:p.S408fs.

47. The pharmaceutical composition of any of paragraphs 30-36, wherein:
(a) the population of subjects is suffering from BRCA; and
(b) the at least one tumor-specific mutation comprises any combination of mutations selected from the group consisting of PIK3CA:p.H1047R, PIK3CA:p.E545K, PIK3CA:p.E542K, AKT1:p.E17K, TP53:p.R175H, PIK3CA:p.N345K, PIK3CA:p.H1047L, SF3B1: p.K700E, GATA3:p.S408fs, PIK3CA:p.E726K, TP53: p.Y220C, TP53:p.H193R, PIK3CA:p.Q546R, TP53: p.R273C, TP53:p.R248W, TP53:p.R273H, TP53: p.I195T, TP53:p.H179R, FGFR2:p.N549K, NUP93: p.E14K, PIK3CA:p.C420R, PIK3CA:p.E453K, PIK3CA:p.Q546K, TP53:p.V216M, TP53:p.C176F, CDH1:p.E243K, ERBB2:p.L755S, KRAS:p.G12V, PIK3CA:p.E545A, TBL1XR1:p.I141fs, TP53: p.G266E, TP53:p.R248Q, TP53:p.Y163C, TP53: p.C141Y, TP53:p.G108fs, ACPP:p.R43W, AKT2: p.I289M, ARHGAP9:p.R137C, C9orf174:p.R136W, CDC42BPA:p.P675T, COL12A1:p.S395L, CRISPLD1:p.R222W, CT47B1: p.234_243EKLTEEATEE>E, CYP1A2:p.V483M, DAB2IP:p.E161K, DGKB:p.S13L, DMD:p.K1772N, DPEP1:p.V11L, ERBB2:p.S310F, ERBB2:p.D769Y, ERBB3:p.E928G, ESYT1:p.R816W, FAM179A: p.A831T, FAM58BP:p.A70T, FMN2:p.S751F, GALNTL6:p.K567del, GATA3:p.L328fs, GATA3: p.N334fs, GATA3:p.L344fs, GATA3:p.H400fs, GATA3:p.S408fs, GATA3:p.S430fs, GATA3:p.H434fs, GATA3:p.H435fs, GDAP1:p.T307A, GRB14: p.A300T, GUCY2C:p.G549C, IL17B:p.R34W, KCNB2:p.R231H, KIF1B:p.R1320W, KIF26B: p.V1113M, KLF4:p.K434Q, LY9:p.I69L, MAP2K4: p.S184L, MAP2K4:p.S251L MAP2K4:p.T261fs, MAP3K1:p.L318fs, MAP3K1:p.I761fs, MAP3K1: p.V1346del, MAP3K1:p.L1384fs, MAPK13:p.E315K, MAPK4:p.V100M, MARCH5:p.R170C, MBP: p.E120K, MEFV:p.R377H, METTL15:p.Q53E, MS4A4A:p.V99M, MUC17:p.R4415H, MYH6:p.T847M, MYO5B:p.A405V, NARS2:p.P240R, NLGN4X:p.D382N, NLRC4:p.R288W, OR13G1:p.R258H, OR2AK2:p.V451, OTOF:p.T388M, PACSIN2:p.Q331H, PALM2-AKAP2:p.A299T, PCDH19:p.R286C, PCDHGC5:p.D664N, PIK3CA:p.R88Q, PIK3CA:p.E110del, PIK3CA:p.K111del, PIK3CA:p.PVPHGLEDL447del, PIK3CA:p.L455fs, PIK3CA:p.M1004I, PIK3CA:p.M1043I, PIK3CA:p.N1044Y, PIK3R1:p.KPDL567del, PREX2:p.R363Q, PRRX1:p.A196V, PTEN:p.V317fs, RGSL1:p.V222I, RUNX1:p.R142fs, RUNX1:p.D96fs, SCN2A:p.R36K, SLC25A32:p.Q83E, SLC25A45:p.G106C, STRA6:p.Q68R, STX6:p.H153D, TBX3:p.H187Y, TFPT:p.S252C, TINAG:p.R332W, TMEM71:p.R63Q, TP53:p.E286K, TP53:p.R282W, TP53:p.V272M, TP53:p.S241fs, TP53:p.C238fs, TP53:p.C238F, TP53:p.C238Y, TP53:p.Y234C, TP53:p.Y220S, TP53:p.R209fs, TP53:p.G199V, TP53:p.L194R, TP53:p.H193L, TP53:p.H193Y, TP53:p.V173L, TP53:p.V173M, TP53:p.K132N, TP53:p.R110fs, TUBD1:p.A200V, VLDLR:p.R231H, VWA3A:p.V955I, VWF:p.K1720N, XPO1:p.E571K, and ZNF268:p.F901 del.

48. The pharmaceutical composition of any of paragraphs 30-36, wherein:
(a) the population of subjects is suffering from COAD; and
(b) the at least one tumor-specific mutation comprises any combination of mutations selected from the group consisting of KRAS:p.G12D, BRAF:p.V600E, KRAS:p.G12V, ACVR2A:p.K435fs, GRB14:p.KKK295del, SEC63:p.L532fs, TGFBR2:p.E125fs, ATR:p.K771fs, ICA1:p.N204fs, KRAS:p.G12C, TP53:p.R175H, ABCA8:p.R842Q, ACTL7B:p.R354H, ACVR2A:p.K435fs, AIM2:p.K340fs, ALG2:p.S302Y, ANKIB1:p.K144fs, ARSG:p.V131I, ATP10D:p.R311H, AXIN2:p.W663fs, C5orf30:p.D4N, CACNG3:p.V134I, CASP5:p.K78fs, CC2D2A:p.R1284C, CDH10:p.E349K, DNMT1:p.E432K, DOCK2:p.G170R, DOCK5:p.E177K, EGR2:p.R390H, ERBB3:p.V104M, FAM135B:p.R884H, FBXW7:p.R505C, FBXW7:p.R465H, FHDC1:p.R254W, FOXL1:p.N89K, HCN4:p.R525H, HLA-DMA:p.E84K, HTR3B:p.R236C, ITGA4:p.T673M, KIF18A:p.R17C, KIF20B:p.E991K, KLHL5:p.R326C, KRAS:p.A146T, KRAS:p.G13D, LPHN3:p.R1183Q, MAP2K4:p.R287H, MAPK8IP1:p.L217fs, MFSD5:p.R280Q, MUC16:p.R8606H, MYO6:p.D1180N, NAA25:p.S807Y, NBPF14:p.V44L, NRAS:p.Q61K, NRAS:p.G13R, PAX3:p.T424M, PGAM1:p.R240H, PHF3:p.R1410I, PIK3CA:p.R88Q, PIK3CA:p.E545K, PIK3CA:p.H1047R, PLXNA3:p.V14fs, POSTN:p.R508C, PTPRU:p.D1434N, PYGO2:p.Q150fs, RBBP7:p.E274K, SFPQ:p.R611Q, SGSM1:p.F117L, SLC25A40:p.R96Q, SLC8A1:p.R431H, SLITRK3:p.S298L, SPATA22:p.S150L, SUN3:p.E128K, TGFBR1:p.S241L, TP53:p.R273H, TP53:p.R273C, TP53:p.R248W, TRPV5:p.R492H, USP40:p.S851L, VPS13C:p.D1359Y, ZBTB24:p.L607I, ZNF434:p.R306C, ZNF443:p.R301I, ZNF484:p.R138C, and ZNF770:p.S441P.

49. The pharmaceutical composition of any of paragraphs 30-36, wherein:
(a) the population of subjects is suffering from GBM; and
(b) the at least one tumor-specific mutation comprises any combination of mutations selected from the group consisting of HSD17B7P2:p.N175S, IDH1:p.R132H, EGFR:p.A289V, EGFR:p.G598V, WASH3P:p.G175S, ZNF814:p.D404E, RPSA:p.Q111E, NBPF10:p.E3455K, TP53:p.R248Q, BRAF:p.V600E, EGFR:p.A289T, PRB2:p.N230del, RGPD5:p.P1760A, TP53:p.R175H, CHEK2:p.K373E, EGFR:p.R108K, EGFR:p.R222C, PIK3CA:p.E545K, PIK3R1:p.G376R, POTEC:p.K507E, SDHAP2:p.V195E, SLC6A10P:p.K88N, TP53:p.R282W, TP53:p.R273H, CD3EAP:p.K219del, DST:p.R146C, EGFR:p.A289D, EGFR:p.H304Y, FRG1B:p.S71N, GOLGA8DP:p.A116E, KRTAP4-11:p.R121K, KRTAP4-11:p.S48R, MAP3K1:p.P324L, OGDH:p.I78fs, PODXL:p.S162fs, PSPH:p.V145I, SPINT1:p.A316V, TP53:p.R248W, TP53:p.G245S, TP53:p.Y220C, TP53:p.R158H, TSHZ2:p.A222T, UBC:p.L149R, ZDHHC4:p.R300H, ZNF844:p.R447P, AASS:p.T878fs, ABCC10:p.R570W, ADAM29:p.V205I, ADAMTS8:p.V524M, AGAP3:p.R766W, AICDA:p.Y144F, AK7:p.A159V, AK8:p.D243A, ANO2:p.R334C, AOX1:p.A507V, ARHGAP5:p.M691L, CALN1:p.V2311I, CARM1:p.A202V, CD163L1:p.V721M, CD1D:p.L25fs, CD209:p.A283T, CDH18:p.A195T, CILP2:p.V553M, CIZ1:p.L89P, CLOCK:p.L123fs, COL6A5:p.T2224M, CSF2RB:p.G298S, CSMD3:p.E171K, CYP2D6:p.H352R, DCAF12L1:p.R335H, DCAF12L2:p.R246H, DPP10:p.V183I, DPY19L2P1:p.R378Q, DQX1:p.R505H, DRD5:p.S275R, DVL2:p.V66G, EFCAB6:p.R379K, EGFR:p.L62R, EGFR:p.R252C, EGFR:p.P596S, EGFR:p.P596L, EGFR:p.G598A, EGFR:p.E709K, EPHA1:p.A184T, ERC2:p.R20H, ESPNP:p.R627Q, FAM126B:p.R382H, FBN3:p.V886I, FGF14:p.T229M, FLG2:p.H1901fs, FLG:p.R2886H, FLNA:p.V1240M, FOXG1:p.H57del, FPR2:p.R54Q, FRG1B:p.K13N, FRG1B:p.A53T, GABRA6:p.V314L, GJB3:p.R160H, GLT8D2:p.A178V, GRM3:p.R183C, HERC1:p.R2330H, HNF1B:p.T417M, HTRA3:p.Q403R, IDH1:p.R132G, IFNA10:p.L80F, IFNA10:p.V79A, JHDM1D:p.R313H, JPH1:p.A395T, KEL:p.V411M, KIAA0907:p.R516fs, KIAA1704:p.D88del, KLK6:p.R120H, KRAS:p.G12D, KRTAP4-7:p.L121V, KRTAP4-7:p.L148V, KRTAP5-4:p.S131C, LAT2:p.L18W, LIMK2:p.R203H, LUM:p.R330C, MCOLN3:p.V141I, MGAT4B:p.T444P, MUC17:p.V77M, MUC17:p.3204_3205insP, MYO1D:p.T109M, MYO6:p.Q914fs, NAP1L5:p.140_141EE>E, NF1:p.F1658fs, NHP2L1:p.R84C, NLRP5:p.R737W, NPTX1:p.A263T, NUFIP2:p.Q29del, ODF4:p.R61C, OR11H12:p.H154P, OR2A7:p.V18I, OR2H1:p.V287I, OR2T12:p.R184H, OR5D13:p.R236C, OR5P2:p.A100V, OR6N2:p.R293C, PASD1:p.A236del, PCDH11X:p.T486M, PCDHB13:p.P221L, PDGFRA:p.E229K, PDGFRB:p.S650L, PHC3:p.T35del, PIK3C2B:p.R287fs, PIK3CA:p.M V, PIK3CA:p.R88Q, PIK3CA:p.M1043V, PIK3CA:p.H1047R, PIK3R1:p.K379N, PODNL1:p.A150V, POTEE:p.V166M, POTEG:p.R136H, PRKCD:p.G432fs, PROKR2:p.V297I, PTEN:p.C136Y, PTEN:p.S170N, PTEN:p.R173H, PTEN:p.T277I, PTEN:p.V317fs, PTPN14:p.E716del, R3HDM2:p.412_413QQ>Q, RAB11FIP5:p.R170H, RASAL3:p.R82H, RB1:p.N316fs, RDH8:p.A198V, REN:p.15_16LL>L, RIMBP2:p.R830H, SCAF11:p.E926fs, SCN7A:p.R1358H, SCNN1G:p.R564H, SDHAP2:p.R31C, SDHAP3:p.A66T, SEMG2:p.R292C, SH3RF2:p.R318C, SHB:p.A460T, SIGLEC10:p.T250M, SLC13A5:p.Q273P, SLC17A9:p.V324I, SLC22A9:

p.R407Q, SLC26A3:p.V881, SLC5A3:p.A302fs, SLC9A4:p.R631H, SPAM1:p.R346Q, SPEN:p.E803fs, SPTA1:p.A2011V, SUSD5:p.T513M, SYNE1: p.R8468H, TARSL2:p.G366D, TAS2R41:p.A255T, TAT:p.R367H, TFPI2:p.R206C, THSD7B:p.R90C, TMEM147:p.A92V, TMEM156:p.R81C, TMPRSS6: p.V302L, TNFSF9:p.A232T, TP53:p.C238F, TP53: p.C238Y, TP53:p.Y234C, TP53:p.V216M, TP53: p.H179R, TP53:p.T155N, TRAPPC10:p.K133fs, TTN: p.R21402W, TTN:p.V16403M, TUBBP5:p.V102M, TYRP1:p.T352fs, UBC:p.R73L, UGT2B28:p.P289H, USH2A:p.R3719H, WASH6P:p.L211V, ZFP42: p.V227I, ZFP42:p.T264M, ZNF181:p.V305G, ZNF280B:p.E400K, ZNF534:p.N583K, ZNF563: p.W208fs, ZNF844:p.F487L, and ZPBP:p.R154C.

50. The pharmaceutical composition of any of paragraphs 30-36, wherein:
(a) the population of subjects is suffering from HNSC; and
(b) the at least one tumor-specific mutation comprises any combination of mutations selected from the group consisting of PIK3CA:p.E545K, PIK3CA:p.E542K, TP53:p.R175H, PIK3CA:p.H1047R, TP53:p.R282W, TP53:p.R248Q, TP53:p.R273H, TP53:p.R248W, TP53:p.G245S, RHOA:p.E40Q, EP300:p.D1399N, HRAS:p.G13V, MB21D2:p.Q311E, NFE2L2:p.E79Q, TP53:p.H179Y, FBXW7:p.R505G, HIST1H2BF: p.E77K, HRAS:p.G12D, MAPK1:p.E322K, NFE2L2: p.D29H, TP53:p.P278S, TP53:p.C242F, TP53: p.Y220C, TP53:p.H193L, TP53:p.H179R, TP53: p.V157F, TP53:p.R110L, AKNAD1:p.K620R, ANXA6:p.R231Q, AP1G2:p.D243N, ATAD5: p.D441N, ATP6AP2:p.E119Q, B2M:p.M1I, BCL11A: p.E579K, C1orf172:p.Y30fs, C7orf57:p.E30K, CCDC135:p.E313K, CDH12:p.P706T, CDH7: p.Q225K, CDK11B:p.E79del, CDKN2A:p.H83Y, CHCHD4:p.T79M, CIRH1A:p.S250I, CLSTN2: p.P759L, CRB1:p.L628fs, DENND5B:p.G1023E, DNAH5:p.Q1797E, DSP:p.R160G, EDA:p.L58F, EFCAB6:p.E1002K, ELF4:p.S415L, EP300: p.C1164Y, EPHA3:p.T802R, EPHA6:p.D952H, ERBB2:p.M916I, ESRRA:p.D219N, FAM101A: p.I89del, FBXO24:p.M553V, FCAR:p.V233M, GPANK1:p.Y351fs, GPR20:p.V300I, GPRASP1: p.S706L, GPRIN3:p.R633fs, GRID2:p.T649fs, GRM3:p.P682L, GUCY2F:p.S404L, HCRTR2: p.D100Y, HIST1H3C:p.K37M, HIST1H4C:p.R68P, HLX:p.S12T, HOXD10:p.Y151C, HPS3:p.K812N, HRAS:p.G12A, HRAS:p.G12S, IFT140:p.E664K, INPPL1:p.T493M, ITGA10:p.R669Q, ITGB1: p.D158N, KIAA1429:p.D1526N, KIAA1429:p.S138F, KPRP:p.E553fs, KSR2:p.T555M, LINGO2:p.P410T, LPCAT1:p.V187del, MAGEB3:p.V75A, MAP3K7: p.E524Q, MAP4K3:p.P657fs, MAP9:p.K485N, MARS2:p.R481Q, MBOAT7:p.R424W, MUC16: p.R12774H, MUC5B:p.T4388M, MYH11:p.E993K, MYOCD:p.T493M, MYOM1:p.R63Q, NANOS3: p.S183L, NCOR1:p.R1561Q, NCOR1:p.Q169E, NCR1:p.D213N, NFE2L2:p.E79K, ODZ1:p.R366M, OPN1MW:p.A285T, OR2M2:p.A95fs, OR2M3: p.M273I, OR2T33:p.R120S, OR6V1:p.1248fs, PABPC5:p.P58L, PACSIN1:p.E359K, PIK3CA: p.M1043V, PIK3CA:p.H1047L, PIWIL1:p.V699M, PLIN5:p.430_431insNG, PLXNA3:p.P58S, PRB1: p.R274fs, PRSS1:p.D107N, RAC1:p.A159V, RGS7: p.L21fs, RPA1:p.R31H, RPL18:p.R178fs, SF11: p.R821Q, SLC35D3:p.*417S, SLC5A7:p.G336C, SMARCA4:p.P913L, STAT3:p.D661V, SYCP2: p.K474N, SYT6:p.R249H, TBX21:p.E494K, THSD7A:p.R1046C, THSD7A:p.C728F, TMC3: p.R934S, TMTC2:p.T409R, TP53:p.E285K, TP53: p.C275F, TP53:p.R273C, TP53:p.G266E, TP53: p.G262V, TP53:p.R249S, TP53:p.G245V, TP53: p.C238F, TP53:p.M237I, TP53:p.Y236C, TP53: p.Y236D, TP53:p.R196P, TP53:p.PHHERC177del, TP53:p.V173L, TP53:p.V173M, TP53:p.Y163C, TP53:p.P151T, TP53:p.V143M, TP53:p.P58fs, URI1: p.S13fs, ZNF177:p.K384N, ZNF750:p.S96fs, and ZZZ3:p.R5Q.

51. The pharmaceutical composition of any of paragraphs 30-36, wherein:
(a) the population of subjects is suffering from KIRC; and
(b) the at least one tumor-specific mutation comprises any combination of mutations selected from the group consisting of WASH3P:p.G175S, VHL:p.L89H, VHL: p.S111N, WDR52:p.V1227G, KRT1: p.552_559YGSGGSSY>Y, KRTAP1-1:p.S34C, PALM2-AKAP2:p.1075_1076insEA, ZNF814: p.D404E, DOPEY2:p.Y2048S, KAT2B:p.W111fs, PABPC1:p.E156fs, PCDHGC5:p.G599V, PIK3CA: p.E545K, RRAD:p.A278E, SIRPA:p.D131del, UQCRFS1:p.I83V, VHL:p.P45L, VHL:p.V74D, VHL: p.R82P, VHL:p.L116fs, VHL:p.L158V, VHL:p.L169P, WDR73:p.DGTRSQ315del, ABCA3:p.E95D, ABCC5:p.L1090fs, ACADS:p.R330H, ACAN: p.G952E, ACSM2A:p.L402fs, ADAM23:p.K380M, ADH1A:p.D154V, AFF3:p.SA620del, AGAP6: p.D69fs, AGAP7:p.E71fs, AHNAK:p.5_6insE, AIDA: p.K247M, ALAS1:p.G302R, ANAPC16:p.R95fs, ANK2:p.N453S, ANKRD36:p.K378R, ARHGEF5: p.E487G, ARSD:p.AGV234del, ARSD:p.A234G, ATP2A1:p.G704C, ATP7A:p.Q990fs, AVIL:p.G299fs, AXDND1:p.EQ991del, BAP1:p.N78S, BAP1:p.M1I, BLM:p.H660Q, BMPER:p.RIAL444del, BRK1: p.K70Q, BTRC:p.I416M, C16orf55:p.D118A, C19orf33:p.K102E, C20orf132:p.E382D, C2orf71:p.1225_1226insS, C6orf132: p.173_182PPPLLLEPPP>P, CASP5:p.R23fs, CATSPER4:p.T425M, CCDC120:p.I8V, CCR5: p.S185I, CCZ1:p.E214D, CD7:p.P174fs, CDAN1: p.L646fs, CDH23:p.F1132Y, CDK5RAP2:p.H1592Q, CENPB:p.E410V, CERCAM:p.A85fs, CHEK2: p.K373E, CHIT1:p.P284fs, CLCN2:p.645_645R>RR, CLUL1:p.G463R, CNTNAP4:p.Y436S, CUL9: p.D1726E, CWC25:p.K364E, CXorf51B:p.V431, DDX39B:p.F149fs, DIRAS1:p.G79C, DISP2: p.F1021S, DNMBP:p.T78P, DOCK8:p.A177fs, DPCR1:p.H383N, DPCR1:p.L768del, EGFR: p.L838M, ENPEP:p.F289C, ESPNP: p.W122fs, FAM105A:p.H126N, FAM186A: p.IPPQAQELEIPL1556del, FAM194B: p.EEEEYL135del, FAM22F:p.S691 del, FAM22F: p.P690fs, FAM47A:p.LRPEPPETGVSH235del, FAM47C:p.P388S, FAM78A:p.W192L, FBXO34: p.Q294fs, FGFR3:p.R571fs, FGFR3:p.P716H, FMN2: p.AIPPPPPLPGA956del, FOXD4L4:p.C405fs, FUT6: p.S140fs, GJA1:p.A31 fs, GOLGA5: p.L492I, GPM6A:p.A50V, GPRIN1: p.231_239RKEDPGSLR>R, GRAMD1B:p.P356H, GREB1:p.S344Y, GRM6:p.A718fs, GUSB:p.L501V, GUSB:p.C500R, HBB:p.F86C, HDAC6:p.G977D, HEXDC:p.T482P, HNFJB:p.N302K, HNRPLL: p.M327V, HRC:p.P439fs, HSFX2:p.D92E, IL1RAP: p.F50C, IVL:p.EQQEGQLKHP167del, KANK4: p.S253P, KCNJ18:p.E378K, KIAA1751:p.K97N, KRT1:p.SSYGSGG557del, KRT2:p.L299W, KRT4: p.F154fs, KRTAP10-6:p.49_49P>PSCCAP, KRTAP5-7:p.C120Y, KRTAP9-2:p.CCQP140del, LARS: p.P185fs, LCP1:p.P445fs, LOC338651: p.PHRSHSPPWS102del, LRCH2:p.D717G, LTA4H: p.F107L, LYST:p.Q710H, MAFA:p.207_208HH>H, MAGEC1:p.P239del, MAP2K5:p.Q445R, MAPKAPK2:p.T214fs, MARCKS:p.K152fs, MED12L: p.P2071 S, MEGF6:p.A582fs, MGST3:p.G143fs, MLXIPL:p.S790R, MOCOS:p.S849P, MST1R: p.M464V, MTOR:p.C1483F, MTOR:p.L1460P, MUC16:p.P11260A, MUC17:p.R1227fs, MUC17: p.H1228fs, MUC2:p.1480_1481insI, MUC6: p.P1569fs, MYO3A:p.N525S, NBPF3:p.D491V, NCOR1P1:p.L52P, NDUFA4L2:p.G3fs, NEFH: p.651_651K>KAKSPEK, NES:p.V611L, NFAT5: p.Q906E, NOXO1:p.G3fs, NR2C1:p.S270I, NSMCE2: p.Q31fs, NUDT21:p.W13fs, ODZ2:p.W628fs, ONECUT1:p.L424M, OR10A3:p.F73V, OR4F4: p.E15G, OR4N2:p.L150fs, OR51B5:p.A66fs, OR7C1: p.F104fs, PABPC1:p.Y408F, PABPC1:p.K333fs, PABPC1:p.A181T, PABPC3:p.P191T, PALLD: p.A996T, PALM2-AKAP2:p.G1118fs, PARD6A: p.G84fs, PASK:p.T62I, PCDH15:p.C1713F, PCNT: p.G136S, PGM5:p.G426fs, PGPEP1L:p.R164fs, PIK3C2B:p.F1473L, PIK3CA:p.N1044K, PIK3R5: p.L371R, PITRM1:p.P816T, PLIN4:p.T347I, PODXL: p.28_30PSP>P, POLR1C:p.K332Q, POTED:p.I214V, PPM1E:p.R311W, PRKCE:p.Q157fs, PROX1: p.V225D, PRRC2C:p.P1883T, PRX:p.P549L, PSD3: p.T563P, PTCH1:p.P689H, RANBP3:p.L386W, RASGEF1C:p.A188T, RGPD6:p.F946L, RHEB: p.Y35N, RIMBP3:p.A396del, RIN3:p.L449V, RLIM: p.S501R, RNF17:p.S351C, RUNX2:p.P466H, SCAF1: p.P208fs, SDK1:p.K508fs, SECISBP2:p.D608E, SERPIN B3:p.S209C, SESTD1:p.I306M, SFRP4: p.P325fs, SH3KBP1:p.P563fs, SIPA1L3:p.G777A, SLC13A2:p.L493fs, SLC16A9:p.CVLLGG470del, SLC25A5:p.A118T, SLC44A5:p.V70F, SLC4A8: p.N229K, SLC52A1:p.G370del, SLC52A2:p.G399fs, SLC6A10P:p.K88N, SLC6A4:p.A85fs, SLC9B1: p.V446fs, SON:p.VLESSAVT1359del, SP8: p.G165del, SPAG1:p.353_354insD, SPATA9:p.C189F, SPEG:p.A992fs, SPTB:p.T1864I, SRA1:p.V110L, STAT6:p.P354fs, STK11IP:p.A155E, STXBP3: p.E279G, SVIL:p.M93T, SYNE1:p.R8468S, SYNJ2: p.K832T, SYNPO:p.G619fs, TAOK2:p.Q899fs, TAS2R38:p.I311T, TBC1D12:p.F608Y, TBC1D1: p.H277R, TBC1D3:p.A556fs, TBC1D3C:p.A495fs, TBC1D3F:p.A556fs, TCF7:p.H140P, TDRD10: p.W276C, THRAP3:p.K551R, TMEM102:p.A110P, TMEM161B:p.L142P, TMEM230:p.D140G, TMEM47:p.G87S, TRDN:p.*730Y, TTBK1: p.T1065S, UBE2O:p.R1118fs, UBR5:p.T1306fs, UPK3A:p.G272fs, VHL:p.G39S, VHL:p.S65L, VHL: p.N78D, VHL:p.R79P, VHL:p.W88L, VHL:p.L89P, VHL:p.R107P, VHL:p.S111R, VHL:p.H115N, VHL: p.D121Y, VHL:p.G123fs, VHL:p.D126fs, VHL: p.L128H, VHL:p.L135F, VHL:p.I151T, VHL:p.L153P, VHL:p.L158P, VHL:p.Q164fs, VHL:p.L184P, VHL: p.L188P, WASH6P:p.315_316insAPP, WASH6P: p.T201M, WWP2:p.G458A, ZCCHC6:p.K937N, ZFAND2B:p.I49T, ZFR2:p.Y107N, ZNF273: p.N319K, ZNF462:p.S650T, ZNF516:p.A256D, ZNF519:p.H431Y, ZNF687:p.F858C, ZNF732: p.E227Q, ZNF880:p.Q406R, ZP3:p.V362fs, and ZRANB1:p.*735fs.

52. The pharmaceutical composition of any of paragraphs 30-36, wherein:
  (a) the population of subjects is suffering from LAML; and
  (b) the at least one tumor-specific mutation comprises any combination of mutations selected from the group consisting of NPM1:p.W288fs, DNMT3A:p.R882H, NPM1:p.L287fs, IDH2:p.R140Q, IDH1:p.R132C, FLT3:p.D835Y, DNMT3A:p.R882C, FLT3: p.600_601insFREYEYD, IDH1:p.R132H, NRAS: p.G13D, U2AF1:p.S34F, KIT:p.D816V, FLT3: p.D835E, IDH2:p.R72K, NRAS:p.G12D, WT1: p.S381fs, ABTB1:p.L249fs, DNMT3A:p.R736H, FLT3:p.D835H, KRAS:p.G12D, NPM:p.L287fs, NRAS:p.Q61H, NRAS:p.Q61K, PHACTR1:p.V251fs, RBBP4:p.E330K, RUNX1:p.R135G, and U2AF1: p.S34Y.

53. The pharmaceutical composition of any of paragraphs 30-36, wherein:
  (a) the population of subjects is suffering from LUAD; and
  (b) the at least one tumor-specific mutation comprises any combination of mutations selected from the group consisting of KRAS:p.G12C, KRAS:p.G12V, EGFR: p.L858R, U2AF1:p.S34F, KRAS:p.G12A, TP53: p.R158L, KRAS:p.G12D, PIK3CA:p.E545K, TP53: p.R273L, EGFR:p.ELREA746del, KRAS:p.G13D, A2ML1:p.S654fs, BRAF:p.G469V, CTNNB1:p.S37F, EGFR:p.G719A, KRAS:p.G13C, MYOF:p.G165fs, EGFR:p.S768I, FAM47C:p.G948W, KRAS:p.Q61L, MYH10:p.L1091fs, NRAS:p.Q61L, OR4C3:p.H130fs, PI15:p.V22F, RAD50:p.D69Y, RIT1:p.M90I, TP53: p.C275F, TP53:p.R249M, TP53:p.R249G, TP53: p.R248P, TP53:p.R175H, TP53:p.Y163C, TP53: p.A159P, TP53:p.V157F, TP53:p.G154V, ABCB1: p.R467L, ACBD3:p.R224L, ACTA1:p.G275C, ACTN2:p.D893Y, ADAM30:p.Q741H, ADAMTS14: p.G238C, ADAMTS20:p.R1251S, ADAMTS20: p.R541L, ADAMTS5:p.L549M, ADAMTS9: p.G659W, ADCY2:p.P1016T, ADCY5:p.G623C, AFP: p.A182G, AHDC1:p.P155Q, AKAP1: p.LDRNEEG317del, ALKBH1:p.K137E, ANK2: p.Q3076L, ANKRD44:p.G339C, ANO3:p.A41S, AP1G1:p.R723L, APBB2:p.T243fs, APOB:p.L973M, APOBR:p.R840L, AQP10:p.Q261L, ARAP3: p.R1226L, ARFIP2:p.R86L, ARHGAP36:p.P16H, ARL13B:p.R358L, ASCC2:p.R365L, ASPM:p.S240F, ASXL3:p.P1470Q, ATRN:p.P197Q, AVIL:p.G64W, AXDND1:p.W101R, B3GAT1:p.R125L, BARX2: p.R68P, BCL9L:p.G980C, BCOR:p.N1459S, BEND2: p.P536Q, BMS1:p.G455V, BRAF:p.V600E, BRAF: p.G466V, BRD9:p.G330W, BRF1:p.V469L, BRWD3: p.H160N, BTRC:p.G260W, C11orf68:p.V135L, C15orf2:p.V753F, C15orf2:p.G906W, C18orf8: p.M61I, C1GALT1:p.G299V, C1orf173:p.G1454S, C1orf173:p.S688Y, C1orf87:p.R541L, C2orf53: p.P272H, C3orf20:p.R740L, C7:p.R687S, C7orf58: p.G140W, C7orf58:p.R238L, CACNA1A:p.S772Y, CACNA1D:p.R1073L, CACNA1E:p.R2089Q, CACNA2D1:p.A352E, CACNG3:p.R232W, CADPS: p.R959S, CALB2:p.R258C, CAMK2B:p.G131V, CARD11:p.I1065M, CCDC111:p.R417L, CCDC141: p.E1204V, CCDC19:p.R279L, CCDC19:p.R207L, CCKAR:p.L271M, CD1B:p.W41L, CDH10:p.S577R, CDH10:p.R472C, CDH10:p.R128S, CDH18:p.A721S, CDH20:p.P433H, CDH6:p.Q237K, CDK13:p.R880S, CDK4:p.R24L, CELF4:p.A309P, CFDP1:p.P129fs, CHN1:p.K264N, CHRNA4:p.S396R, CHRNA9: p.P361Q, CLCNKA:p.P124Q, CLEC12B:p.W217L, CLK4:p.R68L, CNTFR:p.D252Y, CNTN6:p.R807M, CNTNAP2:p.F395L, COL19A1:p.P538Q, COL5A2: p.G612W, COL5A2:p.G516W, COL9A1:p.R211Q, CPE:p.P290Q, CPNE8:p.Q127H, CPSF4:p.P219Q, CRIPAK:p.S180fs, CROT:p.Q580H, CRTC3:p.S363L, CSMD2:p.P1855Q, CSMD3:p.T2810N, CSMD3: p.P2727T, CSMD3:p.Q174H, CUBN:p.G596C, CUL4B:p.R91S, CUL7:p.L371F, CXCL9:p.K122N, CXCR4:p.E345Q, CXorf59:p.R198M, CYP11B1: p.R498G, CYP27A1:p.P112Q, CYP2B6:p.A444E, DACH2:p.R539L, DCC:p.R446H, DDX56:p.R329L, DEFA1:p.W90C, DENND2A:p.R688Q, DENND2A: p.R499L, DMBT1:p.R1521L, DNAH5:p.R3822L, DNAH9:p.S2993R, DNAI2:p.V231L, DPP6:p.L757F, DSG4:p.R128L, DST:p.A4410S, DZIP3:p.M322L, EBF3:p.R231 S, EFCAB4B:p.E265Q, EHHADH: p.Q704H, ELAVL2:p.L263F, EMR1:p.R493H, ENAH: p.R514L, ENPP1:p.G738E, EPB41L3:p.A896S, EPG5:p.R2289L, EPHA1:p.G111V, EPHB6:p.R337H, EPRS:p.V1151L, ERBB2:p.S310Y, ERBB2: p.774_775insAYVM, ERBB2:p.776_776G>VC, ERN2:p.T295K, FAM120B:p.P467H, FAM127C: p.F52L, FAM135B:p.W240C, FAM210B:p.L112F, FAM47A:p.R690L, FAM47B:p.W163C, FAM47B: p.L567F, FAM5C:p.R457G, FAM70B:p.P277T, FAM71B:p.L583M, FAM75A6:p.R304S, FAM75A6: p.P54L, FAM75D1:p.R1265S, FARP1:p.R299L, FAT1:p.R4359L, FAT3:p.R1266H, FAT3:p.G1899V, FAT3:p.H3574N, FBXO18:p.M144I, FBXO31: p.G443fs, FCGBP:p.A1022S, FCRL2:p.V505L, FERD3L:p.P92H, FGB:p.E339Q, FGFR2:p.E116K, FGFRL1:p.R243L, FGFRL1:p.V274L, FKBPL: p.R320L, FLG2:p.G1545V, FLG2:p.L572F, FLG: p.P3254H, FLG:p.P2466Q, FMN2:p.P992T, FOLH1: p.A643S, FOXRED1:p.R136L, FRAS1:p.C382F, FRG2B:p.D142Y, FRMPD1:p.E1093Q, FSHB: p.T43N, GABRA5:p.Q224K, GADL1:p.L352I, GAL3ST3:p.A271S, GALNT14:p.D234E, GAS8: p.R313S, GATA3:p.M443I, GCDH:p.R82C, GEM: p.R268L, GFRAL:p.Q308K, GIT2:p.R123L, GJB4: p.R22S, GLB1L2:p.I407M, GLOD4:p.Q223fs, GNAO1:p.P283Q, GPNMB:p.I74M, GPR137B: p.G240C, GPR158:p.P762L, GPR98:p.G4307W, GRB7:p.R239L, GRHL1:p.G608W, GRID1:p.R683L, GRIK1:p.R368Q, GRM5:p.P895fs, GTF2E1:p.R192L, H3F3C:p.R131L, HAO2:p.H12N, HCN1:p.R231Q, HECW1:p.A183S, HGF:p.M686T, HIP1:p.R940L, HIST1H1E:p.R25P, HLA-DMA:p.A236fs, HOXA5: p.G11C, HS3ST3A1:p.G399W, HSD17B6:p.F209L, HSPA13:p.V85L, HSPBAP1:p.R282L, HTR5A: p.W298C, IGHMBP2:p.R615S, IL2:p.R103M, IL2RA: p.G61W, IL32:p.P215T, ING1:p.A220S, INMT: p.G56V, ITGA8:p.G616C, ITGAD:p.L528fs, ITGAX: p.R283H, ITIH1:p.G254W, ITIH2:p.L842V, ITK: p.R29L, ITPR2:p.P358Q, JMJD1C:p.R1198S, KCNA1:p.G376C, KCNH8:p.M455I, KCNJ3: p.L430F, KCNK18:p.G23V, KCNK2:p.R166L, KEAP1:p.G603W, KEAP1:p.R260L, KEAP1:p.S144F, KHDRBS2:p.S203L, KIAA1211:p.P1203Q, KIAA1549:p.L1272F, KIAA1755:p.Q108H, KIF15: p.E252Q, KIF9:p.G480R, KIRREL:p.G604C, KLF5: p.E419Q, KRAS:p.Q61H, KRTAP10-12:p.R64P, KRTAP27-1:p.M124I, KRTAP4-5:p.C91F, KRTAP5-1:p.S193Y, L1CAM:p.R632S, L3MBTL4:p.W162L, LAMA1:p.D1030Y, LAMB1:p.T1610fs, LAMB4: p.G1239W, LAMB4:p.G588W, LEF1:p.I53V, LEKR1: p.Q450K, LIM2:p.S150T, LIPJ:p.P236Q, LPHN3: p.E740D, LPPR4:p.R527S, LRFN5:p.N132K, LRP1B: p.G3563C, LRP2:p.M4039I, LRRC4C:p.Q1L, LRRIQ1:p.W792L, LRRTM4:p.S243Y, MAGEA10: p.R7H, MAGEC2:p.W109C, MAGI1:p.G1156V, MAGI2:p.P1044T, MAK:p.P373Q, MAP2K1:p.K57N, MARCH11:p.R193L, MEPE:p.G142C, MKI67: p.R1081 S, MKRN3:p.P448H, MLL3:p.N393K, MLL3:p.Q356K, MMRN1:p.A1013S, MOGAT2: p.Q66fs, MXRA5:p.D324Y, MYH4:p.T790M, MYH8: p.R1117C, MYH8:p.H1006N, MYO5B:p.R708L, MYO7B:p.P2040H, MYO9B:p.R94L, MYT1L: p.P351Q, NAA11:p.T184K, NAB1:p.L72F, NAV1: p.R938L, NBPF15:p.G665E, NCAM2:p.G698C, NCAPD2:p.R220L, NDST3:p.V427I, NEK2:p.R239S, NFIA:p.L294F, NLRP3:p.R157C, NOTCH2: p.R2105L, NR4A2:p.R314L, NRG1:p.V481L, NRXN1:p.R813S, NRXN1:p.A660S, NRXN3: p.P23H, NRXN3:p.R103C, NTM:p.G333C, NUAK1: p.G173C, NYAP2:p.R437L, ODZ3:p.P218Q, OIT3: p.R508S, OOEP:p.R101C, OPN1LW:p.P283H, OR10H4:p.M199I, OR10J1:p.L157Q, OR10X1: p.L298I, OR10Z1:p.L205F, OR14A16:p.G160C, OR2A25:p.M80L, OR2AG2:p.G249W, OR2AK2: p.W37C, OR2H2:p.L205F, OR2J2:p.G234W, OR2L13:p.M106I, OR2L13:p.T242A, OR2L3:p.M1I, OR2L3:p.L67I, OR2L8:p.R121C, OR2L8:p.R171S, OR2M2:p.F177L, OR2M2:p.F323L, OR2M5: p.V205L, OR2T12:p.M258L, OR2T27:p.D1 Y, OR2T33:p.P165Q, OR2T34:p.C246F, OR2T6: p.V213L, OR4C12:p.D309Y, OR4C12:p.M279I, OR4C16:p.L162M, OR4M2:p.A119S, OR4M2: p.A161 S, OR51V1:p.P298T, OR5AS1:p.M391, OR5B12:p.S289C, OR5B17:p.M266I, OR5D14: p.H246N, OR5D16:p.P264T, OR5D18:p.R123H, OR5F1:p.G44V, OR5J2:p.A36S, OR5L1:p.T275N, OR6C65:p.I154fs, OR6C75:p.G94W, OR6K2:p.P79Q, OR8D2:p.R306M, OR9A2:p.R289W, OR9G9: p.R169L, P2RX7:p.P142Q, P2RY10:p.T10K, P2RY10:p.V196L, PABPC5:p.R99S, PAPPA2: p.P917T, PAPPA2:p.P1706H, PBLD:p.P55Q, PCDH10:p.R587S, PCDH10:p.V986L, PCDH11X: p.R1010I, PCDHAC2:p.A742V, PCDHB5:p.P649S, PCDHGC5:p.K12N, PCDHGC5:p.P684H, PCLO: p.P3946T, PCMTD1:p.R271M, PDPR:p.G793W, PDYN:p.G191W, PDZD2:p.R565S, PDZD8:p.S980G, PFKM:p.R118S, PIGM:p.R225L, PIK3CA:p.E542K, PIK3CG:p.V165L, PLLRA:p.S291fs, PLCE1: p.G564C, PLCL1:p.M564I, PLEKHA6:p.R110L, PNKP:p.G174W, POGZ:p.G75W, POLE:p.R573L, POM121L12:p.P231T, POM121L12:p.P242H, POTEE:p.V288M, POTEM:p.S78R, POU3F3: p.D321Y, PPT2:p.R265L, PRDM16:p.P1036L, PRELP:p.D201Y, PRPF40B:p.R160S, PRPF6: p.R763L, PTEN:p.R234L, PTPN11:p.G503V, PTPN13:p.E2067K, PTPRJ:p.G334W, PTPRT: p.R928L, PTPRU:p.P559S, PXDNL:p.P1456T, QSOX1:p.R401L, QSOX2:p.R683L, RAB13: p.R167L, RAB8A:p.G20W, RAPGEFL1:p.R356L, RBM19:p.G390W, RCL1:p.P112Q, REG1B:p.W57L, REG3A:p.S150L, REG4:p.G110V, RIMS2:p.R55L, RIT2:p.R85L, RLN2:p.S138C, RNF20:p.P529Q, RORB:p.G94W, RPL10L:p.K187T, RPRD2:p.R97S, RTN1:p.S103R, RUNX2:p.R337M, RYR2:p.K2413N, RYR2:p.M4334I, RYR2:p.P1670T, RYR3:p.P1670T, S100PBP:p.R5L, S1PR1:p.L104F, SAGE1:p.H298Q, SALL1:p.E965K, SALL1:p.R898W, SALL4:p.R187L, SBSPON: p.G133W, SCAF8:p.G740C, SCG2:p.P252Q, SCML4: p.L261F, SCN2A:p.T155K, SEC24D:p.A50fs, SEC61A2:p.G126V, SERPINA12:p.D253Y, SERPINA9:p.M414I, SERPINC1:p.R45L, SGIP1: p.R502L, SH3GL3:p.R174L, SH3PXD2A:p.S759L, SI:p.V1217F, SKOR1:p.Y883C, SLC1A2:p.F348fs, SLC24A5:p.R35S, SLC25A48:p.R101S, SLC35E2: p.R201L, SLC39A12:p.C628S, SLC39A6:p.R53L, SLC4A5:p.I533V, SLC5A1:p.G53W, SLC5A7: p.G442V, SLC6A11:p.W299L, SLC6A2:p.5354C, SLC8A1:p.G433C, SLIT1:p.R1460L, SLITRK5: p.R68L, SLITRK5:p.R468M, SLITRK6:p.N741K, SORL1:p.R205L, SOS1:p.N233Y, SOX9:p.E75K, SPAG16:p.V439L, SPIN4:p.Y171C, SPRR2D: p.P30fs, SPTA1:p.G2367C, SPTA1:p.D2243Y, SSX3: p.P127T, ST18:p.H778Q, STAC3:p.G117W, STOML3:p.D86Y, STX2:p.R107L, SUMF2:p.G110E, SUN3:p.P339Q, SV2C:p.P60Q, SYNDIG1:p.D135Y, SYNE1:p.K8632E, TARS2:p.E199K, TAS2R16: p.Q177H, TCOF1:p.K264R, TCTE1:p.S127I, TDO2: p.Q197H, THSD7A:p.G810W, THSD7A:p.R801L, TIFAB:p.D43E, TIGD4:p.S312F, TLL1:p.P53Q, TMPRSS11E:p.G259C, TMTC1:p.A864D, TMTC1: p.G212V, TMX3:p.R51C, TNNI1:p.R67L, TNR: p.L692I, TOP2A:p.R736L, TP53:p.R337L, TP53: p.E285K, TP53:p.R283P, TP53:p.D281N, TP53: p.C277F, TP53:p.V274F, TP53:p.R273H, TP53: p.I255F, TP53:p.R249S, TP53:p.M237I, TP53: p.S215I, TP53:p.C176F, TP53:p.R10L, TP53: p.G105C, TP53:p.P72fs, TPO:p.E558K, TRAF6: p.R502S, TRIM42:p.Q127K, TRIM48:p.A93D, TRIM4:p.R398L, TRIM51:p.W131C, TRIM9: p.R337S, TRIML:p.H399Q, TRPM3:p.G298W, TSC1: p.G378C, TSG101:p.R276S, TSHZ1:p.K501N, TSHZ3:p.G677V, TTF2:p.R761S, TUBA3C:p.Q176fs, UBAC1:p.K330N, UBE2J2:p.G193W, UBR1: p.G1647W, UGT2B7:p.M214I, VMP1:p.E369Q, VPS13B:p.G2575W, VSTM2A:p.G75V, VWA3B: p.R557L, WBP11:p.P227fs, WDR52:p.G612C, WDR59:p.R837S, WDR75:p.P287Q, WDR88: p.G100W, ZCCHC5:p.G335W, ZFHX4:p.L811F, ZFHX4:p.T1663N, ZFHX4:p.H2511Q, ZFP14: p.Q17L, ZIC1:p.A112E, ZNF154:p.T408N, ZNF223: p.G23W, ZNF295:p.S732C, ZNF322:p.K106N, ZNF385D:p.T226S, ZNF454:p.S190I, ZNF492: p.P392H, ZNF521:p.G640C, ZNF521:p.P270H, ZNF536:p.G186C, ZNF536:p.G663W, ZNF644: p.G21W, ZNF716:p.H263L, ZNF71:p.V411L, ZNF782:p.G484W, ZNF831:p.Q617K, ZNF98: p.C492F, and ZSWIM2:p.S214Y.

54. The pharmaceutical composition of any of paragraphs 30-36, wherein:
    (a) the population of subjects is suffering from LUSC; and
    (b) the at least one tumor-specific mutation comprises any combination of mutations selected from the group consisting of PIK3CA:p.E545K, TP53:p.R158L, KRTAP5-5:p.GCG47del, NFE2L2:p.E79Q, CDKN2A: p.D108Y, DHX9:p.V40G, MAFA:p.207_208HH>H, NFE2L2:p.R34Q, PBX2:p.Y262F, PIK3CA:p.E542K, TP53:p.R273L, TP53:p.C242F, TP53:p.R175G, TP53: p.Y163C, TP53:p.V157F, AICDA:p.R131G, ALPK2: p.D53N, ANKFN1:p.M280I, ARPC1A:p.F212L, ASXL2:p.S1081L, C1orf74:p.D254N, C3orf30: p.D227E, CCDC121:p.W397L, CHN2:p.143M, CLEC4C:p.R179L, CLN3:p.G206S, CNTN5: p.T178N, COL2A1:p.G2753C, CPS1:p.T855K, CSMD3:p.T1094K, CSMD3:p.Q691K, DDX11: p.R167T, EGFR:p.L861Q, EME1:p.D570H, EP300: p.D1399N, ESYT3:p.S574F, FAM135B:p.L648M, FAM135B:p.Q285H, FAM47A:p.G372W, FBXW7: p.R505G, FGFR3:p.S249C, GALNT13:p.G358C, GNL3L:p.K20N, GPC5:p.R347L, HCN1:p.A714S, HCN1:p.R659L, HCN1:p.G499V, HCN1:p.P326T, HERC2P3:p.A803V, HEXDC:p.T482P, HIST1H3B: p.E74K, HIST2H2BE:p.G54D, IFNA10:p.V79A, IL7R:p.S54L, INADL:p.P1340A, ISX:p.C2F, ITGAX: p.R685H, ITPR1:p.E1883Q, KCNN3:p.80_81insQQ, KEAP1:p.G480W, KEAP1:p.R470C, KEAP1: p.V155F, KIAA1751:p.L63F, KIAA2022:p.C345F, KIR3DL2:p.K229E, KLF5:p.E419Q, LAMA4: p.M1293I, LMLN:p.G199C, LRP2:p.A516V, LRRC66:p.F458L, LSG1:p.R517L, LUM:p.R310L, MB21D2:p.Q311E, MCHR1:p.S306F, MKRN3: p.G270V, MUC16:p.N11594K, NFE2L2:p.G81S, NFE2L2:p.G31A, NFE2L2:p.L30F, NFE2L2:p.D29H, OR2B11:p.G10V, OR2T2:p.F13V, OR4K2:p.C254F, OR51F2:p.R67P, OR51S1:p.R159Q, OR5D18: p.T271K, OR8H2:p.L166F, OR8J3:p.S160L, OR8K3: p.K235N, PCDHB1:p.N568K, PHIP:p.I1681M, PIK3CA:p.E726K, PIK3CA:p.H1047R, PLCE1: p.G439C, PRSS57:p.E39Q, PYHIN1:p.G148A, RANBP6:p.I984L, RBMXL1:p.G305C, REG1B: p.M67I, RGS6:p.W366L, RNF5:p.T136I, RP1: p.S1771L, RRP15:p.L214F, RYR2:p.E711K, SAMD3: p.Q206H, SLITRK3:p.R214L, SON:p.S908L, SP4: p.E1 del, STK11:p.G279fs, TARBP1:p.L782V, TBCD: p.R476C, TMPRSS11F:p.R274Q, TP53:p.R337L, TP53:p.E271K, TP53:p.R267P, TP53:p.G245V, TP53: p.Y234C, TP53:p.Y220C, TP53:p.H214R, TP53: p.H193L, TP53:p.H179L, TPTE:p.M541I, TRIM7: p.L332I, TTN:p.T32425M, ZFP36L2:p.D240N, ZNF208:p.H883Q, ZNF48:p.R235H, ZNF626: p.K473R, ZNF676:p.P43T, ZZZ3:p.R162Q.

55. The pharmaceutical composition of any of paragraphs 30-36, wherein:
    (a) the population of subjects is suffering from OV; and
    (b) the at least one tumor-specific mutation comprises any combination of mutations selected from the group consisting of TP53:p.R273H, TP53:p.Y220C, TP53: p.R248Q, TP53:p.R175H, TP53:p.R273C, TP53: p.I195T, TP53:p.R248W, TP53:p.R282W, TP53: p.C176Y, TP53:p.V157F, TP53:p.S241F, TP53: p.H179R, TP53:p.G245S, TP53:p.H193R, ADCY2: p.V888I, B2M:p.M1V, BAP1:p.R227C, CYP4A11: p.V185F, DNAH5:p.R3197Q, GART:p.K807fs, GRIN2B:p.R519Q, HRNR:p.M1fs, KLHL29: p.L716fs, KRAS:p.G12V, MGA:p.R2435Q, MYO3A: p.N525S, NPAS2:p.Q201R, NRAS:p.Q61R, PDAP1: p.K55fs, PGAP1:p.F565C, TP53:p.S315fs, TP53: p.C275Y, TP53:p.R273L, TP53:p.V272M, TP53: p.G266V, TP53:p.G266R, TP53:p.D259Y, TP53: p.P250L, TP53:p.G245D, TP53:p.G245V, TP53: p.G244C, TP53:p.C238fs, TP53:p.Y236C, TP53: p.Y234C, TP53:p.V216M, TP53:p.S215R, TP53: p.Y205C, TP53:p.L194R, TP53:p.P191del, TP53: p.Y163C, TP53:p.A159V, TP53:p.K132N, TRPC7: p.D210V, UXS1:p.V100L, WNT11:p.C344Y, and ZNF295:p.E885A.

56. The pharmaceutical composition of any of paragraphs 30-36, wherein:
    (a) the population of subjects is suffering from READ; and (b) the at least one tumor-specific mutation comprises any combination of mutations selected from the group consisting of KRAS:p.G12V, TP53:p.R273H, KRAS:p.A146T, KRAS:p.G12D, TP53:p.R175H, AKAP9:p.L3482I, APBA1:p.E624K, BAG5:p.D439N, C17orf97:p.E230D, CDH23:p.F177L, CERS3:p.E95D, DNAH5:p.R982H, ERBB2:p.V842I, GABRB3:p.D500N, KRAS:p.G13D, KRAS:p.G12C, KRAS:p.G12S, LRP6:p.R675Q, MACF1:p.F722L, MBOAT2:p.R43Q, MYO1D:p.E246K, NLRC4:p.E409K, NRAP:p.E327K, NRAS:p.Q61K, PCDH15:p.R1552I, PIK3CA:p.N345K, PIK3CA:p.E545K, POLE:p.S459F, PPP2R2B:p.P326L, SMAD4:p.R361H, TP53:p.R248W, ZFP2:p.R150I, and ZNF563:p.K26N.

57. The pharmaceutical composition of any of paragraphs 30-36, wherein:
(a) the population of subjects is suffering from SKCM; and
(b) the at least one tumor-specific mutation comprises any combination of mutations selected from the group consisting of BRAF:p.V600E, NRAS:p.Q61R, NRAS:p.Q61K, HSD17B7P2:p.N175S, BRAF:p.V600K, DISP1:p.G732L, IDH1:p.R132C, NRAS:p.Q61L, MUC16:p.P5119S, RAC1:p.P29S, WASH3P:p.G175S, AGAP9:p.M248V, C15orf23:p.S24F, DNAH5:p.D3236N, SPTLC3:p.R97K, TMC5:p.R276C, CFB:p.R314M, FRG1B:p.A50P, INMT:p.S212F, LOC649330:p.G93E, MAP2K1:p.P124S, RGS7:p.R44C, STK19:p.D89N, ADAM30:p.G97L, ARL16:p.G6R, ARMC4:p.E22K, BRAF:p.K601E, CAPN13:p.P405S, CD1C:p.R89C, CLCC1:p.P406Q, CNTN5:p.S379F, DNAH5:p.R742Q, EEF1B2:p.S43G, FRG1B:p.I59V, GABRG1:p.E205K, IARS2:p.R832C, IL32:p.D218fs, ISX:p.R86C, KLHDC7A:p.E635K, NAP1L4:p.P285Q, NBPF10:p.Q908E, OR2A5:p.S71L, OR4E2:p.R226Q, OR4M1:p.G41E, OR4M2:p.S268F, OR4N2:p.G41E, OR51B2:p.S163L, PCDHGC5:p.R293C, PCLO:p.R4133C, PHGDH:p.G173L, POTEG:p.D51N, PPP6C:p.R301C, PRAMEF11:p.C84S, PSG9:p.E404K, PTPRB:p.D1560N, RNF152:p.P95S, SPAG16:p.P488S, SPATA8:p.E18K, TAF1A:p.R172M, TCEB3C:p.E308K, THSD7B:p.E126K, TTN:p.E12129K, XIRP2:p.D2439N, and ZNF831:p.R1393Q.

58. The pharmaceutical composition of any of paragraphs 30-36, wherein:
(a) the population of subjects is suffering from UCEC; and
(b) the at least one tumor-specific mutation comprises any combination of mutations selected from the group consisting of RPL22:p.K15fs, PTEN:p.R130G, PTEN:p.R130Q, KRAS:p.G12D, KRAS:p.G12V, PIK3CA:p.H1047R, PIK3CA:p.R88Q, PIK3CA:p.E545K, PTEN:p.V317fs, FGFR2:p.S252W, PIK3CA:p.E542K, CTNNB1:p.S37F, POLE:p.P286R, PPP2R1A:p.P179R, CTNNB1:p.S37C, KRAS:p.G13D, CTNNB1:p.D32N, CTNNB1:p.S33F, CTNNB1:p.G34R, KIAA2026:p.R574C, LIMCH1:p.R806fs, PIK3CA:p.H1047L, ALPK2:p.K523fs, CTNNB1:p.S33C, FBXW7:p.R505C, HPD:p.R284fs, KRAS:p.G12A, PIK3CA:p.R93Q, POLE:p.V411L, TP53:p.R248W, ABCA11P:p.R385I, ABI1:p.K445N, ACSM2B:p.K195N, APOB:p.F3102L, ASCC3:p.R136Q, C12orf4:p.R335Q, CCDC132:p.R838C, CHD4:p.R975H, CSDE1:p.R220C, CTNNB1:p.D32Y, CTNNB1:p.S33Y, CTNNB1:p.T41I, EXOC1:p.R588C, FBXW7:p.R465H, FGFR2:p.N549K, FUBP1:p.R430C, GEN1:p.S509L, IK:p.E90fs, KIF20B:p.E54K, MAX:p.H28R, MBOAT2:p.R43Q, METTL14:p.R298P, MFGE8:p.D170N, MS4A8B:p.S3L, NSMCE1:p.D244N, OXR1:p.E122K, PCDH19:p.E530K, PIK3CA:p.R108H, PIK3CA:p.N345K, PIK3CA:p.C420R, PIK3CA:p.Q546P, PIK3CA:p.Q546R, PTEN:p.R130L, RBL2:p.E127K, RXFP1:p.S223Y, SF3B1:p.R957Q, SLC20A1:p.P328fs, SOX17:p.S403I, TNS1:p.Q659del, TP53:p.R273H, TP53:p.R273C, TP53:p.R248Q, TTN:p.D16823N, TXNL1:p.R234C, ZFHX3:p.R1893fs, ZNF180:p.R625I, ZNF257:p.R392I, ZNF354B:p.D609N, ZNF43:p.R280C, ZNF709:p.R468L ZNF765:p.S254L, ABCA5:p.R1476Q, ACVR1:p.R206H, ADAD1:p.S11L, ADAM9:p.R256Q, ADD3:p.E570K, ADGB:p.S1124L, AGXT2:p.R502C, AMBN:p.S225Y, ANKDD1A:p.R24H, ARHGEF33:p.R46I, ATP10B:p.L1304I, ATP2C1:p.E724K, ATP9A:p.R290Q, ATR:p.R1814fs, AVL9:p.F34L, BMPER:p.R241Q, BTN3A2:p.E153K, C14orf118:p.R279I, C14orf166B:p.F230L, C3orf23:p.R217C, C3orf62:p.R185Q, CACNA1C:p.S710L, CAGE1:p.E539K, CARD10:p.KE272del, CCDC144A:p.S1264L, CCDC168:p.D5020Y, CCDC36:p.R209I, CD55:p.E156K, CEP44:p.S253L, CIITA:p.E728K, CREBBP:p.P2094L, CTNNB1:p.S37A, CTTNBP2:p.S420L, DCT:p.R532Q, DIAPH2:p.E121K, DLG2:p.S624L, DNAH10:p.R1888Q, DNAH14:p.R1367C, DNAH7:p.R2961Q, DNAH8:p.R1347H, DNAJC13:p.E1248K, DNMT1:p.E51K, DST:p.S767Y, DYNC2H1:p.E883D, EMR1:p.R631Q, EPHX4:p.R282Q, ERCC6L2:p.L445I, F10:p.E117K, FAM155B:p.E158K, FAM83B:p.R206Q, FARP1:p.S383L, FAT3:p.A4159T, FBXW7:p.R689W, FBXW7:p.R465C, FBXW7:p.G423V, FN1:p.R290C, FZD6:p.R416Q, GABRA3:p.R73H, GABRA4:p.R460Q, GALNTL2:p.E395K, GFAP:p.A233T, GGA2:p.A63V, GIGYF2:p.R227H, GNPTAB:p.R1189Q, GPR112:p.S1283Y, GPR98:p.R4142W, GRIA3:p.S646Y, GRM6:p.E363D, HMCN1:p.S133Y, HSPA4L:p.R483C, HTR2A:p.S219L, INTS7:p.R940C, INTS7:p.R106I, ITM2C:p.E167K, JAKMIP2:p.R283I, KCND3:p.S438L, KCNS2:p.D211N, KDM1B:p.F361L, KIAA0556:p.L330I, KIAA1147:p.A149V, KIF23:p.R150Q, KIF27:p.K925N, KIF9:p.R594Q, KLHL13:p.E213K, KLHL28:p.E33K, LIN9:p.R183W, LRBA:p.E2103K, LRP2:p.R2432I, MAGI2:p.L450M, MC5R:p.A109T, MEGF10:p.S1053L, MKI67:p.T1664fs, MKLN1:p.F485L, MMRN1:p.F917L, MSH4:p.E730K, MTOR:p.S2215Y, MUC7:p.S336L, MYBPC2:p.R646H, N4BP2L2:p.R506C, NAPSA:p.R121Q, NCOA7:p.E369D, NCR1:p.R258W, NEK11:p.R374Q, NHEJ1:p.R109Q, NNMT:p.E233K, NOTCH4:p.15_16LL>L, NPY1R:p.A371T, NRAS:p.Q61R, OGDHL:p.R57C, OMA1:p.R445Q, OPRM1:p.R462C, OR4C12:p.F248L, OR5AK2:p.K89N, OSBPL6:p.R577Q, PCDHAC2:p.K138N, PCDHB12:p.R289C, PCDHGC5:p.A70T, PIK3CA:p.R38H, PIK3CA:p.E39K, PIK3CA:p.E110del, PIK3CA:p.K111E, PIK3CA:p.Q546K, PIK3CA:p.M1043V, PIK3CA:p.M1043I, PLA2G3:p.R201Q, PLXNA1:p.E1295K, PON1:p.R306Q, POTEE:p.R303I, POTEF:p.K674N, PPP2R1A:p.S256F, PPP2R3B:p.F310L, PRAM1:p.A268T, PREX1:p.E1246K, PRKCQ:p.A324V, PTEN:p.R130P, PVRL4:p.A358T, RAI2:p.S385Y, RBM39:p.T353I, RELN:p.F2722L, RFPL1:p.R148Q, ROBO2:

p.D1018N, ROS1:p.R245I, RPS6KA6:p.S394Y, RSBN1:p.E572K, RYR1:p.A2576T, SACS:p.R2906Q, SCAPER:p.R366Q, SELP:p.R429W, SENP7:p.S673Y, SEPHS1:p.E13K, SFRP4:p.R232Q, SGK1:p.K367del, SIX1:p.E191K, SLC10A7:p.S261L, SLC12A2: p.R828Q, SLC6A4:p.R495Q, SLC7A2:p.R322W, SMCR8:p.E175K, SOS1:p.N233Y, SPOP:p.E50K, STRN3:p.K218N, STXBP6:p.D92N, SULT1E1: p.R77Q, SUN3:p.L124I, SUSD1:p.R343C, SYNM: p.R516Q, TAF1:p.R843W, TDRD3:p.R322Q, THADA:p.S1941L, TLN2:p.S208L, TMEM161B: p.R315Q, TMPRSS3:p.R16Q, TP53:p.Y220C, TPTE: p.S423L, TRANK1:p.E846K, TRPC5:p.S490L, TRPM3:p.R429W, TSSK1B:p.E301K, TTLL7: p.R751H, TTN:p.S20317L, TTN:p.E6404K, TTN: p.R4434Q, TTN:p.R2506Q, UGT8:p.E102K, USF1: p.R52Q, USP16:p.R455Q, USP25:p.R873H, USP33: p.R36Q, VPRBP:p.R802Q, VPS3B:p.R692Q, WDR65:p.F110C, YTHDC2:p.E185K, ZFYVE1: p.R266Q, ZKSCAN1:p.R541fs, ZNF117:p.R157I, ZNF180:p.R569I, ZNF195:p.R59Q, ZNF254: p.K179N, ZNF263:p.R510I, ZNF333:p.R554Q, ZNF354B:p.R402I, ZNF442:p.R309Q, ZNF454: p.R376I, ZNF485:p.R374I, ZNF488:p.R206Q, ZNF559:p.E284K, ZNF594:p.R287I, ZNF611: p.R390I, ZNF645:p.R154C, ZNF649:p.R338Q, ZNF649:p.R198I, ZNF674:p.R405I, ZNF675:p.R220I, ZNF678:p.R564I, ZNF732:p.R354I, ZNF780A: p.R466Q, ZNF823:p.R547I, ZNF836:p.R854I, ZNF836:p.R630I, ZNF841:p.R757I, and ZNF98: p.R370I.

59. The pharmaceutical composition of any of paragraphs 30-36, wherein:
    (a) the population of subjects is suffering from ACC; and
    (b) the at least one tumor-specific mutation comprises any combination of mutations selected from the group consisting of ZFPM1:p.EPL444del, GARS:p.P42A, ZNF517:p.V349A, LRIG1:p.L24V, CCDC102A: p.R96W, OPRD1:p.C27F, SOWAHA:p.R124P, LACTB:p.M5L, TOR3A:p.F13L, ZFPM1:p.E444fs, ZNF787:p.D367del, LRIG1:p.L26V, IRX3:p.L422P, TRIOBP:p.H1300R, TUBA1C:p.L146F, ZFPM1: p.P445fs, ZFPM1:p.446_447LA>P, TPO:p.S398T, USP42:p.R779P, ERCC2:p.D312N, GLTPD2: p.D209E, OTOP1:p.LLW 104del, RINL:p.P402L, AMDHD1:p.S3G, ASPDH:p.Q266R, KCNK17: p.S21G, TMEM247:p.Q128E, MUC5B:p.D682G, OBSCN:p.R4516W, FAM184B:p.R784W, SEMA5B: p.V840D, ZNF598:p.E25G, ADAD2:p.G44E, C1orf106:p.R538C, ZAR1:p.Q42H, PANK2:p.G126A, PODXL:p.28_30PSP>P, SALL3:p.L593V, THEM4: p.L17R, C2orf81:p.T315P, CLDN23:p.V210M, FAM109A:p.GGG156del, FPGS:p.122V, HHIPL1: p.V692A, MUC5B:p.M2869T, PLEC:p.R1386Q, SYT8:p.R373W, TAF5:p.S130A, TMEM189-UBE2V1:p.N6D, UQCRFS1:p.S6A, B3GNT6: p.L316fs, CCDC105:p.P499T, CLIC6:p.Q298E, IDUA:p.T374P, NOTCH2:p.C19W, RGS9BP:p.A96S, RREB1:p.G783V, SP8:p.G165del, WDR34:p.W60G, C19orf10:p.G12R, CELSR2:p.16_17insP, FAM75C1: p.71_71H>HLVSQRH, GPRIN2:p.R446H, KBTBD13:p.A81V, OGFR:p.S557T, PODXL: p.30_30P>PSP, BHLHE22:p.L62Q, C4orf32:p.G32E, C5orf65:p.Q245R, KNDC1:p.V806D, KRTAP10-6: p.49_49P>PSCCAP, LRP11:p.P92R, MAP1S: p.S411C, NOL9:p.S58A, RASIP1:p.R601C, RGMB: p.S63R, SARM1:p.R23P, TSC22D2:p.A419T, ZNF628:p.T230A, ZNF814:p.A337V, AATK: p.A541T, BTBD11:p.G265A, CRIPAK:p.C143R, KCTD3:p.F9V, KRT8:p.S59A, MUC5B:p.S681G, NCOR2:p.1846_1847insSSG, OGFR:p.E556K, APOE:p.C130R, C10orf95:p.A85S, C13orf33: p.R59G, CRIPAK:p.C174R, FAM18B2:p.C51Y, GLI3: p.P998L, GLTSCR2:p.Q389R, HECTD2:p.P19A, IRF2BPL:p.123_125QQQ>Q, MEX3C: p.179_182AAAA>A, NEFH:p.EE658del, RNF49: p.S9G, RNF222:p.A133T, SEZ6L2:p.R74P, TNIP2: p.R73G, ARRDC4:p.T79A, B3GNT6:p.P330fs, BAG1:p.G45R, C22orf26:p.P28L, CHDH:p.E40A, COQ2:p.V66L, CTGF:p.H83D, DLEU7:p.A83V, EPPK1:p.D2378H, FAM86C1:p.R30P, FZD1: p.93_94insP, GPRIN2:p.V241M, GPX1: p.11_13AAA>A, HES3:p.P96T, JMJD4:p.A11V, KANK3:p.R359H, LPPR2:p.A186S, NEFH: p.665_666insEE, NOM 1:p.R24G, RNF39:p.G263C, SCRT1:p.S133A, SNED1:p.L1228P, TTLL11: p.122_123insKA, ZCCHC3:p.A159del, ZNF219: p.QP233del, ASB16:p.T249A, ASB2:p.H515P, ATP9B:p.S39G, AVL9:p.G7fs, C17orf96:p.L63V, C19orf29:p.A499V, CRB2:p.T1110M, CRIPAK: p.P173R, CRIPAK:p.I190L, CSGALNACT2:p.L362F, CTBS:p.LAL31del, CTNNB1:p.S45P, DMRT1: p.S45T, DOK7:p.G461D, FBRSL1:p.A836V, FEZ2: p.P50L, FRG1:p.S169N, HSD17B1:p.G313S, IBA57: p.S130R, KIF1A:p.E917D, KRTAP9-1: p.160_160Q>QPSCGSSCCQ, LURAP1L: p.55_56insGGG, NMU:p.A19E, NMU:p.A18E, NOXA1:p.D6E, NPTX1:p.G100D, PLIN5:p.R306W, TBP:p.95_96insQ, TMEM200C:p.S498G, TNXB: p.V706fs, VARS:p.P51S, ZC3H12D:p.P405S, and ZZEF1:p.V30A.

60. The pharmaceutical composition of any of paragraphs 30-36, wherein:
    (a) the population of subjects is suffering from CESC; and
    (b) the at least one tumor-specific mutation comprises any combination of mutations selected from the group consisting of PIK3CA:p.E545K, PIK3CA:p.E542K, MAPK1:p.E322K, EP300:p.D1399N, ERBB2: p.S310F, ERBB3:p.V104M, KRAS:p.G12D, ANKRD12:p.E721Q, ANKRD36:p.M1144T, MICA: p.G318fs, PIK3CA:p.E726K, PTEN:p.R130Q, ABCD1:p.S606P, ACTL7B:p.E211K, ADAM21: p.F129C, ADAMTS12:p.P1053A, AKT1:p.E17K, ANKLE1:p.V643L, ANO3:p.M956I, AOAH:p.R326T, APOD:p.S115L, ASCC1:p.H207Y, ATM:p.S800F, AURKA:p.S387L, BAG5:p.M286I, C12orf43:p.E28Q, C16orf3:p.G65S, C3orf70:p.S6L, C4orf21:p.E800Q, CALB2:p.K60N, CALCB:p.R81T, CCDC152: p.E153Q, CCDC53:p.R58C, CDC27:p.P242S, CFHR5:p.R441H, CLOCK:p.L123fs, CMYA5: p.E2733K, CNTRL:p.P185S, CSHL1:p.R117Q, CSMD3:p.H952Y, CTNNB1:p.D32G, CTSH: p.E254Q, DHPS:p.F49L, DMPK:p.R44H, DNAH14: p.F622fs, DNAH3:p.E3367Q, DNAH8:p.E587D, DNASE1L1:p.D212N, ECE2:p.D254N, FAM71B: p.H445D, FAM73A:p.G23V, FAS:p.E261K, FBXW7: p.R505G, FBXW7:p.R465C, FEZF2:p.E82K, FKBPL: p.E161Q, FMNL1:p.E927Q, GPATCH3:p.E275Q, GPR142:p.P304T, GPRIN2:p.T100P, GRAMD2: p.II23M, HERC2:p.S329F, HGF:p.G229A, HIF3A: p.A72T, HIST1H1B:p.K188N, HIST1H2AL:p.R30P, HIST2H2AC:p.R30P, HLA-C:p.N104K, HLA-DPB1: p.G114fs, HRNR:p.G2539S, INVS:p.R799K, JPH3: p.Q433H, JUP:p.S627L, KIAA1211:p.R308fs, KIAA1211:p.E309fs, KLK2:p.E161K, KRAS: p.G13D, KRAS:p.G12V, LIN9:p.E231K, LOC151174: p.P90S, LRRC37A3:p.A406D, LRTM2:p.L176V, MEPE:p.S30T, MUC12:p.R2634C, MUC4:p.S2936L, MYOM2:p.D988N, NFE2L2:p.D29H, NOTCH2: p.R2298W, NPIPL1:p.P250L, NR5A2:p.E80K, NYAP2:p.R197Q, OBSL1:p.E1642K, OR13C2:p.L9V, OSBP:p.Q721H, PAOX:p.H107Y, PDILT:p.E500K, PIAS3:p.D460N, PLEKHO2:p.E351Q, PNRC1: p.R73C, PPP4R1:p.L597F, PREP:p.F469L, PRKDC: p.Q3568E, PSME3:p.R231W, RANBP6:p.R915W, RCAN2:p.D440N, RNPC3:p.E116fs, SDHAP1: p.H66Y, SDHAP2:p.S37fs, SERPINA3:p.K158N, SERPINA4:p.R98C, SF1:p.R255W, SGSM1:p.E818K, SIM1:p.V213M, SLC10A4:p.F281L, SLC25A5: p.I79F, SLC35G2:p.K62fs, SLC4A9:p.R617C, SLCO2A1:p.M479I, SND1:p.Q38E, SPATA17: p.R72K, SRSF12:p.S150C, TADA2B:p.E67K, TCTEX1D2:p.S74L, TEDDM1:p.M166I, TEX15: p.E1652Q, TMC2:p.E92D, TMEM131:p.E1319Q, TNKS2:p.T619fs, TNS1:p.Q659del, TP53:p.E285K, TRAF3:p.S9F, TRIM61:p.K98N, TRPM1:p.M996I, TUFT1:p.L101F, U2AF1:p.S34F, UNC93B1: p.V498M, USP4:p.L259V, VCAN:p.S1308C, WDR17: p.P278S, ZBED4:p.S385L, ZEB2:p.E1094K, ZFYVE9:p.M1147I, ZNF16:p.R452W, ZNF677: p.R131T, and ZSWIM4:p.E407K.

61. The pharmaceutical composition of any of paragraphs 30-36, wherein:
   (a) the population of subjects is suffering from CRC; and
   (b) the at least one tumor-specific mutation comprises any combination of mutations selected from the group consisting of KRAS:p.G12D, KRAS:p.G12V, BRAF: p.V600E, KRAS:p.G13D, TP53:p.R175H, PIK3CA: p.E545K, FBXW7:p.R465H, KRAS:p.A146T, PIK3CA:p.H1047R, TP53:p.R248W, CDC27: p.D555E, SMAD4:p.R361H, TP53:p.R273H, KRAS: p.G12C, NRAS:p.Q61K, ERBB2:p.V842I, ERBB3: p.V104M, FBXW7:p.R465C, PIK3CA:p.R88Q, PIK3CA:p.E542K, TP53:p.R273C, TP53:p.G245S, AXIN2:p.G665fs, C16orf45:p.T106N, C20orf26: p.R1088Q, DNMT1:p.E432K, FBXW7:p.R505C, HLCS:p.E362K, HPSE2:p.K58N, KIF14:p.R598Q, KIF18A:p.R17C, KIF20B:p.E991K, KLHL5: p.R326K, KLK2:p.P57L, KRAS:p.G12A, KRAS: p.G12S, LPHN3:p.R1183Q, LRP6:p.R675Q, MYH8: p.R1048Q, NRAP:p.E327K, NRAS:p.G12C, PIK3CA: p.N345K, POSTN:p.R508C, PPP2R1A:p.R183W, PTEN:p.R130Q, RAF1:p.S257L, SDK1:p.T1181M, SGSM1:p.F1117L, TCF7L2:p.R482fs, TP53: p.R282W, TRIM23:p.R289Q, UGT8:p.E102K, ZNF491:p.R343Q, A2M:p.R732Q, AADACL4: p.A266T, ABCA8:p.E1158K, ABCA8:p.R842Q, ABCA8:p.A696T, ABCB8:p.R345H, ACACA: p.R1731C, ACADM:p.F48C, ACOT9:p.R50Q, ACPP: p.R105Q, ACTL7B:p.R354H, ACTL9:p.R331H, ACVR1:p.S290L, ADAM30:p.S314Y, ADAM32: p.R559Q, ADAMTS16:p.D817N, ADAMTS4: p.R156W, ADCY5:p.R661H, AGMAT:p.V313M, AGPAT4:p.A212T, AKAP12:p.E1282K, AKAP9: p.L3482I, ALB:p.S294L, ALDH1L1:p.A870T, ALG2: p.S302Y, AMOTL1:p.R676Q, AMPD1:p.K502N, AMPH:p.R292W, ANKRD6:p.R479C, APBA1: p.K730N, APBA1:p.E624K, APC:p.E847fs, APC: p.F1354fs, APC:p.M1413fs, APOB:p.R3136C, APOB: p.A43V, APPL1:p.R668W, AQPEP:p.A309T, ARF4: p.R149H, ARFGEF1:p.D1632N, ARHGAP32: p.E1253K, ARHGAP36:p.R128C, ARHGAP36: p.A147V, ARHGAP5:p.D890fs, ARNTL:p.T395M, ARPP21:p.R338H, ARSG:p.V131I, ASCC3: p.R1197Q, ATP10D:p.R311H, ATP6V0A4:p.R191Q, ATP9B:p.R265Q, AXDND1:p.E930D, AXIN2: p.W663fs, B2M:p.L13fs, B3GALNT1:p.R145Q, BACH 1:p.R538Q, BAG5:p.D439N, BBOX1: p.F176V, BCL2L11:p.R91Q, BCL7A:p.T52M, BCLAF1:p.R37fs, BEND5:p.R198C, BICD2: p.R162H, BLVRA:p.S44L, BMP3:p.R344W, BNC2: p.R512W, BRPF1:p.R66C, BRWD3:p.R787C, BTBD7:p.S436L, BUB1B:p.F996L, BZRAP1: p.V1627I, C11orf330:p.R111C, C14orf101:p.E295K, C14orf102:p.D115N, C14orf105:p.R100I, C15orf2: p.V488I, C15orf33:p.D340N, C16orf87:p.R151I, C1RL:p.L351fs, C22orf40:p.P32fs, C3orf39:p.R333W, C5orf30:p.D4N, C5orf4:p.R114Q, C6orf170:p.K724T, C7orf63:p.A10T, CACHD1:p.S720Y, CACNA1A: p.T665M, CACNA2D3:p.A332T, CACNB2:p.R608H, CACNG3:p.V134I, CACNG3:p.A138V, CACNG5: p.G121R, CADM1:p.S190L, CADPS:p.A1073T, CAPRIN2:p.E13K, CARD11:p.R423Q, CASC1:p.R54Q, CASP14:p.RSW, CBFB:p.E152K, CC2D2A: p.R1284C, CCDC18:p.K615N, CCDC60:p.R230H, CCDC81:p.R259I, CCDC88C:p.P1851fs, CCKBR: p.V236M, CD101:p.D283Y, CD101:p.R594Q, CD180: p.N228T, CDC14B:p.R375C, CDCA7L:p.P405fs, CDH10:p.E349K, CDH12:p.D674N, CDH20: p.A134V, CDH23:p.F177L, CDH2:p.D547Y, CDH9: p.F523L, CDK16:p.R108C, CEACAM5:p.L640I, CEP152:p.E21K, CERS3:p.E95D, CHD4:p.R975H, CHD5:p.A801V, CIZ1:p.V668A, CLEC18A:p.R423H, CLTCL1:p.R481W, CMAS:p.R110Q, CNRIP1: p.R102W, COBLL1:p.K732N, COL4A1:p.R1082I, COL17A1:p.P1004L, COL4A6:p.L550I, COL6A3: p.D2792N, COPB1:p.R425C, CORO2A:p.*526R, COX15:p.L86I, CSMD1:p.S781Y, CTCFL:p.E423K, CTDNEP1:p.E126K, CTTNBP2:p.R164C, CYP4B1: p.E434D, DACH2:p.R539C, DBC1:p.V216I, DBF4B: p.S254Y, DCHS2:p.F2149L, DCLK2:p.S549Y, DDI1: p.R275Q, DENND4A:p.P357H, DENND4C: p.R1081Q, DHTKD1:p.R410Q, DISP1:p.R763C, DKK2:p.R230H, DKK4:p.R203Q, DLC1:p.A350V, DLC1:p.E222D, DMD:p.R3195H, DNAH5:p.R982H, DNAH5:p.R224Q, DNAH9:p.D1547N, DNAJC24: p.E61K, DNM1:p.A251T, DNMT1:p.E1531Q, DNMT3B:p.R92W, DOCK10:p.A1830V, DOCK1: p.E864K, DOCK2:p.G170R, DOCK3:p.R1183C, DOCK5:p.E177K, DOK5:p.R274W, DPP8:p.G165R, DPY19L1:p.F378L, DUOX2:p.F880L, DVL2: p.A601fs, EBAG9:p.E187K, EBF3:p.G255fs, EDNRB:p.L450R, EGR2:p.R390H, EHD3:p.E44K, EIF2C1:p.R139Q, ELF3:p.F305fs, ELMOD2: p.T141M, EMR2:p.S75L, ENAM:p.R373H, ENOX2: p.R356W, ENTPD7:p.E327K, EPG5:p.D369N, EPHB2:p.R392H, ERCC6:p.V780I, ERCC6L: p.R505Q, ERRFI1:p.A421T, ESCO1:p.R300Q, ETV6: p.R369W, F8:p.S2269Y, FAM123B:p.F173fs, FAM135B:p.R884H, FAM169B:p.K165N, FAM170A: p.E56K, FAM171B:p.D459N, FAM181A:p.R109H, FAM5B:p.R402C, FBXO11:p.A432V, FBXW7: p.R689W, FBXW7:p.S582L, FBXW7:p.R14Q, FGF14:p.A236V, FHDC1:p.R254W, FHOD3: p.A225T, FHOD3:p.E813K, FMO3:p.F510L, FNDC1: p.R652H, FOXK1:p.R354W, FOXN3:p.P96fs, FPGT-TNNI3K:p.R455H, FZD3:p.D367N, GABRA4: p.R460Q, GABRA5:p.S126N, GABRB3:p.D500N, GALNTL5:p.R262I, GJA1:p.R362Q, GLRA3: p.L454I, GLRA3:p.F132L, GOLGA4:p.Q1536H, GP2: p.S41L, GPC6:p.A214T, GPLD1:p.R717Q, GPR125: p.R113Q, GPR156:p.F754L, GPR158:p.D566N, GPR21:p.R216H, GPR61:p.A62T, GPR98:p.R4142W, GPRC5A:p.V30I, GRAP2:p.E69D, GRIA1:p.R218C, GRIA2:p.R845Q, GRM7:p.R679Q, GTF3A:p.K306N, HAO1:p.R172C, HARS2:p.R168H, HBB:p.F42L, HCN4:p.R525H, HDAC5:p.A1044T, HGF:p.S467Y, HIPK4:p.R280H, HLA-DMA:p.E84K, HMG20A: p.E248D, HPS3:p.S468L, HRSP12:p.R120Q, HS3ST1:p.E287K, HTR3B:p.R236C, HTR5A: p.R152C, HTT:p.D1548N, HYDIN:p.R1187C, HYDIN:p.R939Q, HYDIN:p.R451Q, HYOU1: p.R158C, IFT172:p.A944V, IGJ:p.R77Q, IL17RA: p.Q803fs, IL1RAPL2:p.T647M, IL3:p.A90T, IL5RA: p.L47I, INPP5D:p.R523Q, INPP5K:p.R263C, IRAK3: p.R267Q, IREB2:p.R419Q, ITGA4:p.T673M, ITGA4: p.F900L, ITIH5:p.A912T, ITK:p.E196K, JAG1: p.A462T, JAK1:p.V310I, KAL1:p.V303L KBTBD8: p.V549I, KCNA3:p.A415V, KCND3:p.S438L, KCNMB4:p.F209L, KCTD20:p.L314fs, KDELC1: p.L447I, KIAA0528:p.R181Q, KIAA0556:p.R1082W, KIAA1109:p.S4937Y, KIAA1804:p.V474M, KIAA1804:p.R477W, KLF16B:p.R145Q, KIF26B: p.A1114V, KPNA4:p.R29Q, KRAS:p.K117N, KRAS: p.Q61L, KRAS:p.Q61K, KRT6B:p.L197P, L1CAM: p.T186M, LALBA:p.A41 T, LAMA4:p.A558V, LBX1: p.R176W, LPAR4:p.R145Q, LRP1B:p.K2623N, LRP2:p.R3043C, LRP2:p.S737L, LRRC18:p.R218W, LRRC3J:p.K23T, LRRC7:p.R1389H, LZTS2: p.P100fs, MACF1:p.S292L, MACF1:p.F722L, MAEL:p.R345C, MAGEE1:p.V380M, MAGI1: p.R1198C, MAP1B:p.E2046D, MAP2:p.K530N, M4AP2K4:p.R287H, MAP3K4:p.R275Q, M4AP7D2: p.R487C, MALPK8IP1:p.L217fs, MBOAT2:p.R43Q, MCF2L2:p.R926Q, MECOM:p.R969C, METTL16: p.R200Q, METTL21A:p.R174Q, METTL6:p.F56L, MFF:p.R162C, MFSD5:p.R280Q, MIA3:p.Q356H, MMAA:p.R326C, MORC1:p.D113Y, MORC2: p.R740H, MPDZ:p.L804I, MR1:p.S46L, MRPL47: p.L234I, MS4A8B:p.S3L, MSH4:p.K464N, MSH6: p.T1085fs, MSH6:p.R1095H, MUC16:p.R8606H, MYH13:p.D311N, MYH7:p.R1689C, MYO1D: p.E246K, MYO3A:p.N525H, MYO6:p.D1180N, MYO9A:p.R2179Q, MYO9A:p.R167Q, MYOZ2: p.E251K, MYT1:p.E226K, NAA25:p.S807Y, NCAM1:p.R474W, NCOA4:p.R562Q, NEB: p.D5434N, NEB:p.L1591I, NEB:p.E1214K, NEDD9: p.A798T, NEDD9:p.A316T, NEK1:p.R608C, NFASC: p.V256I, NINL:p.R1366C, NLRC4:p.D593N, NLRC4: p.E409K, NLRP4:p.V229I, NLRP5:p.R392H, NME9: p.E75K, NOLC1:p.T428M, NPC1:p.E451K, NPSR1: p.R235Q, NRAS:p.Q61L, NRAS:p.G13R, NRAS: p.G12D, NRG2:p.T246M, NTN4:p.E59K, NUB1: p.R373Q, NUDT15:p.S83 Y, NUF2:p.S340L, NUP88: p.A302V, ODZ1:p.R2556W, OGDHL:p.A427T, OGFRL1:p.E427K, OLFM4:p.K132N, OPRM1: p.R353H, OR10A3:p.S93Y, OR2M3:p.R235H, OR52W1:p.R133C, OR5AU1:p.R312H, OR5B17: p.R163H, OR8S1:p.A99V, OSTN:p.R115Q, OTOL1: p.V431I, OTUD3:p.R277I, PAN3:p.S580N, PANK3: p.R260I, PAX3:p.T424M, PCBP1:p.L102Q, PCDH10: p.V477M, PCDH15:p.R1552I, PCDHAC2:p.A519I, PCDHAC2:p.E190K, PCDHAC2:p.A266T, PCDHAC2:p.A156V, PCDHAC2:p.E271K, PCDHAC2: p.A736V, PCDHB5:p.D51Y, PCDHB8:p.D235N, PCDHGC5:p.S289L, PCDHGC5:p.V662M, PCNXL2: p.R135Q, PCOLCE2:p.A348V, PCOLCE2:p.R87H, PDE4B:p.S417L, PGAM1:p.R240H, PHF3:p.R1410I, PIAS2:p.S519L, PIGR:p.A580T, PIK3CA:p.D350G, PIK3CA:p.E545A, PIK3CA:p.E545G, PIK3CA: p.Q546K, PIP4K2C:p.R204H, PKHD1L:p.F1856L, PLA2G4A:p.E443K, PLCG2:p.E544K, PLCG2: p.D973N, PLEKHA6:p.V328fs, PLEKHG4B: p.E384K, PLK1:p.D233G, PLOD3:p.R297fs, PLSCR3:p.E77K, PLXNC1:p.S462L, PLXNC1: p.R819C, POLA1:p.E603D, POLE:p.S459F, POLE: p.V411L, POLQ:p.R860Q, PPP2R2B:p.P326L, PPP2R5C:p.S259Y, PRAMEF4:p.R248H, PREX1: p.V731I, PRKAA2:p.R407Q, PRKAR2B:p.S309L, PRKCI:p.R480C, PRKRA:p.K122N, PSG8:p.R397C, PSG8:p.R320C, PSMD12:p.R201Q, PTPDC1: p.R430W, PTPN12:p.R765Q, PTPN13:p.S887L, PTPRD:p.L053I, PTPRU:p.D1434N, PXDN:p.P856fs, PXDNL:p.T1312M, QRSL1:p.S226L, RAB7L1: p.R79W, RALGAPA1:p.R398C, RANBP2:p.R1231C, RBBP7:p.E313K, RBBP7:p.E274K, RBFOX2: p.A340T, RBMXL1:p.R331Q, RHOBTB1:p.T464M, RIMS2:p.R599Q, RIN3:p.S708L, RLBP1:p.D281N, RLBP1:p.A72V, RNASET2:p.A127V, RNF113B: p.A172V, RNF150:p.R236Q, RNF150:p.S208L, RNF43:p.S216L, ROR2:p.D672N, RPL6:p.F193C, RPS6KA5:p.E166K, RSPO2:p.R28C, RUVBL1: p.E431K, RUVBL1:p.R117C, RWDD2B:p.R254H, RXFP3:p.R13C, RYR3:p.R2705Q, SAGE1:p.R229C, SCFD2:p.R545W, SCML4:p.R194Q, SCN10A: p.T1570M, SCN11A:p.A1688T, SCN11A:p.V1289I, SCN11A:p.V566I, SCUBE2:p.V342M, SEMA3A: p.D81N, SEMA4D:p.R252Q, SEPHS1:p.R371Q, SEZ6L:p.S207L, SFPQ:p.R611Q, SFSWAP:p.S617Y, SGCG:p.A220V, SGCZ:p.I41M, SH3TC2:p.R89C, SIGLEC11:p.S363F, SIPA1L1:p.R1063Q, SIPA1L1: p.S1227Y, SLC12A1:p.S292L, SLC22A15:p.S201L, SLC24A2:p.A134V, SLC25A40:p.R96Q, SLC2A7: p.A65T, SLC30A9:p.R194H, SLC33A1:p.S542L, SLC35F3:p.A280T, SLC39A7:p.R382C, SLC43A1: p.P133L, SLC43A3:p.R216H, SLC44A5:p.R185H, SLC6A2:p.A562T, SLC8A1:p.R431H, SLFN12L: p.F232fs, SLITRK1:p.R52H, SLITRK3:p.S298L, SMAD2:p.R321Q, SMARCA4:p.R38 Q, SOCS5: p.S464L, SORBS1:p.V1156M, SORBS1:p.F570L, SORCS2:p.R320W, SOX6:p.R719W, SPATA22: p.S150L, SPEG:p.A944V, SPTB:p.R86C, SPTBN4: p.A1993V, STIM2:p.R572Q, STT3B:p.D583Y, SULT1C4:p.R85Q, SUN3:p.E128K, SUPT6H: p.A957T, SYNE1:p.I1249L, SYNE1:p.R170W, SYNE2:p.K3103N, SYNGR4:p.R169Q, SYT7: p.T349M, TANK:p.S380L, TAS1R2:p.R270C, TAS2R:p.F183L, TCF7L2:p.R488C, TDRD10: p.S322L, TECTB:p.L29I, TEKT5:p.R401H, TGFBR1: p.S241L, THAP5:p.S287Y, THSD7B:p.R90H, TLL1: p.T153M, TLL2:p.S872L, TM9SF2:p.R91H, TMCC3: p.R110H, TMEM132A:p.R481C, TMEM132D: p.R578W, TMEM55A:p.R189Q, TMEM74:p.R125Q, TMPRSS11A:p.S288L, TNIP2:p.A139T, TOP2B: p.R656H, TOX:p.S354L, TP53:p.G244D, TP53: p.R175C, TPO:p.A826T, TPR:p.S2155L, TPTE2: p.R258Q, TPTE:p.S423L, TRAK1:p.D627N, TRAPPC11:p.R568Q, TRIM23:p.R396Q, TRIM44: p.D331N, TRIO:p.R661W, TRPA1:p.K54N, TRPC5: p.S490L, TRPM6:p.R995H, TRPM7:p.R1862C, TRPM7:p.R843Q, TRPS1:p.R1125W, TRPV5: p.R492H, TRRAP:p.R3515W, TSHZ1:p.R881M, TTC21A:p.S270Y, TTN:p.R22795C, TTN:p.R3193Q, TTN:p.R328H, TUBA3D:p.R243Q, TUFT1:p.A340T, TXNDC15:p.R343Q, UBE2NL:p.R86I, UBIAD1: p.A97T, UGT2A1:p.N97fs, USH2A:p.F2369L, USP11:p.A286T, USP25:p.R119Q, USP26:p.R861Q, USP29:p.F81L, USP31:p.D391N, USP40:p.S851L, UTP14A:p.V148I, VAV3:p.E685K, VCAN:p.R1125H, VPS13C:p.D1359Y, WBSCR17:p.R228C, WDR3: p.E841K, WDR52:p.A157T, XKR6:p.R268Q, XPOT: p.R541W, YTHDC1:p.R267Q, YTHDC2:p.E634K, ZBBX:p.R596I, ZBTB24:p.L607I, ZC3H13:p.R103Q, ZCWPW2:p.D144N, ZEB2:p.R156H, ZFHX4: p.E237D, ZFP14:p.R386C, ZFP28:p.R525I, ZFP2: p.R150I, ZFP3:p.R273I, ZFP90:p.R330Q, ZHX2: p.V790I, ZIC4:p.S305L, ZIM3:p.D352N, ZKSCAN4: p.R319Q, ZMYM4:p.R1446Q, ZNF117:p.R185I, ZNF167:p.R683I, ZNF180:p.R401I, ZNF19:p.R349I, ZNF205:p.R384C, ZNF236:p.S1480L, ZNF248: p.R568I, ZNF259:p.R174I, ZNF266:p.R512Q, ZNF266:p.R344Q, ZNF280B:p.E363K, ZNF283: p.R392Q, ZNF32:p.S62L, ZNF345:p.R82Q, ZNF345: p.R334I, ZNF350:p.R310Q, ZNF434:p.R306C, ZNF439:p.E239D, ZNF439:p.R262I, ZNF443: p.R301I, ZNF445:p.L682M, ZNF470:p.R641I, ZNF471:p.R282I, ZNF484:p.R138C, ZNF528: p.R279Q, ZNF563:p.K26N, ZNF573:p.R350I, ZNF583:p.R344I, ZNF585A:p.E638K, ZNF585A: p.E491D, ZNF625:p.R235Q, ZNF652:p.K327N, ZNF677:p.R451I, ZNF678:p.R368I, ZNF699:p.R41I, ZNF70:p.R244L ZNF770:p.S441P, ZNF774:p.R423Q, ZNF782:p.K247T, ZNF7:p.R337I, and ZNF831: p.E949D.

62. The pharmaceutical composition of any of paragraphs 30-36, wherein:
    (a) the population of subjects is suffering from DLBCL, and
    (b) the at least one tumor-specific mutation comprises any combination of mutations selected from the group consisting of EZH2:p.Y641F, MYD88:p.L273P, BCL2: p.G33R, CARD11:p.E626K, ADCY2:p.A87V, BCL2: p.N172S, BCL2:p.H20Q, BRAF:p.K601E, BTG1: p.L31F, CACNA1E:p.R1458C, CARD11:p.E93D, CD79B:p.Y197D, CD79B:p.Y197H, CREBBP: p.R1446H, GRID1:p.E622K, HIST1H1C:p.A65V, HIST1H1E:p.G133A, HIST1H3B:p.A48S, KRAS: p.G13D, MYD88:p.S251N, PABPC1:p.R94C, PIM1: p.L164F, PIM1:p.L184F, POU2F2:p.T239A, POU2F2: p.T239S, RELN:p.R2971Q, SLC25A48:p.A67T, STAT6:p.D468H, TNF:p.L47F, and TRAF7:p.R11H.

63. The pharmaceutical composition of any of paragraphs 30-36, wherein:
    (a) the population of subjects is suffering from KICH; and
    (b) the at least one tumor-specific mutation comprises any combination of mutations selected from the group consisting of ACR:p.W279C, AGRN: p.1284_1285VT>A, C7orf25:p.R384fs, CAMSAP1: p.T466fs, CBWD6:p.E102fs, DOCK8:p.L1111fs, EBPL:p.Q196P, EBPL:p.L89V, GFM1:p.A17fs, GOLGA6L6:p.D570E, ITGA5:p.A48D, LUZP2: p.S154fs, MTMR9:p.K193fs, MUC16:p.P10452fs, MUC4:p.S2832P, ODF2L:p.K407fs, RHBDD3: p.G34fs, RILPL1:p.S358R, TAS2R30:p.L236fs, TRRAP:p.A973S, UBR5:p.K2120fs, URGCP: p.G639fs, ZNF98:p.A222T, and ZSWIM6:p.Q610fs.

64. The pharmaceutical composition of any of paragraphs 30-36, wherein:
    (a) the population of subjects is suffering from KIRP; and
    (b) the at least one tumor-specific mutation comprises any combination of mutations selected from the group consisting of FAM18B2:p.C51Y, ZNF598:p.E25G, NEFH:p.E645K, EEF1B2:p.S43G, NEFH: p.AKSPEKEE652del, OBP2B:p.K61N, SKI:p.A62G, C14orf126:p.R6W, KRT8:p.S59A, ACSBG2:p.I250M, ASIC2:p.R46L, CSGALNACT2:p.L362F, FRG1B: p.A50P, IDUA:p.H33Q, KRTAP4-5:p.S74C, SCAF11: p.E926fs, SYN2:p.A34del, ZNF814:p.R322K, BMS1: p.E878D, JMY:p.P822T, KIF1A:p.E917D, KRTAP4-7: p.S57P, LAMA5:p.L2223R, LRP1:p.P1058T, MED16: p.H449Q, MUC2:p.T1488P, MUC5B:p.D682G, NACA2:p.R75K, NEFH:p.665_666insEE, OR2L8: p.S201fs, RGPD5:p.P1760A, RRN3:p.P1 S, RRN3: p.R9C, STAG3L2:p.L81fs, ZNF814:p.G320E, ACP6: p.V29G, AHNAK2:p.S2166F, AHNAK2:p.P1215S, AP1G1:p.1782fs, AQP2:p.N68T, BAIAP2L2: p.V396M, BMP6:p.Q118L, BST1:p.G36A, CDR1: p.V31A, CLDN7:p.S172A, CLIP 1:p.S1018fs, COL18A1:p.G884fs, CROCC:p.A355P, CTAGE15P: p.A364V, CUBN:p.I2816M, DMRT2:p.T106S, DPY19L1:p.V249L, DSPP:p.D1047N, EBPL: p.L189V, EIF4G1:p.E465del, EXOSC2:p.R11P, FAM216A:p.P36S, FCGR2A:p.V222G, FMOD: p.S331R, FOLR2:p.Q112R, FRG1B:p.L20P, GAGE2B:p.9_10insY, GDPD5:p.G593fs, GIMAP8: p.A544S, GLUD2:p.R300G, GLUD2:p.S496R, GPR135:p.Q5P, HOXD8:p.Q67H, IER5:p.R194G, IL25:p.C168fs, JSRP1:p.V92A, KRAS:p.G12D, KRTAP1-1:p.Y86C, KRTAP4-11:p.L161V, LTBP1: p.L163P, MAML2:p.Q591K, MAPK7:p.A501D, MEF2A:p.P99S, MET:p.H1094Y, MET:p.M1250T, MST1:p.N435fs, MUC2:p.T1582R, MUC2:p.T1722I, MUC4:p.A4222T, MUC4:p.T2335M, MUC4: p.P1138L, MUC5B:p.S1098A, MUC5B:p.S3431N, MYH7:p.A1487T, NBPF10:p.R39fs, NBPF10: p.Y638S, NEFH:p.654_654S>SPEKAKS, PARG: p.A584T, PBX2:p.Y262F, PIP4K2A:p.R219K, RLIM: p.S471P, RUNX2:p.Q71E, SGK223:p.R63S, SMARCB1:p.L365fs, SRCAP:p.Q1875fs, TBC1D2B: p.R920Q, TCF7L2:p.R482fs, TMEM131:p.K640fs, TMEM60:p.K77fs, TPPP:p.R30K, TRPV3:p.A218E, TTBK2:p.C83W, UBXN11:p.S510G, UGT1 A1:p.T4A, UTS2R:p.A289E, YBX1:p.P250L, ZNF514:p.V81G, ZNF516:p.A256D, ZNF681: p.K405Q, ZNF814:p.D404E, ZNF814:p.P323H, ZXDB:p.G206R.

65. The pharmaceutical composition of any of paragraphs 30-36, wherein:
    (a) the population of subjects is suffering from LIHC and
    (b) the at least one tumor-specific mutation comprises any combination of mutations selected from the group consisting of TP53:p.R249S, CTNNB1:p.D32V, CTNNB1:p.D32G, CTNNB1:p.S33P, CTNNB1: p.K335I, CTNNB1:p.H36P, EEF1A1:p.T432L, GNAS: p.R844C, OR2T4:p.V137L, TP53:p.H193R, ATXN1: p.Q217H, CSMD3:p.F2383fs, CTNNB1:p.D32N, CTNNB1:p.S33C, CTNNB1:p.G34V, CTNNB1: p.S45P, CTNNB1:p.N387K, DHRS4:p.I218T, DNM2: p.E378D, F5:p.Q426L, GALNTL5:p.A45T, GPX1: p.P77R, GRM8:p.R852C, IDH1:p.R132C, KIF26B: p.A2033T, KRT8:p.S59A, LOC100132247:p.T532P, NEB:p.D3854H, PIK3CA:p.H1047R, SOLH: p.R714H, TP53:p.R158H, TP53:p.V157F, and ZNF638:p.D400N.

66. The pharmaceutical composition of any of paragraphs 30-36, wherein:

(a) the population of subjects is suffering from MM: and
(b) the at least one tumor-specific mutation comprises any combination of mutations selected from the group consisting of NRAS:p.Q61R, KRAS:p.Q61H, KRAS:p.G13D, NRAS:p.Q61K, BRAF:p.V600E, NRAS:p.Q61H, NRAS:p.G13R, ZNF717:p.W315C, ATP13A4:p.V431G, DNAJC12:p.R135K, IRF4:p.K123R, KRAS:p.A146T, KRAS:p.Q61R, KRAS:p.G12A, KRAS:p.G12D, ZNF717:p.N594I, ACTG1:p.A22P, ARL6IP1:p.M75L, BEND2:p.E630K, BRAF:p.G469A, CDHR1:p.R218G, DIS3:p.R780K, DMXL2:p.D2412E, DNAJC10:p.I80K, EGR1:p.Q9H, FGFR3:p.*807S, IDH1:p.R132C, IL6ST:p.P216H, INTS12:p.M1V, KRAS:p.K117N, KRAS:p.A59G, KRAS:p.G12R, MAX:p.R36W, MLL5:p.G492E, NBPF1:p.E810K, NRAS:p.Q61L, NRAS:p.G12D, ODF2L:p.E294K, PADI2:p.T114P, PNLIP:p.T37M, PRDM1:p.S588C, PTPN11:p.E76K, PTPN14:p.E286K, RBM6:p.V675G, SCN10A:p.R142H, SRGAP1:p.T61M, SUSD1:p.T168P, TAS2R16:p.V231I, TINAG:p.E403K, TRIP12:p.L1775P, and ZNF717:p.C844S.

67. The pharmaceutical composition of any of paragraphs 30-36, wherein:
(a) the population of subjects is suffering from PRAD; and
(b) the at least one tumor-specific mutation comprises any combination of mutations selected from the group consisting of HSD17B7P2:p.N175S, RGPD5:p.P1760A, FRG1B:p.L52S, EEF1B2:p.S43G, FRG1B:p.I10T, FRG1B:p.A53T, LRRC37A2:p.T102S, NBPF10:p.E3455K, PTH2:p.L22V, CYP2D7P1:p.S32A, FAM47C:p.N648D, MAP3K9:p.E38del, MUC4:p.H4205Q, CHEK2:p.K373E, FRG1B:p.A11T, FRG1B:p.A50P, HLA-J:p.R124W, KRTAP1-5:p.I88T, KRTAP4-9:p.D18V, NPIP:p.A271V, PDGFRA:p.R483fs, ZNF780A:p.Q600H, ZNF845:p.R925H, ZNF91:p.R333H, ARFGAP3:p.N299fs, BTN2A3P:p.P3S, FNBP4:p.TT58del, HLA-A:p.Q78R, LOC554223:p.RAPWMEQ147del, PODXL:p.28_30PSP>P, POLI:p.D17del, SPOP:p.F133L, SYN2:p.A34del, TMEM52:p.23_26LLPL>L, UBC:p.L149R, ZNF208:p.I647S, ZNF799:p.E589G, ZNF814:p.D404E, ASTN2:p.L221del, B4GALNT1:p.G88fs, C16orf74:p.S21del, CCDC15:p.H458P, CD209:p.R129W, CNTNAP1:p.S1029I, DBR1:p.541_542DD>D, FAM22F:p.S691del, FRG1B:p.D32V, FRG1B:p.I34T, FRG1B:p.N55D, FRG1B:p.I59V, FRG1B:p.S71N, KIF25:p.W3R, KRTAP4-11:p.L161V, KRTAP4-11:p.M93V, KRTAP4-11:p.R51K, KRTAP4-6:p.S153Y, LILRB5:p.S598P, LMOD2:p.E24del, LOC645752:p.L40P, LRP1:p.P1058T, LRRIQ3:p.K244fs, LURAP1L:p.55_56insGGG, MLLT10:p.V463E, MYOCD:p.Q310del, NBPF10:p.N1369D, OTUD4:p.T909I, PARG:p.A584T, PEX1:p.I370fs, POTEC:p.K507E, POTEC:p.R477Q, POU4F2:p.68_69insG, PRG4:p.T417P, SDHAP2:p.R31C, SPOP:p.F133C, SPOP:p.W131G, TIMD4:p.T152del, TMEM121:p.P299del, TP53:p.G245S, UBC:p.R73L, UBC:p.I191T, WASH3P:p.G175S, ZMIZ1:p.D1048fs, ZNF709:p.T413I, ACADS:p.R330H, ADAMTS7:p.K1357fs, AFF2:p.R597H, AGAP6:p.S127I, AK302238:p.A44T, AK302879:p.Q191R, ALDH1A2:p.R85C, ANAPC1:p.T537A, ANKRD36C:p.H438R, AP4B1:p.R276W, ARFGAP2:p.S38N, BBS9:p.F268fs, BC139719:p.L133R, BRAF:p.G469A, C22orf43:p.D171del, CANT1:p.K131R, CHD3:p.E35del, CLEC4A:p.R209H, CNOT3:p.E20K, CNPY3:p.17_18LL>L, CNTNAP3B:p.S317T, CNTNAP3B:p.M1247I, CTNNB1:p.T41A, DDX10:p.D788del, DLC1:p.S741T, DPY19L2:p.M210V, EDC4:p.S617del, EFCAB6:p.R379K, ERC2:p.927_928HH>H, FAM111B:p.S269fs, FEM1A:p.L620M, FHOD3:p.A632fs, FLJ43860:p.L850fs, FMN2:p.G59del, FNBP4:p.914_915PP>P, FRG1:p.E86del, FRG1B:p.K13N, FRG1B:p.P42Q, GABRB1:p.R416C, GABRR2:p.A368V, GAGE2B:p.9_10insY, GOLGA8DP:p.N84H, GOT2:p.R355W, GPATCH4:p.K210fs, HDGFL1:p.188_189insA, HLA-DQB2:p.G250S, HLA-DQB2:p.R247H, IDH1:p.R132H, 1L27:p.E176del, IRF2BPL:p.123_125QQQ>Q, KANK3:p.DGDS489del, KIAA1462:p.858_859SS>S, KRTAP4-11:p.S48R, KRTAP4-7:p.S57P, KRTAP4-8:p.C95S, LPHN3:p.R826H, LRP10:p.L11del, LRP5:p.S1609P, LRRC16B:p.R787W, MAS1L:p.R324G, MECOM:p.R915Q, MED12:p.L1224F, MED12L:p.Q2115del, MESP2:p.GQGQGQGQ195del, MGAT4C:p.T345M, MLEC:p.E238del, MSLNL:p.T68P, MUC7:p.S173P, MYC:p.Q37del, NBPF10:p.N440D, NLRP6:p.E611del, NOX3:p.C404fs, OR1M1:p.V69I, OR7E24:p.L7fs, OTUD4:p.A153del, PANK2:p.T417fs, PCLO:p.S496P, PCNT:p.S162G, PCSK9:p.23_24insL, PHOSPHO1:p.S32del, POU4F1:p.H108del, PRAMEF8:p.R319H, PRDM7:p.M387L, PRG4:p.T597P, PTPRD:p.R1323C, PTPRF:p.R1174Q, ROBO3:p.RS1367del, ROCK 1:p.T518S, RPTN:p.G296S, RTL1:p.152_152E>EE, SIRPA:p.V233I, SLC2A6:p.A230D, SLC8A2:p.E710del, SMG7:p.E846fs, SNAPC4:p.S542del, SP8:p.G165del, SPOP:p.F133I, SPOP:p.F33V, SPOP:p.F102C, SPOP:p.F102V, SRSF11:p.G17fs, SRSF4:p.K396del, SSPO:p.S4198fs, STAG3L2:p.L81fs, STK19:p.R18fs, TBC1D2B:p.R920Q, TBC1D9:p.P1233T, TCHH:p.P1158R, TCOF1:p.K1366del, TNRC18:p.2664_2665SS>S, TP53:p.R248Q, TP53:p.R175H, TP53:p.C141G, TSPAN4:p.L92V, UBXN11:p.GPGPGPSP504del, UTP3:p.E81del, WASH3P:p.L187V, ZAN:p.P717L, ZAN:p.L878P, ZFP90:p.R591fs, ZNF761:p.H373R, and ZNF91:p.H305R.

68. The pharmaceutical composition of any of paragraphs 30-36, wherein:
(a) the population of subjects is suffering from STAD; and
(b) the at least one tumor-specific mutation comprises any combination of mutations selected from the group consisting of RNF43:p.G659fs, BZRAP1:p.P1416fs, XYLT2:p.Y526fs, LARP4B:p.T163fs, PGM5:p.I98V, ZBTB20:p.P692fs, ARID1A:p.G1848fs, FHOD3:p.P334fs, KIAA0182:p.T120fs, ATP6V1B1:p.Y383fs, PIK3CA:p.H1047R, FRMD4A:p.P1005fs, PIK3CA:p.E545K, CDC14A:p.N123fs, KRAS:p.G13D, MLL2:p.T172fs, BCORL1:p.S1679fs, PLEKHA6:p.V328fs, C9orf131:p.P342fs, CD4:p.Q164fs, FBXW7:p.R465C, GNG12:p.T68fs, IRS4:p.G591fs, JARID2:p.V422fs, KIAA0195:p.I902fs, MBD6:p.P732fs, MVK:p.P138fs, PAMR1:p.G101fs, WNT16:p.W165fs, ZNF43:p.N251fs, ABCA6:p.L306fs, ADAM28:p.K73fs, AOC3:p.L79fs, ATP2A:p.R819fs, B2M:p.L13fs, C6orf89:p.P58fs, CNTLN:p.K1305fs, CR2:p.V206fs, DYRK4:p.K468fs, ERBB3:p.V104M, GLI1:p.W272fs, KRAS:p.G12D, MLL2:p.T72fs, MSH6:p.T1085fs, NLK:p.C190fs, OR5M3:p.T89fs, PAX6:p.P375fs, PTEN:p.L265fs, RABGAP1:p.K928fs, RAD51 AP2:p.T316fs, SVIL:p.G1862fs, TP53:p.R273H, WNK4:p.G606fs, ARID1A:p.P2139fs, AXIN2:p.G665fs, C13orf33:p.R67fs, C1QTNF5:

p.P308fs, CELSR1:p.G614fs, CRYGD:p.G159fs, DCHS1:p.R235fs, DDC:p.I433fs, EDNRB:p.Y383fs, EPHA2:p.P460fs, FOXN3:p.P96fs, HDAC4:p.P901fs, INF2:p.S527fs, KIRREL2:p.V649fs, KLF3:p.I104fs, KLHL14:p.P231fs, MAP7D3:p.Q308fs, OTX2: p.R44fs, PAFAH1B1:p.K302fs, PLAGL2:p.P10fs, POLM:p.P97fs, PRPF40B:p.I31fs, RALGAPB: p.T379fs, SBNO1:p.N1139fs, SERPINI1:p.L81 fs, SH3KBP1:p.L574fs, SLC2A7:p.H686fs, SLC27A3: p.P643fs, TBX4:p.S370fs, TP53:p.R273C, TP53: p.R175H, TRAM1L1:p.R345fs, WBP1:p.P138fs, ABCC4:p.L883fs, AKAP13:p.K2785fs, ALDH3A1: p.P562fs, ALPK2:p.L356fs, ARFGEF1:p.P1552fs, ARID1A:p.G1848fs, AVPR1A:p.F351fs, BAX: p.M38fs, C14orf43:p.P33fs, C1QTNF5:p.G194fs, C7orf50:p.L179fs, CDC25C:p.K322fs, CETN3: p.K63fs, CHD3:p.P597fs, CTCF:p.K202fs, CTSC: p.F05fs, DDX17:p.G163fs, DLGAP3:p.G377fs, EBF3: p.G255fs, FHDC1:p.F100fs, FILIP1L:p.K749fs, FLNB:p.W529fs, GBP7:p.G431fs, GCC2:p.E700fs, GPR161:p.G517fs, IWS1:p.S802fs, KIAA0240: p.K895fs, KIAA1967:p.P415fs, LRRC43:p.D558fs, MACF1:p.R707fs, MBD6:p.G780fs, MLL3: p.F4496fs, MPRIP:p.A35 fs, MUC6: p.2129_2130SS>S, NOX5:p.P467fs, OPTN:p.P24fs, OR4K5:p.F177fs, PIK3CA:p.N345K, PIK3CA: p.E542K, PLXNA1:p.P1016fs, PNPLA7:p.P1199fs, PODN:p.I301fs, PPP2R3B:p.T389fs, PRSS36: p.L680fs, RGL2:p.G203fs, RHOQ:p.V190fs, RNF111: p.R771fs, RTN2:p.P313fs, SALL4:p.V995fs, SBF1: p.P1076fs, SETDB2:p.R715fs, SNAPC2:p.T292fs, SPG20:p.F232fs, SRCAP:p.P1876fs, STAT2:p.P489fs, TCHP:p.E172fs, TP53:p.R282W, TP53:p.R248Q, USP21:p.K474fs, WDR7:p.G262fs, ZBTB7C: p.E157fs, ZFC3H1:p.K385fs, ZNF124:p.T339fs, ZNF626:p.K115fs, ADNP2:p.S322fs, AGAP1: p.G127fs, ALDH2:p.L286fs, ARHGAP5:p.D890fs, ARHGEF17:p.A615fs, ARID1A:p.Y1324fs, ART 1:p.I243fs, ASCL4:p.D35fs, ATXN2L:p.G998fs, B3GNT5:p.F30fs, BCKDHA:p.H37fs, BCL9L: p.P1127fs, BEND3:p.D265fs, BNC2:p.S575R, BRD3: p.P24fs, C12orf51:p.P4235fs, C1R:p.P216fs, C7orf49: p.G130fs, CA2:p.I145fs, CABP5:p.R145fs, CASD1: p.F781fs, CASP8:p.R471fs, CCDC153:p.P200fs, CD93:p.D280fs, CROT:p.L32fs, CSF3R:p.P468fs, CTCF:p.K202fs, ERBB2:p.S310F, FAM46D:p.S69R, FBN3:p.G601fs, FBXO21:p.F144fs, GAS6:p.G150fs, GLYR1:p.G380fs, GXYLT1:p.L223fs, HAUS6: p.S530fs, IGF2R:p.T1314fs, ITGB1:p.L378I, KDM3B:p.P1316fs, KIF13A:p.K1115fs, KLF3: p.S224fs, LARP1:p.A223fs, LRP1:p.G1488fs, LRP1: p.G1488fs, MAGEE2:p.Q45fs, MAMSTR:p.P162fs, MAPK15:p.Q511fs, MLL2:p.P647fs, MOCS2: p.P22fs, MTG1:p.L105fs, MTG1:p.H327fs, MTIF2: p.N109fs, NID2:p.R1035fs, PAX2:p.P395fs, PCCA: p.R230H, PDZD2:p.R01fs, PFKP:p.M593fs, PIK3CA: p.R88Q, PLA2G1B:p.L53fs, PLAU:p.R201fs, PMEPA1:p.P208fs, POP1:p.K750fs, PTCH1: p.P1307fs, PTPRT:p.P1075fs, RDBP:p.P6fs, RNMT: p.K392fs, ROBO2:p.P1080fs, RUNDC3B:p.L6fs, SDAD1:p.K275fs, SLC10A6:p.G109fs, SNAPC1: p.D21 fs, SPATA5L1:p.C685fs, SPTA1:p.K1732T, STAT5B:p.P367fs, SYT4:p.M1fs, TAF1L:p.K851fs, TAP2:p.L75fs, TBL1XR1:p.N126fs, THEMIS: p.K406fs, TMEM79:p.P161fs, TP53:p.C176F, TP53BP2:p.K69fs, TP53RK:p.L174fs, UBQLN2: p.A523fs, UHRF1BP1:p.I1330fs, VPRBP:p.K939fs, VPS13B:p.T56fs, WASF3:p.P305fs, YLPM1: p.E1178fs, ZC3H13:p.K1006fs, ZC3H18:p.P825fs, ZC3H4:p.E779Q, ZNF48:p.P247fs, ZNF608: p.A465fs, ZNF878:p.S238fs, ZSCAN18:p.P225fs, ABCB1:p.R527fs, ABCB6:p.G318fs, ACACB: p.G255fs, ACP1:p.Q123fs, ACTL6A:p.L88fs, ADAMTSL4:p.G778fs, AGBL5:p.I420fs, AHI1: p.K303fs, AKAP9:p.M3743fs, AKD1:p.R1209fs, ANKRD40:p.D99E, ARHGEF5:p.S1512fs, ARID1A: p.K1071fs, ARID3A:p.S557G, ARPP21:p.I130fs, ASPN:p.F67fs, ASXL3:p.E873fs, ATP6V1C2: p.R312fs, BEST3:p.P444fs, BRAF:p.P403fs, BRMS1: p.G107fs, BTBD11:p.T451fs, BTBD11:p.A561V, C11orf9:p.S261fs, C14orf102:p.R90fs, C14orf43: p.Q36fs, C15orf52:p.G98fs, C19orf21:p.R262C, C19orf70:p.P50fs, C20orf160:p.P46fs, C3:p.P890fs, CADPS2:p.N468fs, CASC3:p.S232F, CASC3: p.P603L, CASC3:p.P645L, CASC3:p.S658L, CASKIN2:p.P727fs, CBLL1:p.E138fs, CBLN3: p.P69fs, CCDC108:p.P164fs, CCDC148:p.K420fs, CCDC153:p.P200fs, CCDC169-SOHLH2:p.K162R, CCDC88A:p.K677fs, CD1E:p.F85V, CD3EAP: p.K218fs, CDH11:p.K357T, CDH1:p.D254Y, CDH23: p.V403I, CFI:p.K37fs, CHPF2:p.D645fs, CIC: p.R507fs, CIC:p.A1114fs, CIC:p.A1114fs, CLSTN1: p.T615M, CNBD1:p.L396P, CNGA4:p.K510T, CNOT6:p.S248fs, CNTROB:p.R920fs, COL9A1: p.P283fs, CPAMD8:p.P784fs, CR1L:p.L79fs, CRB1: p.F630V, CSMD1:p.L3410V, CTNNA3:p.K856fs, CTNND1:p.I447fs, CTSD:p.P89fs, CUX1:p.A439fs, CYP7B1:p.K332T, DAB21P:p.D994fs, DNAH11: p.T871fs, DNAH8:p.K1688fs, DNAJC1:p.K193fs, DNM2:p.P791fs, DSTN:p.F101fs, DYRK1B: p.Q545fs, EAF2:p.V109fs, EDNRB:p.A104V, EEA1: p.N570fs, EFHA1:p.F290fs, EGR1:p.P332fs, EIF4G3: p.K563fs, ELK3:p.S173fs, ENTPD2:p.G204fs, EOMES:p.G332fs, EPHA10:p.P868fs, EPHB6: p.G54fs, EPHX1:p.P132fs, EPPK1:p.G2015fs, ERBB4:p.M1fs, ESF1:p.T99fs, EXOSC8:p.L160fs, FAM113B:p.R5 fs, FAM116A:p.L44 fs, FAM135B: p.S645R, FAM151A:p.P117fs, FAM193A:p.D428fs, FAM193A:p.D428fs, FAM214B:p.A42fs, FAM40B: p.R740C, FAM70B:p.S19L, FASTKD1:p.K3fs, FBXW7:p.R479Q, FBXW9:p.G298fs, FER:p.L474fs, FERMT2:p.K152fs, FGGY:p.G138fs, FIGNL1: p.K309fs, FLG:p.K159fs, FLNB:p.W529fs, FOLH1: p.S501fs, FYB:p.G324fs, GABRD:p.Q412fs, GALNTL1:p.W317fs, GANAB:p.L23fs, GCDH: p.L389fs, GIMAP7:p.V276fs, GIPC3:p.G227fs, GLI3: p.P033fs, GLIPR1L2:p.G92fs, GNPNAT1:p.F54fs, GON4L:p.M134fs, GPATCH4:p.K210fs, GRK4: p.K22fs, GTF3C1:p.S767fs, GTF3C4:p.E562fs, H2AFY2:p.K144fs, HCFC1R1:p.P83fs, HCRTR2: p.S9fs, HCRTR2:p.S9fs, HDLBP:p.G747fs, HECA: p.R333fs, HIVEP3:p.H554fs, HIVEP3:p.P534fs, HLA-C:p.P209fs, HOOK1:p.L361fs, HOXD8: p.P122fs, HTT:p.G697fs, IBTK:p.K1213fs, IDE: p.K37fs, IFT172:p.A837T, INPPL1:p.A974fs, INPPL1:p.P1154fs, INSM2:p.T533fs, INTS12: p.L14fs, INVS:p.R815fs, IPO11:p.S844fs, IRX6: p.A425V, ISG20L2:p.P288fs, ITGB8:p.A7fs, JARID2: p.G394fs, JHDM1D:p.R97fs, KBTBD6:p.G442fs, KCNC1:p.K455fs, KCNH2:p.G149A, KCNJ10: p.P102fs, KCNMB2:p.N151K, KCTD21:p.T6M, KIAA0586:p.A1592fs, KIAA1009:p.F406fs, KIAA1109:p.E1588fs, KIAA2026:p.K690fs, KIF26B: p.S1065fs, KIF6:p.L204fs, KIRREL:p.P335fs, KLC2:

p.T568fs, KRAS:p.Q61H, KRAS:p.G12S, MAN1C1: p.G431fs, MAP A:p.P2063fs, MAP2:p.K1472fs, MAP3K12:p.R449del, MAP7D1:p.A80fs, MGST2: p.K102fs, MKI67:p.T1664fs, MKL1:p.P307fs, MLL2: p.P2354fs, MLL2:p.L656fs, MLL2:p.P647fs, MLL2: p.L1877fs, MMP3:p.I64fs, MPDZ:p.K1582fs, MTUS2:p.R1005W, MUC16:p.A6156T, MYB: p.R481fs, MYEOV:p.L269fs, MYH11:p.K1263del, MYO18A:p.P209fs, MYO7A:p.I539fs, MYOCD: p.G226fs, NAA16:p.H514fs, NBEA:p.V2247fs, NCAPD3:p.Q909fs, NCAPH:p.T466fs, NCOR2: p.P1308fs, NEFM:p.A213V, NEK8:p.V690fs, NF1: p.T676fs, NHLRC1:p.F204fs, NKD1:p.P286fs, NPR3: p.Y138H, NT5M:p.P206fs, NUFIP2:p.R224fs, NUP210:p.L135fs, NYNRIN:p.G113fs, OBSCN: p.G997fs, OGDH:p.Y948fs, OR4C16:p.S135R, OR51A7:p.L124R, OR7C1:p.C179fs, OSBP2: p.H627fs, OTOF:p.E1304K, P2RX1:p.R20fs, PALB2: p.M296fs, PALB2:p.N280fs, PANK1:p.K400fs, PAPD4:p.C225fs, PAPPA2:p.I1683fs, PARP15: p.K461fs, PARP4:p.K847fs, PCDH10:p.N118fs, PCDH10:p.P225fs, PCGF3:p.H63fs, PELI2:p.G197fs, PHACTR1:p.V251 fs, PHACTR2:p.S237fs, PHACTR4:p.S354fs, PHKB:p.K642fs, PIAS3: p.H116fs, PIGO:p.P787fs, PIGT:p.A346fs, PIK3R3: p.M341fs, PITPNM1:p.P295fs, PKN2:p.K76fs, PLA2G15:p.W230fs, PLAG1:p.K184fs, PLEKHO1: p.T254fs, PLOD3:p.R297fs, PLOD3:p.P296fs, PLXNA2:p.P464fs, POLQ:p.L1430fs, PPARGC1B: p.P135fs, PPL:p.P454fs, PPM1H:p.P226fs, PPP1R12C:p.P372fs, PREX2:p.R562fs, PRICKLE4: p.Q109fs, PRKAR1B:p.P87fs, PRKCG:p.R345C, PRMT8:p.S28fs, PROX1:p.F592fs, PRRG3:p.R163fs, PSD2:p.G256fs, PTCHD3:p.F588fs, PTPN4:p.N319fs, PTPRC:p.Q895H, PWWP2B:p.S84fs, PYGO2: p.Q150fs, RABGAP1:p.K928fs, RB1CC1:p.N1711fs, RBM6:p.R96fs, RHOA:p.Y42C, RIMS1:p.R71G, RIMS2:p.V401fs, RING1:p.G171fs, RINT1:p.L107fs, RNF43:p.P116fs, ROBO2:p.K1293fs, RPS6KA6: p.K109fs, RRS1:p.N45fs, RSF1:p.K386fs, RUSC2: p.P486fs, RXFP3:p.A60V, SAFB:p.W798fs, SCARF1: p.R614Q, SCLT1:p.K109fs, SERPINB12:p.Q168fs, SGK3:p.L61fs, SGOL2:p.E407fs, SIGLEC1:p.P318fs, SIK1:p.Q678fs, SLC6A6:p.G98fs, SLC25A17: p.F28fs, SLC26A7:p.1629fs, SLC32A1:p.V494I, SLC4A3:p.L061fs, SLC7A10:p.P157fs, SLC9A2: p.T746fs, SLITRK1:p.K45fs, SND1:p.H721fs, SOAT1:p.F64fs, SORBS2:p.E1158fs, SOX7:p.L309fs, SPAG17:p.Q264fs, SPTY2D1:p.P485fs, SRCIN1: p.P865fs, SREBF2:p.H763fs, SRRT:p.G102fs, STAB1:p.P1120fs, STRADA:p.R333fs, STX2: p.K252fs, SV2A:p.E138fs, SYCP2:p.M176fs, SYNJ2: p.P1111fs, TAS2R10:p.L196fs, TBC1D22B:p.A75fs, TEAD2:p.P298fs, TFE3:p.G482fs, TGM6:p.T358fs, TIMM44:p.K83fs, TIMP3:p.A199fs, TLR4:p.L498V, TMEM132D:p.P206fs, TMEM41A:p.F156fs, TMEM41B:p.F230fs, TMTC4:p.R611C, TNK2: p.P632fs, TOPBP1:p.I1381fs, TP53:p.E286K, TP53: p.P152fs, TRIP11:p.K541fs, TRPA1:p.T673fs, TRPM8:p.H765fs, TTF1:p.K336fs, TTI1:p.R707H, TTN:p.E15192D, U2AF2:p.L175fs, UBC:p.G684fs, UBR4:p.P2802fs, UPF2:p.E1033D, UPK2:p.P49fs, USP13:p.I1116fs, USP15:p.K782fs, VASH1:p.G3fs, VEZF1:p.355_356insN, VPS13A:p.F2883fs, WAPAL: p.R522fs, WDFY3:p.L842fs, WDR59:p.N160fs, WDR5:p.N214fs, WDR60:p.Q412fs, WDTC1: p.M287fs, WHSC1L1:p.K418fs, WNT1:p.W167fs, XIRP2:p.E1007D, YBX2:p.P226fs, YIF1A:p.R131fs, ZBBX:p.E151del, ZBTB40:p.L262fs, ZBTB7C: p.G342fs, ZBTB7C:p.D154fs, ZC3H18:p.T701fs, ZDHHC5:p.E651 del, ZDHHC7:p.P316fs, ZFHX3: p.R1893fs, ZFHX3:p.E763fs, ZFHX4:p.L408fs, ZHX3:p.N249K, ZIM3:p.I384fs, ZKSCAN5:p.D13fs, ZMYM4:p.K345fs, ZNF236:p.T1410M, ZNF23: p.F122fs, ZNF334:p.K426fs, ZNF358:p.T130fs, ZNF701:p.L296fs, ZNF711:p.L737fs, and ZNF831: p.A49fs.

69. The pharmaceutical composition of any of paragraphs 30-36, wherein:
(a) the population of subjects is suffering from TGCT; and
(b) the at least one tumor-specific mutation comprises any combination of mutations selected from the group consisting of FAM18B2:p.C51Y, BTN2A3P:p.P3S, MUC2:p.G1715S, NBPF10:p.L44V, SP8:p.G156S, DCP1B:p.Q252H, DEK:p.E41D, ERC1:p.K692R, FAM104B:p.D75H, FRG1B:p.M49V, KRTAP10-10: p.V234M, LRRCC1:p.A6V, NRAS:p.Q61R, PNPLA4: p.L223P, ANKLE1:p.C644fs, ANKLE1:p.C644fs, KIT:p.D816H, KIT:p.D816Y, MUC2:p.T1597I, PSMD11:p.A5V, RHPN2:p.V73M, RUNX2:p.Q71E, SP4:p.E7K, TUBA1C:p.L146F, ZNF814:p.Y324H, ADAMTS17:p.N572T, ATRX:p.K1936R, BCL11B: p.E535D, BMP2K:p.Q460H, BMP2K:p.H487Q, C12orf32:p.D60V, C22orf43:p.K19E, CDC27: p.N571I, CDC27:p.P242S, DDX11:p.K208fs, EBPL: p.L189V, EZH2:p.K510R, FAM86A:p.A141T, GAS2L2:p.D189A, GRID2IP:p.LS754del, HGC6.3: p.E171G, KIT:p.D816V, KIT:p.N822Y, KIT:p.N822K, KRAS:p.Q61R, KRAS:p.G12V, KRTAP1-1:p.I116V, LRRC37BP1:p.Y166D, MEF2A:p.R127Q, MFF: p.S7F, MST1:p.R347W, MUC4:p.S3048L, MUC6: p.H2000Q, MUC6:p.P1977H, NAT10:p.I393T, OPLAH:p.A900D, PIEZO1:p.Q749E, PRAMEF4: p.F300V, RBM10:p.E184D, SERINC2:p.T121P, SPIN2A:p.M150V, SRRM2:p.A2257S, SSBP3:p.K6R, ZNF680:p.R501W, ABCC8:p.Y512C, ABCC9: p.L466P, ABCD1:p.H169Q, ABL2:p.P19T, ACVR2B: p.R48C, AHDC1:p.P33fs, AHNAK2:p.L1640M, ALPPL2:p.W31 S, AMMECR1:p.G77C, ANK3: p.D1322E, ANKHD1-EIF4EBP3:p.G60S, ANKRD11: p.Y2015S, ANKRD11:p.K369R, ANKRD50: p.V637M, APBB3:p.L450P, ARHGAP24:p.T35A, ARID4B:p.G1076A, ARMC3:p.A514T, ARRB2: p.T99P, ATAD5:p.I305V, ATXN3: p.305_306insQQQQQQQ, AVPR1B:p.G39R, AXDND1:p.E994Q, BAI2:p.A231G, BEST3:p.P383L, BIRC6:p.V414L, BIRC8:p.A225M, BRWD1: p.K1319R, BTN2A2:p.L15F, C12orf51:p.A2644T, C12orf65:p.K143T, C16orf62:p.L244I, C1QBP: p.T225I, C1orf167:p.S123G, C5orf25:p.Y4F, CACNA1E:p.G2080S, CAPNS1:p.LV303del, CCDC159:p.A332S, CDKAL1:p.P409L, CDYL: p.V48A, CDYL:p.A60G, CELSR2:p.L17P, CHD4: p.E138D, CKAP5:p.G576A, CLCC1:p.K52R, CMTM8:p.S26T, CNKSR2:p.P249L, CNTN5:p.I501T, COG5:p.H617R, COL15A1:p.K708R, COL6A3: p.A2378D, CRYGB:p.R143G, CSGALNACT2: p.L362F, CUL4A:p.I438F, CXXC1:p.Q156H, CYP19A1:p.F406L, DCLRE1B:p.F28I, DDX11: p.A376T, DDX11:p.E680D, DEPDC5:p.R1525Q, DLC1:p.S741T, DNMT1:p.R995Q, DOCK11: p.Q169E, DSPP:p.D1047N, E2F7:p.I91S, EBF1: p.D353G, ECI2:p.K55R, EEF1A2:p.Y418S, EIF3J: p.A8G, EML6:p.K805R, EPAS1:p.S474T, EPRS:

p.L1335I, ERICH1:p.E327K, FAM101B:p.L5P, FAM104A:p.M1R, FAM110D:p.R71H, FAM155A: p.Q95R, FAM186A:p.G1492E, FAM194B:p.Y139H, FAM21B:p.P1231S, FAM32A:p.K9R, FAM46B: p.H416R, FAM48B1:p.I499V, FAM48B1:p.A516P, FAM5C:p.S425W, FAM86C2P:p.C120Y, FBXL14: p.V48G, FRMPD3:p.Q832del, FRS2:p.L47S, GDF5: p.E105fs, GPNMB:p.C3fs, GPT2:p.R10P, H2AFV: p.Q125R, HDLBP:p.R503C, HERC2:p.R2129C, HIST1H2BJ:p.K13R, HLX:p.N231K, HMGB3: p.E198D, HSF4:p.R169W, HSF4:p.S491P, HYAL4: p.D222N, INO80E:p.P206fs, INTS4:p.S460A, IQCF6: p.R3H, ITPR1:p.M1569I, ITPR3:p.R1698G, KANSL3:p.G376E, KCNA4:p.E627del, KDM5A: p.P423S, KDM6A:p.Y362fs, KIAA0020:p.K63R, KIDINS220:p.N851 S, KIT:p.W557G, KLHDC2: p.W321S, KRAS:p.A146T, KRAS:p.Q61H, KRAS: p.Q61L, KRAS:p.G12A, KRAS:p.G12R, KRBA1: p.R839G, KRTAP4-8:p.T63S, L2HGDH:p.P441del, LAMC3:p.P174Q, LHCGR:p.L16Q, LOC401296: p.L144M, LPHN2:p.F906I, LRP12:p.G310C, LTB4R: p.F73L, LTBP3:p.L35del, LUC7L3:p.S148T, LYPD4: p.T64K, MAMLD1:p.Q572L, MAP4K2:p.R341G, MAPK7:p.A501D, MAT2A:p.E166G, MED12L: p.C1292Y, MESP2:p.Q182E, MEX3C:p.R534S, MIER2:p.L131F, MLL5:p.Y66C, MLLT3: p.177_178SS>S, MMS19:p.D1005N, MRPS25: p.E119del, MSH6:p.D576A, MTIF3:p.G65E, MUC17: p.M1807T, MUC17:p.T2279N, MUC17:p.G2474S, MUC2:p.TTPSPP1475del, MUC2:p.T1568M, MUC2: p.T1580N, MUC2:p.T1704I, MUC2:p.T1706M, MUC4:p.H1117D, MUC5B:p.R1097H, MYEF2: p.K323E, MYEOV:p.L302H, MYH8:p.A785V, MYO1A:p.N584K, NAP1L3:p.P353R, NAV1: p.I1433M, NCAM1:p.E131G, NEB:p.D3107N, NEFH:p.V670E, NELL2:p.G170D, NHS:p.D1561N, NKD2:p.H447del, NSD1:p.T461R, NT5C3:p.A3P, NYAP1:p.P480S, OBSCN:p.A908T, OR10J1: p.R244Q, OR1S2:p.M298I, OR2L3:p.K294R, OR6K6: p.F311L, PABPC3:p.V325fs, PBX2:p.Y262F, PCDHB4:p.P255F, PCMTD1:p.V281A, PCP4L1: p.K64R, PDE3A:p.A98E, PDIA6:p.N56K, PDS5A: p.L1309F, PHLDA2:p.R28S, PIGR:p.V183G, PIK3CA:p.E545K, PIK3CD:p.C381R, PKD1: p.T938M, PLEKHM1:p.A895V, PLEKHN1:p.A600D, PLXND1:p.R367L, PMS2:p.K651R, PNMA3: p.E200G, POTEF:p.S112G, PRAMEF8:p.I448V, PRDM2:p.E278D, PRODH:p.L527V, PRPF31: p.R289W, PSME4:p.N495D, PTGR1:p.E40A, PTPRB: p.Q726H, RABGEF1:p.N207D, RAC1:p.P34R, RANBP17:p.M900I, REV3L:p.A30S, RFC3:p.I82N, RFC3:p.K296N, RIMBP3:p.Q1154R, RPL19: p.R151C, RPL5:p.R58fs, RPTN:p.M538I, RRAD: p.A278E, RYR1:p.D668Y, RYR2:p.L2023F, SAFB: p.G799V, SCRIB:p.G332V, SDK1:p.Y2146C, SEC16A:p.T443K, SEC31B:p.P905S, SELO: p.R565Q, SELP:p.A297T, SI:p.I1681K, SLC2A7: p.H268Q, SLC37A1:p.V528I, SLC38A1:p.G100R, SMARCA2:p.D1158A, SMARCA5:p.T156fs, SMC3: p.E970Q, SMG1:p.P2696H, SNRNP200:p.A2129G, SPIN2B:p.M150V, ST6GALNAC1:p.S354N, STAMBPL1:p.Y143H, STARD8:p.G662A, STON1-GTF2A1L:p.N451S, SYMPK:p.A336G, TAS2R8: p.W98C, TCHH:p.W1016R, TET1:p.T1472S, TIAM1: p.G247M, TNS1:p.P183S, TOR1AIP2:p.G146R, TPRX1:p.S216P, TPRX1:p.S200P, TRMT61A: p.S244I, TSPAN4:p.L92V, TTF1:p.Q530R, UBE2M: p.G131D, UBR5:p.R2517S, UGT2B11:p.R447I, UMODL1:p.M559I, UNC93A:p.V445A, USP46: p.Q137R, VWA2:p.G317D, VWA7:p.V792G, WASH3P:p.L187V, WNT5B:p.K327E, WRN: p.E510D, XDH:p.P410S, ZAN:p.S755P, ZC3H11A: p.I777T, ZC3H7A:p.C575S, ZDHHC11:p.H250Q, ZFHX4:p.D3239N, ZKSCAN3:p.K200A, ZMYM4: p.T367I, ZNF174:p.P353T, ZNF322:p.Y353C, ZNF592:p.K324Q, ZNF592:p.P500T, ZNF782: p.C145F, ZNF799:p.C453R, ZNF804B:p.P644S, and ZNRF3:p.R889W.

70. The pharmaceutical composition of any of paragraphs 30-36, wherein:
(a) the population of subjects is suffering from THCA; and
(b) the at least one tumor-specific mutation comprises any combination of mutations selected from the group consisting of BRAF:p.V600E, NRAS:p.Q61R, HRAS: p.Q61R, NRAS:p.Q61K, OTUD4:p.T909I, HRAS: p.Q61K, NLRP6:p.E611G, AKT1:p.E17K, ANKMY1: p.N302I, ATP6V1A:p.L237P, CYP19A1:p.S113I, DCUN1D4:p.L275P, DGCR8:p.E518K, DLC1: p.S741T, DNAH10:p.C1853F, EIF1AX:p.G9D, FAM75D5:p.L222P, FCGRT:p.P40A, KRAS:p.Q61K, LMX1B:p.Q285del, MAS1L:p.R324G, MED15: p.S35I, MEGF6:p.Y393C, ODZ2:p.A1529V, OR5L1: p.R122H, OR6K6:p.F311L, OTX1:p.D315N, POTEE: p.S75G, SCN5A:p.D1978H, TOP2A:p.K1199E, and TSG101:p.K265R.

71. The pharmaceutical composition of any of paragraphs 30-36, wherein:
(a) the population of subjects is suffering from UCS; and
(b) the at least one tumor-specific mutation comprises any combination of mutations selected from the group consisting of TP53:p.R248Q, ZNF814:p.D404E, BTN2A3P:p.P3S, FBXW7:p.R465C, FRG1B:p.G65E, MUC4:p.H4205Q, NBPF10:p.V99F, PIK3CA: p.E545K, PIK3CA:p.H1047R, PPP2R1A:p.P179R, DDX11L2:p.*128Q, FBXW7:p.R479Q, FRG1B: p.K13N, FRG1B:p.L52S, HSD17B7P2:p.N175S, KRAS:p.G12V, LOC283788:p.S37G, TP53:p.R273H, TP53:p.S241Y, ADAMTS12:p.E359K, BCL2L11: p.L187fs, CDC27:p.L460fs, CHEK2:p.K373E, ESPNP:p.W122fs, FBXW7:p.R689W, FBXW7: p.R505G, FBXW7:p.R465H, FCGBP:p.V4019M, FRG1B:p.I10T, FRG1B:p.D32V, FRG1B:p.R37K, KRAS:p.G12D, LOC100233156:p.R21C, LOC283788:p.I46M, LRP1B:p.L1392F, MAMLD1: p.Q572L, MST1P9:p.L319P, MUC4:p.A2390T, MUC4:p.G2172S, NBPF10:p.E3455K, PIK3CA: p.G106V, PODXL:p.28_30PSP>P, POTEC:p.R477Q, PPP2R1A:p.R183W, PPP2R1A:p.S219L, PTPN18: p.TG378del, RGPD3:p.N756D, RPL13AP20: p.G107R, SAMD4B:p.R477W, SMAP1:p.E169fs, TP53:p.H193R, TP53:p.H179R, TP53:p.R175H, TUBBP5:p.R119H, and U2AF1:p.S34F.

72. The pharmaceutical composition of any of paragraphs 30-36, wherein:
(a) the population of subjects is suffering from PAAD; and
(b) the at least one tumor-specific mutation comprises any combination of mutations selected from the group consisting of RBM14:p.AAAAAAA286del, KRAS: p.G12D, JMY:p.PPPPPPPPPPPP811 del, RIOK1: p.D69del, LCE2A:p.SSGGCCGSSSGGCC47del, KRAS:p.G12V, C1QB:p.GPKGPMGPKGGPGAP GAP90del, ZFHX3:p.V777del, DBR1: p.541_542DD>D, AEBP1:p.K1133del, KRAS:

p.G12R, RBM47:p.495_502AAAAAAAA>A, AP3S1: p.K41fs, MLL2:p.AEGPHLSPQPEELHLSPQ792del, RFX1:p.386_401GGGGGGGGGGGGGSG>G, AXDND1:p.EQ991del, HERC2P3:p.A803V, RGPD3: p.N756D, FNDC1:p.D180del, ANAPC1:p.T537A, IRS4:p.21_22AA>A, GIGYF2:p.Q1005del, NCOA3: p.Q1253fs, SIK3:p.950_951QQ>Q, GPR6: p.AAAAATAAGGPDTGEWGPPA36del, NBPF12: p.D1323fs, SHROOM4:p.1156_1157EE>E, ZMIZ2: p.VAAAAATATATATAT153del, DGKK:p.PAPP41del, LZTS1:p.RTQDLEGALRTKGLEL432del, CASQ2: p.395_396DD>D, DCP1B:p.251_252insH, ESPNP: p.296_317PPPPSFPPPPPPPGTQLPPPPP>P, KBTBD6:p.T403K, NBPF16:p.D449fs, ANKRD36C: p.H438R, ESPN: p.PPPPPPSFPPPPPPPGTQLPP430del, FCGBP: p.A2493V, KRAS:p.Q61H, NCOA3:p.Q276del, OR2T2:p.C203fs, TMCC1:p.Q565L, BCKDHA: p.G129fs, ESPNP:p.H64fs, GNAS:p.R844H, NBPF14: p.R25C, OGFOD1:p.G477fs, RBM12:p.P693S, SLC38A10:p.1071_107211>I, SORBS2:p.P866S, TP53:p.R248W, TP53:p.R175H, and UBAC1: p.E269del.

73. The pharmaceutical composition of any of paragraphs 30-72, wherein the composition comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 neoantigenic peptides.

74. The pharmaceutical composition of paragraph 73, wherein the composition comprises 15 to 20 neoantigenic peptides.

75. The pharmaceutical composition of paragraphs 73 or 74, further comprising at least one additional neoantigenic peptide which is specific for an individual patient's tumor.

76. The pharmaceutical composition of paragraph 75, wherein the patient specific neoantigenic peptide is selected by identifying sequence differences between the genome, exome, and/or transcriptome of the patient's tumor sample and the genome, exome, and/or transcriptome of a non-tumor sample.

77. The pharmaceutical composition of paragraph 75, wherein the samples are fresh or formalin-fixed paraffin embedded tumor tissues, freshly isolated cells, or circulating tumor cells.

78. The pharmaceutical composition of paragraph 75, wherein the sequence differences are determined by Next Generation Sequencing.

79. The pharmaceutical composition of any of paragraphs 30-78, wherein each neoantigenic peptide is from about 5 to about 50 amino acids in length.

80. The pharmaceutical composition of paragraph 79, wherein each neoantigenic peptide is between about 15 to about 35 amino acids in length; is about 15 amino acids or less in length; is about 8 and about 11 amino acids in length; or is 9 or 10 amino acids in length.

81. The pharmaceutical composition of paragraph 79 or 80, wherein each neoantigenic peptide binds major histocompatibility complex (MHC) class I.

82. The pharmaceutical composition of any one of paragraphs 30-81, wherein each neoantigenic peptide binds to MHC class I with a binding affinity of less than about 500 nM, or optionally each neoantigenic peptide binds to HLA-A, -B or -C with a $K_D$ of less than 500 nM.

83. The pharmaceutical composition of paragraph 79, wherein each neoantigenic peptide is about 30 amino acids or less in length; is between about 6 and about 25 amino acids in length; is between about 15 and about 24 amino acids in length; or is between about 9 and about 15 amino acids in length.

84. The pharmaceutical composition of paragraph 79, 82 or 83, wherein each neoantigenic peptide binds major histocompatibility complex (MHC) class II.

85. The pharmaceutical composition of paragraph 84, wherein each neoantigenic peptide binds to MHC class I with a binding affinity of less than about 500 nM, or optionally each neoantigenic peptide binds to HLA-A, -B or -C with a $K_D$ of less than 500 nM.

86. The pharmaceutical composition of any of paragraphs 30-85, wherein at least one neoantigenic peptide further comprises flanking amino acids.

87. The pharmaceutical composition of paragraph 86, wherein the flanking amino acids are not native flanking amino acids.

88. The pharmaceutical composition of any of paragraphs 30-87, which at least one neoantigenic peptide is linked to at least a second neoantigenic peptide.

89. The pharmaceutical composition of paragraph 88, wherein peptides are linked using a poly-glycine or poly-serine linker.

90. The pharmaceutical composition of paragraph 88 or 89, wherein the second neoantigenic peptide binds MHC class I or class II with a binding affinity of less than about 1000 nM.

91. The pharmaceutical composition of any of paragraphs 88-90, wherein the second neoantigenic peptide binds MHC class I or class II with a binding affinity of less than about 500 nM.

92. The pharmaceutical composition of any of paragraphs 88-91, wherein both of the neoepitopes bind to human leukocyte antigen (HLA)-A, -B, -C, -DP, -DQ, or -DR.

93. The pharmaceutical composition of any of paragraphs 88-92, wherein the isolated neoantigenic peptide and the second neoantigenic peptide binds a class I HLA or the isolated neoantigenic peptide and the second neoantigenic peptide binds a class II HLA.

94. The pharmaceutical composition of any of paragraphs 88-92, wherein the isolated neoantigenic peptide binds a class II HLA and the second neoantigenic peptide binds a class I HLA or the isolated neoantigenic peptide binds a class I HLA and the second neoantigenic peptide binds a class II HLA.

95. The pharmaceutical composition of any of paragraphs 30-94, wherein at least one neoantigenic peptide further comprises modifications which increase in vivo half-life, cellular targeting, antigen uptake, antigen processing, MHC affinity, MHC stability, or antigen presentation.

96. The pharmaceutical composition of paragraph 95, wherein the modification is conjugation to a carrier protein, conjugation to a ligand, conjugation to an antibody, PEGylation, polysialylation HESylation, recombinant PEG mimetics, Fc fusion, albumin fusion, nanoparticle attachment, nanoparticulate encapsulation, cholesterol fusion, iron fusion, acylation, amidation, glycosylation, side chain oxidation, phosphorylation, biotinylation, the addition of a surface active material, the addition of amino acid mimetics, or the addition of unnatural amino acids.

97. The pharmaceutical composition of paragraph 95, wherein the cells that are targeted are antigen presenting cells.

98. The pharmaceutical composition of paragraph 97, wherein the antigen presenting cells are dendritic cells.

99. The pharmaceutical composition of paragraph 98, wherein the dendritic cells are targeted using DEC205, XCR1, CD197, CD80, CD86, CD123, CD209, CD273, CD283, CD289, CD184, CD85h, CD85j, CD85k, CD85d, CD85g, CD85a, CD141, CD11c, CD83, TSLP receptor, or CD1a marker.

100. The pharmaceutical composition of paragraph 99, wherein the dendritic cells are targeted using the CD141, DEC205, or XCR1 marker.

101. The pharmaceutical composition of any of paragraphs 30-100, which is an immunogenic or vaccine composition.

102. The pharmaceutical composition of paragraph 101, further comprising an immunomodulator or adjuvant.

103. The pharmaceutical composition of paragraph 102, wherein the immunodulator or adjuvant is selected from the group consisting of Poly(I:C), Poly-ICLC, STING agonist, 1018 ISS, aluminium salts, Amplivax, AS15, BCG, CP-870, 893, CpG7909, CyaA, dSLIM, GM-CSF, IC30, IC31, Imiquimod, ImuFact IMP321, IS Patch, ISS, ISCOMATRIX, JuvImmune, LipoVac, MF59, monophosphoryl lipid A, Montanide IMS 1312 VG, Montanide ISA 206 VG, Montanide ISA 50 V2, Montanide ISA 51 VG, OK-432, OM-174, OM-197-MP-EC, ISA-TLR2 agonist, ONTAK, PepTel®. vector system, PLG microparticles, resiquimod, SRL172, virosomes and other virus-like particles, YF-17D, VEGF trap, R848, beta-glucan, Pam3Cys, Pam3CSK4, acrylic or methacrylic polymers, copolymers of maleic anhydride, and QS21 stimulon.

104. An isolated polynucleotide encoding the isolated neoantigenic peptide of any of paragraphs 1-24.

105. The isolated polynucleotide of paragraph 104, which is RNA.

106. The isolated polynucleotide of paragraph 105, wherein the RNA is modified to increase stability, increase cellular targeting, increase translation efficiency, adjuvanticity, cytosol accessibility, and/or decrease cytotoxicity.

107. The isolated polynucleotide of paragraph 106, wherein the modification is conjugation to a carrier protein, conjugation to a ligand, conjugation to an antibody, codon optimization, increased GC-content, incorporation of modified nucleosides, incorporation of 5'-cap or cap analog, and/or incorporation of an unmasked poly-A sequence.

108. A cell comprising the polynucleotide of any of paragraphs 104-107.

109. A vector comprising the polynucleotide of any one of paragraphs 104-107.

110. The vector of paragraph 110, in which the polynucleotide is operably linked to a promoter.

111. The vector of paragraphs 109 or 110, which is a plasmid, phage, transposon, cosmid, virus, or virion.

112. The vector of paragraph 111, which is an adeno-associated virus, herpesvirus, lentivirus, or pseudotypes thereof.

113. An in vivo delivery system comprising the isolated polynucleotide of any of paragraphs 104-107.

114. The delivery system of paragraph 113, wherein the delivery system includes spherical nucleic acids, viruses, virus-like particles, plasmids, bacterial plasmids, or nanoparticles.

115. A cell comprising the vector or delivery system of any of paragraphs 109-114.

116. The cell of paragraph 115, which is an antigen presenting cell.

117. The cell of paragraph 116, which is a dendritic cell.

118. The cell of paragraph 117, which is an immature dendritic cell.

119. A composition comprising at least one polynucleotide of any of paragraphs 104-107.

120. The composition of paragraph 119, wherein the composition comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 of the isolated polynucleotides.

121. The composition of paragraph 120, wherein the composition comprises between about 2 and about 20 polynucleotides.

122. The composition of any one of paragraphs 119-121, wherein the composition further comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 additional neoantigenic polynucleotides encoding for additional neoantigenic peptides.

123. The composition of paragraph 122, wherein the composition comprises between about 4 and about 20 additional neoantigenic polynucleotides.

124. The composition of paragraph 122, wherein the isolated polynucleotides and the additional neoantigenic polynucleotides are linked.

125. The composition of paragraph 124, wherein the polynucleotides are linked using nucleic acids that encode a poly-glycine or poly-serine linker.

126. The composition of any of paragraphs 122-125, wherein at least one of the additional neoantigenic peptide is specific for an individual patient's tumor.

127. The composition of paragraph 126, wherein the patient specific neoantigenic peptide is selected by identifying sequence differences between the genome, exome, and/or transcriptome of the patient's tumor sample and the genome, exome, and/or transcriptome of a non-tumor sample.

128. The composition of paragraph 127, wherein the samples are fresh or formalin-fixed paraffin embedded tumor tissues, freshly isolated cells, or circulating tumor cells.

129. The composition of paragraphs 127 or 128, wherein the sequence differences are determined by Next Generation Sequencing.

130. A T cell receptor (TCR) capable of binding at least one neoantigenic peptide listed in any of paragraphs 1-27, optionally a neoantigenic peptide comprising FGFR3 S249C, ERBB3 V104M, EGFR L858R, MUC4 H4205Q, PDGFRA R483fs, TMEM52 23_26LLPL>L, or PODXL 28_30PSP>P.

131. The TCR of paragraph 130, which is capable of binding the isolated neoantigenic peptide in the context of MHC class I or class II.

132. A chimeric antigen receptor comprising: (i) a T cell activation molecule; (ii) a transmembrane region; and (iii) an antigen recognition moiety capable of binding an isolated neoantigenic peptide of any one of paragraphs 1-27.

133. The chimeric antigen receptor of paragraph 132, wherein CD3-zeta is the T cell activation molecule.

134. The chimeric antigen receptor of paragraph 132 or 133, further comprising at least one costimulatory signaling domain.

135. The chimeric antigen receptor of any of paragraphs 132-134, wherein the signaling domain is CD28, 4-1BB, ICOS, OX40, ITAM, or Fc epsilon RI-gamma.

136. The chimeric antigen receptor of any of paragraphs 132-135, wherein the antigen recognition moiety is capable of binding the isolated neoantigenic peptide in the context of MHC class I or class II.

137. The chimeric antigen receptor of any of paragraphs 132-136, comprising the CD3-zeta, CD28, CTLA-4, ICOS, BTLA, KIR, LAG3, CD137, OX40, CD27, CD40L, Tim-3, A2aR, or PD-1 transmembrane region.

138. The chimeric antigen receptor of any of paragraphs 132-137, wherein the tumor-specific epitope is located in the extracellular domain of a tumor associated polypeptide, optionally the tumor-specific epitope comprises FGFR3 S249C, ERBB3 V104M, EGFR L858R, MUC4 H4205Q, PDGFRA R483fs, TMEM52 23_26LLPL>L, or PODXL 28_30PSP>P.

139. A T cell comprising the T cell receptor or chimeric antigen receptor of any of paragraphs 130-138.

140. The T cell of paragraph 139, which is a helper or cytotoxic T cell.

141. A nucleic acid comprising a promoter operably linked to a polynucleotide encoding the T cell receptor of paragraph 130 or 131.

142. The nucleic acid of paragraph 141, wherein the TCR is capable of binding the at least one neoantigenic peptide in the context of major histocompatibility complex (MHC) class I or class II.

143. A nucleic acid comprising a promoter operably linked to a polynucleotide encoding the chimeric antigen receptor of any of paragraphs 132-138.

144. The nucleic acid of paragraph 143, wherein the antigen recognition moiety is capable of binding the at least one neoantigenic peptide in the context of major histocompatibility complex (MHC) class I or class II.

145. The nucleic acid of paragraphs 143 or 144, wherein the tumor-specific epitope is located in the extracellular domain of a tumor associated polypeptide.

146. The nucleic acid of any of paragraphs 143-145, comprising the CD3-zeta, CD28, CTLA-4, ICOS, BTLA, KIR, LAG3, CD137, OX40, CD27, CD40L, Tim-3, A2aR, or PD-1 transmembrane region.

147. An antibody capable of binding at least one neoantigenic peptide listed in Tables 1-9.

148. A modified cell transfected or transduced with the nucleic acid of any one of paragraphs 141-146.

149. The modified cell of paragraph 148, wherein the modified cell is a T cell, tumor infiltrating lymphocyte, NK-T cell, TCR-expressing cell, CD4+ T cell, CD8+ T cell, or NK cell.

150. A composition comprising the T cell receptor or chimeric antigen receptor of any of paragraphs 130-138.

151. A composition comprising autologous patient T cells containing the T cell receptor or chimeric antigen receptor of any of paragraphs 130-138.

152. The composition of paragraph 150 or 151, further comprising an immune checkpoint inhibitor.

153. The composition of paragraph 150 of 151, further comprising at least two immune checkpoint inhibitors.

154. The composition of paragraph 152 or 153, wherein the immune checkpoint inhibitor inhibits a checkpoint protein selected from the group consisting of CTLA-4, PDL1, PDL2, PD1, B7-H3, B7-H4, BTLA, HVEM, TIM3, GAL9, LAG3, VISTA, KIR, 2B4, CD160, CGEN-15049, CHK 1, CHK2, A2aR, and B-7 family ligands or a combination thereof.

155. The composition of paragraph 154, wherein the immune checkpoint inhibitor interacts with a ligand of a checkpoint protein selected from the group consisting of CTLA-4, PDL1, PDL2, PD1, B7-H3, B7-H4, BTLA, HVEM, TIM3, GAL9, LAG3, VISTA, KIR, 2B4, CD160, CGEN-15049, CHK 1, CHK2, A2aR, and B-7 family ligands or a combination thereof.

156. The composition of any of paragraphs 119-129 or 150-156, further comprising an immune modulator or adjuvant.

157. The composition of paragraph 156, wherein the immune modulator is a co-stimulatory ligand, a TNF ligand, an Ig superfamily ligand, CD28, CD80, CD86, ICOS, CD40L, OX40, CD27, GITR, CD30, DR3, CD69, or 4-1BB.

158. The composition of paragraph 156, wherein the immune modulator is at least one cancer cell or cancer cell extract.

159. The composition of paragraph 158, wherein the cancer cell is autologous to the subject in need of the composition.

160. The composition of paragraph 159, wherein the cancer cell has undergone lysis or been exposed to UV radiation.

161. The composition of paragraph 156, wherein the composition further comprises an adjuvant.

162. The composition of paragraph 161, wherein the adjuvant is selected from the group consisting of: Poly(I:C), Poly-ICLC, STING agonist, 1018 ISS, aluminium salts, Amplivax, AS15, BCG, CP-870,893, CpG7909, CyaA, dSLIM, GM-CSF, IC30, IC31, Imiquimod, ImuFact IMP321, IS Patch, ISS, ISCOMATRIX, Juvlmmune, LipoVac, MF59, monophosphoryl lipid A, Montanide IMS 1312 VG, Montanide ISA 206 VG, Montanide ISA 50 V2, Montanide ISA 51 VG, OK-432, OM-174, OM-197-MP-EC, ISA-TLR2 agonist, ONTAK, PepTel®. vector system, PLG microparticles, resiquimod, SRL172, virosomes and other virus-like particles, YF-17D, VEGF trap, R848, beta-glucan, Pam3Cys, Pam3CSK4, acrylic or methacrylic polymers, copolymers of maleic anhydride, and QS21 stimulon.

163. The composition of paragraph 161 or 162, wherein the adjuvant induces a humoral immune response when administered to a subject.

164. The composition of paragraph 162, wherein the adjuvant induces a T helper cell type I response when administered to a subject.

165. An in vivo delivery system comprising the pharmaceutical composition of any of paragraphs 30-103.

166. The delivery system of paragraph 165, wherein the delivery system includes cell-penetrating peptides, nanoparticulate encapsulation, virus like particles, or liposomes.

167. The delivery system of paragraph 166, wherein the cell-penetrating peptide is TAT peptide, herpes simplex virus VP22, transportan, or Antp.

168. A cell comprising the isolated neoantigenic peptide of any of paragraphs 1-29.

169. The cell of paragraph 168, which is an antigen presenting cell.

170. The cell of paragraph 169, which is a dendritic cell.

171. A method of treating cancer or initiating, enhancing, or prolonging an anti-tumor responses in a subject in need thereof comprising administering to the subject the peptide, polynucleotide, vector, composition, antibody, or cells of any of paragraphs 1-164.

172. A method of prophylactic cancer treatment comprising:
(a) selecting a cancer drug for a patient in need thereof, the drug selected from the group consisting of ibrutinib, erlotinib, imatinib, gefitinib, crizotinib, trastuzumab, vemurafenib, RAF/MEK inhibitors, and antiestrogen therapy, and (b) administering prophylactically to the subject, a pharmaceutical composition according to any of paragraphs 30-103 wherein the at least one neoantigenic peptide is derived from drug resistant mutations associated with the selected cancer drug.

173. A method of treating or preventing a tumor in a population of subjects in need thereof, comprising administering to a subject an agent comprising an extracellular ligand-binding domain recognizing a tumor-specific neoepitope comprising a tumor-specific mutation having an incidence of at least 1% of subjects in the population.

174. The method according to any of paragraphs 171-173, wherein the tumor-specific mutation comprises a mutation listed for any population in Table 9.

175. The method according to any of paragraphs 171-173, wherein the tumor-specific mutation is within a gene containing an extracellular domain.

176. The method according to paragraph 175, wherein the tumor-specific mutation comprises FGFR3 S249C, ERBB3 V104M, EGFR L858R, MUC4 H4205Q, PDGFRA R483fs, TMEM52 23_26LLPL>L, or PODXL 28_30PSP>P.

177. The method according to paragraph 176, wherein the tumor-specific mutation is within the extracellular domain.

178. The method according to paragraph 177, wherein the tumor-specific mutation comprises FGFR3 S249C or ERBB3 V104M.

179. The method of any of paragraph 171-178, wherein the subject is a human.

180. The method of paragraph 179, wherein the subject has cancer.

181. The method of paragraph 180, wherein the cancer is selected from the group consisting of urogenital, gynecological, lung, gastrointestinal, head and neck cancer, malignant glioblastoma, malignant mesothelioma, non-metastatic or metastatic breast cancer, malignant melanoma, Merkel Cell Carcinoma or bone and soft tissue sarcomas, haematologic neoplasias, multiple myeloma, acute myelogenous leukemia, chronic myelogenous leukemia, myelodysplastic syndrome and acute lymphoblastic leukemia, non-small cell lung cancer (NSCLC), breast cancer, metastatic colorectal cancers, hormone sensitive or hormone refractory prostate cancer, colorectal cancer, ovarian cancer, hepatocellular cancer, renal cell cancer, pancreatic cancer, gastric cancer, oesophageal cancers, hepatocellular cancers, cholangiocellular cancers, head and neck squamous cell cancer soft tissue sarcoma, and small cell lung cancer.

182. The method of any of paragraphs 171-181, wherein the subject has undergone surgical removal of the tumor.

183. The method of any of paragraphs 171-182, wherein the peptide, polynucleotide, vector, composition, or cells is administered via intravenous, intraperitoneal, intratumoral, intradermal, or subcutaneous administration.

184. The method of paragraph 183, wherein the peptide, polynucleotide, vector, composition, or cells is administered into an anatomic site that drains into a lymph node basin.

185. The method of paragraph 184, wherein administration is into multiple lymph node basins.

186. The method of any one of paragraphs 183-185, wherein administration is by a subcutaneous or intradermal route.

187. The method of paragraph 183, wherein peptide is administered.

188. The method of paragraph 187, wherein administration is intratumorally.

189. The method of paragraph 183, wherein polynucleotide, optionally RNA, is administered.

190. The method of paragraph 189, wherein the polynucleotide is administered intravenously.

191. The method of paragraph 183, wherein the cell is a T cell or dendritic cell.

192. The method of paragraph 191, wherein the peptide or polynucleotide comprises an antigen presenting cell targeting moiety.

193. The method of any of paragraphs 171-192, further comprising administering at least one immune checkpoint inhibitor to the subject.

194. The method of paragraph 193, wherein the checkpoint inhibitor is a biologic therapeutic or a small molecule.

195. The method of paragraph 193 or 194, wherein the checkpoint inhibitor is selected from the group consisting of a monoclonal antibody, a humanized antibody, a fully human antibody and a fusion protein or a combination thereof.

196. The method of any of paragraphs 193-195, wherein the checkpoint inhibitor inhibits a checkpoint protein selected from the group consisting of CTLA-4, PDL1, PDL2, PD1, B7-H3, B7-H4, BTLA, HVEM, TIM3, GAL9, LAG3, VISTA, KIR, 2B4, CD160, CGEN-15049, CHK 1, CHK2, A2aR, and B-7 family ligands or a combination thereof.

197. The method of any of paragraphs 193-196, wherein the checkpoint inhibitor interacts with a ligand of a checkpoint protein selected from the group consisting of CTLA-4, PDL1, PDL2, PD1, B7-H3, B7-H4, BTLA, HVEM, TIM3, GAL9, LAG3, VISTA, KIR, 2B4, CD160, CGEN-15049, CHK 1, CHK2, A2aR, and B-7 family ligands or a combination thereof.

198. The method of any of paragraphs 193-197, wherein two or more checkpoint inhibitors are administered.

199. The method of paragraph 198, wherein the checkpoint inhibitors are: (i) ipilimumab or tremelimumab, and (ii) nivolumab.

200. The method of any of paragraphs 193-199, wherein the checkpoint inhibitor and the composition are administered simultaneously or sequentially in any order.

201. The method of paragraph 200, wherein the peptide, polynucleotide, vector, composition, or cells is administered prior to the checkpoint inhibitor.

202. The method of paragraph 200, wherein the peptide, polynucleotide, vector, composition, or cells is administered after the checkpoint inhibitor.

203. The method of paragraph 200, wherein administration of the checkpoint inhibitor is continued throughout neoantigen peptide, polynucleotide, vector, composition, or cell therapy.

204. The method of any of paragraphs 193-203, wherein the neoantigen peptide, polynucleotide, vector, composition, or cell therapy is administered to subjects that only partially respond or do not respond to checkpoint inhibitor therapy.

205. The method of any one of paragraphs 193-204, wherein the checkpoint inhibitor is administered intravenously or subcutaneously.

206. The method of paragraph 205, wherein the checkpoint inhibitor is administered subcutaneously within about 2 cm of the site of administration of the composition.

207. The method of paragraph 206, wherein the composition is administered into the same draining lymph node as the checkpoint inhibitor.

208. The method of any of paragraphs 171-207, further comprising administering an additional therapeutic agent to the subject either prior to, simultaneously with, or after treatment with the peptide, polynucleotide, vector, composition, or cells.

209. The method of paragraph 208, wherein the additional agent is a chemotherapeutic agent, an immunomodulatory drug, an immune metabolism modifying drug, a targeted therapy, radiation an anti-angiogenesis agent, or an agent that reduces immune-suppression.

210. The method of paragraph 209, wherein the chemotherapeutic agent is an alkylating agent, a topoisomerase inhibitor, an anti-metabolite, or an anti-mitotic agent.

211. The method of paragraph 208, wherein the additional agent is an anti-glucocorticoid induced tumor necrosis factor family receptor (GITR) agonistic antibody or antibody fragment, ibrutinib, docetaxeol, cisplatin, or cyclophosphamide.

212. The method of any of paragraphs 171-211, which elicits a CD4+ T cell immune response.

213. The method of any of paragraphs 171-212, which elicits a CD4+ T cell immune response and a CD8+ T cell immune response.

214. A method for stimulating an immune response in a subject, comprising administering an effective amount of modified cells or composition of any of paragraphs 30-103, 108, 115-129, 139, 140, 148-164, and 168-170.

215. The method of paragraph 214, wherein the immune response is cytotoxic and/or humoral immune response.

216. The method of paragraph 214, wherein the method stimulates a T cell-mediated immune response in a subject.

217. The method of paragraph 216, wherein the T cell-mediated immune response is directed against a target cell.

218. The method of paragraph 217, wherein the target cell is a tumor cell.

219. The method of any of paragraphs 214-218, wherein the modified cells are transfected or transduced in vivo.

220. The method of any of paragraphs 214-219, wherein the modified cells are transfected or transduced ex vivo.

221. The method of any of paragraphs 214-220, wherein the modified cells are autologous patient T cells.

222. The method of paragraph 221, wherein the autologous patient T cells are obtained from a patient that has received a neoantigen peptide or nucleic acid vaccine.

223. The method of paragraph 222, wherein the neoantigen peptide or nucleic acid vaccine comprises at least one personalized neoantigen.

224. The method of paragraph 223, wherein the neoantigen peptide or nucleic acid vaccine comprises at least one additional neoantigenic peptide listed in Tables 1-9.

225. The method of paragraph 224, wherein the patient received a chemotherapeutic agent, an immunomodulatory drug, an immune metabolism modifying drug, targeted therapy or radiation prior to and/or during receipt of the neoantigen peptide or nucleic acid vaccine.

226. The method of any of paragraphs 222-225, wherein the patient receives treatment with at least one checkpoint inhibitor.

227. The method of any of paragraphs 222-226, wherein the autologous T cells are obtained from a patient that has already received at least one round of T cell therapy containing a neoantigen.

228. The method of any of paragraphs 222-227, wherein the method further comprises adoptive T cell therapy.

229. The method of paragraph 228, wherein the adoptive T cell therapy comprises autologous T-cells.

230. The method of paragraph 229, wherein the autologous T-cells are targeted against tumor antigens.

231. The method of paragraph 228 or 229 wherein the adoptive T cell therapy further comprises allogenic T-cells.

232. The method of paragraph 231, wherein the allogenic T-cells are targeted against tumor antigens.

233. The method of any of paragraphs 227-231, wherein the adoptive T cell therapy is administered before the checkpoint inhibitor.

234. A method for evaluating the efficacy of any of paragraphs 171-213, comprising: (i) measuring the number or concentration of target cells in a first sample obtained from the subject before administering the modified cell, (ii) measuring the number concentration of target cells in a second sample obtained from the subject after administration of the modified cell, and (iii) determining an increase or decrease of the number or concentration of target cells in the second sample compared to the number or concentration of target cells in the first sample.

235. The method of paragraph 234, wherein treatment efficacy is determined by monitoring a clinical outcome; an increase, enhancement or prolongation of anti-tumor activity by T cells; an increase in the number of anti-tumor T cells or activated T cells as compared with the number prior to treatment; B cell activity; CD4 T cell activity; or a combination thereof.

236. The method of paragraph 235, wherein treatment efficacy is determined by monitoring a biomarker.

237. The method of paragraph 236, wherein the biomarker is selected from the group consisting of CEA, Her-2/neu, bladder tumor antigen, thyroglobulin, alpha-fetoprotein, PSA, CA 125, CA19.9, CA 15.3, leptin, prolactin, osteopontin, IGF-II, CD98, fascin, sPIgR, 14-3-3 eta, troponin I, and b-type natriuretic peptide.

238. The method of paragraph 235, wherein clinical outcome is selected from the group consisting of tumor regression; tumor shrinkage; tumor necrosis; anti-tumor response by the immune system; tumor expansion, recurrence or spread; or a combination thereof.

239. The method of paragraph 235, wherein the treatment effect is predicted by presence of T cells or by presence of a gene signature indicating T cell inflammation or a combination thereof.

240. A kit comprising a neoantigen therapeutic of any of paragraphs 1-164.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. All rights to explicitly disclaim any embodiments that are the subject of any granted patent(s) of applicant in the lineage of this application or in any other lineage or in any prior filed application of any third party is explicitly reserved Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention. Nothing herein is intended as a promise.

These and other embodiments are disclosed or are obvious from and encompassed by, the following Detailed Description.

DETAILED DESCRIPTION OF THE INVENTION

To facilitate an understanding of the present invention, a number of terms and phrases are defined herein:

Unless specifically stated or obvious from context, as used herein, the term "about" is understood as within a range of normal tolerance in the art, for example within 2 standard deviations of the mean. About can be understood as within 50%, 45%, 40%, 35%, 30%, 25%, 20%, 15%, 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

Unless specifically stated or obvious from context, as used herein, the term "or" is understood to be inclusive. Unless specifically stated or obvious from context, as used herein, the terms "a," "an," and "the" are understood to be singular or plural.

All gene name symbols refer to the gene as commonly known in the art. Gene symbols may be those referred to by the HUGO Gene Nomenclature Committee (HGNC). Any reference to the gene symbol is a reference made to the entire gene or variants of the gene. The HUGO Gene Nomenclature Committee is responsible for providing human gene naming guidelines and approving new, unique human gene names and symbols. All human gene names and symbols can be searched at www.genenames.org, the HGNC website, and the guidelines for their formation are available there (www.genenames.org/guidelines).

By "agent" is meant any small molecule chemical compound, antibody, nucleic acid molecule, or polypeptide, or fragments thereof.

By "ameliorate" is meant decrease, suppress, attenuate, diminish, arrest, or stabilize the development or progression of a disease (e.g., a neoplasia, tumor, etc.).

By "alteration" is meant a change (increase or decrease) in the expression levels or activity of a gene or polypeptide as detected by standard art known methods such as those described herein. As used herein, an alteration includes a 10% change in expression levels, preferably a 25% change, more preferably a 40% change, and most preferably a 50% or greater change in expression levels.

By "analog" is meant a molecule that is not identical, but has analogous functional or structural features. For example, a tumor specific neo-antigen polypeptide analog retains the biological activity of a corresponding naturally-occurring tumor specific neo-antigen polypeptide, while having certain biochemical modifications that enhance the analog's function relative to a naturally-occurring polypeptide. Such biochemical modifications could increase the analog's protease resistance, membrane permeability, or half-life, without altering, for example, ligand binding. An analog may include an unnatural amino acid.

"Combination therapy" is intended to embrace administration of therapeutic agents (e.g. neoantigenic peptides described herein) in a sequential manner, that is, wherein each therapeutic agent is administered at a different time, as well as administration of these therapeutic agents, or at least two of the therapeutic agents, in a substantially simultaneous manner. Substantially simultaneous administration can be accomplished, for example, by administering to the subject a single capsule having a fixed ratio of each therapeutic agent or in multiple, single capsules for each of the therapeutic agents. For example, one combination of the present invention may comprise a pooled sample of neoantigenic peptides administered at the same or different times, or they can be formulated as a single, co-formulated pharmaceutical composition comprising the peptides. As another example, a combination of the present invention (e.g., a pooled sample of tumor specific neoantigens) may be formulated as separate pharmaceutical compositions that can be administered at the same or different time. As used herein, the term "simultaneously" is meant to refer to administration of one or more agents at the same time. For example, in certain embodiments, the neoantigenic peptides are administered simultaneously. Simultaneously includes administration contemporaneously, that is during the same period of time. In certain embodiments, the one or more agents are administered simultaneously in the same hour, or simultaneously in the same day. Sequential or substantially simultaneous administration of each therapeutic agent can be effected by any appropriate route including, but not limited to, oral routes, intravenous routes, sub-cutaneous routes, intramuscular routes, direct absorption through mucous membrane tissues (e.g., nasal, mouth, vaginal, and rectal), and ocular routes (e.g., intravitreal, intraocular, etc.). The therapeutic agents can be administered by the same route or by different routes. For example, one component of a particular combination may be administered by intravenous injection while the other component(s) of the combination may be administered orally. The components may be administered in any therapeutically effective sequence. The phrase "combination" embraces groups of compounds or non-drug therapies useful as part of a combination therapy.

The term "neoantigen" or "neoantigenic" means a class of tumor antigens that arises from a tumor-specific mutation(s) which alters the amino acid sequence of genome encoded proteins.

By "neoplasia" is meant any disease that is caused by or results in inappropriately high levels of cell division, inappropriately low levels of apoptosis, or both. For example, cancer is an example of a neoplasia. Examples of cancers include, without limitation, leukemia (e.g., acute leukemia, acute lymphocytic leukemia, acute myelocytic leukemia, acute myeloblastic leukemia, acute promyelocytic leukemia, acute myelomonocytic leukemia, acute monocytic leukemia, acute erythroleukemia, chronic leukemia, chronic myelocytic leukemia, chronic lymphocytic leukemia), polycythemia vera, lymphoma (e.g., Hodgkin's disease, non-Hodgkin's disease), Waldenstrom's macroglobulinemia, heavy chain disease, and solid tumors such as sarcomas and carcinomas (e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, nile duct carcinoma, choriocarcinoma, seminoma, embryonal carcinoma, Wilm's tumor, cervical cancer, uterine cancer, testicular cancer, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, schwannoma, meningioma, melanoma, neuroblastoma, and retinoblastoma). Lymphoproliferative disorders are also considered to be proliferative diseases.

The term "vaccine" is meant to refer in the present context to a pooled sample of tumor-specific neoantigenic peptides, for example at least two, at least three, at least four, at least five, or more neoantigenic peptides. A "vaccine" is to be understood as meaning a composition for generating immunity for the prophylaxis and/or treatment of diseases (e.g., neoplasia/tumor). Accordingly, vaccines are medicaments which comprise antigens and are intended to be used in humans or animals for generating specific defense and protective substance by vaccination. A "vaccine composition" can include a pharmaceutically acceptable excipient, carrier or diluent.

The term "pharmaceutically acceptable" refers to approved or approvable by a regulatory agency of the Federal or a state government or listed in the U.S. Pharmacopeia or other generally recognized pharmacopeia for use in animals, including humans.

A "pharmaceutically acceptable excipient, carrier or diluent" refers to an excipient, carrier or diluent that can be administered to a subject, together with an agent, and which does not destroy the pharmacological activity thereof and is nontoxic when administered in doses sufficient to deliver a therapeutic amount of the agent.

A "pharmaceutically acceptable salt" of pooled tumor specific neoantigens as recited herein may be an acid or base salt that is generally considered in the art to be suitable for use in contact with the tissues of human beings or animals without excessive toxicity, irritation, allergic response, or other problem or complication. Such salts include mineral and organic acid salts of basic residues such as amines, as well as alkali or organic salts of acidic residues such as carboxylic acids. Specific pharmaceutical salts include, but are not limited to, salts of acids such as hydrochloric, phosphoric, hydrobromic, malic, glycolic, fumaric, sulfuric, sulfamic, sulfanilic, formic, toluenesulfonic, methanesulfonic, benzene sulfonic, ethane disulfonic, 2-hydroxyethylsulfonic, nitric, benzoic, 2-acetoxybenzoic, citric, tartaric, lactic, stearic, salicylic, glutamic, ascorbic, pamoic, succinic, fumaric, maleic, propionic, hydroxymaleic, hydroiodic, phenylacetic, alkanoic such as acetic, HOOC—(CH2)n-COOH where n is 0-4, and the like. Similarly, pharmaceutically acceptable cations include, but are not limited to sodium, potassium, calcium, aluminum, lithium and ammonium. Those of ordinary skill in the art will recognize from this disclosure and the knowledge in the art that further pharmaceutically acceptable salts for the pooled tumor specific neoantigens provided herein, including those listed by Remington's Pharmaceutical Sciences, 17th ed., Mack Publishing Company, Easton, Pa., p. 1418 (1985). In general, a pharmaceutically acceptable acid or base salt can be synthesized from a parent compound that contains a basic or acidic moiety by any conventional chemical method. Briefly, such salts can be prepared by reacting the free acid or base forms of these compounds with a stoichiometric amount of the appropriate base or acid in an appropriate solvent.

By a "polypeptide" or "peptide" is meant a polypeptide that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide. An isolated polypeptide may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

As used herein, the terms "prevent," "preventing," "prevention," "prophylactic treatment," and the like, refer to reducing the probability of developing a disease or condition in a subject, who does not have, but is at risk of or susceptible to developing a disease or condition.

The term "prime/boost" or "prime/boost dosing regimen" is meant to refer to the successive administrations of a vaccine or immunogenic or immunological compositions. The priming administration (priming) is the administration of a first vaccine or immunogenic or immunological composition type and may comprise one, two or more administrations. The boost administration is the second administration of a vaccine or immunogenic or immunological composition type and may comprise one, two or more administrations, and, for instance, may comprise or consist essentially of annual administrations. In certain embodiments, administration of the neoplasia vaccine or immunogenic composition is in a prime/boost dosing regimen.

Ranges provided herein are understood to be shorthand for all of the values within the range. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50, as well as all intervening decimal values between the aforementioned integers such as, for example, 1.1, 1.2, 1.3, 1.4, 1.5, 1.6, 1.7, 1.8, and 1.9. With respect to sub-ranges, "nested sub-ranges" that extend from either end point of the range are specifically contemplated. For example, a nested sub-range of an exemplary range of 1 to 50 may comprise 1 to 10, 1 to 20, 1 to 30, and 1 to 40 in one direction, or 50 to 40, 50 to 30, 50 to 20, and 50 to 10 in the other direction.

A "receptor" is to be understood as meaning a biological molecule or a molecule grouping capable of binding a ligand. A receptor may serve, to transmit information in a cell, a cell formation or an organism. The receptor comprises at least one receptor unit and frequently contains two or more receptor units, where each receptor unit may consist of a protein molecule, in particular a glycoprotein molecule. The receptor has a structure that complements the structure of a ligand and may complex the ligand as a binding partner. Signaling information may be transmitted by conformational changes of the receptor following binding with the ligand on the surface of a cell. According to the invention, a receptor may refer to particular proteins of MHC classes I and II capable of forming a receptor/ligand complex with a ligand, in particular a peptide or peptide fragment of suitable length.

The term "subject" refers to an animal which is the object of treatment, observation, or experiment. By way of example only, a subject includes, but is not limited to, a mammal, including, but not limited to, a human or a non-human mammal, such as a non-human primate, bovine, equine, canine, ovine, or feline.

The terms "treat," "treated," "treating," "treatment," and the like are meant to refer to reducing or ameliorating a disorder and/or symptoms associated therewith (e.g., a neoplasia or tumor). "Treating" may refer to administration of the therapy to a subject after the onset, or suspected onset, of a cancer. "Treating" includes the concepts of "alleviating", which refers to lessening the frequency of occurrence or recurrence, or the severity, of any symptoms or other ill effects related to a cancer and/or the side effects associated with cancer therapy. The term "treating" also encompasses the concept of "managing" which refers to reducing the severity of a particular disease or disorder in a patient or delaying its recurrence, e.g., lengthening the period of remission in a patient who had suffered from the disease. It is appreciated that, although not precluded, treating a disorder or condition does not require that the disorder, condition, or symptoms associated therewith be completely eliminated.

The term "therapeutic effect" refers to some extent of relief of one or more of the symptoms of a disorder (e.g., a neoplasia or tumor) or its associated pathology. "Therapeutically effective amount" as used herein refers to an amount of an agent which is effective, upon single or multiple dose administration to the cell or subject, in prolonging the survivability of the patient with such a disorder, reducing one or more signs or symptoms of the disorder, preventing or delaying, and the like beyond that expected in the absence of such treatment. "Therapeutically effective amount" is intended to qualify the amount required to achieve a therapeutic effect. A physician or veterinarian having ordinary skill in the art can readily determine and prescribe the "therapeutically effective amount" (e.g., ED50) of the pharmaceutical composition required. For example, the physician or veterinarian could start doses of the compounds of the invention employed in a pharmaceutical composition at levels lower than that required in order to achieve the desired therapeutic effect and gradually increase the dosage until the desired effect is achieved.

The terms "spacer" or "linker" as used in reference to a fusion protein refers to a peptide that joins the proteins comprising a fusion protein. Generally, a spacer has no specific biological activity other than to join or to preserve some minimum distance or other spatial relationship between the proteins or RNA sequences. However, in certain embodiments, the constituent amino acids of a spacer may be selected to influence some property of the molecule such as the folding, net charge, or hydrophobicity of the molecule.

Suitable linkers for use in an embodiment of the present invention are well known to those of skill in the art and include, but are not limited to, straight or branched-chain carbon linkers, heterocyclic carbon linkers, or peptide linkers. The linker is used to separate two neoantigenic peptides by a distance sufficient to ensure that, in a preferred embodiment, each neoantigenic peptide properly folds. Preferred peptide linker sequences adopt a flexible extended conformation and do not exhibit a propensity for developing an ordered secondary structure. Typical amino acids in flexible protein regions include Gly, Asn and Ser. Virtually any permutation of amino acid sequences containing Gly, Asn and Ser would be expected to satisfy the above criteria for a linker sequence. Other near neutral amino acids, such as Thr and Ala, also may be used in the linker sequence. Still other amino acid sequences that may be used as linkers are disclosed in Maratea et al. (1985), Gene 40: 39-46; Murphy et al. (1986) Proc. Nat'l. Acad. Sci. USA 83: 8258-62; U.S. Pat. Nos. 4,935,233; and 4,751,180.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

The therapy disclosed herein constitutes a new method for treating various types of cancer. The therapy described herein also provides a method of therapy for achieving clinical benefit without an unacceptable level of side effects.

In one aspect the present invention relates to methods for the treatment of neoplasia, and more particularly tumors, by administering to a subject a vaccine or immunogenic composition comprising a plurality of tumor specific neoantigenic peptides. As described in more detail herein, in some embodiments the composition provides a specific, optimized subset of tumor-specific neoantigens suitable for the treatment of tumors in a high proportion of subjects suffering from cancer. In some embodiments, the tumor specific neoantigens may together bind to a high overall proportion of HLA allotypes present in the subject population.

The immune system can be classified into two functional subsystems: the innate and the acquired immune system. The innate immune system is the first line of defense against infections, and most potential pathogens are rapidly neutralized by this system before they can cause, for example, a noticeable infection. The acquired immune system reacts to molecular structures, referred to as antigens, of the intruding organism. There are two types of acquired immune reactions, which include the humoral immune reaction and the cell-mediated immune reaction. In the humoral immune reaction, antibodies secreted by B cells into bodily fluids bind to pathogen-derived antigens, leading to the elimination of the pathogen through a variety of mechanisms, e.g. complement-mediated lysis. In the cell-mediated immune reaction, T-cells capable of destroying other cells are activated. For example, if proteins associated with a disease are present in a cell, they are fragmented proteolytically to peptides within the cell. Specific cell proteins then attach themselves to the antigen or peptide formed in this manner and transport them to the surface of the cell, where they are presented to the molecular defense mechanisms, in particular T-cells, of the body. Cytotoxic T cells recognize these antigens and kill the cells that harbor the antigens.

The molecules that transport and present peptides on the cell surface are referred to as proteins of the major histocompatibility complex (MHC). MHC proteins are classified into two types, referred to as MHC class I and MHC class II. The structures of the proteins of the two MHC classes are very similar; however, they have very different functions. Proteins of MHC class I are present on the surface of almost all cells of the body, including most tumor cells. MHC class I proteins are loaded with antigens that usually originate from endogenous proteins or from pathogens present inside cells, and are then presented to naïve or cytotoxic T-lymphocytes (CTLs). MHC class II proteins are present on dendritic cells, B-lymphocytes, macrophages and other antigen-presenting cells. They mainly present peptides, which are processed from external antigen sources, i.e. outside of the cells, to T-helper (Th) cells. Most of the peptides bound by the MHC class I proteins originate from cytoplasmic proteins produced in the healthy host cells of an organism itself, and do not normally stimulate an immune reaction. Accordingly, cytotoxic T-lymphocytes that recognize such self-peptide-presenting MHC molecules of class I are deleted in the thymus (central tolerance) or, after their release from the thymus, are deleted or inactivated, i.e. tolerized (peripheral tolerance). MHC molecules are capable of stimulating an immune reaction when they present peptides to non-tolerized T-lymphocytes. Cytotoxic T-lymphocytes have both T-cell receptors (TCR) and CD8 molecules on their surface. T-Cell receptors are capable of recognizing and binding peptides complexed with the molecules of MHC class I. Each cytotoxic T-lymphocyte expresses a unique T-cell receptor which is capable of binding specific MHC/peptide complexes.

The peptide antigens attach themselves to the molecules of MHC class I by competitive affinity binding within the endoplasmic reticulum, before they are presented on the cell surface. Here, the affinity of an individual peptide antigen is directly linked to its amino acid sequence and the presence of specific binding motifs in defined positions within the amino acid sequence. If the sequence of such a peptide is known, it is possible to manipulate the immune system against diseased cells using, for example, peptide vaccines.

One of the critical barriers to developing curative and tumor-specific immunotherapy is the identification and selection of highly specific and restricted tumor antigens to avoid autoimmunity. Tumor neoantigens, which arise as a result of genetic change (e.g., inversions, translocations, deletions, missense mutations, splice site mutations, etc.) within malignant cells, represent the most tumor-specific class of antigens. Neoantigens have rarely been used in cancer vaccine or immunogenic compositions due to technical difficulties in identifying them, selecting optimized neoantigens, and producing neoantigens for use in a vaccine or immunogenic composition. These problems may be addressed by:

identifying mutations in neoplasias/tumors which are present at the DNA level in tumor but not in matched germline samples from a high proportion of subjects having cancer;

analyzing the identified mutations with one or more peptide-MHC binding prediction algorithms to generate a plurality of neoantigen T cell epitopes that are expressed within the neoplasia/tumor and that bind to a high proportion of patient HLA alleles; and synthesizing the plurality of neoantigenic peptides selected from the sets of all neoantigen peptides and predicted binding peptides for use in a cancer vaccine or immunogenic composition suitable for treating a high proportion of subjects having cancer.

For example, translating sequencing information into a therapeutic vaccine may include:

(1) Prediction of mutated peptides that can bind to HLA molecules of a high proportion of individuals. Efficiently choosing which particular mutations to utilize as immunogen requires the ability to predict which mutated peptides would efficiently bind to a high proportion of patient's HLA alleles. Recently, neural network based learning approaches with validated binding and non-binding peptides have advanced the accuracy of prediction algorithms for the major HLA-A and -B alleles.

(2) Formulating the drug as a multi-epitope vaccine of long peptides. Targeting as many mutated epitopes as practically possible takes advantage of the enormous capacity of the immune system, prevents the opportunity for immunological escape by down-modulation of a particular immune targeted gene product, and compensates for the known inaccuracy of epitope prediction approaches. Synthetic peptides provide a particularly useful means to prepare multiple immunogens efficiently and to rapidly translate identification of mutant epitopes to an effective vaccine. Peptides can be readily synthesized chemically and easily purified utilizing reagents free of contaminating bacteria or animal substances. The small size allows a clear focus on the mutated region of the protein and also reduces irrelevant antigenic competition from other components (unmutated protein or viral vector antigens).

(3) Combination with a strong vaccine adjuvant. Effective vaccines require a strong adjuvant to initiate an immune response. As described below, poly-ICLC, an agonist of TLR3 and the RNA helicase-domains of MDA5 and RIG3, has shown several desirable properties for a vaccine adjuvant. These properties include the induction of local and systemic activation of immune cells in vivo, production of stimulatory chemokines and cytokines, and stimulation of antigen-presentation by DCs. Furthermore, poly-ICLC can induce durable CD4+ and CD8+ responses in humans. Importantly, striking similarities in the upregulation of transcriptional and signal transduction pathways were seen in subjects vaccinated with poly-ICLC and in volunteers who had received the highly effective, replication-competent yellow fever vaccine. Furthermore, >90% of ovarian carcinoma patients immunized with poly-ICLC in combination with a NYES0-1 peptide vaccine (in addition to Montanide) showed induction of CD4+ and CD8+ T cell, as well as antibody responses to the peptide in a recent phase 1 study. At the same time, polyICLC has been extensively tested in more than 25 clinical trials to date and exhibited a relatively benign toxicity profile.

The above-described advantages of the invention are described further herein.

As described herein, there is a large body of evidence in both animals and humans that mutated epitopes are effective in inducing an immune response and that cases of spontaneous tumor regression or long term survival correlate with CD8+ T-cell responses to mutated epitopes (Buckwalter and Srivastava P K. "It is the antigen(s), stupid" and other lessons from over a decade of vaccitherapy of human cancer. Seminars in immunology 20:296-300 (2008); Karanikas et al, High frequency of cytolytic T lymphocytes directed against a tumor-specific mutated antigen detectable with HLA tetramers in the blood of a lung carcinoma patient with long survival. Cancer Res. 61:3718-3724 (2001); Lennerz et al, The response of autologous T cells to a human melanoma is dominated by mutated neoantigens. Proc Natl Acad Sci USA. 102:16013 (2005)) and that "immunoediting" can be tracked to alterations in expression of dominant mutated antigens in mice and man (Matsushita et al, Cancer exome analysis reveals a T-cell-dependent mechanism of cancer immunoediting Nature 482:400 (2012); DuPage et al, Expression of tumor-specific antigens underlies cancer immunoediting Nature 482:405 (2012); and Sampson et al, Immunologic escape after prolonged progression-free survival with epidermal growth factor receptor variant III peptide vaccination in patients with newly diagnosed glioblastoma J Clin Oncol. 28:4722-4729 (2010)).

Sequencing technology has revealed that each tumor contains multiple, patient-specific mutations that alter the protein coding content of a gene. Such mutations create altered proteins, ranging from single amino acid changes (caused by missense mutations) to addition of long regions of novel amino acid sequence due to frame shifts, read-through of termination codons or translation of intron regions (novel open reading frame mutations; neoORFs). These mutated proteins are valuable targets for the host's immune response to the tumor as, unlike native proteins, they are not subject to the immune-dampening effects of self-tolerance. Therefore, mutated proteins are more likely to be immunogenic and are also more specific for the tumor cells compared to normal cells of the patient.

In one embodiment, the neoantigenic peptides in the composition together have affinity to a plurality of MHC molecules, e.g. which together cover a large proportion of the target population. Efficiently choosing which particular mutations to utilize as immunogen requires the ability to predict which mutated peptides would efficiently bind to the HLA alleles present in the patient population. Recently, neural network based learning approaches with validated binding and non-binding peptides have advanced the accuracy of prediction algorithms for the major HLA-A and -B alleles. Utilizing the recently improved algorithms for predicting which missense mutations create strong binding peptides to cognate MHC molecules, a set of peptides representative of optimal mutated epitopes (both neoORF and missense) for the patient population may be identified and prioritized (Zhang et al, Machine learning competition in immunology—Prediction of HLA class I binding peptides J Immunol Methods 374:1 (2011); Lundegaard et al Prediction of epitopes using neural network based methods J Immunol Methods 374:26 (2011)).

Targeting as many mutated epitopes as practically possible takes advantage of the enormous capacity of the immune system, prevents the opportunity for immunological escape by down-modulation of a particular immune targeted gene product, and compensates for the known inaccuracy of epitope prediction approaches. Synthetic peptides provide a particularly useful means to prepare multiple immunogens efficiently and to rapidly translate identification of mutant epitopes to an effective vaccine or immunogenic composition. Peptides can be readily synthesized chemically and easily purified utilizing reagents free of contaminating bacteria or animal substances. The small size allows a clear focus on the mutated region of the protein and also reduces irrelevant antigenic competition from other components (unmutated protein or viral vector antigens).

In one embodiment the drug formulation is a multi-epitope vaccine or immunogenic composition of long peptides. Such "long" peptides undergo efficient internalization, processing and cross-presentation in professional antigen-presenting cells such as dendritic cells, and have been shown to induce CTLs in humans (Melief and van der Burg, Immunotherapy of established (pre) malignant disease by synthetic long peptide vaccines Nature Rev Cancer 8:351 (2008)). In one embodiment at least 2 peptides are prepared for immunization. In some embodiments 20 or more peptides are prepared for immunization. In one embodiment the neoantigenic peptide ranges from about 5 to about 50 amino acids in length. In another embodiment peptides from about 15 to about 35 amino acids in length is synthesized. In preferred embodiment the neoantigenic peptide ranges from about 20 to about 35 amino acids in length.

Production of Tumor Specific Neoantigens

The present invention is based, at least in part, on the ability to present the immune system of the patient with a pool of tumor specific neoantigens. One of skill in the art from this disclosure and the knowledge in the art will appreciate that there are a variety of ways in which to produce such tumor specific neoantigens. In general, such tumor specific neoantigens may be produced either in vitro or in vivo. Tumor specific neoantigens may be produced in vitro as peptides or polypeptides, which may then be formulated into a neoplasia vaccine or immunogenic composition and administered to a subject. As described in further detail herein, such in vitro production may occur by a variety of methods known to one of skill in the art such as, for example, peptide synthesis or expression of a peptide/polypeptide from a DNA or RNA molecule in any of a variety of bacterial, eukaryotic, or viral recombinant expression systems, followed by purification of the expressed peptide/polypeptide. Alternatively, tumor specific neoantigens may be produced in vivo by introducing molecules (e.g., DNA, RNA, viral expression systems, and the like) that encode tumor specific neoantigens into a subject, whereupon the encoded tumor specific neoantigens are expressed. The methods of in vitro and in vivo production of neoantigens is also further described herein as it relates to pharmaceutical compositions and methods of delivery of the therapy.

In certain embodiments the present invention includes modified neoantigenic peptides. As used herein in reference to neoantigenic peptides, the terms "modified", "modification" and the like refer to one or more changes that enhance a desired property of the neoantigenic peptide, where the change does not alter the primary amino acid sequence of the neoantigenic peptide. "Modification" includes a covalent chemical modification that does not alter the primary amino acid sequence of the neoantigenic peptide itself. Such desired properties include, for example, prolonging the in vivo half-life, increasing the stability, reducing the clearance, altering the immunogenicity or allergenicity, enabling the raising of particular antibodies, cellular targeting, antigen uptake, antigen processing, MHC affinity, MHC stability, or antigen presentation. Changes to a neoantigenic peptide that may be carried out include, but are not limited to, conjugation to a carrier protein, conjugation to a ligand, conjugation to an antibody, PEGylation, polysialylation HESylation, recombinant PEG mimetics, Fc fusion, albumin fusion, nanoparticle attachment, nanoparticulate encapsulation, cholesterol fusion, iron fusion, acylation, amidation, glycosylation, side chain oxidation, phosphorylation, biotinylation, the addition of a surface active material, the addition of amino acid mimetics, or the addition of unnatural amino acids.

The clinical effectiveness of protein therapeutics is often limited by short plasma half-life and susceptibility to protease degradation. Studies of various therapeutic proteins (e.g., filgrastim) have shown that such difficulties may be overcome by various modifications, including conjugating or linking the polypeptide sequence to any of a variety of non-proteinaceous polymers, e.g., polyethylene glycol (PEG), polypropylene glycol, or polyoxyalkylenes (see, for example, typically via a linking moiety covalently bound to both the protein and the nonproteinaceous polymer, e.g., a PEG). Such PEG-conjugated biomolecules have been shown to possess clinically useful properties, including better physical and thermal stability, protection against susceptibility to enzymatic degradation, increased solubility, longer in vivo circulating half-life and decreased clearance, reduced immunogenicity and antigenicity, and reduced toxicity.

PEGs suitable for conjugation to a polypeptide sequence are generally soluble in water at room temperature, and have the general formula $R(0\text{-}CH_2\text{—}CH_2)_nO\text{—}R$, where R is hydrogen or a protective group such as an alkyl or an alkanol group, and where n is an integer from 1 to 1000. When R is a protective group, it generally has from 1 to 8 carbons. The PEG conjugated to the polypeptide sequence can be linear or branched. Branched PEG derivatives, "star-PEGs" and multi-armed PEGs are contemplated by the present disclosure. A molecular weight of the PEG used in the present disclosure is not restricted to any particular range, but certain embodiments have a molecular weight between 500 and 20,000 while other embodiments have a molecular weight between 4,000 and 10,000.

The present disclosure also contemplates compositions of conjugates wherein the PEGs have different n values and thus the various different PEGs are present in specific ratios. For example, some compositions comprise a mixture of conjugates where n=1, 2, 3 and 4. In some compositions, the percentage of conjugates where n=1 is 18-25%, the percentage of conjugates where n=2 is 50-66%, the percentage of conjugates where n=3 is 12-16%, and the percentage of conjugates where n=4 is up to 5%. Such compositions can be produced by reaction conditions and purification methods know in the art. For example, cation exchange chromatography may be used to separate conjugates, and a fraction is then identified which contains the conjugate having, for example, the desired number of PEGs attached, purified free from unmodified protein sequences and from conjugates having other numbers of PEGs attached.

PEG may be bound to a polypeptide of the present disclosure via a terminal reactive group (a "spacer"). The spacer is, for example, a terminal reactive group which mediates a bond between the free amino or carboxyl groups of one or more of the polypeptide sequences and polyethylene glycol. The PEG having the spacer which may be bound to the free amino group includes N-hydroxysuccinylimide polyethylene glycol which may be prepared by activating succinic acid ester of polyethylene glycol with N-hydroxy succinylimide. Another activated polyethylene glycol which may be bound to a free amino group is 2,4-bis(O-methoxypolyethyleneglycol)-6-chloro-s-triazine which may be prepared by reacting polyethylene glycol monomethyl ether with cyanuric chloride. The activated polyethylene glycol which is bound to the free carboxyl group includes polyoxyethylenediamine.

Conjugation of one or more of the polypeptide sequences of the present disclosure to PEG having a spacer may be carried out by various conventional methods. For example, the conjugation reaction can be carried out in solution at a pH of from 5 to 10, at temperature from 4° C. to room temperature, for 30 minutes to 20 hours, utilizing a molar ratio of reagent to protein of from 4:1 to 30:1. Reaction conditions may be selected to direct the reaction towards producing predominantly a desired degree of substitution. In general, low temperature, low pH (e.g., pH=5), and short reaction time tend to decrease the number of PEGs attached, whereas high temperature, neutral to high pH (e.g., pH>7), and longer reaction time tend to increase the number of PEGs attached. Various means known in the art may be used to terminate the reaction. In some embodiments the reaction is terminated by acidifying the reaction mixture and freezing at, e.g., −20° C.

The present disclosure also contemplates the use of PEG Mimetics. Recombinant PEG mimetics have been developed that retain the attributes of PEG (e.g., enhanced serum half-life) while conferring several additional advantageous properties. By way of example, simple polypeptide chains (comprising, for example, Ala, Glu, Gly, Pro, Ser and Thr) capable of forming an extended conformation similar to PEG can be produced recombinantly already fused to the peptide or protein drug of interest (e.g., Amunix' XTEN technology; Mountain View, Calif.). This obviates the need for an additional conjugation step during the manufacturing process. Moreover, established molecular biology techniques enable control of the side chain composition of the polypeptide chains, allowing optimization of immunogenicity and manufacturing properties.

For purposes of the present disclosure, "glycosylation" is meant to broadly refer to the enzymatic process that attaches glycans to proteins, lipids or other organic molecules. The use of the term "glycosylation" in conjunction with the present disclosure is generally intended to mean adding or deleting one or more carbohydrate moieties (either by removing the underlying glycosylation site or by deleting the glycosylation by chemical and/or enzymatic means), and/or adding one or more glycosylation sites that may or may not be present in the native sequence. In addition, the phrase includes qualitative changes in the glycosylation of the native proteins involving a change in the nature and proportions of the various carbohydrate moieties present. Glycosylation can dramatically affect the physical properties of proteins and can also be important in protein stability, secretion, and subcellular localization. Proper glycosylation can be essential for biological activity. In fact, some genes from eucaryotic organisms, when expressed in bacteria (e.g., *E. coli*) which lack cellular processes for glycosylating proteins, yield proteins that are recovered with little or no activity by virtue of their lack of glycosylation.

Addition of glycosylation sites can be accomplished by altering the amino acid sequence. The alteration to the polypeptide may be made, for example, by the addition of, or substitution by, one or more serine or threonine residues (for O-linked glycosylation sites) or asparagine residues (for N-linked glycosylation sites). The structures of N-linked and O-linked oligosaccharides and the sugar residues found in each type may be different. One type of sugar that is commonly found on both is N-acetylneuraminic acid (hereafter referred to as sialic acid). Sialic acid is usually the terminal residue of both N-linked and O-linked oligosaccharides and, by virtue of its negative charge, may confer acidic properties to the glycoprotein. A particular embodiment of the present disclosure comprises the generation and use of N-glycosylation variants.

The polypeptide sequences of the present disclosure may optionally be altered through changes at the DNA level, particularly by mutating the DNA encoding the polypeptide at preselected bases such that codons are generated that will translate into the desired amino acids. Another means of increasing the number of carbohydrate moieties on the polypeptide is by chemical or enzymatic coupling of glycosides to the polypeptide.

Removal of carbohydrates may be accomplished chemically or enzymatically, or by substitution of codons encoding amino acid residues that are glycosylated. Chemical deglycosylation techniques are known, and enzymatic cleavage of carbohydrate moieties on polypeptides can be achieved by the use of a variety of endo- and exo-glycosidases.

Dihydrofolate reductase (DHFR)—deficient Chinese Hamster Ovary (CHO) cells are a commonly used host cell for the production of recombinant glycoproteins. These cells do not express the enzyme beta-galactoside alpha-2,6-sialyltransferase and therefore do not add sialic acid in the alpha-2,6 linkage to N-linked oligosaccharides of glycoproteins produced in these cells.

The present disclosure also contemplates the use of polysialylation, the conjugation of peptides and proteins to the naturally occurring, biodegradable a-(2-8) linked polysialic acid ("PSA") in order to improve their stability and in vivo pharmacokinetics. PSA is a biodegradable, non-toxic natural polymer that is highly hydrophilic, giving it a high apparent molecular weight in the blood which increases its serum half-life. In addition, polysialylation of a range of peptide and protein therapeutics has led to markedly reduced proteolysis, retention of activity in vivo activity, and reduction in immunogenicity and antigenicity (see, e.g., G. Gregoriadis et al., Int. J. Pharmaceutics 300(1-2): 125-30). As with modifications with other conjugates (e.g., PEG), various techniques for site-specific polysialylation are available (see, e.g., T. Lindhout et al., PNAS 108(18)7397-7402 (2011)).

Additional suitable components and molecules for conjugation include, for example, thyroglobulin; albumins such as human serum albumin (HAS); tetanus toxoid; Diphtheria toxoid; polyamino acids such as poly(D-lysine:D-glutamic acid): VP6 polypeptides of rotaviruses; influenza virus hemaglutinin, influenza virus nucleoprotein; Keyhole Limpet Hemocyanin (KLH); and hepatitis B virus core protein and surface antigen; or any combination of the foregoing.

Fusion of albumin to one or more polypeptides of the present disclosure can, for example, be achieved by genetic manipulation, such that the DNA coding for HSA, or a fragment thereof, is joined to the DNA coding for the one or more polypeptide sequences. Thereafter, a suitable host can be transformed or transfected with the fused nucleotide sequences in the form of, for example, a suitable plasmid, so as to express a fusion polypeptide. The expression may be effected in vitro from, for example, prokaryotic or eukaryotic cells, or in vivo from, for example, a transgenic organism. In some embodiments of the present disclosure, the expression of the fusion protein is performed in mammalian cell lines, for example, CHO cell lines. Transformation is used broadly herein to refer to the genetic alteration of a cell resulting from the direct uptake, incorporation and expression of exogenous genetic material (exogenous DNA) from its surroundings and taken up through the cell membrane(s). Transformation occurs naturally in some species of bacteria, but it can also be effected by artificial means in other cells.

Furthermore, albumin itself may be modified to extend its circulating half-life. Fusion of the modified albumin to one or more Polypeptides can be attained by the genetic manipulation techniques described above or by chemical conjugation; the resulting fusion molecule has a half-life that exceeds that of fusions with non-modified albumin. (See WO2011/051489).

Several albumin-binding strategies have been developed as alternatives for direct fusion, including albumin binding through a conjugated fatty acid chain (acylation). Because serum albumin is a transport protein for fatty acids, these natural ligands with albumin-binding activity have been used for half-life extension of small protein therapeutics. For example, insulin determir (LEVEMIR), an approved product for diabetes, comprises a myristyl chain conjugated to a genetically-modified insulin, resulting in a long-acting insulin analog.

Another type of modification is to conjugate (e.g., link) one or more additional components or molecules at the N- and/or C-terminus of a polypeptide sequence, such as another protein (e.g., a protein having an amino acid sequence heterologous to the subject protein), or a carrier molecule. Thus, an exemplary polypeptide sequence can be provided as a conjugate with another component or molecule.

A conjugate modification may result in a polypeptide sequence that retains activity with an additional or complementary function or activity of the second molecule. For example, a polypeptide sequence may be conjugated to a molecule, e.g., to facilitate solubility, storage, in vivo or shelf half-life or stability, reduction in immunogenicity, delayed or controlled release in vivo, etc. Other functions or activities include a conjugate that reduces toxicity relative to an unconjugated polypeptide sequence, a conjugate that targets a type of cell or organ more efficiently than an unconjugated polypeptide sequence, or a drug to further counter the causes or effects associated with a disorder or disease as set forth herein (e.g., diabetes).

A Polypeptide may also be conjugated to large, slowly metabolized macromolecules such as proteins; polysaccharides, such as sepharose, agarose, cellulose, cellulose beads; polymeric amino acids such as polyglutamic acid, polylysine; amino acid copolymers; inactivated virus particles; inactivated bacterial toxins such as toxoid from diphtheria, tetanus, cholera, leukotoxin molecules; inactivated bacteria; and dendritic cells.

Additional candidate components and molecules for conjugation include those suitable for isolation or purification. Particular non-limiting examples include binding molecules, such as biotin (biotin-avidin specific binding pair), an antibody, a receptor, a ligand, a lectin, or molecules that comprise a solid support, including, for example, plastic or polystyrene beads, plates or beads, magnetic beads, test strips, and membranes.

Purification methods such as cation exchange chromatography may be used to separate conjugates by charge difference, which effectively separates conjugates into their various molecular weights. For example, the cation exchange column can be loaded and then washed with ~20 mM sodium acetate, pH ~4, and then eluted with a linear (0 M to 0.5 M) NaCl gradient buffered at a pH from about 3 to 5.5, e.g., at pH ~4.5. The content of the fractions obtained by cation exchange chromatography may be identified by molecular weight using conventional methods, for example, mass spectroscopy, SDS-PAGE, or other known methods for separating molecular entities by molecular weight.

In certain embodiments, the amino- or carboxyl-terminus of a polypeptide sequence of the present disclosure can be fused with an immunoglobulin Fc region (e.g., human Fc) to form a fusion conjugate (or fusion molecule). Fc fusion conjugates have been shown to increase the systemic half-life of biopharmaceuticals, and thus the biopharmaceutical product may require less frequent administration.

Fc binds to the neonatal Fc receptor (FcRn) in endothelial cells that line the blood vessels, and, upon binding, the Fc fusion molecule is protected from degradation and re-released into the circulation, keeping the molecule in circulation longer. This Fc binding is believed to be the mechanism by which endogenous IgG retains its long plasma half-life. More recent Fc-fusion technology links a single copy of a biopharmaceutical to the Fc region of an antibody to optimize the pharmacokinetic and pharmacodynamic properties of the biopharmaceutical as compared to traditional Fc-fusion conjugates.

The present disclosure contemplates the use of other modifications, currently known or developed in the future, of the Polypeptides to improve one or more properties. One such method for prolonging the circulation half-life, increasing the stability, reducing the clearance, or altering the immunogenicity or allergenicity of a polypeptide of the present disclosure involves modification of the polypeptide sequences by hesylation, which utilizes hydroxyethyl starch derivatives linked to other molecules in order to modify the molecule's characteristics. Various aspects of hesylation are described in, for example, U.S. Patent Appln. Nos. 2007/0134197 and 2006/0258607.

In Vitro Peptide/Polypeptide Synthesis

Proteins or peptides may be made by any technique known to those of skill in the art, including the expression of proteins, polypeptides or peptides through standard molecular biological techniques, the isolation of proteins or peptides from natural sources, in vitro translation, or the chemical synthesis of proteins or peptides. The nucleotide and protein, polypeptide and peptide sequences corresponding to various genes have been previously disclosed, and may be found at computerized databases known to those of ordinary skill in the art. One such database is the National Center for Biotechnology Information's Genbank and Gen-Pept databases located at the National Institutes of Health website. The coding regions for known genes may be amplified and/or expressed using the techniques disclosed herein or as would be known to those of ordinary skill in the art. Alternatively, various commercial preparations of proteins, polypeptides and peptides are known to those of skill in the art.

Peptides can be readily synthesized chemically utilizing reagents that are free of contaminating bacterial or animal substances (Merrifield RB: Solid phase peptide synthesis. I. The synthesis of a tetrapeptide. J. Am. Chem. Soc. 85:2149-54, 1963). In certain embodiments, neoantigenic peptides are prepared by (1) parallel solid-phase synthesis on multichannel instruments using uniform synthesis and cleavage conditions; (2) purification over a RP-HPLC column with column stripping; and re-washing, but not replacement, between peptides; followed by (3) analysis with a limited set of the most informative assays. The Good Manufacturing Practices (GMP) footprint can be defined around the set of peptides for an individual patient, thus requiring suite changeover procedures only between syntheses of peptides for different patients.

Alternatively, a nucleic acid (e.g., a polynucleotide) encoding a neoantigenic peptide of the invention may be used to produce the neoantigenic peptide in vitro. The polynucleotide may be, e.g., DNA, cDNA, PNA, CNA, RNA, either single- and/or double-stranded, or native or stabilized forms of polynucleotides, such as e.g. polynucleotides with a phosphorothiate backbone, or combinations thereof and it may or may not contain introns so long as it codes for the peptide. In one embodiment in vitro translation is used to produce the peptide. Many exemplary systems exist that one skilled in the art could utilize (e.g., Retic Lysate IVT Kit, Life Technologies, Waltham, Mass.).

An expression vector capable of expressing a polypeptide can also be prepared. Expression vectors for different cell types are well known in the art and can be selected without undue experimentation. Generally, the DNA is inserted into an expression vector, such as a plasmid, in proper orientation and correct reading frame for expression. If necessary, the DNA may be linked to the appropriate transcriptional and translational regulatory control nucleotide sequences recognized by the desired host (e.g., bacteria), although such controls are generally available in the expression vector. The vector is then introduced into the host bacteria for cloning using standard techniques (see, e.g., Sambrook et al. (1989) Molecular Cloning, A Laboratory Manual, Cold Spring Harbor Laboratory, Cold Spring Harbor, N.Y.).

Expression vectors comprising the isolated polynucleotides, as well as host cells containing the expression vectors, are also contemplated. The neoantigenic peptides may be provided in the form of RNA or cDNA molecules encoding the desired neoantigenic peptides. One or more neoantigenic peptides of the invention may be encoded by a single expression vector.

The term "polynucleotide encoding a polypeptide" encompasses a polynucleotide which includes only coding sequences for the polypeptide as well as a polynucleotide which includes additional coding and/or non-coding sequences. Polynucleotides can be in the form of RNA or in the form of DNA. DNA includes cDNA, genomic DNA, and synthetic DNA; and can be double-stranded or single-stranded, and if single stranded can be the coding strand or non-coding (anti-sense) strand.

In embodiments, the polynucleotides may comprise the coding sequence for the tumor specific neoantigenic peptide fused in the same reading frame to a polynucleotide which aids, for example, in expression and/or secretion of a polypeptide from a host cell (e.g., a leader sequence which functions as a secretory sequence for controlling transport of a polypeptide from the cell). The polypeptide having a leader sequence is a preprotein and can have the leader sequence cleaved by the host cell to form the mature form of the polypeptide.

In embodiments, the polynucleotides can comprise the coding sequence for the tumor specific neoantigenic peptide fused in the same reading frame to a marker sequence that allows, for example, for purification of the encoded polypeptide, which may then be incorporated into the personalized neoplasia vaccine or immunogenic composition. For example, the marker sequence can be a hexa-histidine tag (SEQ ID NO: 33733) supplied by a pQE-9 vector to provide for purification of the mature polypeptide fused to the marker in the case of a bacterial host, or the marker sequence can be a hemagglutinin (HA) tag derived from the influenza hemagglutinin protein when a mammalian host (e.g., COS-7 cells) is used. Additional tags include, but are not limited to, Calmodulin tags, FLAG tags, Myc tags, S tags, SBP tags, Softag 1, Softag 3, V5 tag, Xpress tag, Isopeptag, SpyTag, Biotin Carboxyl Carrier Protein (BCCP) tags, GST tags, fluorescent protein tags (e.g., green fluorescent protein tags), maltose binding protein tags, Nus tags, Strep-tag, thioredoxin tag, TC tag, Ty tag, and the like.

In embodiments, the polynucleotides may comprise the coding sequence for one or more of the tumor specific neoantigenic peptides fused in the same reading frame to create a single concatamerized neoantigenic peptide construct capable of producing multiple neoantigenic peptides.

In certain embodiments, isolated nucleic acid molecules having a nucleotide sequence at least 60% identical, at least 65% identical, at least 70% identical, at least 75% identical, at least 80% identical, at least 85% identical, at least 90% identical, at least 95% identical, or at least 96%, 97%, 98% or 99% identical to a polynucleotide encoding a tumor specific neoantigenic peptide of the present invention, can be provided.

By a polynucleotide having a nucleotide sequence at least, for example, 95% "identical" to a reference nucleotide sequence is intended that the nucleotide sequence of the polynucleotide is identical to the reference sequence except that the polynucleotide sequence can include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence can be deleted or substituted with another nucleotide, or a number of nucleotides up to 5% of the total nucleotides in the reference sequence can be inserted into the reference sequence. These mutations of the reference sequence can occur at the amino- or carboxy-terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 80% identical, at least 85% identical, at least 90% identical, and in some embodiments, at least 95%, 96%, 970%, 98%, or 99% identical to a reference sequence can be determined conventionally using known computer programs such as the Bestfit program (Wisconsin Sequence Analysis Package, Version 8 for Unix, Genetics Computer Group, University Research Park, 575 Science Drive, Madison, Wis. 53711). Bestfit uses the local homology algorithm of Smith and Waterman, Advances in Applied Mathematics 2:482-489 (1981), to find the best segment of homology between two sequences. When using Bestfit or any other sequence alignment program to determine whether a particular sequence is, for instance, 95% identical to a reference sequence according to the present invention, the parameters are set such that the percentage of identity is calculated over the full length of the reference nucleotide sequence and that gaps in homology of up to 5% of the total number of nucleotides in the reference sequence are allowed.

The isolated tumor specific neoantigenic peptides described herein can be produced in vitro (e.g., in the laboratory) by any suitable method known in the art. Such methods range from direct protein synthetic methods to constructing a DNA sequence encoding isolated polypeptide sequences and expressing those sequences in a suitable transformed host. In some embodiments, a DNA sequence is constructed using recombinant technology by isolating or synthesizing a DNA sequence encoding a wild-type protein of interest. Optionally, the sequence can be mutagenized by site-specific mutagenesis to provide functional analogs thereof. See, e.g. Zoeller et al., Proc. Nat'l. Acad. Sci. USA 81:5662-5066 (1984) and U.S. Pat. No. 4,588,585.

In embodiments, a DNA sequence encoding a polypeptide of interest would be constructed by chemical synthesis using an oligonucleotide synthesizer. Such oligonucleotides can be designed based on the amino acid sequence of the desired polypeptide and selecting those codons that are favored in the host cell in which the recombinant polypeptide of interest is produced. Standard methods can be applied to synthesize an isolated polynucleotide sequence encoding an isolated polypeptide of interest. For example, a complete amino acid sequence can be used to construct a back-translated gene. Further, a DNA oligomer containing a nucleotide sequence coding for the particular isolated polypeptide can be synthesized. For example, several small oligonucleotides coding for portions of the desired polypeptide can be synthesized and then ligated. The individual oligonucleotides typically contain 5' or 3' overhangs for complementary assembly.

Once assembled (e.g., by synthesis, site-directed mutagenesis, or another method), the polynucleotide sequences encoding a particular isolated polypeptide of interest is inserted into an expression vector and optionally operatively linked to an expression control sequence appropriate for expression of the protein in a desired host. Proper assembly can be confirmed by nucleotide sequencing, restriction mapping, and expression of a biologically active polypeptide in a suitable host. As well known in the art, in order to obtain high expression levels of a transfected gene in a host, the gene can be operatively linked to transcriptional and translational expression control sequences that are functional in the chosen expression host.

Recombinant expression vectors may be used to amplify and express DNA encoding the tumor specific neoantigenic peptides. Recombinant expression vectors are replicable DNA constructs which have synthetic or cDNA-derived DNA fragments encoding a tumor specific neoantigenic peptide or a bioequivalent analog operatively linked to suitable transcriptional or translational regulatory elements derived from mammalian, microbial, viral or insect genes. A transcriptional unit generally comprises an assembly of (1) a genetic element or elements having a regulatory role in gene expression, for example, transcriptional promoters or enhancers, (2) a structural or coding sequence which is transcribed into mRNA and translated into protein, and (3) appropriate transcription and translation initiation and termination sequences, as described in detail herein. Such regulatory elements can include an operator sequence to control transcription. The ability to replicate in a host, usually conferred by an origin of replication, and a selection gene to facilitate recognition of transformants can additionally be incorporated. DNA regions are operatively linked when they are functionally related to each other. For example, DNA for a signal peptide (secretory leader) is operatively linked to DNA for a polypeptide if it is expressed as a precursor which participates in the secretion of the polypeptide; a promoter is operatively linked to a coding sequence if it controls the transcription of the sequence; or a ribosome binding site is operatively linked to a coding sequence if it is positioned so as to permit translation. Generally, operatively linked means contiguous, and in the case of secretory leaders, means contiguous and in reading frame. Structural elements intended for use in yeast expression systems include a leader sequence enabling extracellular secretion of translated protein by a host cell. Alternatively, where recombinant protein is expressed without a leader or transport sequence, it can include an N-terminal methionine residue. This residue can optionally be subsequently cleaved from the expressed recombinant protein to provide a final product.

Useful expression vectors for eukaryotic hosts, especially mammals or humans include, for example, vectors comprising expression control sequences from SV40, bovine papilloma virus, adenovirus and cytomegalovirus. Useful expression vectors for bacterial hosts include known bacterial plasmids, such as plasmids from *Escherichia coli*, including pCR 1, pBR322, pMB9 and their derivatives, wider host range plasmids, such as M13 and filamentous single-stranded DNA phages.

Suitable host cells for expression of a polypeptide include prokaryotes, yeast, insect or higher eukaryotic cells under the control of appropriate promoters. Prokaryotes include gram negative or gram positive organisms, for example *E. coli* or bacilli. Higher eukaryotic cells include established cell lines of mammalian origin. Cell-free translation systems could also be employed. Appropriate cloning and expression vectors for use with bacterial, fungal, yeast, and mammalian cellular hosts are well known in the art (see Pouwels et al., Cloning Vectors: A Laboratory Manual, Elsevier, N.Y., 1985).

Various mammalian or insect cell culture systems are also advantageously employed to express recombinant protein. Expression of recombinant proteins in mammalian cells can be performed because such proteins are generally correctly folded, appropriately modified and completely functional. Examples of suitable mammalian host cell lines include the COS-7 lines of monkey kidney cells, described by Gluzman (Cell 23:175, 1981), and other cell lines capable of expressing an appropriate vector including, for example, L cells, C127, 3T3, Chinese hamster ovary (CHO), 293, HeLa and BHK cell lines. Mammalian expression vectors can comprise nontranscribed elements such as an origin of replication, a suitable promoter and enhancer linked to the gene to be expressed, and other 5' or 3' flanking nontranscribed sequences, and 5' or 3' nontranslated sequences, such as necessary ribosome binding sites, a polyadenylation site, splice donor and acceptor sites, and transcriptional termination sequences. Baculovirus systems for production of heterologous proteins in insect cells are reviewed by Luckow and Summers, Bio/Technology 6:47 (1988).

The proteins produced by a transformed host can be purified according to any suitable method. Such standard methods include chromatography (e.g., ion exchange, affinity and sizing column chromatography, and the like), centrifugation, differential solubility, or by any other standard technique for protein purification. Affinity tags such as hexahistidine (SEQ ID NO: 33733), maltose binding domain, influenza coat sequence, glutathione-S-transferase, and the like can be attached to the protein to allow easy purification by passage over an appropriate affinity column. Isolated proteins can also be physically characterized using such techniques as proteolysis, nuclear magnetic resonance and x-ray crystallography.

For example, supernatants from systems which secrete recombinant protein into culture media can be first concentrated using a commercially available protein concentration filter, for example, an Amicon or Millipore Pellicon ultrafiltration unit. Following the concentration step, the concentrate can be applied to a suitable purification matrix. Alternatively, an anion exchange resin can be employed, for example, a matrix or substrate having pendant diethylaminoethyl (DEAE) groups. The matrices can be acrylamide, agarose, dextran, cellulose or other types commonly employed in protein purification. Alternatively, a cation exchange step can be employed. Suitable cation exchangers include various insoluble matrices comprising sulfopropyl or carboxymethyl groups. Finally, one or more reversed-phase high performance liquid chromatography (RP-HPLC) steps employing hydrophobic RP-HPLC media, e.g., silica gel having pendant methyl or other aliphatic groups, can be employed to further purify a cancer stem cell protein-Fc composition. Some or all of the foregoing purification steps, in various combinations, can also be employed to provide a homogeneous recombinant protein.

Recombinant protein produced in bacterial culture can be isolated, for example, by initial extraction from cell pellets, followed by one or more concentration, salting-out, aqueous ion exchange or size exclusion chromatography steps. High performance liquid chromatography (HPLC) can be employed for final purification steps. Microbial cells employed in expression of a recombinant protein can be disrupted by any convenient method, including freeze-thaw cycling, sonication, mechanical disruption, or use of cell lysing agents.

In Vivo Peptide/Polypeptide Synthesis

The present invention also contemplates the use of nucleic acid molecules as vehicles for delivering neoantigenic peptides/polypeptides to the subject in need thereof, in vivo, in the form of, e.g., DNA/RNA vaccines (see, e.g., WO2012/159643, and WO2012/159754, hereby incorporated by reference in their entirety).

In one embodiment neoantigens may be administered to a patient in need thereof by use of a plasmid. These are plasmids which usually consist of a strong viral promoter to drive the in vivo transcription and translation of the gene (or complementary DNA) of interest (Mor, et al., (1995). The Journal of Immunology 155 (4): 2039-2046). Intron A may sometimes be included to improve mRNA stability and hence increase protein expression (Leitner et al. (1997).The Journal of Immunology 159 (12): 6112-6119). Plasmids also include a strong polyadenylation/transcriptional termination signal, such as bovine growth hormone or rabbit beta-globulin polyadenylation sequences (Alarcon et al., (1999). Adv. Parasitol. Advances in Parasitology 42: 343-410; Robinson et al., (2000). Adv. Virus Res. Advances in Virus Research 55: 1-74; Böhm et al., (1996). Journal of Immunological Methods 193 (1): 29-40.). Multicistronic vectors are sometimes constructed to express more than one immunogen, or to express an immunogen and an immunostimulatory protein (Lewis et al., (1999). Advances in Virus Research (Academic Press) 54: 129-88).

Because the plasmid is the "vehicle" from which the immunogen is expressed, optimising vector design for maximal protein expression is essential (Lewis et al., (1999). Advances in Virus Research (Academic Press) 54: 129-88). One way of enhancing protein expression is by optimising the codon usage of pathogenic mRNAs for eukaryotic cells. Another consideration is the choice of promoter. Such promoters may be the SV40 promoter or Rous Sarcoma Virus (RSV).

Plasmids may be introduced into animal tissues by a number of different methods. The two most popular approaches are injection of DNA in saline, using a standard hypodermic needle, and gene gun delivery. A schematic outline of the construction of a DNA vaccine plasmid and its subsequent delivery by these two methods into a host is illustrated at Scientific American (Weiner et al., (1999) Scientific American 281 (1): 34-41). Injection in saline is normally conducted intramuscularly (IM) in skeletal muscle, or intradermally (ID), with DNA being delivered to the extracellular spaces. This can be assisted by electroporation by temporarily damaging muscle fibres with myotoxins such as bupivacaine; or by using hypertonic solutions of saline or sucrose (Alarcon et al., (1999). Adv. Parasitol. Advances in Parasitology 42: 343-410). Immune responses to this method of delivery can be affected by many factors, including needle type, needle alignment, speed of injection, volume of injection, muscle type, and age, sex and physiological condition of the animal being injected (Alarcon et al., (1999). Adv. Parasitol. Advances in Parasitology 42: 343-410).

Gene gun delivery, the other commonly used method of delivery, ballistically accelerates plasmid DNA (pDNA) that has been adsorbed onto gold or tungsten microparticles into the target cells, using compressed helium as an accelerant (Alarcon et al., (1999). Adv. Parasitol. Advances in Parasitology 42: 343-410: Lewis et al., (1999). Advances in Virus Research (Academic Press) 54: 129-88).

Alternative delivery methods may include aerosol instillation of naked DNA on mucosal surfaces, such as the nasal and lung mucosa, (Lewis et al., (1999). Advances in Virus Research (Academic Press) 54: 129-88) and topical administration of pDNA to the eye and vaginal mucosa (Lewis et al., (1999) Advances in Virus Research (Academic Press) 54: 129-88). Mucosal surface delivery has also been achieved using cationic liposome-DNA preparations, biodegradable microspheres, attenuated Shigella or Listeria vectors for oral administration to the intestinal mucosa, and recombinant adenovirus vectors. DNA or RNA may also be delivered to cells following mild mechanical disruption of the cell membrane, temporarily permeabilizing the cells. Such a mild mechanical disruption of the membrane can be accomplished by gently forcing cells through a small aperture (Ex Vivo Cytosolic Delivery of Functional Macromolecules to Immune Cells, Sharei et al, PLOS ONE|DOI: 10.1371/journal.pone.0118803 Apr. 13, 2015).

The method of delivery determines the dose of DNA required to raise an effective immune response. Saline injections require variable amounts of DNA, from 10 μg-1 mg, whereas gene gun deliveries require 100 to 1000 times less DNA than intramuscular saline injection to raise an effective immune response. Generally, 0.2 µg-20 µg are required, although quantities as low as 16 ng have been reported. These quantities vary from species to species, with mice, for example, requiring approximately 10 times less DNA than primates. Saline injections require more DNA because the DNA is delivered to the extracellular spaces of the target tissue (normally muscle), where it has to overcome physical barriers (such as the basal lamina and large amounts of connective tissue, to mention a few) before it is taken up by the cells, while gene gun deliveries bombard DNA directly into the cells, resulting in less "wastage" (See e.g., Sedegah et al., (1994). Proceedings of the National Academy of Sciences of the United States of America 91 (21): 9866-9870; Daheshia et al., (1997). The Journal of Immunology 159 (4): 1945-1952; Chen et al., (1998). The Journal of Immunology 160 (5): 2425-2432; Sizemore (1995) Science 270 (5234): 299-302; Fynan et al., (1993) Proc. Natl. Acad. Sci. U.S.A. 90 (24): 11478-82).

In one embodiment, a neoplasia vaccine or immunogenic composition may include separate DNA plasmids encoding, for example, one or more neoantigenic peptides/polypeptides as identified in according to the invention. As discussed herein, the exact choice of expression vectors can depend upon the peptide/polypeptides to be expressed, and is well within the skill of the ordinary artisan. The expected persistence of the DNA constructs (e.g., in an episomal, non-replicating, non-integrated form in the muscle cells) is expected to provide an increased duration of protection.

One or more neoantigenic peptides of the invention may be encoded and expressed in vivo using a viral based system (e.g., an adenovirus system, an adeno associated virus (AAV) vector, a poxvirus, or a lentivirus). In one embodiment, the neoplasia vaccine or immunogenic composition may include a viral based vector for use in a human patient in need thereof, such as, for example, an adenovirus (see, e.g., Baden et al. First-in-human evaluation of the safety and immunogenicity of a recombinant adenovirus serotype 26 HIV-1 Env vaccine (IPCAVD 001). J Infect Dis. 2013 Jan. 15; 207(2):240-7, hereby incorporated by reference in its entirety). Plasmids that can be used for adeno associated virus, adenovirus, and lentivirus delivery have been described previously (see e.g., U.S. Pat. Nos. 6,955,808 and 6,943,019, and U.S. Patent application No. 20080254008, hereby incorporated by reference).

The peptides and polypeptides of the invention can also be expressed by a vector, e.g., a nucleic acid molecule as herein-discussed, e.g., RNA or a DNA plasmid, a viral vector such as a poxvirus, e.g., orthopox virus, avipox virus, or adenovirus, AAV or lentivirus. This approach involves the use of a vector to express nucleotide sequences that encode the peptide of the invention. Upon introduction into an acutely or chronically infected host or into a noninfected host, the vector expresses the immunogenic peptide, and thereby elicits a host CTL response.

Among vectors that may be used in the practice of the invention, integration in the host genome of a cell is possible with retrovirus gene transfer methods, often resulting in long term expression of the inserted transgene. In a preferred embodiment the retrovirus is a lentivirus. Additionally, high transduction efficiencies have been observed in many different cell types and target tissues. The tropism of a retrovirus can be altered by incorporating foreign envelope proteins, expanding the potential target population of target cells. A retrovirus can also be engineered to allow for conditional expression of the inserted transgene, such that only certain cell types are infected by the lentivirus. Cell type specific promoters can be used to target expression in specific cell types. Lentiviral vectors are retroviral vectors (and hence both lentiviral and retroviral vectors may be used in the practice of the invention). Moreover, lentiviral vectors are preferred as they are able to transduce or infect non-dividing cells and typically produce high viral titers. Selection of a retroviral gene transfer system may therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the desired nucleic acid into the target cell to provide permanent expression. Widely used retroviral vectors that may be used in the practice of the invention include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., (1992) J. Virol. 66:2731-2739; Johann et al., (1992) J. Virol. 66:1635-1640; Sommnerfelt et al., (1990) Virol. 176:58-59; Wilson et al., (1998) J. Virol. 63:2374-2378; Miller et al., (1991) J. Virol. 65:2220-2224; PCT/US94/05700).

Also useful in the practice of the invention is a minimal non-primate lentiviral vector, such as a lentiviral vector based on the equine infectious anemia virus (EIAV) (see, e.g., Balagaan, (2006) J Gene Med; 8: 275-285, Published online 21 Nov. 2005 in Wiley InterScience (www.interscience.wiley.com). DOI: 10.1002/jgm.845). The vectors may have cytomegalovirus (CMV) promoter driving expression of the target gene. Accordingly, the invention contemplates amongst vector(s) useful in the practice of the invention: viral vectors, including retroviral vectors and lentiviral vectors.

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for delivery to the Brain, see, e.g., US Patent Publication Nos. US20110293571; US20040013648, US20070025970, US20090111106 and U.S. Pat. No. 7,259,015. In another embodiment lentiviral vectors are used to deliver vectors to the brain of those being treated for a disease.

As to lentivirus vector systems useful in the practice of the invention, mention is made of U.S. Pat. Nos. 6,428,953, 6,165,782, 6,013,516, 5,994,136, 6,312,682, and 7,198,784, and documents cited therein.

In an embodiment herein the delivery is via an lentivirus. Zou et al. administered about 10 µl of a recombinant lentivirus having a titer of $1 \times 10^9$ transducing units (TU)/ml by an intrathecal catheter. These sort of dosages can be adapted or extrapolated to use of a retroviral or lentiviral vector in the present invention. For transduction in tissues such as the brain, it is necessary to use very small volumes, so the viral preparation is concentrated by ultracentrifugation. The resulting preparation should have at least $10^8$ TU/ml, preferably from $10^8$ to $10^9$ TU/ml, more preferably at least $10^9$ TU/ml. Other methods of concentration such as ultrafiltration or binding to and elution from a matrix may be used.

In other embodiments the amount of lentivirus administered may be $1.\text{x}.10^5$ or about $1.\text{x}.10^5$ plaque forming units (PFU), $5.\text{x}.10^5$ or about $5.\text{x}.10^5$ PFU, $1.\text{x}.10^6$ or about $1.\text{x}10^6$ PFU, $5.\text{x}.10^6$ or about $5.\text{x}.10^6$ PFU, $1.\text{x}.10^7$ or about $1.\text{x}.10^7$ PFU, $5.\text{x}.10^7$ or about $5.\text{x}.10^7$ PFU, $1.\text{x}.10^8$ or about $1.\text{x}.10^8$ PFU, $5.\text{x}.10^8$ or about $5.\text{x}.10^8$ PFU, $1.\text{x}.10^9$ or about $1.\text{x}.10^9$ PFU, $5.\text{x}.10^9$ or about $5.\text{x}.10^9$ PFU, $1.\text{x}.10^{10}$ or about 1.x.$10^{10}$ PFU or 5.x.$10^{10}$ or about 5.x.$10^{10}$ PFU as total single dosage for an average human of 75 kg or adjusted for the weight and size and species of the subject. One of skill in the art can determine suitable dosage. Suitable dosages for a virus can be determined empirically.

Also useful in the practice of the invention is an adenovirus vector. One advantage is the ability of recombinant adenoviruses to efficiently transfer and express recombinant genes in a variety of mammalian cells and tissues in vitro and in vivo, resulting in the high expression of the transferred nucleic acids. Further, the ability to productively infect quiescent cells, expands the utility of recombinant adenoviral vectors. In addition, high expression levels ensure that the products of the nucleic acids will be expressed to sufficient levels to generate an immune response (see e.g., U.S. Pat. No. 7,029,848, hereby incorporated by reference).

As to adenovirus vectors useful in the practice of the invention, mention is made of U.S. Pat. No. 6,955,808. The adenovirus vector used can be selected from the group consisting of the Ad5, Ad35, Ad11, C6, and C7 vectors. The sequence of the Adenovirus 5 ("Ad5") genome has been published. (Chroboczek, J., Bieber, F., and Jacrot, B. (1992) The Sequence of the Genome of Adenovirus Type 5 and Its Comparison with the Genome of Adenovirus Type 2, Virology 186, 280-285; the contents if which is hereby incorporated by reference). Ad35 vectors are described in U.S. Pat. Nos. 6,974,695, 6,913,922, and 6,869,794. Ad11 vectors are described in U.S. Pat. No. 6,913,922. C6 adenovirus vectors are described in U.S. Pat. Nos. 6,780,407; 6,537,594; 6,309,647; 6,265,189; 6,156,567; 6,090,393; 5,942,235 and 5,833,975. C7 vectors are described in U.S. Pat. No. 6,277,558. Adenovirus vectors that are E1-defective or deleted, E3-defective or deleted, and/or E4-defective or deleted may also be used. Certain adenoviruses having mutations in the E1 region have improved safety margin because E1-defective adenovirus mutants are replication-defective in non-permissive cells, or, at the very least, are highly attenuated. Adenoviruses having mutations in the E3 region may have enhanced the immunogenicity by disrupting the mechanism whereby adenovirus down-regulates MHC class I molecules. Adenoviruses having E4 mutations may have reduced immunogenicity of the adenovirus vector because of suppression of late gene expression. Such vectors may be particularly useful when repeated re-vaccination utilizing the same vector is desired. Adenovirus vectors that are deleted or mutated in E1, E3, E4, E1 and E3, and E1 and E4 can be used in accordance with the present invention. Furthermore, "gutless" adenovirus vectors, in which all viral genes are deleted, can also be used in accordance with the present invention. Such vectors require a helper virus for their replication and require a special human 293 cell line expressing both E1a and Cre, a condition that does not exist in natural environment. Such "gutless" vectors are non-immunogenic and thus the vectors may be inoculated multiple times for re-vaccination. The "gutless" adenovirus vectors can be used for insertion of heterologous inserts/genes such as the transgenes of the present invention, and can even be used for co-delivery of a large number of heterologous inserts/genes.

In an embodiment herein the delivery is via an adenovirus, which may be at a single booster dose containing at least $1 \times 10^5$ particles (also referred to as particle units, pu) of adenoviral vector. In an embodiment herein, the dose preferably is at least about $1 \times 10^6$ particles (for example, about $1 \times 10^6$-$1 \times 10^{12}$ particles), more preferably at least about $1 \times 10^7$ particles, more preferably at least about $1 \times 10^8$ particles (e.g., about $1 \times 10^8$-$1 \times 10^{11}$ particles or about $1 \times 10^8$-$1 \times 10^{12}$ particles), and most preferably at least about $1 \times 10^9$ particles (e.g., about $1 \times 10^9$-$1 \times 10^{10}$ particles or about $1 \times 10^9$-$1 \times 10^{12}$ particles), or even at least about $1 \times 10^{10}$ particles (e.g., about $1 \times 10^{10}$-$1 \times 10^{12}$ particles) of the adenoviral vector. Alternatively, the dose comprises no more than about $1 \times 10^{14}$ particles, preferably no more than about $1 \times 10^{13}$ particles, even more preferably no more than about $1 \times 10^{12}$ particles, even more preferably no more than about $1 \times 10^{11}$ particles, and most preferably no more than about $1 \times 10^{10}$ particles (e.g., no more than about $1 \times 10^9$ articles). Thus, the dose may contain a single dose of adenoviral vector with, for example, about $1 \times 10^6$ particle units (pu), about $2 \times 10^6$ pu, about $4 \times 10^6$ pu, about $1 \times 10^7$ pu, about $2 \times 10^7$ pu, about $4 \times 10^7$ pu, about $1 \times 10^8$ pu, about $2 \times 10^8$ pu, about $4 \times 10^8$ pu, about $1 \times 10^9$ pu, about $2 \times 10^9$ pu, about $4 \times 10^9$ pu, about $1 \times 10^{10}$ pu, about $2 \times 10^{10}$ pu, about $4 \times 10^{10}$ pu, about $1 \times 10^{11}$ pu, about $2 \times 10^{11}$ pu, about $4 \times 10^{11}$ pu, about $1 \times 10^{12}$ pu, about $2 \times 10^{12}$ pu, or about $4 \times 10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In terms of in vivo delivery, AAV is advantageous over other viral vectors due to low toxicity and low probability of causing insertional mutagenesis because it doesn't integrate into the host genome. AAV has a packaging limit of 4.5 or 4.75 Kb. Constructs larger than 4.5 or 4.75 Kb result in significantly reduced virus production. There are many promoters that can be used to drive nucleic acid molecule expression. AAV ITR can serve as a promoter and is advantageous for eliminating the need for an additional promoter element. For ubiquitous expression, the following promoters can be used: CMV, CAG, CBh, PGK, SV40, Ferritin heavy or light chains, etc. For brain expression, the following promoters can be used: SynapsinI for all neurons, CaMKIIalpha for excitatory neurons, GAD67 or GAD65 or VGAT for GABAergic neurons, etc. Promoters used to drive RNA synthesis can include: Pol III promoters such as U6 or H1. The use of a Pol II promoter and intronic cassettes can be used to express guide RNA (gRNA).

With regard to AAV vectors useful in the practice of the invention, mention is made of U.S. Pat. Nos. 5,658,785, 7,115,391, 7,172,893, 6,953,690, 6,936,466, 6,924,128, 6,893,865, 6,793,926, 6,537,540, 6,475,769 and 6,258,595, and documents cited therein.

As to AAV, the AAV can be AAV1, AAV2, AAV5 or any combination thereof. One can select the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The above promoters and vectors are preferred individually.

In an embodiment herein, the delivery is via an AAV. A therapeutically effective dosage for in vivo delivery of the AAV to a human is believed to be in the range of from about 20 to about 50 ml of saline solution containing from about $1 \times 10^{10}$ to about $1 \times 10^{50}$ functional AAV/ml solution. The dosage may be adjusted to balance the therapeutic benefit against any side effects. In an embodiment herein, the AAV dose is generally in the range of concentrations of from about $1 \times 10^5$ to $1 \times 10^{50}$ genomes AAV, from about $1 \times 10^8$ to $1 \times 10^{20}$ genomes AAV, from about $1 \times 10^{10}$ to about $1 \times 10^{16}$ genomes, or about $1 \times 10^{11}$ to about $1 \times 10^{16}$ genomes AAV. A human dosage may be about $1 \times 10^{13}$ genomes AAV. Such concentrations may be delivered in from about 0.001 ml to about 100 ml, about 0.05 to about 50 ml, or about 10 to about 25 ml of a carrier solution. In a preferred embodiment, AAV is used with a titer of about 2×10$^{13}$ viral genomes/milliliter, and each of the striatal hemispheres of a mouse receives one 500 nanoliter injection. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In another embodiment effectively activating a cellular immune response for a neoplasia vaccine or immunogenic composition can be achieved by expressing the relevant neoantigens in a vaccine or immunogenic composition in a non-pathogenic microorganism. Well-known examples of such microorganisms are *Mycobacterium bovis* BCG, *Salmonella* and *Pseudomona* (See, U.S. Pat. No. 6,991,797, hereby incorporated by reference in its entirety).

In another embodiment a Poxvirus is used in the neoplasia vaccine or immunogenic composition. These include orthopoxvirus, avipox, vaccinia, MVA, NYVAC, canarypox, ALVAC, fowlpox, TROVAC, etc. (see e.g., Verardi et al., Hum Vaccin Immunother. 2012 July; 8(7):961-70; and Moss, Vaccine. 2013; 31(39): 4220-4222). Poxvirus expression vectors were described in 1982 and quickly became widely used for vaccine development as well as research in numerous fields. Advantages of the vectors include simple construction, ability to accommodate large amounts of foreign DNA and high expression levels.

Information concerning poxviruses that may be used in the practice of the invention, such as Chordopoxvirinae subfamily poxviruses (poxviruses of vertebrates), for instance, orthopoxviruses and avipoxviruses, e.g., vaccinia virus (e.g., Wyeth Strain, WR Strain (e.g., ATCC® VR-1354), Copenhagen Strain, NYVAC, NYVAC.1, NYVAC.2, MVA, MVA-BN), canarypox virus (e.g., Wheatley C93 Strain, ALVAC), fowlpox virus (e.g., FP9 Strain, Webster Strain, TROVAC), dovepox, pigeonpox, quailpox, and raccoon pox, inter alia, synthetic or non-naturally occurring recombinants thereof, uses thereof, and methods for making and using such recombinants may be found in scientific and patent literature, such as:

U.S. Pat. Nos. 4,603,112, 4,769,330, 5,110,587, 5,174, 993, 5,364,773, 5,572,938, 5,494,807, 5,766,597, 7,767,449, 6,780,407, 6,537,594, 6,265,189, 6,214, 353, 6,130,066, 6,004,777, 5,990,091, 5,942,235, 5,833,975, 5,766,597, 5,756,101, 7,045,313, 6,780, 417, 8,470,598, 8,372,622, 8,268,329, 8,268,325, 8,236,560, 8,163,293, 7,964,398, 7,964,396, 7,964, 395, 7,939,086, 7,923,017, 7,897,156, 7,892,533, 7,628,980, 7,459,270, 7,445,924, 7,384,644, 7,335, 364, 7,189,536, 7,097,842, 6,913,752, 6,761,893, 6,682,743, 5,770,212, 5,766,882, and 5,989,562, and Panicali, D. Proc. Natl. Acad. Sci. 1982; 79; 4927-493, Panicali D. Proc. Natl. Acad. Sci. 1983; 80(17): 5364-8, Mackett, M. Proc. Natl. Acad. Sci. 1982; 79: 7415-7419, Smith G L. Proc. Natl. Acad. Sci. 1983; 80(23): 7155-9, Smith G L. Nature 1983; 302: 490-5, Sullivan V J. Gen. Vir. 1987; 68: 2587-98, Perkus M Journal of Leukocyte Biology 1995; 58:1-13, Yilma T D. Vaccine 1989; 7: 484-485, Brochier B. Nature 1991; 354: 520-22, Wiktor, T J. Proc. Natl Acd. Sci. 1984; 81: 7194-8, Rupprecht, C E. Proc. Natl Acd. Sci. 1986; 83: 7947-50, Poulet, H Vaccine 2007; 25(July): 5606-12, Weyer J. Vaccine 2009; 27(November): 7198-201, Buller, R M Nature 1985; 317(6040): 813-5, Buller R M. J. Virol. 1988; 62(3):866-74, Flexner, C. Nature 1987; 330(6145): 259-62, Shida, H. J. Virol. 1988; 62(12): 4474-80, Kotwal, G J. J. Virol. 1989; 63(2): 600-6, Child, S J. Virology 1990; 174(2): 625-9, Mayr A. Zentralbl Bakteriol 1978; 167(5,6): 375-9, Antoine G. Virology. 1998; 244(2): 365-96, Wyatt, L S. Virology 1998; 251(2): 334-42, Sancho, M C. J. Virol. 2002; 76(16); 8313-34, Gallego-Gomez, J C. J. Virol. 2003; 77(19); 10606-22), Goebel S J. Virology 1990; (a,b) 179: 247-66, Tartaglia, J. Virol. 1992; 188(1): 217-32, Najera J L. J. Virol. 2006; 80(12): 6033-47, Najera, J L. J. Virol. 2006; 80: 6033-6047, Gomez, C E. J. Gen. Virol. 2007; 88: 2473-78, Mooij, P. Jour. Of Virol. 2008; 82: 2975-2988, Gomez, C E. Curr. Gene Ther. 2011; 11: 189-217, Cox, W. Virology 1993; 195: 845-50, Perkus, M. Jour. Of Leukocyte Biology 1995; 58: 1-13, Blanchard T J. J Gen Virology 1998; 79(5): 1159-67, Amara R. Science 2001; 292: 69-74, Hel, Z., J. Immunol. 2001; 167: 7180-9, Gherardi M M. J. Virol. 2003; 77: 7048-57, Didierlaurent, A. Vaccine 2004; 22: 3395-3403, Bissht H. Proc. Nat. Aca. Sci. 2004; 101: 6641-46, McCurdy L H. Clin. Inf. Dis 2004; 38: 1749-53, Earl P L. Nature 2004; 428: 182-85, Chen Z. J. Virol. 2005; 79: 2678-2688, Najera J L. J. Virol. 2006; 80(12); 6033-47, Nam J H. Acta. Virol. 2007; 51: 125-30, Antonis A F. Vaccine 2007; 25: 4818-4827, B Weyer J. Vaccine 2007; 25: 4213-22, Ferrier-Rembert A. Vaccine 2008; 26(14): 1794-804, Corbett M. Proc. Natl. Acad. Sci. 2008; 105(6): 2046-51, Kaufman H L., J. Clin. Oncol. 2004; 22: 2122-32, Amato, R J. Clin. Cancer Res. 2008; 14(22): 7504-10, Dreicer R. Invest New Drugs 2009; 27(4): 379-86, Kantoff P W. J. Clin. Oncol. 2010, 28, 1099-1105, Amato R J. J. Clin. Can. Res. 2010; 16(22): 5539-47, Kim, D W. Hum. Vaccine. 2010; 6: 784-791, Oudard, S. Cancer Immunol. Immunother. 2011; 60: 261-71, Wyatt, L S. Aids Res. Hum. Retroviruses. 2004; 20: 645-53, Gomez, C E. Virus Research 2004; 105: 11-22, Webster, D P. Proc. Natl. Acad. Sci. 2005; 102: 4836-4, Huang, X. Vaccine 2007; 25: 8874-84, Gomez, C E. Vaccine 2007a; 25: 2863-85, Esteban M. Hum. Vaccine 2009; 5: 867-871, Gomez, C E. Curr. Gene therapy 2008; 8(2): 97-120, Whelan, K T. Plos one 2009; 4(6): 5934, Scriba, T J. Eur. Jour. Immuno. 2010; 40(1): 279-90, Corbett, M. Proc. Natl. Acad. Sci. 2008; 105: 2046-2051, Midgley, C M. J. Gen. Virol. 2008; 89: 2992-97, Von Krempelhuber, A. Vaccine 2010; 28: 1209-16, Perreau, M. J. Of Virol. 2011; October: 9854-62, Pantaleo, G. Curr Opin HIV-AIDS. 2010: 5: 391-396, each of which is incorporated herein by reference.

In another embodiment the vaccinia virus is used in the neoplasia vaccine or immunogenic composition to express a neoantigen. (Rolph et al., Recombinant viruses as vaccines and immunological tools. Curr Opin Immunol 9:517-524, 1997). The recombinant vaccinia virus is able to replicate within the cytoplasm of the infected host cell and the polypeptide of interest can therefore induce an immune response. Moreover, Poxviruses have been widely used as vaccine or immunogenic composition vectors because of their ability to target encoded antigens for processing by the major histocompatibility complex class I pathway by directly infecting immune cells, in particular antigen-presenting cells, but also due to their ability to self-adjuvant.

In another embodiment ALVAC is used as a vector in a neoplasia vaccine or immunogenic composition. ALVAC is a canarypox virus that can be modified to express foreign transgenes and has been used as a method for vaccination against both prokaryotic and eukaryotic antigens (Horig H, Lee D S, Conkright W, et al. Phase I clinical trial of a recombinant canarypoxvirus (ALVAC) vaccine expressing human carcinoembryonic antigen and the B7.1 co-stimulatory molecule. Cancer Immunol Immunother 2000; 49:504-14; von Mehren M, Arlen P, Tsang K Y, et al. Pilot study of a dual gene recombinant avipox vaccine containing both carcinoembryonic antigen (CEA) and B7.1 transgenes in patients with recurrent CEA-expressing adenocarcinomas. Clin Cancer Res 2000; 6:2219-28; Musey L, Ding Y, Elizaga M, et al. HIV-1 vaccination administered intramuscularly can induce both systemic and mucosal T cell immunity in HIV-1-uninfected individuals. J Immunol 2003; 171:1094-101; Paoletti E. Applications of pox virus vectors to vaccination: an update. Proc Natl Acad Sci USA 1996; 93:11349-53; U.S. Pat. No. 7,255,862). In a phase I clinical trial, an ALVAC virus expressing the tumor antigen CEA showed an excellent safety profile and resulted in increased CEA-specific T-cell responses in selected patients; objective clinical responses, however, were not observed (Marshall J L, Hawkins M J, Tsang K Y, et al. Phase I study in cancer patients of a replication-defective avipox recombinant vaccine that expresses human carcinoembryonic antigen. J Clin Oncol 1999; 17:332-7).

In another embodiment a Modified Vaccinia Ankara (MVA) virus may be used as a viral vector for a neoantigen vaccine or immunogenic composition. MVA is a member of the Orthopoxvirus family and has been generated by about 570 serial passages on chicken embryo fibroblasts of the Ankara strain of Vaccinia virus (CVA) (for review see Mayr, A., et al., Infection 3, 6-14, 1975). As a consequence of these passages, the resulting MVA virus contains 31 kilobases less genomic information compared to CVA, and is highly host-cell restricted (Meyer, H. et al., J. Gen. Virol. 72, 1031-1038, 1991). MVA is characterized by its extreme attenuation, namely, by a diminished virulence or infectious ability, but still holds an excellent immunogenicity. When tested in a variety of animal models, MVA was proven to be avirulent, even in immuno-suppressed individuals. Moreover, MVA-BN®-HER2 is a candidate immunotherapy designed for the treatment of HER-2-positive breast cancer and is currently in clinical trials. (Mandl et al., Cancer Immunol Immunother. January 2012; 61(1): 19-29). Methods to make and use recombinant MVA has been described (e.g., see U.S. Pat. Nos. 8,309,098 and 5,185,146 hereby incorporated in its entirety).

In another embodiment the modified Copenhagen strain of vaccinia virus, NYVAC and NYVAC variations are used as a vector (see U.S. Pat. No. 7,255,862; PCT WO 95/30018; U.S. Pat. Nos. 5,364,773 and 5,494,807, hereby incorporated by reference in its entirety).

In one embodiment recombinant viral particles of the vaccine or immunogenic composition are administered to patients in need thereof. Dosages of expressed neoantigen can range from a few to a few hundred micrograms, e.g., 5 to 500 .mu.g. The vaccine or immunogenic composition can be administered in any suitable amount to achieve expression at these dosage levels. The viral particles can be administered to a patient in need thereof or transfected into cells in an amount of about at least $10^{3.5}$ pfu; thus, the viral particles are preferably administered to a patient in need thereof or infected or transfected into cells in at least about $10^4$ pfu to about $10^6$ pfu; however, a patient in need thereof can be administered at least about $10^8$ pfu such that a more preferred amount for administration can be at least about $10^7$ pfu to about $10^9$ pfu. Doses as to NYVAC are applicable as to ALVAC, MVA, MVA-BN, and avipoxes, such as canarypox and fowlpox.

Vaccine or Immunogenic Composition Adjuvant

Effective vaccine or immunogenic compositions advantageously include a strong adjuvant to initiate an immune response. As described herein, poly-ICLC, an agonist of TLR3 and the RNA helicase-domains of MDA5 and RIG3, has shown several desirable properties for a vaccine or immunogenic composition adjuvant. These properties include the induction of local and systemic activation of immune cells in vivo, production of stimulatory chemokines and cytokines, and stimulation of antigen-presentation by DCs. Furthermore, poly-ICLC can induce durable CD4+ and CD8+ responses in humans. Importantly, striking similarities in the upregulation of transcriptional and signal transduction pathways were seen in subjects vaccinated with poly-ICLC and in volunteers who had received the highly effective, replication-competent yellow fever vaccine. Furthermore, >90% of ovarian carcinoma patients immunized with poly-ICLC in combination with a NY-ESO-1 peptide vaccine (in addition to Montanide) showed induction of CD4+ and CD8+ T cell, as well as antibody responses to the peptide in a recent phase 1 study. At the same time, poly-ICLC has been extensively tested in more than 25 clinical trials to date and exhibited a relatively benign toxicity profile. In addition to a powerful and specific immunogen the neoantigen peptides may be combined with an adjuvant (e.g., poly-ICLC) or another anti-neoplastic agent. Without being bound by theory, these neoantigens are expected to bypass central thymic tolerance (thus allowing stronger anti-tumor T cell response), while reducing the potential for autoimmunity (e.g., by avoiding targeting of normal self-antigens). An effective immune response advantageously includes a strong adjuvant to activate the immune system (Speiser and Romero, Molecularly defined vaccines for cancer immunotherapy, and protective T cell immunity Seminars in Immunol 22:144 (2010)). For example, Toll-like receptors (TLRs) have emerged as powerful sensors of microbial and viral pathogen "danger signals", effectively inducing the innate immune system, and in turn, the adaptive immune system (Bhardwaj and Gnjatic, TLR AGONISTS: Are They Good Adjuvants? Cancer J. 16:382-391 (2010)). Among the TLR agonists, poly-ICLC (a synthetic double-stranded RNA mimic) is one of the most potent activators of myeloid-derived dendritic cells. In a human volunteer study, poly-ICLC has been shown to be safe and to induce a gene expression profile in peripheral blood cells comparable to that induced by one of the most potent live attenuated viral vaccines, the yellow fever vaccine YF-17D (Caskey et al, Synthetic double-stranded RNA induces innate immune responses similar to a live viral vaccine in humans J Exp Med 208:2357 (2011)). In a preferred embodiment Hiltonol®, a GMP preparation of poly-ICLC prepared by Oncovir, Inc, is utilized as the adjuvant. In other embodiments, other adjuvants described herein are envisioned. For instance oil-in-water, water-in-oil or multiphasic W/O/W; see, e.g., U.S. Pat. No. 7,608,279 and Aucouturier et al, Vaccine 19 (2001), 2666-2672, and documents cited therein.

Indications

Examples of cancers and cancer conditions that can be treated with the therapy of this document include, but are not limited to a patient in need thereof that has been diagnosed as having cancer, or at risk of developing cancer. The subject may have a solid tumor such as breast, ovarian, prostate, lung, kidney, gastric, colon, testicular, head and neck, pancreas, brain, melanoma, and other tumors of tissue organs and hematological tumors, such as lymphomas and leukemias, including acute myelogenous leukemia, chronic myelogenous leukemia, chronic lymphocytic leukemia, T cell lymphocytic leukemia, and B cell lymphomas, tumors of the brain and central nervous system (e.g., tumors of the meninges, brain, spinal cord, cranial nerves and other parts of the CNS, such as glioblastomas or medulla blastomas); head and/or neck cancer, breast tumors, tumors of the circulatory system (e.g., heart, mediastinum and pleura, and other intrathoracic organs, vascular tumors, and tumor-associated vascular tissue); tumors of the blood and lymphatic system (e.g., Hodgkin's disease, Non-Hodgkin's disease lymphoma, Burkitt's lymphoma, AIDS-related lymphomas, malignant immunoproliferative diseases, multiple myeloma, and malignant plasma cell neoplasms, lymphoid leukemia, myeloid leukemia, acute or chronic lymphocytic leukemia, monocytic leukemia, other leukemias of specific cell type, leukemia of unspecified cell type, unspecified malignant neoplasms of lymphoid, hematopoietic and related tissues, such as diffuse large cell lymphoma, T-cell lymphoma or cutaneous T-cell lymphoma); tumors of the excretory system (e.g., kidney, renal pelvis, ureter, bladder, and other urinary organs); tumors of the gastrointestinal tract (e.g., esophagus, stomach, small intestine, colon, colorectal, rectosigmoid junction, rectum, anus, and anal canal); tumors involving the liver and intrahepatic bile ducts, gall bladder, and other parts of the biliary tract, pancreas, and other digestive organs; tumors of the oral cavity (e.g., lip, tongue, gum, floor of mouth, palate, parotid gland, salivary glands, tonsil, oropharynx, nasopharynx, puriform sinus, hypopharynx, and other sites of the oral cavity); tumors of the reproductive system (e.g., vulva, vagina, Cervix uteri, uterus, ovary, and other sites associated with female genital organs, placenta, penis, prostate, testis, and other sites associated with male genital organs); tumors of the respiratory tract (e.g., nasal cavity, middle ear, accessory sinuses, larynx, trachea, bronchus and lung, such as small cell lung cancer and non-small cell lung cancer); tumors of the skeletal system (e.g., bone and articular cartilage of limbs, bone articular cartilage and other sites); tumors of the skin (e.g., malignant melanoma of the skin, non-melanoma skin cancer, basal cell carcinoma of skin, squamous cell carcinoma of skin, mesothelioma, Kaposi's sarcoma); and tumors involving other tissues including peripheral nerves and autonomic nervous system, connective and soft tissue, retroperitoneoum and peritoneum, eye, thyroid, adrenal gland, and other endocrine glands and related structures, secondary and unspecified malignant neoplasms of lymph nodes, secondary malignant neoplasm of respiratory and digestive systems and secondary malignant neoplasm of other sites. Thus the population of subjects described herein may be suffering from one of the above cancer types. In other embodiments, the population of subjects may be all subjects suffering from solid tumors, or all subjects suffering from liquid tumors.

Of special interest is the treatment of Non-Hodgkin's Lymphoma (NHL), clear cell Renal Cell Carcinoma (ccRCC), metastatic melanoma, sarcoma, leukemia or a cancer of the bladder, colon, brain, breast, head and neck, endometrium, lung, ovary, pancreas or prostate. In certain embodiments, the melanoma is high risk melanoma.

Cancers that can be treated using the therapy described herein may include among others cases which are refractory to treatment with other chemotherapeutics. The term "refractory, as used herein refers to a cancer (and/or metastases thereof), which shows no or only weak antiproliferative response (e.g., no or only weak inhibition of tumor growth) after treatment with another chemotherapeutic agent. These are cancers that cannot be treated satisfactorily with other chemotherapeutics. Refractory cancers encompass not only (i) cancers where one or more chemotherapeutics have already failed during treatment of a patient, but also (ii) cancers that can be shown to be refractory by other means, e.g., biopsy and culture in the presence of chemotherapeutics.

The therapy described herein is also applicable to the treatment of patients in need thereof who have not been previously treated.

The therapy described herein is also applicable where the subject has no detectable neoplasia but is at high risk for disease recurrence.

Also of special interest is the treatment of patients in need thereof who have undergone Autologous Hematopoietic Stem Cell Transplant (AHSCT), and in particular patients who demonstrate residual disease after undergoing AHSCT. The post-AHSCT setting is characterized by a low volume of residual disease, the infusion of immune cells to a situation of homeostatic expansion, and the absence of any standard relapse-delaying therapy. These features provide a unique opportunity to use the claimed neoplastic vaccine or immunogenic composition compositions to delay disease relapse.

Pharmaceutical Compositions/Methods of Delivery

The present invention is also directed to pharmaceutical compositions comprising an effective amount of one or more neoantigenic peptides as described herein (including a pharmaceutically acceptable salt, thereof), optionally in combination with a pharmaceutically acceptable carrier, excipient or additive.

When administered as a combination, the therapeutic agents (i.e. the neoantigenic peptides) can be formulated as separate compositions that are given at the same time or different times, or the therapeutic agents can be given as a single composition.

The compositions may be administered once daily, twice daily, once every two days, once every three days, once every four days, once every five days, once every six days, once every seven days, once every two weeks, once every three weeks, once every four weeks, once every two months, once every six months, or once per year. The dosing interval can be adjusted according to the needs of individual patients. For longer intervals of administration, extended release or depot formulations can be used.

The compositions of the invention can be used to treat diseases and disease conditions that are acute, and may also be used for treatment of chronic conditions. In particular, the compositions of the invention are used in methods to treat or prevent a neoplasia. In certain embodiments, the compounds of the invention are administered for time periods exceeding two weeks, three weeks, one month, two months, three months, four months, five months, six months, one year, two years, three years, four years, or five years, ten years, or fifteen years; or for example, any time period range in days, months or years in which the low end of the range is any time period between 14 days and 15 years and the upper end of the range is between 15 days and 20 years (e.g., 4 weeks and 15 years, 6 months and 20 years). In some cases, it may be advantageous for the compounds of the invention to be administered for the remainder of the patient's life. In preferred embodiments, the patient is monitored to check the progression of the disease or disorder, and the dose is adjusted accordingly. In preferred embodiments, treatment according to the invention is effective for at least two weeks, three weeks, one month, two months, three months, four months, five months, six months, one year, two years, three years, four years, or five years, ten years, fifteen years, twenty years, or for the remainder of the subject's life.

Surgical resection uses surgery to remove abnormal tissue in cancer, such as mediastinal, neurogenic, or germ cell tumors, or thymoma. In certain embodiments, administration of the composition is initiated following tumor resection. In other embodiments, administration of the neoplasia vaccine or immunogenic composition is initiated 1, 2, 3, 4, 5, 6, 7, 8, 9, 10, 11, 12, 13, 14, 15 or more weeks after tumor resection. Preferably, administration of the neoplasia vaccine or immunogenic composition is initiated 4, 5, 6, 7, 8, 9, 10, 11 or 12 weeks after tumor resection.

Prime/boost regimens refer to the successive administrations of a vaccine or immunogenic or immunological compositions. In certain embodiments, administration of the neoplasia vaccine or immunogenic composition is in a prime/boost dosing regimen, for example administration of the neoplasia vaccine or immunogenic composition at weeks 1, 2, 3 or 4 as a prime and administration of the neoplasia vaccine or immunogenic composition is at months 2, 3 or 4 as a boost. In another embodiment heterologous prime-boost strategies are used to ellicit a greater cytotoxic T-cell response (see Schneider et al., Induction of CD8+ T cells using heterologous prime-boost immunisation strategies, Immunological Reviews Volume 170, Issue 1, pages 29-38, August 1999). In another embodiment DNA encoding neoantigens is used to prime followed by a protein boost. In another embodiment protein is used to prime followed by boosting with a virus encoding the neoantigen. In another embodiment a virus encoding the neoantigen is used to prime and another virus is used to boost. In another embodiment protein is used to prime and DNA is used to boost. In a preferred embodiment a DNA vaccine or immunogenic composition is used to prime a T-cell response and a recombinant viral vaccine or immunogenic composition is used to boost the response. In another preferred embodiment a viral vaccine or immunogenic composition is coadministered with a protein or DNA vaccine or immunogenic composition to act as an adjuvant for the protein or DNA vaccine or immunogenic composition. The patient can then be boosted with either the viral vaccine or immunogenic composition, protein, or DNA vaccine or immunogenic composition (see Hutchings et al., Combination of protein and viral vaccines induces potent cellular and humoral immune responses and enhanced protection from murine malaria challenge. Infect Immun. 2007 December; 75(12):5819-26. Epub 2007 Oct. 1).

The pharmaceutical compositions can be processed in accordance with conventional methods of pharmacy to produce medicinal agents for administration to patients in need thereof, including humans and other mammals.

Modifications of the neoantigenic peptides can affect the solubility, bioavailability and rate of metabolism of the peptides, thus providing control over the delivery of the active species. Solubility can be assessed by preparing the neoantigenic peptide and testing according to known methods well within the routine practitioner's skill in the art.

In certain embodiments of the pharmaceutical composition the pharmaceutically acceptable carrier comprises water. In certain embodiments, the pharmaceutically acceptable carrier further comprises dextrose. In certain embodiments, the pharmaceutically acceptable carrier further comprises dimethylsulfoxide. In certain embodiments, the pharmaceutical composition further comprises an immunomodulator or adjuvant. In certain embodiments, the immunodulator or adjuvant is selected from the group consisting of poly-ICLC, STING agonist, 1018 ISS, aluminum salts, Amplivax, AS15, BCG, CP-870,893, CpG7909, CyaA, dSLIM, GM-CSF, IC30, IC31, Imiquimod, ImuFact IMP321, IS Patch, ISS, ISCOMATRIX, JuvImmune, LipoVac, MF59, monophosphoryl lipid A, Montanide IMS 1312, Montanide ISA 206, Montanide ISA 50V, Montanide ISA-51, OK-432, OM-174, OM-197-MP-EC, ONTAK, PEPTEL, vector system, PLGA microparticles, resiquimod, SRL172, Virosomes and other Virus-like particles, YF-17D, VEGF trap, R848, beta-glucan, Pam3Cys, and Aquila's QS21 stimulon. In certain embodiments, the immunomodulator or adjuvant comprises poly-ICLC.

Xanthenone derivatives such as, for example, Vadimezan or AsA404 (also known as 5,6-dimethylxanthenone-4-acetic acid (DMXAA)), may also be used as adjuvants according to embodiments of the invention. Alternatively, such derivatives may also be administered in parallel to the vaccine or immunogenic composition of the invention, for example via systemic or intratumoral delivery, to stimulate immunity at the tumor site. Without being bound by theory, it is believed that such xanthenone derivatives act by stimulating interferon (IFN) production via the stimulator of IFN gene ISTING) receptor (see e.g., Conlon et al. (2013) Mouse, but not Human STING, Binds and Signals in Response to the Vascular Disrupting Agent 5,6-Dimethylxanthenone-4-Acetic Acid, Journal of Immunology, 190: 5216-25 and Kim et al. (2013) Anticancer Flavonoids are Mouse-Selective STING Agonists, 8:1396-1401).

The vaccine or immunological composition may also include an adjuvant compound chosen from the acrylic or methacrylic polymers and the copolymers of maleic anhydride and an alkenyl derivative. It is in particular a polymer of acrylic or methacrylic acid cross-linked with a polyalkenyl ether of a sugar or polyalcohol (carbomer), in particular cross-linked with an allyl sucrose or with allylpentaerythritol. It may also be a copolymer of maleic anhydride and ethylene cross-linked, for example, with divinyl ether (see U.S. Pat. No. 6,713,068 hereby incorporated by reference in its entirety).

In certain embodiments, the pH modifier can stabilize the adjuvant or immunomodulator as described herein.

In certain embodiments, a pharmaceutical composition comprises: one to five peptides, dimethylsulfoxide (DMSO), dextrose, water, succinate, poly I: poly C, poly-L-lysine, carboxymethylcellulose, and chloride. In certain embodiments, each of the one to five peptides is present at a concentration of 300 µg/ml. In certain embodiments, the pharmaceutical composition comprises ≤3% DMSO by volume. In certain embodiments, the pharmaceutical composition comprises 3.6-3.7% dextrose in water. In certain embodiments, the pharmaceutical composition comprises 3.6-3.7 mM succinate (e.g., as sodium succinate) or a salt thereof. In certain embodiments, the pharmaceutical composition comprises 0.5 mg/ml poly I: poly C. In certain embodiments, the pharmaceutical composition comprises 0.375 mg/ml poly-L-Lysine. In certain embodiments, the pharmaceutical composition comprises 1.25 mg/ml sodium carboxymethylcellulose. In certain embodiments, the pharmaceutical composition comprises 0.225% sodium chloride.

Pharmaceutical compositions comprise the herein-described tumor specific neoantigenic peptides in a therapeutically effective amount for treating diseases and conditions (e.g., a neoplasia/tumor), which have been described herein, optionally in combination with a pharmaceutically acceptable additive, carrier and/or excipient. One of ordinary skill in the art from this disclosure and the knowledge in the art will recognize that a therapeutically effective amount of one of more compounds according to the present invention may vary with the condition to be treated, its severity, the treatment regimen to be employed, the pharmacokinetics of the agent used, as well as the patient (animal or human) treated.

To prepare the pharmaceutical compositions according to the present invention, a therapeutically effective amount of one or more of the compounds according to the present invention is preferably intimately admixed with a pharmaceutically acceptable carrier according to conventional pharmaceutical compounding techniques to produce a dose. A carrier may take a wide variety of forms depending on the form of preparation desired for administration, e.g., ocular, oral, topical or parenteral, including gels, creams ointments, lotions and time released implantable preparations, among numerous others. In preparing pharmaceutical compositions in oral dosage form, any of the usual pharmaceutical media may be used. Thus, for liquid oral preparations such as suspensions, elixirs and solutions, suitable carriers and additives including water, glycols, oils, alcohols, flavoring agents, preservatives, coloring agents and the like may be used. For solid oral preparations such as powders, tablets, capsules, and for solid preparations such as suppositories, suitable carriers and additives including starches, sugar carriers, such as dextrose, mannitol, lactose and related carriers, diluents, granulating agents, lubricants, binders, disintegrating agents and the like may be used. If desired, the tablets or capsules may be enteric-coated or sustained release by standard techniques.

The active compound is included in the pharmaceutically acceptable carrier or diluent in an amount sufficient to deliver to a patient a therapeutically effective amount for the desired indication, without causing serious toxic effects in the patient treated.

Oral compositions generally include an inert diluent or an edible carrier. They may be enclosed in gelatin capsules or compressed into tablets. For the purpose of oral therapeutic administration, the active compound or its prodrug derivative can be incorporated with excipients and used in the form of tablets, troches, or capsules. Pharmaceutically compatible binding agents, and/or adjuvant materials can be included as part of the composition.

The tablets, pills, capsules, troches and the like can contain any of the following ingredients, or compounds of a similar nature: a binder such as microcrystalline cellulose, gum tragacanth or gelatin; an excipient such as starch or lactose, a dispersing agent such as alginic acid or corn starch; a lubricant such as magnesium stearate; a glidant such as colloidal silicon dioxide; a sweetening agent such as sucrose or saccharin; or a flavoring agent such as peppermint, methyl salicylate, or orange flavoring. When the dosage unit form is a capsule, it can contain, in addition to material herein discussed, a liquid carrier such as a fatty oil. In addition, dosage unit forms can contain various other materials which modify the physical form of the dosage unit, for example, coatings of sugar, shellac, or enteric agents.

Formulations of the present invention suitable for oral administration may be presented as discrete units such as capsules, cachets or tablets each containing a predetermined amount of the active ingredient as a powder or granules; as a solution or a suspension in an aqueous liquid or a non-aqueous liquid; or as an oil-in-water liquid emulsion or a water-in-oil emulsion and as a bolus, etc.

A tablet may be made by compression or molding, optionally with one or more accessory ingredients. Compressed tablets may be prepared by compressing in a suitable machine the active ingredient in a free-flowing form such as a powder or granules, optionally mixed with a binder, lubricant, inert diluent, preservative, surface-active or dispersing agent. Molded tablets may be made by molding in a suitable machine a mixture of the powdered compound moistened with an inert liquid diluent. The tablets optionally may be coated or scored and may be formulated so as to provide slow or controlled release of the active ingredient therein.

Methods of formulating such slow or controlled release compositions of pharmaceutically active ingredients, are known in the art and described in several issued US patents, some of which include, but are not limited to, U.S. Pat. Nos. 3,870,790; 4,226,859; 4,369,172; 4,842,866 and 5,705,190, the disclosures of which are incorporated herein by reference in their entireties. Coatings can be used for delivery of compounds to the intestine (see, e.g., U.S. Pat. Nos. 6,638,534, 5,541,171, 5,217,720, and 6,569,457, and references cited therein).

The active compound or pharmaceutically acceptable salt thereof may also be administered as a component of an elixir, suspension, syrup, wafer, chewing gum or the like. A syrup may contain, in addition to the active compounds, sucrose or fructose as a sweetening agent and certain preservatives, dyes and colorings and flavors.

Solutions or suspensions used for ocular, parenteral, intradermal, subcutaneous, or topical application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates; and agents for the adjustment of tonicity such as sodium chloride or dextrose.

In certain embodiments, the pharmaceutically acceptable carrier is an aqueous solvent, i.e., a solvent comprising water, optionally with additional co-solvents. Exemplary pharmaceutically acceptable carriers include water, buffer solutions in water (such as phosphate-buffered saline (PBS), and 5% dextrose in water (D5W). In certain embodiments, the aqueous solvent further comprises dimethyl sulfoxide (DMSO), e.g., in an amount of about 1-4%, or 1-3%. In certain embodiments, the pharmaceutically acceptable carrier is isotonic (i.e., has substantially the same osmotic pressure as a body fluid such as plasma).

In one embodiment, the active compounds are prepared with carriers that protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid, and polylactic-co-glycolic acid (PLGA). Methods for preparation of such formulations are within the ambit of the skilled artisan in view of this disclosure and the knowledge in the art.

A skilled artisan from this disclosure and the knowledge in the art recognizes that in addition to tablets, other dosage forms can be formulated to provide slow or controlled release of the active ingredient. Such dosage forms include, but are not limited to, capsules, granulations and gel-caps.

Liposomal suspensions may also be pharmaceutically acceptable carriers. These may be prepared according to methods known to those skilled in the art. For example, liposomal formulations may be prepared by dissolving appropriate lipid(s) in an inorganic solvent that is then evaporated, leaving behind a thin film of dried lipid on the surface of the container. An aqueous solution of the active compound are then introduced into the container. The container is then swirled by hand to free lipid material from the sides of the container and to disperse lipid aggregates, thereby forming the liposomal suspension. Other methods of preparation well known by those of ordinary skill may also be used in this aspect of the present invention.

The formulations may conveniently be presented in unit dosage form and may be prepared by conventional pharmaceutical techniques. Such techniques include the step of bringing into association the active ingredient and the pharmaceutical carrier(s) or excipient(s). In general, the formulations are prepared by uniformly and intimately bringing into association the active ingredient with liquid carriers or finely divided solid carriers or both, and then, if necessary, shaping the product.

Formulations and compositions suitable for topical administration in the mouth include lozenges comprising the ingredients in a flavored basis, usually sucrose and acacia or tragacanth; pastilles comprising the active ingredient in an inert basis such as gelatin and glycerin, or sucrose and acacia; and mouthwashes comprising the ingredient to be administered in a suitable liquid carrier.

Formulations suitable for topical administration to the skin may be presented as ointments, creams, gels and pastes comprising the ingredient to be administered in a pharmaceutical acceptable carrier. A preferred topical delivery system is a transdermal patch containing the ingredient to be administered.

Formulations for rectal administration may be presented as a suppository with a suitable base comprising, for example, cocoa butter or a salicylate.

Formulations suitable for nasal administration, wherein the carrier is a solid, include a coarse powder having a particle size, for example, in the range of 20 to 500 microns which is administered in the manner in which snuff is administered, i.e., by rapid inhalation through the nasal passage from a container of the powder held close up to the nose. Suitable formulations, wherein the carrier is a liquid, for administration, as for example, a nasal spray or as nasal drops, include aqueous or oily solutions of the active ingredient.

Formulations suitable for vaginal administration may be presented as pessaries, tampons, creams, gels, pastes, foams or spray formulations containing in addition to the active ingredient such carriers as are known in the art to be appropriate.

The parenteral preparation can be enclosed in ampoules, disposable syringes or multiple dose vials made of glass or plastic. If administered intravenously, preferred carriers include, for example, physiological saline or phosphate buffered saline (PBS).

For parenteral formulations, the carrier usually comprises sterile water or aqueous sodium chloride solution, though other ingredients including those which aid dispersion may be included. Of course, where sterile water is to be used and maintained as sterile, the compositions and carriers are also sterilized. Injectable suspensions may also be prepared, in which case appropriate liquid carriers, suspending agents and the like may be employed.

Formulations suitable for parenteral administration include aqueous and non-aqueous sterile injection solutions which may contain antioxidants, buffers, bacteriostats and solutes which render the formulation isotonic with the blood of the intended recipient; and aqueous and non-aqueous sterile suspensions which may include suspending agents and thickening agents. The formulations may be presented in unit-dose or multi-dose containers, for example, sealed ampules and vials, and may be stored in a freeze-dried (lyophilized) condition requiring only the addition of the sterile liquid carrier, for example, water for injections, immediately prior to use. Extemporaneous injection solutions and suspensions may be prepared from sterile powders, granules and tablets of the kind previously described.

Administration of the active compound may range from continuous (intravenous drip) to several oral administrations per day (for example, Q.I.D.) and may include oral, topical, eye or ocular, parenteral, intramuscular, intravenous, subcutaneous, transdermal (which may include a penetration enhancement agent), buccal and suppository administration, among other routes of administration, including through an eye or ocular route.

The neoplasia vaccine or immunogenic composition, and any additional agents, may be administered by injection, orally, parenterally, by inhalation spray, rectally, vaginally, or topically in dosage unit formulations containing conventional pharmaceutically acceptable carriers, adjuvants, and vehicles. The term parenteral as used herein includes, into a lymph node or nodes, subcutaneous, intravenous, intramuscular, intrasternal, infusion techniques, intraperitoneally, eye or ocular, intravitreal, intrabuccal, transdermal, intranasal, into the brain, including intracranial and intradural, into the joints, including ankles, knees, hips, shoulders, elbows, wrists, directly into tumors, and the like, and in suppository form.

In certain embodiments, the vaccine or immunogenic composition is administered intravenously or subcutaneously. Various techniques can be used for providing the subject compositions at the site of interest, such as injection, use of catheters, trocars, projectiles, pluronic gel, stents, sustained drug release polymers or other device which provides for internal access. Where an organ or tissue is accessible because of removal from the patient, such organ or tissue may be bathed in a medium containing the subject compositions, the subject compositions may be painted onto the organ, or may be applied in any convenient way.

The tumor specific neoantigenic peptides may be administered through a device suitable for the controlled and sustained release of a composition effective in obtaining a desired local or systemic physiological or pharmacological effect. The method includes positioning the sustained released drug delivery system at an area wherein release of the agent is desired and allowing the agent to pass through the device to the desired area of treatment.

The tumor specific neoantigenic peptides may be utilized in combination with at least one known other therapeutic agent, or a pharmaceutically acceptable salt of said agent. Examples of known therapeutic agents which can be used for combination therapy include, but are not limited to, corticosteroids (e.g., cortisone, prednisone, dexamethasone), non-steroidal anti-inflammatory drugs (NSAIDS) (e.g., ibuprofen, celecoxib, aspirin, indomethicin, naproxen), alkylating agents such as busulfan, cis-platin, mitomycin C, and carboplatin; antimitotic agents such as colchicine, vinblastine, paclitaxel, and docetaxel; topo I inhibitors such as camptothecin and topotecan; topo II inhibitors such as doxorubicin and etoposide; and/or RNA/DNA antimetabolites such as 5-azacytidine, 5-fluorouracil and methotrexate; DNA antimetabolites such as 5-fluoro-2'-deoxy-uridine, ara-C, hydroxyurea and thioguanine; antibodies such as HERCEPTIN and RITUXAN.

It should be understood that in addition to the ingredients particularly mentioned herein, the formulations of the present invention may include other agents conventional in the art having regard to the type of formulation in question, for example, those suitable for oral administration may include flavoring agents.

Pharmaceutically acceptable salt forms may be the preferred chemical form of compounds according to the present invention for inclusion in pharmaceutical compositions according to the present invention.

The present compounds or their derivatives, including prodrug forms of these agents, can be provided in the form of pharmaceutically acceptable salts. As used herein, the term pharmaceutically acceptable salts or complexes refers to appropriate salts or complexes of the active compounds according to the present invention which retain the desired biological activity of the parent compound and exhibit limited toxicological effects to normal cells. Nonlimiting examples of such salts are (a) acid addition salts formed with inorganic acids (for example, hydrochloric acid, hydrobromic acid, sulfuric acid, phosphoric acid, nitric acid, and the like), and salts formed with organic acids such as acetic acid, oxalic acid, tartaric acid, succinic acid, malic acid, ascorbic acid, benzoic acid, tannic acid, pamoic acid, alginic acid, and polyglutamic acid, among others; (b) base addition salts formed with metal cations such as zinc, calcium, sodium, potassium, and the like, among numerous others.

The compounds herein are commercially available or can be synthesized. As can be appreciated by the skilled artisan, further methods of synthesizing the compounds of the formulae herein is evident to those of ordinary skill in the art. Additionally, the various synthetic steps may be performed in an alternate sequence or order to give the desired compounds. Synthetic chemistry transformations and protecting group methodologies (protection and deprotection) useful in synthesizing the compounds described herein are known in the art and include, for example, those such as described in R. Larock, Comprehensive Organic Transformations, 2nd. Ed., Wiley-VCH Publishers (1999); T. W. Greene and P. G. M. Wuts, Protective Groups in Organic Synthesis, 3rd. Ed., John Wiley and Sons (1999); L. Fieser and M. Fieser, Fieser and Fieser's Reagents for Organic Synthesis, John Wiley and Sons (1999); and L. Paquette, ed., Encyclopedia of Reagents for Organic Synthesis, John Wiley and Sons (1995), and subsequent editions thereof.

The additional agents that may be included with the tumor specific neo-antigenic peptides of this invention may contain one or more asymmetric centers and thus occur as racemates and racemic mixtures, single enantiomers, individual diastereomers and diastereomeric mixtures. All such isomeric forms of these compounds are expressly included in the present invention. The compounds of this invention may also be represented in multiple tautomeric forms, in such instances, the invention expressly includes all tautomeric forms of the compounds described herein (e.g., alkylation of a ring system may result in alkylation at multiple sites, the invention expressly includes all such reaction products). All such isomeric forms of such compounds are expressly included in the present invention. All crystal forms of the compounds described herein are expressly included in the present invention.

Dosage

When the agents described herein are administered as pharmaceuticals to humans or animals, they can be given per se or as a pharmaceutical composition containing active ingredient in combination with a pharmaceutically acceptable carrier, excipient, or diluent.

Actual dosage levels and time course of administration of the active ingredients in the pharmaceutical compositions of the invention can be varied so as to obtain an amount of the active ingredient which is effective to achieve the desired therapeutic response for a particular patient, composition, and mode of administration, without being toxic to the patient. Generally, agents or pharmaceutical compositions of the invention are administered in an amount sufficient to reduce or eliminate symptoms associated with neoplasia, e.g. cancer or tumors.

A preferred dose of an agent is the maximum that a patient can tolerate and not develop serious or unacceptable side effects. Exemplary dose ranges include 0.01 mg to 250 mg per day, 0.01 mg to 100 mg per day, 1 mg to 100 mg per day, 10 mg to 100 mg per day, 1 mg to 10 mg per day, and 0.01 mg to 10 mg per day. A preferred dose of an agent is the maximum that a patient can tolerate and not develop serious or unacceptable side effects. In embodiments, the agent is administered at a concentration of about 10 micrograms to about 100 mg per kilogram of body weight per day, about 0.1 to about 10 mg/kg per day, or about 1.0 mg to about 10 mg/kg of body weight per day.

In embodiments, the pharmaceutical composition comprises an agent in an amount ranging between 1 and 10 mg, such as 1, 2, 3, 4, 5, 6, 7, 8, 9, or 10 mg.

In embodiments, the therapeutically effective dosage produces a serum concentration of an agent of from about 0.1 ng/ml to about 50-100 mg/ml. The pharmaceutical compositions 5 typically should provide a dosage of from about 0.001 mg to about 2000 mg of compound per kilogram of body weight per day. For example, dosages for systemic administration to a human patient can range from 1-10 mg/kg, 20-80 mg/kg, 5-50 mg/kg, 75-150 mg/kg, 100-500 mg/kg, 250-750 mg/kg, 500-1000 mg/kg, 1-10 mg/kg, 5-50 mg/kg, 25-75 mg/kg, 50-100 mg/kg, 100-250 mg/kg, 50-100 mg/kg, 250-500 mg/kg, 500-750 mg/kg, 750-1000 mg/kg, 1000-1500 mg/kg, 10 1500-2000 mg/kg, 5 mg/kg, 20 mg/kg, 50 mg/kg, 100 mg/kg, 500 mg/kg, 1000 mg/kg, 1500 mg/kg, or 2000 mg/kg. Pharmaceutical dosage unit forms are prepared to provide from about 1 mg to about 5000 mg, for example from about 100 to about 2500 mg of the compound or a combination of essential ingredients per dosage unit form.

In embodiments, about 50 nM to about 1 µM of an agent is administered to a subject. In related embodiments, about 50-100 nM, 50-250 nM, 100-500 nM, 250-500 nM, 250-750 nM, 500-750 nM, 500 nM to 1 µM, or 750 nM to 1 µM of an agent is administered to a subject.

Determination of an effective amount is well within the capability of those skilled in the art, especially in light of the detailed disclosure provided herein. Generally, an efficacious or effective amount of an agent is determined by first administering a low dose of the agent(s) and then incrementally increasing the administered dose or dosages until a desired effect (e.g., reduce or eliminate symptoms associated with viral infection or autoimmune disease) is observed in the treated subject, with minimal or acceptable toxic side effects. Applicable methods for determining an appropriate dose and dosing schedule for administration of a pharmaceutical composition of the present invention are described, for example, in Goodman and Gilman's The Pharmacological Basis of Therapeutics, Goodman et al., eds., 11th Edition, McGraw-Hill 2005, and Remington: The Science and Practice of Pharmacy, 20th and 21st Editions, Gennaro and University of the Sciences in Philadelphia, Eds., Lippencott Williams & Wilkins (2003 and 2005), each of which is hereby incorporated by reference.

Preferred unit dosage formulations are those containing a daily dose or unit, daily sub-dose, as herein discussed, or an appropriate fraction thereof, of the administered ingredient.

The dosage regimen for treating a disorder or a disease with the tumor specific neoantigenic peptides of this invention and/or compositions of this invention is based on a variety of factors, including the type of disease, the age, weight, sex, medical condition of the patient, the severity of the condition, the route of administration, and the particular compound employed. Thus, the dosage regimen may vary widely, but can be determined routinely using standard methods.

The amounts and dosage regimens administered to a subject can depend on a number of factors, such as the mode of administration, the nature of the condition being treated, the body weight of the subject being treated and the judgment of the prescribing physician; all such factors being within the ambit of the skilled artisan from this disclosure and the knowledge in the art.

The amount of compound included within therapeutically active formulations according to the present invention is an effective amount for treating the disease or condition. In general, a therapeutically effective amount of the present preferred compound in dosage form usually ranges from slightly less than about 0.025 mg/kg/day to about 2.5 g/kg/day, preferably about 0.1 mg/kg/day to about 100 mg/kg/day of the patient or considerably more, depending upon the compound used, the condition or infection treated and the route of administration, although exceptions to this dosage range may be contemplated by the present invention. In its most preferred form, compounds according to the present invention are administered in amounts ranging from about 1 mg/kg/day to about 100 mg/kg/day. The dosage of the compound can depend on the condition being treated, the particular compound, and other clinical factors such as weight and condition of the patient and the route of administration of the compound. It is to be understood that the present invention has application for both human and veterinary use.

For oral administration to humans, a dosage of between approximately 0.1 to 100 mg/kg/day, preferably between approximately 1 and 100 mg/kg/day, is generally sufficient.

Where drug delivery is systemic rather than topical, this dosage range generally produces effective blood level concentrations of active compound ranging from less than about 0.04 to about 400 micrograms/cc or more of blood in the patient. The compound is conveniently administered in any suitable unit dosage form, including but not limited to one containing 0.001 to 3000 mg, preferably 0.05 to 500 mg of active ingredient per unit dosage form. An oral dosage of 10-250 mg is usually convenient.

According to certain exemplary embodiments, the vaccine or immunogenic composition is administered at a dose of about 10 µg to 1 mg per neoantigenic peptide. According to certain exemplary embodiments, the vaccine or immunogenic composition is administered at an average weekly dose level of about 10 µg to 2000 µg per neoantigenic peptide.

The concentration of active compound in the drug composition will depend on absorption, distribution, inactivation, and excretion rates of the drug as well as other factors known to those of skill in the art. It is to be noted that dosage values will also vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or practice of the claimed composition. The active ingredient may be administered at once, or may be divided into a number of smaller doses to be administered at varying intervals of time.

The invention provides for pharmaceutical compositions containing at least one tumor specific neoantigen described herein. In embodiments, the pharmaceutical compositions contain a pharmaceutically acceptable carrier, excipient, or diluent, which includes any pharmaceutical agent that does not itself induce the production of an immune response harmful to a subject receiving the composition, and which may be administered without undue toxicity. As used herein, the term "pharmaceutically acceptable" means being approved by a regulatory agency of the Federal or a state government or listed in the U.S. Pharmacopia, European Pharmacopia or other generally recognized pharmacopia for use in mammals, and more particularly in humans. These compositions can be useful for treating and/or preventing viral infection and/or autoimmune disease.

A thorough discussion of pharmaceutically acceptable carriers, diluents, and other excipients is presented in Remington's Pharmaceutical Sciences (17th ed., Mack Publishing Company) and Remington: The Science and Practice of Pharmacy (21st ed., Lippincott Williams & Wilkins), which are hereby incorporated by reference. The formulation of the pharmaceutical composition should suit the mode of administration. In embodiments, the pharmaceutical composition is suitable for administration to humans, and can be sterile, non-particulate and/or non-pyrogenic.

Pharmaceutically acceptable carriers, excipients, or diluents include, but are not limited to, saline, buffered saline, dextrose, water, glycerol, ethanol, sterile isotonic aqueous buffer, and combinations thereof.

Wetting agents, emulsifiers and lubricants, such as sodium lauryl sulfate and magnesium stearate, as well as coloring agents, release agents, coating agents, sweetening, flavoring and perfuming agents, preservatives, and antioxidants can also be present in the compositions.

Examples of pharmaceutically-acceptable antioxidants include, but are not limited to: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

In embodiments, the pharmaceutical composition is provided in a solid form, such as a lyophilized powder suitable for reconstitution, a liquid solution, suspension, emulsion, tablet, pill, capsule, sustained release formulation, or powder.

In embodiments, the pharmaceutical composition is supplied in liquid form, for example, in a sealed container indicating the quantity and concentration of the active ingredient in the pharmaceutical composition. In related embodiments, the liquid form of the pharmaceutical composition is supplied in a hermetically sealed container.

Methods for formulating the pharmaceutical compositions of the present invention are conventional and well known in the art (see Remington and Remington's). One of skill in the art can readily formulate a pharmaceutical composition having the desired characteristics (e.g., route of administration, biosafety, and release profile).

Methods for preparing the pharmaceutical compositions include the step of bringing into association the active ingredient with a pharmaceutically acceptable carrier and, optionally, one or more accessory ingredients. The pharmaceutical compositions can be prepared by uniformly and intimately bringing into association the active ingredient with liquid carriers, or finely divided solid carriers, or both, and then, if necessary, shaping the product. Additional methodology for preparing the pharmaceutical compositions, including the preparation of multilayer dosage forms, are described in Ansel's Pharmaceutical Dosage Forms and Drug Delivery Systems (9th ed., Lippincott Williams & Wilkins), which is hereby incorporated by reference.

Pharmaceutical compositions suitable for oral administration can be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouth washes and the like, each containing a predetermined amount of a compound(s) described herein, a derivative thereof, or a pharmaceutically acceptable salt or prodrug thereof as the active ingredient(s). The active ingredient can also be administered as a bolus, electuary, or paste.

In solid dosage forms for oral administration (e.g., capsules, tablets, pills, dragees, powders, granules and the like), the active ingredient is mixed with one or more pharmaceutically acceptable carriers, excipients, or diluents, such as sodium citrate or dicalcium phosphate, and/or any of the following: (1) fillers or extenders, such as starches, lactose, sucrose, glucose, mannitol, and/or silicic acid; (2) binders, such as, for example, carboxymethylcellulose, alginates, gelatin, polyvinyl pyrrolidone, sucrose and/or acacia; (3) humectants, such as glycerol; (4) disintegrating agents, such as agar-agar, calcium carbonate, potato or tapioca starch, alginic acid, certain silicates, and sodium carbonate; (5) solution retarding agents, such as paraffin; (6) absorption accelerators, such as quaternary ammonium compounds; (7) wetting agents, such as, for example, acetyl alcohol and glycerol monostearate; (8) absorbents, such as kaolin and bentonite clay; (9) lubricants, such a talc, calcium stearate, magnesium stearate, solid polyethylene glycols, sodium lauryl sulfate, and mixtures thereof; and (10) coloring agents. In the case of capsules, tablets, and pills, the pharmaceutical compositions can also comprise buffering agents. Solid compositions of a similar type can also be prepared using fillers in soft and hard-filled gelatin capsules, and excipients such as lactose or milk sugars, as well as high molecular weight polyethylene glycols and the like.

A tablet can be made by compression or molding, optionally with one or more accessory ingredients. Compressed tablets can be prepared using binders (for example, gelatin or hydroxypropylmethyl cellulose), lubricants, inert diluents, preservatives, disintegrants (for example, sodium starch glycolate or cross-linked sodium carboxymethyl cellulose), surface-actives, and/or dispersing agents. Molded tablets can be made by molding in a suitable machine a mixture of the powdered active ingredient moistened with an inert liquid diluent.

The tablets and other solid dosage forms, such as dragees, capsules, pills, and granules, can optionally be scored or prepared with coatings and shells, such as enteric coatings and other coatings well known in the art.

In some embodiments, in order to prolong the effect of an active ingredient, it is desirable to slow the absorption of the compound from subcutaneous or intramuscular injection. This can be accomplished by the use of a liquid suspension of crystalline or amorphous material having poor water solubility. The rate of absorption of the active ingredient then depends upon its rate of dissolution which, in turn, can depend upon crystal size and crystalline form. Alternatively, delayed absorption of a parenterally-administered active ingredient is accomplished by dissolving or suspending the compound in an oil vehicle. In addition, prolonged absorption of the injectable pharmaceutical form can be brought about by the inclusion of agents that delay absorption such as aluminum monostearate and gelatin.

Controlled release parenteral compositions can be in form of aqueous suspensions, microspheres, microcapsules, magnetic microspheres, oil solutions, oil suspensions, emulsions, or the active ingredient can be incorporated in biocompatible carrier(s), liposomes, nanoparticles, implants or infusion devices.

Materials for use in the preparation of microspheres and/or microcapsules include biodegradable/bioerodible polymers such as polyglactin, poly-(isobutyl cyanoacrylate), poly(2-hydroxyethyl-L-glutamine) and poly(lactic acid).

Biocompatible carriers which can be used when formulating a controlled release parenteral formulation include carbohydrates such as dextrans, proteins such as albumin, lipoproteins or antibodies.

Materials for use in implants can be non-biodegradable, e.g., polydimethylsiloxane, or biodegradable such as, e.g., poly(caprolactone), poly(lactic acid), poly(glycolic acid) or poly(ortho esters).

In embodiments, the active ingredient(s) are administered by aerosol. This is accomplished by preparing an aqueous aerosol, liposomal preparation, or solid particles containing the compound. A nonaqueous (e.g., fluorocarbon propellant) suspension can be used. The pharmaceutical composition can also be administered using a sonic nebulizer, which would minimize exposing the agent to shear, which can result in degradation of the compound.

Ordinarily, an aqueous aerosol is made by formulating an aqueous solution or suspension of the active ingredient(s) together with conventional pharmaceutically-acceptable carriers and stabilizers. The carriers and stabilizers vary with the requirements of the particular compound, but typically include nonionic surfactants (Tweens, Pluronics, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

Dosage forms for topical or transdermal administration of an active ingredient(s) includes powders, sprays, ointments, pastes, creams, lotions, gels, solutions, patches and inhalants. The active ingredient(s) can be mixed under sterile conditions with a pharmaceutically acceptable carrier, and with any preservatives, buffers, or propellants as appropriate.

Transdermal patches suitable for use in the present invention are disclosed in Transdermal Drug Delivery: Developmental Issues and Research Initiatives (Marcel Dekker Inc., 1989) and U.S. Pat. Nos. 4,743,249, 4,906,169, 5,198,223, 4,816,540, 5,422,119, 5,023,084, which are hereby incorporated by reference. The transdermal patch can also be any transdermal patch well known in the art, including transscrotal patches. Pharmaceutical compositions in such transdermal patches can contain one or more absorption enhancers or skin permeation enhancers well known in the art (see, e.g., U.S. Pat. Nos. 4,379,454 and 4,973,468, which are hereby incorporated by reference). Transdermal therapeutic systems for use in the present invention can be based on iontophoresis, diffusion, or a combination of these two effects.

Transdermal patches have the added advantage of providing controlled delivery of active ingredient(s) to the body. Such dosage forms can be made by dissolving or dispersing the active ingredient(s) in a proper medium. Absorption enhancers can also be used to increase the flux of the active ingredient across the skin. The rate of such flux can be controlled by either providing a rate controlling membrane or dispersing the active ingredient(s) in a polymer matrix or gel.

Such pharmaceutical compositions can be in the form of creams, ointments, lotions, liniments, gels, hydrogels, solutions, suspensions, sticks, sprays, pastes, plasters and other kinds of transdermal drug delivery systems. The compositions can also include pharmaceutically acceptable carriers or excipients such as emulsifying agents, antioxidants, buffering agents, preservatives, humectants, penetration enhancers, chelating agents, gel-forming agents, ointment bases, perfumes, and skin protective agents.

Examples of emulsifying agents include, but are not limited to, naturally occurring gums, e.g. gum acacia or gum tragacanth, naturally occurring phosphatides, e.g. soybean lecithin and sorbitan monooleate derivatives.

Examples of antioxidants include, but are not limited to, butylated hydroxy anisole (BHA), ascorbic acid and derivatives thereof, tocopherol and derivatives thereof, and cysteine.

Examples of preservatives include, but are not limited to, parabens, such as methyl or propyl p-hydroxybenzoate and benzalkonium chloride.

Examples of humectants include, but are not limited to, glycerin, propylene glycol, sorbitol and urea.

Examples of penetration enhancers include, but are not limited to, propylene glycol, DMSO, triethanolamine, N,N-dimethylacetamide, N,N-dimethylformamide, 2-pyrrolidone and derivatives thereof, tetrahydrofurfuryl alcohol, propylene glycol, diethylene glycol monoethyl or monomethyl ether with propylene glycol monolaurate or methyl laurate, eucalyptol, lecithin, TRANSCUTOL, and AZONE.

Examples of chelating agents include, but are not limited to, sodium EDTA, citric acid and phosphoric acid.

Examples of gel forming agents include, but are not limited to, Carbopol, cellulose derivatives, bentonite, alginates, gelatin and polyvinylpyrrolidone.

In addition to the active ingredient(s), the ointments, pastes, creams, and gels of the present invention can contain excipients, such as animal and vegetable fats, oils, waxes, paraffins, starch, tragacanth, cellulose derivatives, polyethylene glycols, silicones, bentonites, silicic acid, talc and zinc oxide, or mixtures thereof.

Powders and sprays can contain excipients such as lactose, talc, silicic acid, aluminum hydroxide, calcium silicates and polyamide powder, or mixtures of these substances. Sprays can additionally contain customary propellants, such as chlorofluorohydrocarbons, and volatile unsubstituted hydrocarbons, such as butane and propane.

Injectable depot forms are made by forming microencapsule matrices of compound(s) of the invention in biodegradable polymers such as polylactide-polyglycolide. Depending on the ratio of compound to polymer, and the nature of the particular polymer employed, the rate of compound release can be controlled. Examples of other biodegradable polymers include poly(orthoesters) and poly(anhydrides). Depot injectable formulations are also prepared by entrapping the drug in liposomes or microemulsions which are compatible with body tissue.

Subcutaneous implants are well known in the art and are suitable for use in the present invention. Subcutaneous implantation methods are preferably non-irritating and mechanically resilient. The implants can be of matrix type, of reservoir type, or hybrids thereof. In matrix type devices, the carrier material can be porous or non-porous, solid or semi-solid, and permeable or impermeable to the active compound or compounds. The carrier material can be biodegradable or may slowly erode after administration. In some instances, the matrix is non-degradable but instead relies on the diffusion of the active compound through the matrix for the carrier material to degrade. Alternative subcutaneous implant methods utilize reservoir devices where the active compound or compounds are surrounded by a rate controlling membrane, e.g., a membrane independent of component concentration (possessing zero-order kinetics). Devices consisting of a matrix surrounded by a rate controlling membrane also suitable for use.

Both reservoir and matrix type devices can contain materials such as polydimethylsiloxane, such as SILASTIC, or other silicone rubbers. Matrix materials can be insoluble polypropylene, polyethylene, polyvinyl chloride, ethylvinyl acetate, polystyrene and polymethacrylate, as well as glycerol esters of the glycerol palmitostearate, glycerol stearate, and glycerol behenate type. Materials can be hydrophobic or hydrophilic polymers and optionally contain solubilizing agents.

Subcutaneous implant devices can be slow-release capsules made with any suitable polymer, e.g., as described in U.S. Pat. Nos. 5,035,891 and 4,210,644, which are hereby incorporated by reference.

In general, at least four different approaches are applicable in order to provide rate control over the release and transdermal permeation of a drug compound. These approaches are: membrane-moderated systems, adhesive diffusion-controlled systems, matrix dispersion-type systems and microreservoir systems. It is appreciated that a controlled release percutaneous and/or topical composition can be obtained by using a suitable mixture of these approaches.

In a membrane-moderated system, the active ingredient is present in a reservoir which is totally encapsulated in a shallow compartment molded from a drug-impermeable laminate, such as a metallic plastic laminate, and a rate-controlling polymeric membrane such as a microporous or a non-porous polymeric membrane, e.g., ethylene-vinyl acetate copolymer. The active ingredient is released through the rate controlling polymeric membrane. In the drug reservoir, the active ingredient can either be dispersed in a solid polymer matrix or suspended in an unleachable, viscous liquid medium such as silicone fluid. On the external surface of the polymeric membrane, a thin layer of an adhesive polymer is applied to achieve an intimate contact of the transdermal system with the skin surface. The adhesive polymer is preferably a polymer which is hypoallergenic and compatible with the active drug substance.

In an adhesive diffusion-controlled system, a reservoir of the active ingredient is formed by directly dispersing the active ingredient in an adhesive polymer and then by, e.g., solvent casting, spreading the adhesive containing the active ingredient onto a flat sheet of substantially drug-impermeable metallic plastic backing to form a thin drug reservoir layer.

A matrix dispersion-type system is characterized in that a reservoir of the active ingredient is formed by substantially homogeneously dispersing the active ingredient in a hydrophilic or lipophilic polymer matrix. The drug-containing polymer is then molded into disc with a substantially well-defined surface area and controlled thickness. The adhesive polymer is spread along the circumference to form a strip of adhesive around the disc.

A microreservoir system can be considered as a combination of the reservoir and matrix dispersion type systems. In this case, the reservoir of the active substance is formed by first suspending the drug solids in an aqueous solution of water-soluble polymer and then dispersing the drug suspension in a lipophilic polymer to form a multiplicity of unleachable, microscopic spheres of drug reservoirs.

Any of the herein-described controlled release, extended release, and sustained release compositions can be formulated to release the active ingredient in about 30 minutes to about 1 week, in about 30 minutes to about 72 hours, in about 30 minutes to 24 hours, in about 30 minutes to 12 hours, in about 30 minutes to 6 hours, in about 30 minutes to 4 hours, and in about 3 hours to 10 hours. In embodiments, an effective concentration of the active ingredient(s) is sustained in a subject for 4 hours, 6 hours, 8 hours, 10 hours, 12 hours, 16 hours, 24 hours, 48 hours, 72 hours, or more after administration of the pharmaceutical compositions to the subject.

Vaccine or Immunogenic Compositions

The present invention is directed in some aspects to pharmaceutical compositions suitable for the prevention or treatment of cancer. In one embodiment, the composition comprises at least an immunogenic composition, e.g., a neoplasia vaccine or immunogenic composition capable of raising a specific T-cell response. The neoplasia vaccine or immunogenic composition comprises neoantigenic peptides and/or neoantigenic polypeptides corresponding to tumor specific neoantigens as described herein.

A suitable neoplasia vaccine or immunogenic composition can preferably contain a plurality of tumor specific neoantigenic peptides. In an embodiment, the vaccine or immunogenic composition can include between 1 and 100 sets of peptides, more preferably between 1 and 50 such peptides, even more preferably between 10 and 30 sets peptides, even more preferably between 15 and 25 peptides. According to another preferred embodiment, the vaccine or immunogenic composition can include at least one peptides, more preferably 2, 3, 4, or 5 peptides, In certain embodiments, the vaccine or immunogenic composition can comprise 5, 6, 7, 8, 9, 10, 11, 12, 13, 14, 15, 16, 17, 18, 19, 20, 21, 22, 23, 24, 25, 26, 27, 28, 29, or 30 different peptides.

The optimum amount of each peptide to be included in the vaccine or immunogenic composition and the optimum dosing regimen can be determined by one skilled in the art without undue experimentation. For example, the peptide or its variant may be prepared for intravenous (i.v.) injection, sub-cutaneous (s.c.) injection, intradermal (i.d.) injection, intraperitoneal (i.p.) injection, intramuscular (i.m.) injection. Preferred methods of peptide injection include s.c, i.d., i.p., i.m., and i.v. Preferred methods of DNA injection include i.d., i.m., s.c, i.p. and i.v. For example, doses of between 1 and 500 mg 50 µg and 1.5 mg, preferably 10 µg to 500 µg, of peptide or DNA may be given and can depend from the respective peptide or DNA. Doses of this range were successfully used in previous trials (Brunsvig P F, et al., Cancer Immunol Immunother. 2006; 55(12): 1553-1564; M. Staehler, et al., ASCO meeting 2007; Abstract No 3017). Other methods of administration of the vaccine or immunogenic composition are known to those skilled in the art.

In one embodiment of the present invention the different tumor specific neoantigenic peptides and/or polypeptides are selected for use in the neoplasia vaccine or immunogenic composition so as to maximize the likelihood of generating an immune attack against the neoplasias/tumors in a high proportion of subjects in the population. Without being bound by theory, it is believed that the inclusion of a diversity of tumor specific neoantigenic peptides can generate a broad scale immune attack against a neoplasia/tumor. In one embodiment, the selected tumor specific neoantigenic peptides/polypeptides are encoded by missense mutations. In a second embodiment, the selected tumor specific neoantigenic peptides/polypeptides are encoded by a combination of missense mutations and neoORF mutations. In a third embodiment, the selected tumor specific neoantigenic peptides/polypeptides are encoded by neoORF mutations.

In one embodiment in which the selected tumor specific neoantigenic peptides/polypeptides are encoded by missense mutations, the peptides and/or polypeptides are chosen based on their capability to associate with the MHC molecules of a high proportion of subjects in the population. Peptides/polypeptides derived from neoORF mutations can also be selected on the basis of their capability to associate with the MHC molecules of the patient population.

The vaccine or immunogenic composition is capable of raising a specific cytotoxic T-cells response and/or a specific helper T-cell response.

The vaccine or immunogenic composition can further comprise an adjuvant and/or a carrier. Examples of useful adjuvants and carriers are given herein. The peptides and/or polypeptides in the composition can be associated with a carrier such as, e.g., a protein or an antigen-presenting cell such as e.g. a dendritic cell (DC) capable of presenting the peptide to a T-cell.

Adjuvants are any substance whose admixture into the vaccine or immunogenic composition increases or otherwise modifies the immune response to the mutant peptide. Carriers are scaffold structures, for example a polypeptide or a polysaccharide, to which the neoantigenic peptides, is capable of being associated. Optionally, adjuvants are conjugated covalently or non-covalently to the peptides or polypeptides of the invention.

The ability of an adjuvant to increase the immune response to an antigen is typically manifested by a significant increase in immune-mediated reaction, or reduction in disease symptoms. For example, an increase in humoral immunity is typically manifested by a significant increase in the titer of antibodies raised to the antigen, and an increase in T-cell activity is typically manifested in increased cell proliferation, or cellular cytotoxicity, or cytokine secretion. An adjuvant may also alter an immune response, for example, by changing a primarily humoral or Th2 response into a primarily cellular, or Th1 response.

Suitable adjuvants include, but are not limited to 1018 ISS, aluminum salts, Amplivax, AS15, BCG, CP-870,893, CpG7909, CyaA, dSLIM, GM-CSF, IC30, IC31, Imiquimod, ImuFact IMP321, IS Patch, ISS, ISCOMATRIX, Juvlmmune, LipoVac, MF59, monophosphoryl lipid A, Montanide IMS 1312, Montanide ISA 206, Montanide ISA 50V, Montanide ISA-51, OK-432, OM-174, OM-197-MP-EC, ONTAK, PEPTEL. vector system, PLG microparticles, resiquimod, SRL172, Virosomes and other Virus-like particles, YF-17D, VEGF trap, R848, beta-glucan, Pam3Cys, Aquila's QS21 stimulon (Aquila Biotech, Worcester, Mass., USA) which is derived from saponin, mycobacterial extracts and synthetic bacterial cell wall mimics, and other proprietary adjuvants such as Ribi's Detox. Quil or Superfos. Several immunological adjuvants (e.g., MF59) specific for dendritic cells and their preparation have been described previously (Dupuis M, et al., Cell Immunol. 1998; 186(1): 18-27; Allison A C; Dev Biol Stand. 1998; 92:3-11). Also cytokines may be used. Several cytokines have been directly linked to influencing dendritic cell migration to lymphoid tissues (e.g., TNF-alpha), accelerating the maturation of dendritic cells into efficient antigen-presenting cells for T-lymphocytes (e.g., GM-CSF, IL-1 and IL-4) (U.S. Pat. No. 5,849,589, specifically incorporated herein by reference in its entirety) and acting as immunoadjuvants (e.g., IL-12) (Gabrilovich D I, et al., J Immunother Emphasis Tumor Immunol. 1996 (6):414-418).

Toll like receptors (TLRs) may also be used as adjuvants, and are important members of the family of pattern recognition receptors (PRRs) which recognize conserved motifs shared by many micro-organisms, termed "pathogen-associated molecular patterns" (PAMPS). Recognition of these "danger signals" activates multiple elements of the innate and adaptive immune system. TLRs are expressed by cells of the innate and adaptive immune systems such as dendritic cells (DCs), macrophages, T and B cells, mast cells, and granulocytes and are localized in different cellular compartments, such as the plasma membrane, lysosomes, endosomes, and endolysosomes. Different TLRs recognize distinct PAMPS. For example, TLR4 is activated by LPS contained in bacterial cell walls, TLR9 is activated by unmethylated bacterial or viral CpG DNA, and TLR3 is activated by double stranded RNA. TLR ligand binding leads to the activation of one or more intracellular signaling pathways, ultimately resulting in the production of many key molecules associated with inflammation and immunity (particularly the transcription factor NF-κB and the Type-I interferons). TLR mediated DC activation leads to enhanced DC activation, phagocytosis, upregulation of activation and co-stimulation markers such as CD80, CD83, and CD86, expression of CCR7 allowing migration of DC to draining lymph nodes and facilitating antigen presentation to T cells, as well as increased secretion of cytokines such as type I interferons, IL-12, and IL-6. All of these downstream events are critical for the induction of an adaptive immune response.

Among the most promising cancer vaccine or immunogenic composition adjuvants currently in clinical development are the TLR9 agonist CpG and the synthetic double-stranded RNA (dsRNA) TLR3 ligand poly-ICLC. In preclinical studies poly-ICLC appears to be the most potent TLR adjuvant when compared to LPS and CpG due to its induction of pro-inflammatory cytokines and lack of stimulation of IL-10, as well as maintenance of high levels of co-stimulatory molecules in DCs1. Furthermore, poly-ICLC was recently directly compared to CpG in non-human primates (rhesus macaques) as adjuvant for a protein vaccine or immunogenic composition consisting of human papillomavirus (HPV)16 capsomers (Stahl-Hennig C, Eisenblatter M, Jasny E, et al. Synthetic double-stranded RNAs are adjuvants for the induction of T helper 1 and humoral immune responses to human papillomavirus in rhesus macaques. PLoS pathogens. April 2009; 5(4)).

CpG immuno stimulatory oligonucleotides have also been reported to enhance the effects of adjuvants in a vaccine or immunogenic composition setting. Without being bound by theory, CpG oligonucleotides act by activating the innate (non-adaptive) immune system via Toll-like receptors (TLR), mainly TLR9. CpG triggered TLR9 activation enhances antigen-specific humoral and cellular responses to a wide variety of antigens, including peptide or protein antigens, live or killed viruses, dendritic cell vaccines, autologous cellular vaccines and polysaccharide conjugates in both prophylactic and therapeutic vaccines. More importantly, it enhances dendritic cell maturation and differentiation, resulting in enhanced activation of Th1 cells and strong cytotoxic T-lymphocyte (CTL) generation, even in the absence of CD4 T-cell help. The Th1 bias induced by TLR9 stimulation is maintained even in the presence of vaccine adjuvants such as alum or incomplete Freund's adjuvant (IFA) that normally promote a Th2 bias. CpG oligonucleotides show even greater adjuvant activity when formulated or co-administered with other adjuvants or in formulations such as microparticles, nano particles, lipid emulsions or similar formulations, which are especially necessary for inducing a strong response when the antigen is relatively weak. They also accelerate the immune response and enabled the antigen doses to be reduced by approximately two orders of magnitude, with comparable antibody responses to the full-dose vaccine without CpG in some experiments (Arthur M. Krieg, Nature Reviews, Drug Discovery, 5, June 2006, 471-484). U.S. Pat. No. 6,406,705 B1 describes the combined use of CpG oligonucleotides, non-nucleic acid adjuvants and an antigen to induce an antigen-specific immune response. A commercially available CpG TLR9 antagonist is dSLIM (double Stem Loop Immunomodulator) by Mologen (Berlin, GERMANY), which is a preferred component of the pharmaceutical composition of the present invention. Other TLR binding molecules such as RNA binding TLR 7, TLR 8 and/or TLR 9 may also be used.

Other examples of useful adjuvants include, but are not limited to, chemically modified CpGs (e.g. CpR, Idera), Poly(I:C)(e.g. polyi:CI2U), non-CpG bacterial DNA or RNA as well as immunoactive small molecules and antibodies such as cyclophosphamide, sunitinib, bevacizumab, celebrex, NCX-4016, sildenafil, tadalafil, vardenafil, sorafinib, XL-999, CP-547632, pazopanib, ZD2171, AZD2171, ipilimumab, tremelimumab, and SC58175, which may act therapeutically and/or as an adjuvant. The amounts and concentrations of adjuvants and additives useful in the context of the present invention can readily be determined by the skilled artisan without undue experimentation. Additional adjuvants include colony-stimulating factors, such as Granulocyte Macrophage Colony Stimulating Factor (GM-CSF, sargramostim).

Poly-ICLC is a synthetically prepared double-stranded RNA consisting of polyI and polyC strands of average length of about 5000 nucleotides, which has been stabilized to thermal denaturation and hydrolysis by serum nucleases by the addition of polylysine and carboxymethylcellulose. The compound activates TLR3 and the RNA helicase-domain of MDA5, both members of the PAMP family, leading to DC and natural killer (NK) cell activation and production of a "natural mix" of type I interferons, cytokines, and chemokines. Furthermore, poly-ICLC exerts a more direct, broad host-targeted anti-infectious and possibly antitumor effect mediated by the two IFN-inducible nuclear enzyme systems, the 2'5'-OAS and the P1/eIF2a kinase, also known as the PKR (4-6), as well as RIG-I helicase and MDA5.

In rodents and non-human primates, poly-ICLC was shown to enhance T cell responses to viral antigens, cross-priming, and the induction of tumor-, virus-, and autoantigen-specific CD8+ T-cells. In a recent study in non-human primates, poly-ICLC was found to be essential for the generation of antibody responses and T-cell immunity to DC targeted or non-targeted HIV Gag p24 protein, emphasizing its effectiveness as a vaccine adjuvant.

In human subjects, transcriptional analysis of serial whole blood samples revealed similar gene expression profiles among the 8 healthy human volunteers receiving one single s.c. administration of poly-ICLC and differential expression of up to 212 genes between these 8 subjects versus 4 subjects receiving placebo. Remarkably, comparison of the poly-ICLC gene expression data to previous data from volunteers immunized with the highly effective yellow fever vaccine YF 17D showed that a large number of transcriptional and signal transduction canonical pathways, including those of the innate immune system, were similarly upregulated at peak time points.

More recently, an immunologic analysis was reported on patients with ovarian, fallopian tube, and primary peritoneal cancer in second or third complete clinical remission who were treated on a phase 1 study of subcutaneous vaccination with synthetic overlapping long peptides (OLP) from the cancer testis antigen NY-ESO-1 alone or with Montanide-ISA-51, or with 1.4 mg poly-ICLC and Montanide. The generation of NY-ESO-1-specific CD4+ and CD8+ T-cell and antibody responses were markedly enhanced with the addition of poly-ICLC and Montanide compared to OLP alone or OLP and Montanide.

A vaccine or immunogenic composition according to the present invention may comprise more than one different adjuvant. Furthermore, the invention encompasses a therapeutic composition comprising any adjuvant substance including any of those herein discussed. It is also contemplated that the peptide or polypeptide, and the adjuvant can be administered separately in any appropriate sequence.

A carrier may be present independently of an adjuvant. The carrier may be covalently linked to the antigen. A carrier can also be added to the antigen by inserting DNA encoding the carrier in frame with DNA encoding the antigen. The function of a carrier can for example be to confer stability, to increase the biological activity, or to increase serum half-life. Extension of the half-life can help to reduce the number of applications and to lower doses, thus are beneficial for therapeutic but also economic reasons. Furthermore, a carrier may aid presenting peptides to T-cells. The carrier may be any suitable carrier known to the person skilled in the art, for example a protein or an antigen presenting cell. A carrier protein could be but is not limited to keyhole limpet hemocyanin, serum proteins such as transferrin, bovine serum albumin, human serum albumin, thyroglobulin or ovalbumin, immunoglobulins, or hormones, such as insulin or palmitic acid. For immunization of humans, the carrier may be a physiologically acceptable carrier acceptable to humans and safe. However, tetanus toxoid and/or diptheria toxoid are suitable carriers in one embodiment of the invention. Alternatively, the carrier may be dextrans for example sepharose.

Cytotoxic T-cells (CTLs) recognize an antigen in the form of a peptide bound to an MHC molecule rather than the intact foreign antigen itself. The MHC molecule itself is located at the cell surface of an antigen presenting cell. Thus, an activation of CTLs is only possible if a trimeric complex of peptide antigen, MHC molecule, and APC is present. Correspondingly, it may enhance the immune response if not only the peptide is used for activation of CTLs, but if additionally APCs with the respective MHC molecule are added. Therefore, in some embodiments the vaccine or immunogenic composition according to the present invention additionally contains at least one antigen presenting cell.

The antigen-presenting cell (or stimulator cell) typically has an MHC class I or II molecule on its surface, and in one embodiment is substantially incapable of itself loading the MHC class I or II molecule with the selected antigen. As is described in more detail herein, the MHC class I or II molecule may readily be loaded with the selected antigen in vitro.

CD8+ cell activity may be augmented through the use of CD4+ cells. The identification of CD4 T+ cell epitopes for tumor antigens has attracted interest because many immune based therapies against cancer may be more effective if both CD8+ and CD4+T lymphocytes are used to target a patient's tumor. CD4+ cells are capable of enhancing CD8 T cell responses. Many studies in animal models have clearly demonstrated better results when both CD4+ and CD8+ T cells participate in anti-tumor responses (see e.g., Nishimura et al. (1999) Distinct role of antigen-specific T helper type 1 (TH1) and Th2 cells in tumor eradication in vivo. J Ex Med 190:617-27). Universal CD4+ T cell epitopes have been identified that are applicable to developing therapies against different types of cancer (see e.g., Kobayashi et al. (2008) Current Opinion in Immunology 20:221-27). For example, an HLA-DR restricted helper peptide from tetanus toxoid was used in melanoma vaccines to activate CD4+ T cells non-specifically (see e.g., Slingluff et al. (2007) Immunologic and Clinical Outcomes of a Randomized Phase II Trial of Two Multipeptide Vaccines for Melanoma in the Adjuvant Setting, Clinical Cancer Research 13(21):6386-95). It is contemplated within the scope of the invention that such CD4+ cells may be applicable at three levels that vary in their tumor specificity: 1) a broad level in which universal CD4+ epitopes (e.g., tetanus toxoid) may be used to augment CD8+ cells; 2) an intermediate level in which native, tumor-associated CD4+ epitopes may be used to augment CD8+ cells; and 3) a patient specific level in which neoantigen CD4+ epitopes may be used to augment CD8+ cells in a patient specific manner. Although current algorithms for predicting CD4 epitopes are limited in accuracy, it is a reasonable expectation that many long peptides containing predicted CD8 neoepitopes will also include CD4 epitopes. CD4 epitopes are longer than CD8 epitopes and typically are 10-12 amino acids in length although some can be longer (Kreiter et al, Mutant MHC Class II epitopes drive therapeutic immune responses to cancer, Nature (2015). Thus the neoantigenic epitopes described herein, either in the form of long peptides (>25 amino acids) or nucleic acids encoding such long peptides, may also boost CD4 responses in a tumor and patient-specific manner (level (3) above).

CD8+ cell immunity may also be generated with neoantigen loaded dendritic cell (DC) vaccine. DCs are potent antigen-presenting cells that initiate T cell immunity and can be used as cancer vaccines when loaded with one or more peptides of interest, for example, by direct peptide injection. For example, patients that were newly diagnosed with metastatic melanoma were shown to be immunized against 3 HLA-A*0201-restricted gp100 melanoma antigen-derived peptides with autologous peptide pulsed CD40L/IFN-g-activated mature DCs via an IL-12p70-producing patient DC vaccine (see e.g., Carreno et al (2013) L-12p70-producing patient DC vaccine elicits Tc1-polarized immunity, Journal of Clinical Investigation, 123(8):3383-94 and Ali et al. (2009) In situ regulation of DC subsets and T cells mediates tumor regression in mice, Cancer Immunotherapy, 1(8):1-10). It is contemplated within the scope of the invention that neoantigen loaded DCs may be prepared using the synthetic TLR 3 agonist Polyinosinic-Polycytidylic Acid-poly-L-lysine Carboxymethylcellulose (Poly-ICLC) to stimulate the DCs. Poly-ICLC is a potent individual maturation stimulus for human DCs as assessed by an upregulation of CD83 and CD86, induction of interleukin-12 (IL-12), tumor necrosis factor (TNF), interferon gamma-induced protein 10 (IP-10), interleukin 1 (IL-1), and type I interferons (IFN), and minimal interleukin 10 (IL-10) production. DCs may be differentiated from frozen peripheral blood mononuclear cells (PBMCs) obtained by leukapheresis, while PBMCs may be isolated by Ficoll gradient centrifugation and frozen in aliquots.

Illustratively, the following 7 day activation protocol may be used. Day 1—PBMCs are thawed and plated onto tissue culture flasks to select for monocytes which adhere to the plastic surface after 1-2 hr incubation at 37° C. in the tissue culture incubator. After incubation, the lymphocytes are washed off and the adherent monocytes are cultured for 5 days in the presence of interleukin-4 (IL-4) and granulocyte macrophage-colony stimulating factor (GM-CSF) to differentiate to immature DCs. On Day 6, immature DCs are pulsed with the keyhole limpet hemocyanin (KLH) protein which serves as a control for the quality of the vaccine and may boost the immunogenicity of the vaccine. The DCs are stimulated to mature, loaded with peptide antigens, and incubated overnight. On Day 7, the cells are washed, and frozen in 1 ml aliquots containing 4-20×10(6) cells using a controlled-rate freezer. Lot release testing for the batches of DCs may be performed to meet minimum specifications before the DCs are injected into patients (see e.g., Sabado et al. (2013) Preparation of tumor antigen-loaded mature dendritic cells for immunotherapy, J. Vis Exp. August 1; (78). doi: 10.3791/50085).

A DC vaccine may be incorporated into a scaffold system to facilitate delivery to a patient. Therapeutic treatment of a patients neoplasia with a DC vaccine may utilize a biomaterial system that releases factors that recruit host dendritic cells into the device, differentiates the resident, immature DCs by locally presenting adjuvants (e.g., danger signals) while releasing antigen, and promotes the release of activated, antigen loaded DCs to the lymph nodes (or desired site of action) where the DCs may interact with T cells to generate a potent cytotoxic T lymphocyte response to the cancer neoantigens. Implantable biomaterials may be used to generate a potent cytotoxic T lymphocyte response against a neoplasia in a patient specific manner. The biomaterial-resident dendritic cells may then be activated by exposing them to danger signals mimicking infection, in concert with release of antigen from the biomaterial. The activated dendritic cells then migrate from the biomaterials to lymph nodes to induce a cytotoxic T effector response. This approach has previously been demonstrated to lead to regression of established melanoma in preclinical studies using a lysate prepared from tumor biopsies (see e.g., Ali et al. (2209) In situ regulation of DC subsets and T cells mediates tumor regression in mice, Cancer Immunotherapy 1(8):1-10; Ali et al. (2009) Infection-mimicking materials to program dendritic cells in situ. Nat Mater 8:151-8), and such a vaccine is currently being tested in a Phase I clinical trial recently initiated at the Dana-Farber Cancer Institute. This approach has also been shown to lead to regression of glioblastoma, as well as the induction of a potent memory response to prevent relapse, using the C6 rat glioma model.24 in the current proposal. The ability of such an implantable, biomatrix vaccine delivery scaffold to amplify and sustain tumor specific dendritic cell activation may lead to more robust anti-tumor immunosensitization than can be achieved by traditional subcutaneous or intra-nodal vaccine administrations.

The present invention may include any method for loading a neoantigenic peptide onto a dendritic cell. One such method applicable to the present invention is a microfluidic intracellular delivery system. Such systems cause temporary membrane disruption by rapid mechanical deformation of human and mouse immune cells, thus allowing the intracellular delivery of biomolecules (Sharei et al., 2015, PLOS ONE).

Preferably, the antigen presenting cells are dendritic cells. Suitably, the dendritic cells are autologous dendritic cells that are pulsed with the neoantigenic peptide. The peptide may be any suitable peptide that gives rise to an appropriate T-cell response. T-cell therapy using autologous dendritic cells pulsed with peptides from a tumor associated antigen is disclosed in Murphy et al. (1996) The Prostate 29, 371-380 and Tjua et al. (1997) The Prostate 32, 272-278. In certain embodiments the dendritic cells are targeted using CD141, DEC205, or XCR1 markers. CD141+XCR1+DC's were identified as a subset that may be better suited to the induction of anti-tumor responses (Bachem et al., J. Exp. Med. 207, 1273-1281 (2010); Crozat et al., J. Exp. Med. 207, 1283-1292 (2010); and Gallois & Bhardwaj, Nature Med. 16, 854-856 (2010)).

Thus, in one embodiment of the present invention the vaccine or immunogenic composition containing at least one antigen presenting cell is pulsed or loaded with one or more peptides of the present invention. Alternatively, peripheral blood mononuclear cells (PBMCs) isolated from a patient may be loaded with peptides ex vivo and injected back into the patient. As an alternative the antigen presenting cell comprises an expression construct encoding a peptide of the present invention. The polynucleotide may be any suitable polynucleotide and it is preferred that it is capable of transducing the dendritic cell, thus resulting in the presentation of a peptide and induction of immunity.

The inventive pharmaceutical composition may be compiled so that the selection, number and/or amount of peptides present in the composition covers a high proportion of subjects in the population. The selection may be dependent on the specific type of cancer, the status of the disease, earlier treatment regimens, and, of course, the HLA-haplotypes present in the patient population.

Pharmaceutical compositions comprising the peptide of the invention may be administered to an individual already suffering from cancer. In therapeutic applications, compositions are administered to a patient in an amount sufficient to elicit an effective CTL response to the tumor antigen and to cure or at least partially arrest symptoms and/or complications. An amount adequate to accomplish this is defined as "therapeutically effective dose." Amounts effective for this use can depend on, e.g., the peptide composition, the manner of administration, the stage and severity of the disease being treated, the weight and general state of health of the patient, and the judgment of the prescribing physician, but generally range for the initial immunization (that is for therapeutic or prophylactic administration) from about 1.0 μg to about 50,000 μg of peptide for a 70 kg patient, followed by boosting dosages or from about 1.0 μg to about 10,000 μg of peptide pursuant to a boosting regimen over weeks to months depending upon the patient's response and condition and possibly by measuring specific CTL activity in the patient's blood. It should be kept in mind that the peptide and compositions of the present invention may generally be employed in serious disease states, that is, life-threatening or potentially life threatening situations, especially when the cancer has metastasized. For therapeutic use, administration should begin as soon as possible after the detection or surgical removal of tumors. This is followed by boosting doses until at least symptoms are substantially abated and for a period thereafter.

The pharmaceutical compositions (e.g., vaccine compositions) for therapeutic treatment are intended for parenteral, topical, nasal, oral or local administration. Preferably, the pharmaceutical compositions are administered parenterally, e.g., intravenously, subcutaneously, intradermally, or intramuscularly. The compositions may be administered at the site of surgical excision to induce a local immune response to the tumor. The invention provides compositions for parenteral administration which comprise a solution of the peptides and vaccine or immunogenic compositions are dissolved or suspended in an acceptable carrier, preferably an aqueous carrier. A variety of aqueous carriers may be used, e.g., water, buffered water, 0.9% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc.

A liposome suspension containing a peptide may be administered intravenously, locally, topically, etc. in a dose which varies according to, inter alia, the manner of administration, the peptide being delivered, and the stage of the disease being treated. For targeting to the immune cells, a ligand, such as, e.g., antibodies or fragments thereof specific for cell surface determinants of the desired immune system cells, can be incorporated into the liposome.

For solid compositions, conventional or nanoparticle nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, the immunogenic peptides are preferably supplied in finely divided form along with a surfactant and propellant. Typical percentages of peptides are 0.01%-20% by weight, preferably 1%-10%. The surfactant can, of course, be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%-20%, by weight of the composition, preferably 0.25-5%. The balance of the composition is ordinarily propellant. A carrier can also be included as desired, as with, e.g., lecithin for intranasal delivery.

The peptides and polypeptides of the invention can be readily synthesized chemically utilizing reagents that are free of contaminating bacterial or animal substances (Merrifield RB: Solid phase peptide synthesis. I. The synthesis of a tetrapeptide. J. Am. Chem. Soc. 85:2149-54, 1963).

The peptides and polypeptides of the invention can also be expressed by a vector, e.g., a nucleic acid molecule as herein-discussed, e.g., RNA or a DNA plasmid, a viral vector such as a poxvirus, e.g., orthopox virus, avipox virus, or adenovirus, AAV or lentivirus. This approach involves the use of a vector to express nucleotide sequences that encode the peptide of the invention. Upon introduction into an acutely or chronically infected host or into a noninfected host, the vector expresses the immunogenic peptide, and thereby elicits a host CTL response.

For therapeutic or immunization purposes, nucleic acids encoding the peptide of the invention and optionally one or more of the peptides described herein can also be administered to the patient. A number of methods are conveniently used to deliver the nucleic acids to the patient. For instance, the nucleic acid can be delivered directly, as "naked DNA". This approach is described, for instance, in Wolff et al., Science 247: 1465-1468 (1990) as well as U.S. Pat. Nos. 5,580,859 and 5,589,466. The nucleic acids can also be administered using ballistic delivery as described, for instance, in U.S. Pat. No. 5,204,253. Particles comprised solely of DNA can be administered. Alternatively, DNA can be adhered to particles, such as gold particles. Generally, a plasmid for a vaccine or immunological composition can comprise DNA encoding an antigen (e.g., one or more neoantigens) operatively linked to regulatory sequences which control expression or expression and secretion of the antigen from a host cell, e.g., a mammalian cell; for instance, from upstream to downstream, DNA for a promoter, such as a mammalian virus promoter (e.g., a CMV promoter such as an hCMV or mCMV promoter, e.g., an early-intermediate promoter, or an SV40 promoter—see documents cited or incorporated herein for useful promoters), DNA for a eukaryotic leader peptide for secretion (e.g., tissue plasminogen activator), DNA for the neoantigen(s), and DNA encoding a terminator (e.g., the 3' UTR transcriptional terminator from the gene encoding Bovine Growth Hormone or bGH polyA). A composition can contain more than one plasmid or vector, whereby each vector contains and expresses a different neoantigen. Mention is also made of Wasmoen U.S. Pat. No. 5,849,303, and Dale U.S. Pat. No. 5,811,104, whose text may be useful. DNA or DNA plasmid formulations can be formulated with or inside cationic lipids; and, as to cationic lipids, as well as adjuvants, mention is also made of Loosmore U.S. Patent Application 2003/0104008. Also, teachings in Audonnet U.S. Pat. Nos. 6,228,846 and 6,159,477 may be relied upon for DNA plasmid teachings that can be employed in constructing and using DNA plasmids that contain and express in vivo.

The nucleic acids can also be delivered complexed to cationic compounds, such as cationic lipids. Lipid-mediated gene delivery methods are described, for instance, in WO1996/18372; WO 1993/24640; Mannino & Gould-Fogerite, BioTechniques 6(7): 682-691 (1988); U.S. Pat. No. 5,279,833; WO 1991/06309; and Feigner et al., Proc. Natl. Acad. Sci. USA 84: 7413-7414 (1987).

RNA encoding the peptide of interest (e.g., mRNA) can also be used for delivery (see, e.g., Kiken et al, 2011; Su et al, 2011; see also U.S. Pat. No. 8,278,036; Halabi et al. J Clin Oncol (2003) 21:1232-1237; Petsch et al, Nature Biotechnology 2012 Dec. 7; 30(12):1210-6).

Viral vectors as described herein can also be used to deliver the neoantigenic peptides of the invention. Vectors can be administered so as to have in vivo expression and response akin to doses and/or responses elicited by antigen administration.

A preferred means of administering nucleic acids encoding the peptide of the invention uses minigene constructs encoding multiple epitopes. To create a DNA sequence encoding the selected CTL epitopes (minigene) for expression in human cells, the amino acid sequences of the epitopes are reverse translated. A human codon usage table is used to guide the codon choice for each amino acid. These epitope-encoding DNA sequences are directly adjoined, creating a continuous polypeptide sequence. To optimize expression and/or immunogenicity, additional elements can be incorporated into the minigene design. Examples of amino acid sequence that could be reverse translated and included in the minigene sequence include: helper T lymphocyte, epitopes, a leader (signal) sequence, and an endoplasmic reticulum retention signal. In addition, MHC presentation of CTL epitopes may be improved by including synthetic (e.g. poly-alanine) or naturally-occurring flanking sequences adjacent to the CTL epitopes.

The minigene sequence is converted to DNA by assembling oligonucleotides that encode the plus and minus strands of the minigene. Overlapping oligonucleotides (30-100 bases long) are synthesized, phosphorylated, purified and annealed under appropriate conditions using well known techniques. The ends of the oligonucleotides are joined using T4 DNA ligase. This synthetic minigene, encoding the CTL epitope polypeptide, can then cloned into a desired expression vector.

Standard regulatory sequences well known to those of skill in the art are included in the vector to ensure expression in the target cells. Several vector elements are required: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences can also be considered for increasing minigene expression. It has recently been proposed that immuno stimulatory sequences (ISSs or CpGs) play a role in the immunogenicity of DNA' vaccines. These sequences could be included in the vector, outside the minigene coding sequence, if found to enhance immunogenicity.

In some embodiments, a bicistronic expression vector, to allow production of the minigene-encoded epitopes and a second protein included to enhance or decrease immunogenicity can be used. Examples of proteins or polypeptides that could beneficially enhance the immune response if co-expressed include cytokines (e.g., IL2, IL12, GM-CSF), cytokine-inducing molecules (e.g. LeIF) or costimulatory molecules. Helper (HTL) epitopes could be joined to intracellular targeting signals and expressed separately from the CTL epitopes. This would allow direction of the HTL epitopes to a cell compartment different than the CTL epitopes. If required, this could facilitate more efficient entry of HTL epitopes into the MHC class II pathway, thereby improving CTL induction. In contrast to CTL induction, specifically decreasing the immune response by co-expression of immunosuppressive molecules (e.g. TGF-$\beta$) may be beneficial in certain diseases.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

Purified plasmid DNA can be prepared for injection using a variety of formulations. The simplest of these is reconstitution of lyophilized DNA in sterile phosphate-buffer saline (PBS). A variety of methods have been described, and new techniques may become available. As noted herein, nucleic acids are conveniently formulated with cationic lipids. In addition, glycolipids, fusogenic liposomes, peptides and compounds referred to collectively as protective, interactive, non-condensing (PINC) could also be complexed to purified plasmid DNA to influence variables such as stability, intramuscular dispersion, or trafficking to specific organs or cell types.

Target cell sensitization can be used as a functional assay for expression and MHC class I presentation of minigene-encoded CTL epitopes. The plasmid DNA is introduced into a mammalian cell line that is suitable as a target for standard CTL chromium release assays. The transfection method used is dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 labeled and used as target cells for epitope-specific CTL lines. Cytolysis, detected by 51 Cr release, indicates production of MHC presentation of mini gene-encoded CTL epitopes.

In vivo immunogenicity is a second approach for functional testing of minigene DNA formulations. Transgenic mice expressing appropriate human MHC molecules are immunized with the DNA product. The dose and route of administration are formulation dependent (e.g. IM for DNA in PBS, IP for lipid-complexed DNA). Twenty-one days after immunization, splenocytes are harvested and restimulated for 1 week in the presence of peptides encoding each epitope being tested. These effector cells (CTLs) are assayed for cytolysis of peptide-loaded, chromium-51 labeled target cells using standard techniques. Lysis of target cells sensitized by MHC loading of peptides corresponding to minigene-encoded epitopes demonstrates DNA vaccine function for in vivo induction of CTLs.

Peptides may be used to elicit CTL ex vivo, as well. The resulting CTL, can be used to treat chronic tumors in patients in need thereof that do not respond to other conventional forms of therapy, or does not respond to a peptide vaccine approach of therapy. Ex vivo CTL responses to a particular tumor antigen are induced by incubating in tissue culture the patient's CTL precursor cells (CTLp) together with a source of antigen-presenting cells (APC) and the appropriate peptide. After an appropriate incubation time (typically 1-4 weeks), in which the CTLp are activated and mature and expand into effector CTL, the cells are infused back into the patient, where they destroy their specific target cell (i.e., a tumor cell). In order to optimize the in vitro conditions for the generation of specific cytotoxic T cells, the culture of stimulator cells are maintained in an appropriate serum-free medium.

Prior to incubation of the stimulator cells with the cells to be activated, e.g., precursor CD8+ cells, an amount of antigenic peptide is added to the stimulator cell culture, of sufficient quantity to become loaded onto the human Class I molecules to be expressed on the surface of the stimulator cells. In the present invention, a sufficient amount of peptide is an amount that allows about 200, and preferably 200 or more, human Class I MHC molecules loaded with peptide to be expressed on the surface of each stimulator cell. Preferably, the stimulator cells are incubated with >2 µg/ml peptide. For example, the stimulator cells are incubates with >3, 4, 5, 10, 15, or more µg/ml peptide.

Resting or precursor CD8+ cells are then incubated in culture with the appropriate stimulator cells for a time period sufficient to activate the CD8+ cells. Preferably, the CD8+ cells are activated in an antigen-specific manner. The ratio of resting or precursor CD8+(effector) cells to stimulator cells may vary from individual to individual and may further depend upon variables such as the amenability of an individual's lymphocytes to culturing conditions and the nature and severity of the disease condition or other condition for which the within-described treatment modality is used. Preferably, however, the lymphocyte: stimulator cell ratio is in the range of about 30:1 to 300:1. The effector/stimulator culture may be maintained for as long a time as is necessary to stimulate a therapeutically useable or effective number of CD8+ cells.

The induction of CTL in vitro requires the specific recognition of peptides that are bound to allele specific MHC class I molecules on APC. The number of specific MHC/peptide complexes per APC is crucial for the stimulation of CTL, particularly in primary immune responses. While small amounts of peptide/MHC complexes per cell are sufficient to render a cell susceptible to lysis by CTL, or to stimulate a secondary CTL response, the successful activation of a CTL precursor (pCTL) during primary response requires a significantly higher number of MHC/peptide complexes. Peptide loading of empty major histocompatability complex molecules on cells allows the induction of primary cytotoxic T lymphocyte responses.

Since mutant cell lines do not exist for every human MHC allele, it is advantageous to use a technique to remove endogenous MHC-associated peptides from the surface of APC, followed by loading the resulting empty MHC molecules with the immunogenic peptides of interest. The use of non-transformed (non-tumorigenic), noninfected cells, and preferably, autologous cells of patients as APC is desirable for the design of CTL induction protocols directed towards development of ex vivo CTL therapies. This application discloses methods for stripping the endogenous MHC-associated peptides from the surface of APC followed by the loading of desired peptides.

A stable MHC class I molecule is a trimeric complex formed of the following elements: 1) a peptide usually of 8-10 residues, 2) a transmembrane heavy polymorphic protein chain which bears the peptide-binding site in its a1 and a2 domains, and 3) a non-covalently associated non-polymorphic light chain, p2microglobuiin. Removing the bound peptides and/or dissociating the p2microglobulin from the complex renders the MHC class I molecules nonfunctional and unstable, resulting in rapid degradation. All MHC class I molecules isolated from PBMCs have endogenous peptides bound to them. Therefore, the first step is to remove all endogenous peptides bound to MHC class I molecules on the APC without causing their degradation before exogenous peptides can be added to them.

Two possible ways to free up MHC class I molecules of bound peptides include lowering the culture temperature from 37° C. to 26° C. overnight to destabilize p2microglobulin and stripping the endogenous peptides from the cell using a mild acid treatment. The methods release previously bound peptides into the extracellular environment allowing new exogenous peptides to bind to the empty class I molecules. The cold-temperature incubation method enables exogenous peptides to bind efficiently to the MHC complex, but requires an overnight incubation at 26° C. which may slow the cell's metabolic rate. It is also likely that cells not actively synthesizing MHC molecules (e.g., resting PBMC) would not produce high amounts of empty surface MHC molecules by the cold temperature procedure.

Harsh acid stripping involves extraction of the peptides with trifluoroacetic acid, pH 2, or acid denaturation of the immunoaffinity purified class I-peptide complexes. These methods are not feasible for CTL induction, since it is important to remove the endogenous peptides while preserving APC viability and an optimal metabolic state which is critical for antigen presentation. Mild acid solutions of pH 3 such as glycine or citrate-phosphate buffers have been used to identify endogenous peptides and to identify tumor associated T cell epitopes. The treatment is especially effective, in that only the MHC class I molecules are destabilized (and associated peptides released), while other surface antigens remain intact, including MHC class II molecules. Most importantly, treatment of cells with the mild acid solutions do not affect the cell's viability or metabolic state. The mild acid treatment is rapid since the stripping of the endogenous peptides occurs in two minutes at 4° C. and the APC is ready to perform its function after the appropriate peptides are loaded. The technique is utilized herein to make peptide-specific APCs for the generation of primary antigen-specific CTL. The resulting APC are efficient in inducing peptide-specific CD8+CTL.

Activated CD8+ cells may be effectively separated from the stimulator cells using one of a variety of known methods. For example, monoclonal antibodies specific for the stimulator cells, for the peptides loaded onto the stimulator cells, or for the CD8+ cells (or a segment thereof) may be utilized to bind their appropriate complementary ligand. Antibody-tagged molecules may then be extracted from the stimulator-effector cell admixture via appropriate means, e.g., via well-known immunoprecipitation or immunoassay methods.

Effective, cytotoxic amounts of the activated CD8+ cells can vary between in vitro and in vivo uses, as well as with the amount and type of cells that are the ultimate target of these killer cells. The amount can also vary depending on the condition of the patient and should be determined via consideration of all appropriate factors by the practitioner. Preferably, however, about $1 \times 10^6$ to about $1 \times 10^{12}$, more preferably about $1 \times 10^8$ to about $1 \times 10^{11}$, and even more preferably, about $1 \times 10^9$ to about $1 \times 10^{10}$ activated CD8+ cells are utilized for adult humans, compared to about $5 \times 10^6$-$5 \times 10^7$ cells used in mice.

Preferably, as discussed herein, the activated CD8+ cells are harvested from the cell culture prior to administration of the CD8+ cells to the individual being treated. It is important to note, however, that unlike other present and proposed treatment modalities, the present method uses a cell culture system that is not tumorigenic. Therefore, if complete separation of stimulator cells and activated CD8+ cells are not achieved, there is no inherent danger known to be associated with the administration of a small number of stimulator cells, whereas administration of mammalian tumor-promoting cells may be extremely hazardous.

Methods of re-introducing cellular components are known in the art and include procedures such as those exemplified in U.S. Pat. No. 4,844,893 to Honsik, et al. and U.S. Pat. No. 4,690,915 to Rosenberg. For example, administration of activated CD8+ cells via intravenous infusion is appropriate.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Wei, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments are discussed in the sections that follow.

Therapeutic Methods

The present invention provides methods of inducing a neoplasia/tumor specific immune response in a subject, vaccinating against a neoplasia/tumor, treating and or alleviating a symptom of cancer in a subject by administering the subject a plurality of neoantigenic peptides or composition of the invention.

According to the invention, the herein-described neoplasia vaccine or immunogenic composition may be used for a patient that has been diagnosed as having cancer, or at risk of developing cancer.

The claimed combination of the invention is administered in an amount sufficient to induce a CTL response.

Additional Therapies

The tumor specific neoantigen peptides and pharmaceutical compositions described herein can also be administered in a combination therapy with another agent, for example a therapeutic agent. In certain embodiments, the additional agents can be, but are not limited to, chemotherapeutic agents, anti-angiogenesis agents and agents that reduce immune-suppression.

The neoplasia vaccine or immunogenic composition can be administered before, during, or after administration of the additional agent. In embodiments, the neoplasia vaccine or immunogenic composition is administered before the first administration of the additional agent. In other embodiments, the neoplasia vaccine or immunogenic composition is administered after the first administration of the additional therapeutic agent (e.g., 1, 2, 3, 4, 5, 6, 7, 8, 9, 10, 11, 12, 13, 14 days or more). In embodiments, the neoplasia vaccine or immunogenic composition is administered simultaneously with the first administration of the additional therapeutic agent.

The therapeutic agent is for example, a chemotherapeutic or biotherapeutic agent, radiation, or immunotherapy. Any suitable therapeutic treatment for a particular cancer may be administered. Examples of chemotherapeutic and biotherapeutic agents include, but are not limited to, an angiogenesis inhibitor, such as hydroxy angiostatin K1-3, DL-α-Difluoromethyl-ornithine, endostatin, fumagillin, genistein, minocycline, staurosporine, and thalidomide; a DNA intercaltor/cross-linker, such as Bleomycin, Carboplatin, Carmustine, Chlorambucil, Cyclophosphamide, cis-Diammineplatinum (II) dichloride (Cisplatin), Melphalan, Mitoxantrone, and Oxaliplatin; a DNA synthesis inhibitor, such as (±)-Amethopterin (Methotrexate), 3-Amino-1,2,4-benzotriazine 1,4-dioxide, Aminopterin, Cytosine β-D-arabinofuranoside, 5-Fluoro-5'-deoxyuridine, 5-Fluorouracil, Ganciclovir, Hydroxyurea, and Mitomycin C; a DNA-RNA transcription regulator, such as Actinomycin D, Daunorubicin, Doxorubicin, Homoharringtonine, and Idarubicin; an enzyme inhibitor, such as S(+)-Camptothecin, Curcumin, (−)-Deguelin, 5,6-Dichlorobenzimidazole 1-β-D-ribofuranoside, Etoposide, Formestane, Fostriecin, Hispidin, 2-Imino-1-imidazoli-dineacetic acid (Cyclocreatine), Mevinolin, Trichostatin A, Tyrphostin AG 34, and Tyrphostin AG 879; a gene regulator, such as 5-Aza-2'-deoxycytidine, 5-Azacytidine, Cholecalciferol (Vitamin D3), 4-Hydroxytamoxifen, Melatonin, Mifepristone, Raloxifene, all trans-Retinal (Vitamin A aldehyde), Retinoic acid all trans (Vitamin A acid), 9-cis-Retinoic Acid, 13-cis-Retinoic acid, Retinol (Vitamin A), Tamoxifen, and Troglitazone; a microtubule inhibitor, such as Colchicine, docetaxel, Dolastatin 15, Nocodazole, Paclitaxel, Podophyllotoxin, Rhizoxin, Vinblastine, Vincristine, Vindesine, and Vinorelbine (Navelbine); and an unclassified therapeutic agent, such as 17-(Allylamino)-17-demethoxygeldanamycin, 4-Amino-1,8-naphthalimide, Apigenin, Brefeldin A, Cimetidine, Dichloromethylene-diphosphonic acid, Leuprolide (Leuprorelin), Luteinizing Hormone-Releasing Hormone, Pifithrin-α, Rapamycin, Sex hormone-binding globulin, Thapsigargin, and Urinary trypsin inhibitor fragment (Bikunin). The therapeutic agent may be altretamine, amifostine, asparaginase, capecitabine, cladribine, cisapride, cytarabine, dacarbazine (DTIC), dactinomycin, dronabinol, epoetin alpha, filgrastim, fludarabine, gemcitabine, granisetron, ifosfamide, irinotecan, lansoprazole, levamisole, leucovorin, megestrol, mesna, metoclopramide, mitotane, omeprazole, ondansetron, pilocarpine, prochloroperazine, or topotecan hydrochloride. The therapeutic agent may be a monoclonal antibody or small molecule such as rituximab (Rituxan®), alemtuzumab (Campath®), Bevacizumab (Avastin®), Cetuximab (Erbitux®), panitumumab (Vectibix®), and trastuzumab (Herceptin®), Vemurafenib (Zelboraf@) imatinib mesylate (Gleevec®), erlotinib (Tarceva®), gefitinib (Iressa®), Vismodegib (Erivedge™), 90Y-ibritumomab tiuxetan, 131I-tositumomab, ado-trastuzumab emtansine, lapatinib (Tykerb®), pertuzumab (Perjeta™), ado-trastuzumab emtansine (Kadcyla™), regorafenib (Stivarga®), sunitinib (Sutent®), Denosumab (Xgeva®), sorafenib (Nexavar®), pazopanib (Votrient®), axitinib (Inlyta®), dasatinib (Sprycel®), nilotinib (Tasigna®), bosutinib (Bosulif®), ofatumumab (Arzerra®), obinutuzumab (Gazyva™), ibrutinib (Imbruvica™), idelalisib (Zydelig®), crizotinib (Xalkori®), erlotinib (Tarceva®), afatinib dimaleate (Gilotrif®), ceritinib (LDK378/Zykadia), Tositumomab and 131I-tositumomab (Bexxar®), ibritumomab tiuxetan (Zevalin®), brentuximab vedotin (Adcetris®), bortezomib (Velcade®), siltuximab (Sylvant™), trametinib (Mekinist®), dabrafenib (Tafinlar®), pembrolizumab (Keytruda®), carfilzomib (Kyprolis®), Ramucirumab (Cyramza™), Cabozantinib (Cometriq™), vandetanib (Caprelsa®), Optionally, the therapeutic agent is a neoantigen. The therapeutic agent may be a cytokine such as interferons (INFs), interleukins (ILs), or hematopoietic growth factors. The therapeutic agent may be INF-α, IL-2, Aldesleukin, IL-2, Erythropoietin, Granulocyte-macrophage colony-stimulating factor (GM-CSF) or granulocyte colony-stimulating factor. The therapeutic agent may be a targeted therapy such as toremifene (Fareston®), fulvestrant (Faslodex®), anastrozole (Arimidex®), exemestane (Aromasin®), letrozole (Femara®), ziv-aflibercept (Zaltrap®), Alitretinoin (Panretin®), temsirolimus (Torisel®), Tretinoin (Vesanoid®), denileukin diftitox (Ontak®), vorinostat (Zolinza®), romidepsin (Istodax®), bexarotene (Targretin®), pralatrexate (Folotyn®), lenaliomide (Revlimid®), belinostat (Beleodaq™), lenaliomide (Revlimid®), pomalidomide (Pomalyst®), Cabazitaxel (Jevtana®), enzalutamide (Xtandi®), abiraterone acetate (Zytiga®), radium 223 chloride (Xofigo®), or everolimus (Afinitor®). Additionally, the therapeutic agent may be an epigenetic targeted drug such as HDAC inhibitors, kinase inhibitors, DNA methyltransferase inhibitors, histone demethylase inhibitors, or histone methylation inhibitors. The epigenetic drugs may be Azacitidine (Vidaza), Decitabine (Dacogen), Vorinostat (Zolinza), Romidepsin (Istodax), or Ruxolitinib (Jakafi). For prostate cancer treatment, a preferred chemotherapeutic agent with which anti-CTLA-4 can be combined is paclitaxel (TAXOL).

In certain embodiments, the one or more additional agents are one or more anti-glucocorticoid-induced tumor necrosis factor family receptor (GITR) agonistic antibodies. GITR is a costimulatory molecule for T lymphocytes, modulates innate and adaptive immune system and has been found to participate in a variety of immune responses and inflammatory processes. GITR was originally described by Nocentini et al. after being cloned from dexamethasone-treated murine T cell hybridomas (Nocentini et al. Proc Natl Acad Sci USA 94:6216-6221.1997). Unlike CD28 and CTLA-4, GITR has a very low basal expression on naive CD4+ and CD8+ T cells (Ronchetti et al. Eur J Immunol 34:613-622. 2004). The observation that GITR stimulation has immunostimulatory effects in vitro and induced autoimmunity in vivo prompted the investigation of the antitumor potency of triggering this pathway. A review of Modulation Of Ctla 4 And Gitr For Cancer Immunotherapy can be found in Cancer Immunology and Immunotherapy (Avogadri et al. Current Topics in Microbiology and Immunology 344. 2011). Other agents that can contribute to relief of immune suppression include checkpoint inhibitors targeted at another member of the CD28/CTLA4 Ig superfamily such as BTLA, LAG3, ICOS, PDL1 or KIR (Page et a, Annual Review of Medicine 65:27 (2014)). In further additional embodiments, the checkpoint inhibitor is targeted at a member of the TNFR superfamily such as CD40, OX40, CD137, GITR, CD27 or TIM-3. In some cases targeting a checkpoint inhibitor is accomplished with an inhibitory antibody or similar molecule. In other cases, it is accomplished with an agonist for the target; examples of this class include the stimulatory targets OX40 and GITR.

In certain embodiments, the one or more additional agents are synergistic in that they increase immunogenicity after treatment. In one embodiment the additional agent allows for lower toxicity and/or lower discomfort due to lower doses of the additional therapeutic agents or any components of the combination therapy described herein. In another embodiment the additional agent results in longer lifespan due to increased effectiveness of the combination therapy described herein. Chemotherapeutic treatments that enhance the immunological response in a patient have been reviewed (Zitvogel et al., Immunological aspects of cancer chemotherapy. Nat Rev Immunol. 2008 January; 8(1):59-73). Additionally, chemotherapeutic agents can be administered safely with immunotherapy without inhibiting vaccine specific T-cell responses (Perez et al., A new era in anticancer peptide vaccines. Cancer May 2010). In one embodiment the additional agent is administered to increase the efficacy of the therapy described herein. In one embodiment the additional agent is a chemotherapy treatment. In one embodiment low doses of chemotherapy potentiate delayed-type hypersensitivity (DTH) responses. In one embodiment the chemotherapy agent targets regulatory T-cells. In one embodiment cyclophosphamide is the therapeutic agent. In one embodiment cyclophosphamide is administered prior to vaccination. In one embodiment cyclophosphamide is administered as a single dose before vaccination (Walter et al., Multipeptide immune response to cancer vaccine IMA901 after single-dose cyclophosphamide associates with longer patient survival. Nature Medicine; 18:8 2012). In another embodiment, cyclophosphamide is administered according to a metronomic program, where a daily dose is administered for one month (Ghiringhelli et al., Metronomic cyclophosphamide regimen selectively depletes CD4+ CD25+ regulatory T cells and restores T and NK effector functions in end stage cancer patients. Cancer Immunol Immunother 2007 56:641-648). In another embodiment taxanes are administered before vaccination to enhance T-cell and NK-cell functions (Zitvogel et al., 2008). In another embodiment a low dose of a chemotherapeutic agent is administered with the therapy described herein. In one embodiment the chemotherapeutic agent is estramustine. In one embodiment the cancer is hormone resistant prostate cancer. A ≥50% decrease in serum prostate specific antigen (PSA) was seen in 8.7% of advanced hormone refractory prostate cancer patients by personalized vaccination alone, whereas such a decrease was seen in 54% of patients when the personalized vaccination was combined with a low dose of estramustine (Itoh et al., Personalized peptide vaccines: A new therapeutic modality for cancer. Cancer Sci 2006; 97: 970-976). In another embodiment glucocorticoids are administered with or before the therapy described herein (Zitvogel et al., 2008). In another embodiment glucocorticoids are administered after the therapy described herein. In another embodiment Gemcitabine is administered before, simultaneously, or after the therapy described herein to enhance the frequency of tumor specific CTL precursors (Zitvogel et al., 2008). In another embodiment 5-fluorouracil is administered with the therapy described herein as synergistic effects were seen with a peptide based vaccine (Zitvogel et al., 2008). In another embodiment an inhibitor of Braf, such as Vemurafenib, is used as an additional agent. Braf inhibition has been shown to be associated with an increase in melanoma antigen expression and T-cell infiltrate and a decrease in immunosuppressive cytokines in tumors of treated patients (Frederick et al., BRAF inhibition is associated with enhanced melanoma antigen expression and a more favorable tumor microenvironment in patients with metastatic melanoma. Clin Cancer Res. 2013; 19:1225-1231). In another embodiment an inhibitor of tyrosine kinases is used as an additional agent. In one embodiment the tyrosine kinase inhibitor is used before vaccination with the therapy described herein. In one embodiment the tyrosine kinase inhibitor is used simultaneously with the therapy described herein. In another embodiment the tyrosine kinase inhibitor is used to create a more immune permissive environment. In another embodiment the tyrosine kinase inhibitor is sunitinib or imatinib mesylate. It has previously been shown that favorable outcomes could be achieved with sequential administration of continuous daily dosing of sunitinib and recombinant vaccine (Farsaci et al., Consequence of dose scheduling of sunitinib on host immune response elements and vaccine combination therapy. Int J Cancer; 130: 1948-1959). Sunitinib has also been shown to reverse type-1 immune suppression using a daily dose of 50 mg/day (Finke et al., Sunitinib Reverses Type-1 Immune Suppression and Decreases T-Regulatory Cells in Renal Cell Carcinoma Patients. Clin Cancer Res 2008; 14(20)). In another embodiment targeted therapies are administered in combination with the therapy described herein. Doses of targeted therapies has been described previously (Alvarez, Present and future evolution of advanced breast cancer therapy. Breast Cancer Research 2010, 12(Suppl 2):S1). In another embodiment temozolomide is administered with the therapy described herein. In one embodiment temozolomide is administered at 200 mg/day for 5 days every fourth week of a combination therapy with the therapy described herein. Results of a similar strategy have been shown to have low toxicity (Kyte et al., Telomerase Peptide Vaccination Combined with Temozolomide: A Clinical Trial in Stage IV Melanoma Patients. Clin Cancer Res; 17(13) 2011). In another embodiment the therapy is administered with an additional therapeutic agent that results in lymphopenia. In one embodiment the additional agent is temozolomide. An immune response can still be induced under these conditions (Sampson et al., Greater chemotherapy-induced lymphopenia enhances tumor-specific immune responses that eliminate EGFRvIII-expressing tumor cells in patients with glioblastoma. Neuro-Oncology 13(3):324-333, 2011).

Patients in need thereof may receive a series of priming vaccinations with a mixture of tumor-specific peptides. Additionally, over a 4 week period the priming may be followed by two boosts during a maintenance phase. All vaccinations are subcutaneously delivered. The vaccine or immunogenic composition is evaluated for safety, tolerability, immune response and clinical effect in patients and for feasibility of producing vaccine or immunogenic composition and successfully initiating vaccination within an appropriate time frame. The first cohort can consist of 5 patients, and after safety is adequately demonstrated, an additional cohort of 10 patients may be enrolled. Peripheral blood is extensively monitored for peptide-specific T-cell responses and patients are followed for up to two years to assess disease recurrence.

Administering a Combination Therapy Consistent with Standard of Care

In another aspect, the therapy described herein provides selecting the appropriate point to administer a combination therapy in relation to and within the standard of care for the cancer being treated for a patient in need thereof. The studies described herein show that the combination therapy can be effectively administered even within the standard of care that includes surgery, radiation, or chemotherapy. The standards of care for the most common cancers can be found on the website of National Cancer Institute (www.cancer.gov/cancertopics). The standard of care is the current treatment that is accepted by medical experts as a proper treatment for a certain type of disease and that is widely used by healthcare professionals. Standard or care is also called best practice, standard medical care, and standard therapy. Standards of Care for cancer generally include surgery, lymph node removal, radiation, chemotherapy, targeted therapies, antibodies targeting the tumor, and immunotherapy. Immunotherapy can include checkpoint blockers (CBP), chimeric antigen receptors (CARs), and adoptive T-cell therapy. The combination therapy described herein can be incorporated within the standard of care. The combination therapy described herein may also be administered where the standard of care has changed due to advances in medicine.

Incorporation of the combination therapy described herein may depend on a treatment step in the standard of care that can lead to activation of the immune system. Treatment steps that can activate and function synergistically with the combination therapy have been described herein. The therapy can be advantageously administered simultaneously or after a treatment that activates the immune system.

Incorporation of the combination therapy described herein may depend on a treatment step in the standard of care that causes the immune system to be suppressed. Such treatment steps may include irradiation, high doses of alkylating agents and/or methotrexate, steroids such as glucosteroids, surgery, such as to remove the lymph nodes, imatinib mesylate, high doses of TNF, and taxanes (Zitvogel et al., 2008). The combination therapy may be administered before such steps or may be administered after.

In one embodiment the combination therapy may be administered after bone marrow transplants and peripheral blood stem cell transplantation. Bone marrow transplantation and peripheral blood stem cell transplantation are procedures that restore stem cells that were destroyed by high doses of chemotherapy and/or radiation therapy. After being treated with high-dose anticancer drugs and/or radiation, the patient receives harvested stem cells, which travel to the bone marrow and begin to produce new blood cells. A "mini-transplant" uses lower, less toxic doses of chemotherapy and/or radiation to prepare the patient for transplant. A "tandem transplant" involves two sequential courses of high-dose chemotherapy and stem cell transplant. In autologous transplants, patients receive their own stem cells. In syngeneic transplants, patients receive stem cells from their identical twin. In allogeneic transplants, patients receive stem cells from their brother, sister, or parent. A person who is not related to the patient (an unrelated donor) also may be used. In some types of leukemia, the graft-versus-tumor (GVT) effect that occurs after allogeneic BMT and PBSCT is crucial to the effectiveness of the treatment. GVT occurs when white blood cells from the donor (the graft) identify the cancer cells that remain in the patient's body after the chemotherapy and/or radiation therapy (the tumor) as foreign and attack them. Immunotherapy with the combination therapy described herein can take advantage of this by vaccinating after a transplant. Additionally, the transferred cells may be presented with neoantigens of the combination therapy described herein before transplantation.

In one embodiment the combination therapy is administered to a patient in need thereof with a cancer that requires surgery. In one embodiment the combination therapy described herein is administered to a patient in need thereof in a cancer where the standard of care is primarily surgery followed by treatment to remove possible micro-metastases, such as breast cancer. Breast cancer is commonly treated by various combinations of surgery, radiation therapy, chemotherapy, and hormone therapy based on the stage and grade of the cancer. Adjuvant therapy for breast cancer is any treatment given after primary therapy to increase the chance of long-term survival. Neoadjuvant therapy is treatment given before primary therapy. Adjuvant therapy for breast cancer is any treatment given after primary therapy to increase the chance of long-term disease-free survival. Primary therapy is the main treatment used to reduce or eliminate the cancer. Primary therapy for breast cancer usually includes surgery, a mastectomy (removal of the breast) or a lumpectomy (surgery to remove the tumor and a small amount of normal tissue around it; a type of breast-conserving surgery). During either type of surgery, one or more nearby lymph nodes are also removed to see if cancer cells have spread to the lymphatic system. When a woman has breast-conserving surgery, primary therapy almost always includes radiation therapy. Even in early-stage breast cancer, cells may break away from the primary tumor and spread to other parts of the body (metastasize). Therefore, doctors give adjuvant therapy to kill any cancer cells that may have spread, even if they cannot be detected by imaging or laboratory tests.

In one embodiment the combination therapy is administered consistent with the standard of care for Ductal carcinoma in situ (DCIS). The standard of care for this breast cancer type is:
1. Breast-conserving surgery and radiation therapy with or without tamoxifen.
2. Total mastectomy with or without tamoxifen.
3. Breast-conserving surgery without radiation therapy.

The combination therapy may be administered before breast conserving surgery or total mastectomy to shrink the tumor before surgery. In another embodiment the combination therapy can be administered as an adjuvant therapy to remove any remaining cancer cells. In another embodiment patients diagnosed with stage I, II, IIIA, and Operable IIIC breast cancer are treated with the combination therapy as described herein. The standard of care for this breast cancer type is:
1. Local-regional treatment:
   Breast-conserving therapy (lumpectomy, breast radiation, and surgical staging of the axilla).
   Modified radical mastectomy (removal of the entire breast with level I-II axillary dissection) with or without breast reconstruction.
   Sentinel node biopsy.
2. Adjuvant radiation therapy postmastectomy in axillary node-positive tumors:
   For one to three nodes: unclear role for regional radiation (infra/supraclavicular nodes, internal mammary nodes, axillary nodes, and chest wall).
   For more than four nodes or extranodal involvement: regional radiation is advised.
3. Adjuvant systemic therapy In one embodiment the combination therapy is administered as a neoadjuvant therapy to shrink the tumor. In another embodiment the combination is administered as an adjuvant systemic therapy.

In another embodiment patients diagnosed with inoperable stage IIIB or IIIC or inflammatory breast cancer are treated with the combination therapy as described herein. The standard of care for this breast cancer type is:
1. Multimodality therapy delivered with curative intent is the standard of care for patients with clinical stage IIIB disease.
2. Initial surgery is generally limited to biopsy to permit the determination of histology, estrogen-receptor (ER) and progesterone-receptor (PR) levels, and human epidermal growth factor receptor 2 (HER2/neu) overexpression. Initial treatment with anthracycline-based chemotherapy and/or taxane-based therapy is standard. For patients who respond to neoadjuvant chemotherapy, local therapy may consist of total mastectomy with axillary lymph node dissection followed by postoperative radiation therapy to the chest wall and regional lymphatics. Breast-conserving therapy can be considered in patients with a good partial or complete response to neoadjuvant chemotherapy. Subsequent systemic therapy may consist of further chemotherapy. Hormone therapy should be administered to patients whose tumors are ER-positive or unknown. All patients should be considered candidates for clinical trials to evaluate the most appropriate fashion in which to administer the various components of multimodality regimens.

In one embodiment the combination therapy is administered as part of the various components of multimodality regimens. In another embodiment the combination therapy is administered before, simultaneously with, or after the multimodality regimens. In another embodiment the combination therapy is administered based on synergism between the modalities. In another embodiment the combination therapy is administered after treatment with anthracycline-based chemotherapy and/or taxane-based therapy (Zitvogel et al., 2008). Treatment after administering the combination therapy may negatively affect dividing effector T-cells. The combination therapy may also be administered after radiation.

In another embodiment the combination therapy described herein is used in the treatment in a cancer where the standard of care is primarily not surgery and is primarily based on systemic treatments, such as Chronic Lymphocytic Leukemia (CLL).

In another embodiment patients diagnosed with stage I, II, III, and IV Chronic Lymphocytic Leukemia are treated with the combination therapy as described herein. The standard of care for this cancer type is:
1. Observation in asymptomatic or minimally affected patients
2. Rituximab
3. Ofatumomab
4. Oral alkylating agents with or without corticosteroids
5. Fludarabine, 2-chlorodeoxyadenosine, or pentostatin
6. Bendamustine
7. Lenalidomide
8. Combination chemotherapy.
   combination chemotherapy regimens include the following:
   Fludarabine plus cyclophosphamide plus rituximab.
   Fludarabine plus rituximab as seen in the CLB-9712 and CLB-9011 trials.
   Fludarabine plus cyclophosphamide versus fludarabine plus cyclophosphamide plus rituximab.
   Pentostatin plus cyclophosphamide plus rituximab as seen in the MAYO-MC0183 trial, for example.
   Ofatumumab plus fludarabine plus cyclophosphamide.
   CVP: cyclophosphamide plus vincristine plus prednisone.
   CHOP: cyclophosphamide plus doxorubicin plus vincristine plus prednisone.
   Fludarabine plus cyclophosphamide versus fludarabine as seen in the E2997 trial [NCT00003764] and the LRF-CLL4 trial, for example.
   Fludarabine plus chlorambucil as seen in the CLB-9011 trial, for example.
9. Involved-field radiation therapy.
10. Alemtuzumab
11. Bone marrow and peripheral stem cell transplantations are under clinical evaluation.
12. Ibrutinib In one embodiment the combination therapy is administered before, simultaneously with or after treatment with Rituximab or Ofatumomab. As these are monoclonal antibodies that target B-cells, treatment with the combination therapy may be synergistic. In another embodiment the combination therapy is administered after treatment with oral alkylating agents with or without corticosteroids, and Fludarabine, 2-chlorodeoxyadenosine, or pentostatin, as these treatments may negatively affect the immune system if administered before. In one embodiment bendamustine is administered with the combination therapy in low doses based on the results for prostate cancer described herein. In one embodiment the combination therapy is administered after treatment with bendamustine.

In another embodiment, therapies targeted to specific recurrent mutations in genes that include extracellular domains are used in the treatment of a patient in need thereof suffering from cancer. The genes may advantageously be well-expressed genes. Well expressed may be expressed in "transcripts per million" (TPM). A TPM greater than 100 is considered well expressed. Well expressed genes may be FGFR3, ERBB3, EGFR, MUC4, PDGFRA, MMP12, TMEM52, and PODXL. The therapies may be a ligand capable of binding to an extracellular neoantigen epitope. Such ligands are well known in the art and may include therapeutic antibodies or fragments thereof, antibody-drug conjugates, engineered T cells, or aptamers. Engineered T cells may be chimeric antigen receptors (CARs). Antibodies may be fully humanized, humanized, or chimeric. The antibody fragments may be a nanobody, Fab, Fab', (Fab')2, Fv, ScFv, diabody, triabody, tetrabody, Bis-scFv, minibody, Fab2, or Fab3 fragment. Antibodies may be developed against tumor-specific neoepitopes using known methods in the art.

Adoptive Cell Transfer (ACT)

Aspects of the invention involve the adoptive transfer of immune system cells, such as T cells, specific for selected antigens, such as tumor associated antigens (see Maus et al., 2014, Adoptive Immunotherapy for Cancer or Viruses, Annual Review of Immunology, Vol. 32: 189-225; Rosenberg and Restifo, 2015, Adoptive cell transfer as personalized immunotherapy for human cancer, Science Vol. 348 no. 6230 pp. 62-68; Restifo et al., 2015, Adoptive immunotherapy for cancer: harnessing the T cell response. Nat. Rev. Immunol. 12(4): 269-281; and Jenson and Riddell, 2014, Design and implementation of adoptive therapy with chimeric antigen receptor-modified T cells. Immunol Rev. 257(1): 127-144). Various strategies may for example be employed to genetically modify T cells by altering the specificity of the T cell receptor (TCR) for example by introducing new TCR α and β chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088,379).

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004,811; 6,284,240; 6,392,013; 6,410,014; 6,753,162; 8,211,422; and, PCT Publication WO9215322). Alternative CAR constructs may be characterized as belonging to successive generations. First-generation CARs typically consist of a single-chain variable fragment of an antibody specific for an antigen, for example comprising a $V_L$ linked to a $V_H$ of a specific antibody, linked by a flexible linker, for example by a CD8α hinge domain and a CD8α transmembrane domain, to the transmembrane and intracellular signaling domains of either CD3ζ or FcRγ (scFv-CD3ζ or scFv-FcRγ; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761). Third-generation CARs include a combination of costimulatory endodomains, such a CD3 ζ-chain, CD97, GDI 1a-CD18, CD2, ICOS, CD27, CD154, CDS, OX40, 4-1BB, or CD28 signaling domains (for example scFv-CD28-4-1BB-CD3ζ or scFv-CD28-OX40-CD3 see U.S. Pat. Nos. 8,906,682; 8,399,645; 5,686,281; PCT Publication No. WO2014134165; PCT Publication No. WO2012079000). Alternatively, costimulation may be orchestrated by expressing CARs in antigen-specific T cells, chosen so as to be activated and expanded following engagement of their native αβTCR, for example by antigen on professional antigen-presenting cells, with attendant costimulation. In addition, additional engineered receptors may be provided on the immunoresponsive cells, for example to improve targeting of a T-cell attack and/or minimize side effects.

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using 2nd generation antigen-specific CARs signaling through CD3 and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with γ-irradiated activating and propagating cells (AaPC), which co-express the cancer antigen and co-stimulatory molecules. The engineered CAR T-cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to treat tumor xenografts.

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoreponsive cell, thereby treating or preventing the disease (such as a neoplasia, a pathogen infection, an autoimmune disorder, or an allogeneic transplant reaction).

In one embodiment, the treatment can be administrated into patients undergoing an immunosuppressive treatment. The cells or population of cells, may be made resistant to at least one immunosuppressive agent due to the inactivation of a gene encoding a receptor for such immunosuppressive agent. Not being bound by a theory, the immunosuppressive treatment should help the selection and expansion of the immunoresponsive or T cells according to the invention within the patient.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of $10^4$-$10^9$ cells per kg body weight, preferably $10^5$ to $10^6$ cells/kg body weight including all integer values of cell numbers within those ranges. Dosing in CAR T cell therapies may for example involve administration of from $10^6$ to $10^9$ cells/kg, with or without a course of lymphodepletion, for example with cyclophosphamide. The cells or population of cells can be administrated in one or more doses. In another embodiment, the effective amount of cells are administrated as a single dose. In another embodiment, the effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells are administrated parenterally. The administration can be an intravenous administration. The administration can be directly done by injection within a tumor.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation (Greco, et al., Improving the safety of cell therapy with the TK-suicide gene. Front. Pharmacol. 2015; 6: 95). In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-1683; Sadelain M, The New England Journal of Medicine 2011; 365:1735-173; Ramos et al., Stem Cells 28(6): 1107-15 (2010)).

In a further refinement of adoptive therapies, genome editing may be used to tailor immunoresponsive cells to alternative implementations, for example providing edited CAR T cells (see Poirot et al., 2015, Multiplex genome edited T-cell manufacturing platform for "off-the-shelf" adoptive T-cell immunotherapies, Cancer Res 75 (18): 3853). Cells may be edited using any DNA targeting protein, including, but not limited to a CRISPR system, Zinc Finger binding protein, TALE or TALEN as known in the art. DNA targeting proteins may be delivered to an immune cell by any method known in the art. In preferred embodiments, cells are edited ex vivo and transferred to a subject in need thereof. Immunoresponsive cells, CAR T cells or any cells used for adoptive cell transfer may be edited. Editing may be performed to eliminate potential alloreactive T-cell receptors (TCR), disrupt the target of a chemotherapeutic agent, block an immune checkpoint, activate a T cell, and/or increase the differentiation and/or proliferation of functionally exhausted or dysfunctional CD8+ T-cells (see PCT Patent Publications: WO2013176915, WO2014059173, WO2014172606, WO2014184744, and WO2014191128). Editing may result in inactivation of a gene.

By inactivating a gene it is intended that the gene of interest is not expressed in a functional protein form. In a particular embodiment, the CRISPR system specifically catalyzes cleavage in one targeted gene thereby inactivating said targeted gene. The nucleic acid strand breaks caused are commonly repaired through the distinct mechanisms of homologous recombination or non-homologous end joining (NHEJ). However, NHEJ is an imperfect repair process that often results in changes to the DNA sequence at the site of the cleavage. Repair via non-homologous end joining (NHEJ) often results in small insertions or deletions (Indel) and can be used for the creation of specific gene knockouts. Cells in which a cleavage induced mutagenesis event has occurred can be identified and/or selected by well-known methods in the art.

T cell receptors (TCR) are cell surface receptors that participate in the activation of T cells in response to the presentation of antigen. The TCR is generally made from two chains, α and β, which assemble to form a heterodimer and associates with the CD3-transducing subunits to form the T cell receptor complex present on the cell surface. Each α and β chain of the TCR consists of an immunoglobulin-like N-terminal variable (V) and constant (C) region, a hydrophobic transmembrane domain, and a short cytoplasmic region. As for immunoglobulin molecules, the variable region of the α and β chains are generated by V(D)J recombination, creating a large diversity of antigen specificities within the population of T cells. However, in contrast to immunoglobulins that recognize intact antigen, T cells are activated by processed peptide fragments in association with an MHC molecule, introducing an extra dimension to antigen recognition by T cells, known as MHC restriction. Recognition of MHC disparities between the donor and recipient through the T cell receptor leads to T cell proliferation and the potential development of graft versus host disease (GVHD). The inactivation of TCRα or TCRβ can result in the elimination of the TCR from the surface of T cells preventing recognition of alloantigen and thus GVHD. However, TCR disruption generally results in the elimination of the CD3 signaling component and alters the means of further T cell expansion.

Allogeneic cells are rapidly rejected by the host immune system. It has been demonstrated that, allogeneic leukocytes present in non-irradiated blood products will persist for no more than 5 to 6 days (Boni, Muranski et al. 2008 Blood 1;

112(12):4746-54). Thus, to prevent rejection of allogeneic cells, the host's immune system usually has to be suppressed to some extent. However, in the case of adoptive cell transfer the use of immunosuppressive drugs also have a detrimental effect on the introduced therapeutic T cells. Therefore, to effectively use an adoptive immunotherapy approach in these conditions, the introduced cells would need to be resistant to the immunosuppressive treatment. Thus, in a particular embodiment, the present invention further comprises a step of modifying T cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to T cells for immunotherapy by inactivating the target of the immunosuppressive agent in T cells. As non-limiting examples, targets for an immunosuppressive agent can be a receptor for an immunosuppressive agent such as: CD52, glucocorticoid receptor (GR), a FKBP family gene member and a cyclophilin family gene member.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDICDI). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson H A, et al., SHP-1: the next checkpoint target for cancer immunotherapy? Biochem Soc Trans. 2016 Apr. 15; 44(2):356-62). SHP-1 is a widely expressed inhibitory protein tyrosine phosphatase (PTP). In T-cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

WO2014172606 relates to the use of MT1 and/or MT1 inhibitors to increase proliferation and/or activity of exhausted CD8+ T-cells and to decrease CD8+ T-cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SHP-1 or TIM-3. In preferred embodiments, the gene locus involved in the expression of PD-1 or CTLA-4 genes is targeted. In other preferred embodiments, combinations of genes are targeted, such as but not limited to PD-1 and TIGIT.

In other embodiments, at least two genes are edited. Pairs of genes may include, but are not limited to PD1 and TCRα, PD1 and TCRβ, CTLA-4 and TCRα, CTLA-4 and TCRβ, LAG3 and TCRα, LAG3 and TCRβ, Tim3 and TCRα, Tim3 and TCRβ, BTLA and TCRα, BTLA and TCRβ, BY55 and TCRα, BY55 and TCRβ3, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ3.

Whether prior to or after genetic modification of the T cells, the T cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. T cells can be expanded in vitro or in vivo.

Selecting the Patient Population Most Likely to Benefit from the Therapy

In another aspect, the invention provides selecting for the patients in need thereof most likely to benefit from the therapy of the present invention. Although the compositions and methods of the present invention are typically applicable in a high proportion of subjects suffering from cancer, the method may still comprise one or more steps of selecting patients from the patient population who are likely to benefit. For instance, the method may comprise selecting subjects whose tumors contain one or more of the mutations represented in the neoantigenic peptides in the composition. In another embodiment, the method may comprise selecting subjects having at least one HLA allele which binds to one or more neoepitopes represented in the neoantigenic peptides in the composition.

Vaccine or Immunogenic Composition Kits and Co-Packaging

In an aspect, the invention provides kits containing any one or more of the elements discussed herein to allow administration of the therapy. Elements may be provided individually or in combinations, and may be provided in any suitable container, such as a vial, a bottle, or a tube. In some embodiments, the kit includes instructions in one or more languages, for example in more than one language. In some embodiments, a kit comprises one or more reagents for use in a process utilizing one or more of the elements described herein. Reagents may be provided in any suitable container. For example, a kit may provide one or more delivery or storage buffers. Reagents may be provided in a form that is usable in a particular process, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more of the vectors, proteins and/or one or more of the polynucleotides described herein. The kit may advantageously allow the provision of all elements of the systems of the invention. Kits can involve vector(s) and/or particle(s) and/or nanoparticle(s) containing or encoding RNA(s) for 1-50 or more neoantigen mutations to be administered to an animal, mammal, primate, rodent, etc., with such a kit including instructions for administering to such a eukaryote; and such a kit can optionally include any of the anti-cancer agents described herein. The kit may include any of the components above (e.g. vector(s) and/or particle(s) and/or nanoparticle(s) containing or encoding RNA(s) for 1-50 or more neoantigen mutations, neoantigen proteins or peptides) as well as instructions for use with any of the methods of the present invention.

In one embodiment the kit contains at least one vial with an immunogenic composition or vaccine. In one embodiment the kit contains at least one vial with an immunogenic composition or vaccine and at least one vial with an anti-cancer agent. In one embodiment kits may comprise ready to use components that are mixed and ready to administer. In one aspect a kit contains a ready to use immunogenic or vaccine composition and a ready to use anti-cancer agent. The ready to use immunogenic or vaccine composition may comprise separate vials containing different pools of immunogenic compositions. The immunogenic compositions may comprise one vial containing a viral vector or DNA plasmid and the other vial may comprise immunogenic protein. The ready to use anticancer agent may comprise a cocktail of anticancer agents or a single anticancer agent. Separate vials may contain different anti-cancer agents. In another embodiment a kit may contain a ready to use anti-cancer agent and an immunogenic composition or vaccine in a ready to be reconstituted form. The immunogenic or vaccine composition may be freeze dried or lyophilized. The kit may comprise a separate vial with a reconstitution buffer that can be added to the lyophilized composition so that it is ready to administer. The buffer may advantageously comprise an adjuvant or emulsion according to the present invention. In another embodiment the kit may comprise a ready to reconstitute anti-cancer agent and a ready to reconstitute immunogenic composition or vaccine. In this aspect both may be lyophilized. In this aspect separate reconstitution buffers for each may be included in the kit. The buffer may advantageously comprise an adjuvant or emulsion according to the present invention. In another embodiment the kit may comprise single vials containing a dose of immunogenic composition and anti-cancer agent that are administered together. In another aspect multiple vials are included so that one vial is administered according to a treatment timeline. One vial may only contain the anti-cancer agent for one dose of treatment, another may contain both the anti-cancer agent and immunogenic composition for another dose of treatment, and one vial may only contain the immunogenic composition for yet another dose. In a further aspect the vials are labeled for their proper administration to a patient in need thereof. The immunogen or anti-cancer agents of any embodiment may be in a lyophilized form, a dried form or in aqueous solution as described herein. The immunogen may be a live attenuated virus, protein, or nucleic acid as described herein.

In one embodiment the anticancer agent is one that enhances the immune system to enhance the effectiveness of the immunogenic composition or vaccine. In a preferred embodiment the anti-cancer agent is a checkpoint inhibitor.

In another embodiment the kit contains multiple vials of immunogenic compositions and anti-cancer agents to be administered at different time intervals along a treatment plan. In another embodiment the kit may comprise separate vials for an immunogenic composition for use in priming an immune response and another immunogenic composition to be used for boosting. In one aspect the priming immunogenic composition could be DNA or a viral vector and the boosting immunogenic composition may be protein. Either composition may be lyophilized or ready for administering. In another embodiment different cocktails of anti-cancer agents containing at least one anti-cancer agent are included in different vials for administration in a treatment plan.

Although the present invention and its advantages have been described in detail, it should be understood that various changes, substitutions and alterations can be made herein without departing from the spirit and scope of the invention as defined in the appended claims.

The present invention will be further illustrated in the following Examples which are given for illustration purposes only and are not intended to limit the invention in any way.

EXAMPLES

Example 1 sPDL1 Generates Immunogenic Epitopes Across a Variety of HLA Alleles.

PDL1 (CD274) is a trans-membrane protein which interacts with PD1 (CD279; PDCD1) on T cells and may be involved in multiple forms of natural immune suppression (such as during gestation). Expression of PDL1 is also utilized by tumor cells as a way to evade host immune response. sPDL1 is an alternate spliced form of the PDL1 gene. This alternate spliced form is caused by a lack of splicing at the end of Exon 4, reading into the $4^{th}$ intron. The transcript terminates within intron 4. The translation product is in frame for 18 amino acids before a stop codon is encountered.

The translated product lacks the transmembrane domain typically found in PDL1 and thus is secreted. It also contains a cysteine within the neoORF translated from the intron and appears to dimerize in the media. The secreted form appears to block binding between PDL1 and PD1.

Applicants analyzed the predicted binding possibilities for 9 and 10mer peptides containing the neoORF region encoded by the intron. The analysis is shown for predicted 9mer peptides Table 1. The values in bolded font are alleles that are present at a frequency >5% in the indicated population. Notably, the common HLA allele A0210 in the Caucasian population is predicted to have a reasonably tight binding peptide. A similar analysis shows that 10mer peptides are also predicted to be potentially immunogenic, including for the A0201 allele (85 nM). Tumor cells expressing the alternate form of the PDL1 message would be thus rendered as targets of the immune system.

These peptides could be utilized across multiple patients (either HLA-restricted or more broadly if the patient is expected to have some probability to contain a relevant HLA allele) as a "Shared Neoantigen". Note that given the relatively short size of the neoORF region of sPDL1, two or three long overlapping peptides could be used as a mixture, allowing targeting of any HLA allele, even rare alleles, and reducing the need to prepare a different product for each patient based on their HLA type.

This neoORF may also contain a CD4 epitope although prediction algorithms for CD4 epitopes are not highly accurate. The presence of a CD4 epitope could be assessed in vitro with naive T cells or in patient samples.

TABLE 1

(SEQ ID NOS 1-23, respectively, in order of appearance)

ENHTAELVIP
GNILNVSIKICLTLSPST

| HLA | peptide 9mers | affinity (nM) | Caucasian | Black | Asian | Hispanic |
|---|---|---|---|---|---|---|
| A0201 | VIPGNILNV | 182 | 28.3% | 11.4% | 9.7% | 19.7% |
| B4001 | AELVIPGNI | 144 | 4.0% | 1.0% | 12.0% | 1.3% |
| A3201 | NILNVSIKI | 491 | 3.2% | 1.6% | 0.3% | 2.6% |
| A3201 | VSIKICLTL | 224 | 3.2% | 1.6% | 0.3% | 2.6% |
| A2301 | VSIKICLTL | 468 | 2.3% | 11.6% | 0.2% | 3.5% |
| B4002 | AELVIPGNI | 53 | 1.6% | 0.3% | 7.6% | 5.0% |
| B4901 | AELVIPGNI | 108 | 1.4% | 3.1% | 0.0% | 2.3% |
| B4102 | AELVIPGNI | 192 | 1.0% | 0.6% | 0.0% | 0.5% |
| A0205 | VIPGNILNV | 170 | 0.8% | 2.3% | 0.1% | 1.4% |
| B5801 | VSIKICLTL | 373 | 0.8% | 4.3% | 4.5% | 1.3% |
| A6802 | HTAEVIPG | 170 | 0.7% | 6.4% | 0.0% | 2.4% |
| B4405 | AELVIPGNI | 219 | 0.6% | 0.0% | 0.0% | 0.2% |
| B4101 | AELVIPGNI | 92 | 0.5% | 0.6% | 0.0% | 1.1% |
| B4501 | AELVIPGNI | 302 | 0.4% | 5.3% | 0.0% | 1.5% |
| B1517 | VSIKICLTL | 23 | 0.3% | 0.5% | 0.1% | 0.6% |
| A0206 | VIPGNILNV | 85 | 0.2% | 0.0% | 4.7% | 4.1% |
| A0202 | VIPGNILNV | 90 | 0.1% | 4.4% | 0.0% | 0.7% |
| A6901 | HTAEVIPG | 283 | 0.1% | 0.1% | 0.0% | 0.5% |
| A6901 | NILNVSIKI | 162 | 0.1% | 0.1% | 0.0% | 0.5% |
| B1503 | IKICLTLSP | 408 | 0.1% | 6.5% | 0.1% | 1.5% |
| B1503 | VSIKICLTL | 138 | 0.1% | 6.5% | 0.1% | 1.5% |
| A0203 | VIPGNILNV | 98 | 0.0% | 0.0% | 5.2% | 0.0% |

Example 2

Androgen Receptor Generates Immunogenic Epitopes Across a Variety of HLA Alleles.

The androgen receptor was identified as another alternate spliced form of a message that results in a neoORF which may be specifically expressed in tumor cells. Alternate splicing results in at least two isoforms that bring in cryptic exons that are .neoORFs.

Of these alternate transcripts, AR-V1 and AR-V7 were consistently seen in hormone resistant prostate cancer samples.

The immunogenic potential of these neoORFs was unknown and thus Applicants conducted predicted binding analysis across a number of common HLA alleles. These are shown for HLA A alleles (Table 2).

TABLE 2

(SEQ ID NOS 24, 27, 28, 30, 25, 29, 31, 26, 32, 33, 41, 43, 45, 34, 42, 44, 46, 35, 47, 36, 48, 37, 49 and 38-40, respectively, in order of appearance)

| | A0201 | | | A0301 | | | A1101 | | | A3001 | | |
|---|---|---|---|---|---|---|---|---|---|---|---|---|
| Caucasian | 28.30% | | | 13.70% | | | 6.00% | | | 1.60% | | |
| Asian | 9.70% | | | 0.90% | | | 22.40% | | | 1.40% | | |
| Hispanic | 19.65% | | | 7.59% | | | 4.88% | | | 2.20% | | |
| Black | 11.40% | | | 7.10% | | | 1.00% | | | 6.50% | | |
| | RVFGVSEWL | SEQ2 | 233 | RVGNCKHLK | SEQ1 | 122 | RVGNCKHLK | SEQ1 | 33 | RVGNCKHLK | SEQ1 | 30 |
| | GMTLGAVVV | SEQ2 | 282 | | | | VVVSERILR | SEQ2 | 359 | KFRVGNCKH | SEQ1 | 103 |
| | MTLGEKFRV | SEQ1 | 400 | | | | | | | KFRVGNCKHL | SEQ1 | 190 |

| | A3101 | | | A3201 | | | A3301 | | | A6801 | | | A | B | |
|---|---|---|---|---|---|---|---|---|---|---|---|---|---|---|---|
| | 2.40% | | | 3.20% | | | 0.70% | | | 3.40% | | | 30.30% | 6.80% | Caucasian |
| | 3.40% | | | 0.30% | | | 0.60% | | | 0.30% | | | 28.70% | 19.70% | Asian |
| | 4.72% | | | 2.62% | | | 1.97% | | | 4.46% | | | 26.46% | 7.86% | Hispanic |
| | 1.00% | | | 1.60% | | | 1.70% | | | 3.20% | | | 20.40% | 2.10% | Black |
| | RVGNCKHLK | SEQ1 | 70 | RVFGVSEWL | SEQ2 | 41 | NCKHLKMTR | SEQ1 | 385 | VVVSERILR | SEQ2 | 47 | | | |
| | TLGAVVVSER | SEQ2 | 121 | ILRVFGVSEW | SEQ2 | 255 | TLGAVVVSER | SEQ2 | 417 | TLGAVVVSER | SEQ2 | 84 | | | |
| | VVVSERILR | SEQ2 | 127 | | | | | | | EAGMTLGEK | SEQ 1 | 230 | | | |
| | GMTLGEKFR | SEQ1 | 199 | | | | | | | LGAVVVSER | SEQ2 | 268 | | | |

TABLE 2-continued (SEQ ID NOS 24, 27, 28, 30, 25. 29, 31, 26, 32, 33, 41, 43, 45, 34, 42. 44,
46, 35, 47,36, 48.37, 49 and 38-40, respectively, in order of appearance)

| AVVVSERILR | SEQ2 | 230 | AVVVSERILR | SEQ2 | 339 |
|---|---|---|---|---|---|
| AGMTLGEKFR | SEQ1 | 284 | | | |
| GNCKHLKMTR | SEQ1 | 466 | | | |
| LGAVVVSER | SEQ2 | 488 | | | |

Again, as for sPDL1, a number of peptides are predicted to be immunogenic binders and these can be applied across a large subset of patients. These immunogenic peptides can be used across multiple patients.

Example 3

Drug Resistant Mutations.

Treatment with various chemotherapeutic agents, particularly with targeted therapies such as tyrosine kinase inhibitors, frequently leads to new mutations in the target molecules that resist the activity of the therapeutic. Multiple strategies to overcome this resistance are being evaluated, including development of second generation therapies that are not affected by these mutations and treatment with multiple agents including those that act downstream of the resistance mutation.

Applicants have evaluated the immunogenic potential of the mutated peptides created by these resistance mutations and have found that for some, predicted immunogenic peptides are created that can bind to a range of HLA alleles. Two specific examples are provided below as well as data for a range of resistance variants.

BTK/C481S

A very common mutation to ibrutinib, a molecule targeting Bruton's Tyrosine Kinase (BTK) and used for CLL and certain lymphomas, is a Cysteine to Serine change at position 481. This change produces a number of binding peptides which bind to a range of HLA molecules.

Shown are results of binding predictions for 9mer peptides. Similar binding peptides can be found for 10mer peptides (Table 3). Only peptides with mutant predicted affinity below 150 nM are included. Expanding the range of peptides up to 500 nM would also significantly increase the number of HLA range.

TABLE 3

(SEQ ID NOS 50-72, respectively, in order of appearance)

| HLA | peptide 9mers | Affinity (nM) MUT | Affinity (nM) NAT | Caucasian | Black | Asian | Hispanic |
|---|---|---|---|---|---|---|---|
| A0201 | SLLNYLREM | 97 | 278 | 28.3% | 11.4% | 9.7% | 19.7% |
| A2402 | EYMANGSLL | 95 | 120 | 9.3% | 2.0% | 23.1% | 12.4% |
| B1801 | TEYMANGSL | 80 | 252 | 6.1% | 3.5% | 0.4% | 4.1% |
| B1501 | MANGSLLNY | 91 | 158 | 5.8% | 0.8% | 12.1% | 2.6% |
| B3501 | MANGSLLNY | 17 | 17 | 5.6% | 6.1% | 2.4% | 6.0% |
| B4001 | TEYMANGSL | 10 | 24 | 4.0% | 1.0% | 12.0% | 1.3% |
| A3101 | LLNYLREMR | 43 | 206 | 2.4% | 1.0% | 3.4% | 4.7% |
| A2301 | EYMANGSLL | 122 | 133 | 2.3% | 11.6% | 0.2% | 3.5% |
| A2902 | MANGSLLNY | 17 | 10 | 2.0% | 4.4% | 0.0% | 4.1% |
| B4002 | TEYMANGSL | 45 | 110 | 1.6% | 0.3% | 7.6% | 5.0% |
| B4102 | TEYMANGSL | 133 | 341 | 1.0% | 0.6% | 0.0% | 0.5% |
| B5801 | MANGSLLNY | 40 | 35 | 0.8% | 4.3% | 4.5% | 1.3% |
| A3301 | LLNYLREMR | 91 | 188 | 0.7% | 1.7% | 0.6% | 2.0% |
| A3002 | MANGSLLNY | 16 | 15 | 0.5% | 6.6% | 0.0% | 2.8% |
| A6804 | EYMANGSLL | 47 | 448 | 0.0% | 0.0% | 0.0% | 0.0% |
| B1801 | TEYMANGSL | 44 | 252 | 6.1% | 3.5% | 0.4% | 4.1% |
| B1501 | MANGSLLNY | 42 | 158 | 5.8% | 0.8% | 12.1% | 2.6% |
| B3501 | MANGSLLNY | 40 | 17 | 5.6% | 6.1% | 2.4% | 6.0% |
| B4001 | TEYMANGSL | 38 | 24 | 4.0% | 1.0% | 12.0% | 1.3% |
| A3101 | LLNYLREMR | 36 | 206 | 2.4% | 1.0% | 3.4% | 4.7% |
| A2301 | EYMANGSLL | 34 | 133 | 2.3% | 11.6% | 0.2% | 3.5% |
| A2902 | MANGSLLNY | 32 | 10 | 2.0% | 4.4% | 0.0% | 4.1% |
| B4002 | TEYMANGSL | 30 | 110 | 1.6% | 0.3% | 7.6% | 5.0% |

Such peptide immunogens are preferably utilized prophylactically (prior to detection of resistant disease) to induce an immunogenic response capable of killing any pre-existing or newly mutated cells or could also be used at the time of detection of disease recurrence following or during therapy. These peptides could be utilized across multiple patients (either HLA-restricted or more broadly if the patient is expected with some probability to contain a relevant HLA allele).

EGFR/T790M

Erlotinib, which targets the tyrosine kinase domain of the Epidermal Growth Factor Receptor (EGFR), is commonly used in the treatment of lung cancer and resistant tumors invariably develop following therapy. A common mutation found in resistant clones is a Threonine to methionine mutation at position 790. This change produces a number of binding peptides which bind to a range of HLA molecules (Table 4).

TABLE 4

|  |  |  |  |  |  |  | SUM |
|---|---|---|---|---|---|---|---|
| Caucasian | 2.3% | 3.9% | 4.0% | 3.2% | 3.2% |  | 17% |
| Black | 11.6% | 0.3% | 1.5% | 1.6% | 1.6% |  | 17% |
| Asian | 0.2% | 0.0% | 3.9% | 0.3% | 0.3% |  | 5% |
| Hispanic | 3.5% | 0.9% | 2.8% | 2.6% | 2.6% |  | 12% |
|  | A23C1 | A2501 | A2601 | A3201 | A3201 |  |  |
|  | VQLIMQLMPF 366 | STVQLIMQLM 125 | STVQLIMQLM 67 | QLIMQLMPF 155 VQLIMQLMPF 426 | QLIMQLMPF 155 VQLIMQLMPF 426 |  |  |
| Caucasian | 4.2% | 5.8% | 2.9% | 1.4% | 0.4% | 1.6% | 16% |
| Black | 1.2% | 0.8% | 0.1% | 0.3% | 0.1% | 0.3% | 3% |
| Asian | 1.2% | 12.1% | 0.2% | 2.4% | 0.0% | 7.6% | 24% |
| Hispanic | 1.2% | 2.6% | 1.8% | 1.0% | 2.2% | 5.0% | 14% |
|  | B1302 | B1501 | B3801 | B3901 | B3906 | B4002 |  |
|  | MQLMPFGCLL 125 | MQLMPFGCLL 488 QLIMQLMPF 23 VQLIMQLMPF 73 | MQLMPFGCLL 400 | MQLMPFGCLL 213 | MQLMPFGCLL 400 | MQLMPFGCL 221 MQLMPFGCLL 103 VQLIMQLMPF 365 |  |

(SEQ ID NOS 73,74,74-76,73,73,78,78,78,78,78,79,80,78,77 and 77, respectively, in order of apperance)

As stated herein, such peptide immunogens are ideally utilized prophylactically (prior to detection of resistant disease) to induce an immunogenic response capable of killing any pre-existing or newly mutated cells or are also used at the time of detection of disease recurrence following or during therapy. These peptides could be utilized across multiple patients (either HLA-restricted or more broadly if the patient is expected with some probability to contain a relevant HLA allele).

Note that as an immunogen, only a single long peptide containing the mutated amino acid and at least 10 amino acids on either side of the mutated amino acid would be sufficient to contain all the epitopes listed. Thus, all the HLA alleles shown, as well as any additional alleles that have not been shown in this analysis would be covered. For the Caucasian population, the HLA A alleles shown represent 17% of the population distribution of alleles and the HLA B alleles represent 16% of the population distribution of alleles. As each individual has two HLA A alleles and two HLA B alleles, approximately 50% of Caucasian patients will be expected to have at least one of the alleles shown and thus benefit from immune therapy with a vaccine targeting this molecule. This rationale also applies to any other single amino acid mutation discussed herein.

Other Resistance Variants

In addition to the specific resistance cases discussed herein, there are many other observed resistance mutations to targeted therapy. Each of these are also used to define immunogenic epitopes that could be utilized as vaccine for immunotherapy targeting those cells containing the resistance mutations (Table 5).

TABLE 5

| Drug | Gene | Resistance mutation | Sensitive | Refs |
|---|---|---|---|---|
| Imatinib | BCR-Abl | T315I |  | http://www.mycancergenome.org/content/disease/chronic-myeloid-leukemia/ |
| Imatinib | BCR-Abl | Y253H |  | http://www.mycancergenome.org/content/disease/chronic-myeloid-leukemia/ |
| Imatinib | BCR-Abl | E255K |  | http://www.mycancergenome.org/content/disease/chronic-myeloid-leukemia/ |
| Imatinib | BCR-Abl | E255V |  | http://www.mycancergenome.org/content/disease/chronic-myeloid-leukemia/ |
| Imatinib | c-kit | T670I |  | http://www.mycancergenome.org/content/disease/gist/kit/50/ |
| Erlotinib/gefitinib | PIK3CA | E545K |  | PMC1570180; PMC3132801 |
| Erlotinib/gefitinib | HER2 | G776(YVMA) |  | PMID 16843263; 15753357 |
| Erlotinib/gefitinib | EML4-ALK | G1269A |  | http://www.ncbi.nlm.nih.gov/pubmed/22235099?dopt=Abstract |
| Crizotinib | KRAS | G12V/D |  | http://www.ncbi.nlm.nih.gov/pubmed/22235099?dopt=Abstract |
| Crizotinib | ALK | L1196M |  | http://stm.sciencemag.org/content/4/120/120ra17 |
| Crizotinib | ALK | G1202R |  | http://stm.sciencemag.org/content/4/120/120ra17 |
| Crizotinib | ALK | S1206Y |  | http://stm.sciencemag.org/content/4/120/120ra17 |
| Crizotinib | ALK | 1151T(ins) |  | http://stm.sciencemag.org/content/4/120/120ra17 |
| Crizotinib | ALK | F1174C |  | http://cancerdiscovery.aacrjournals.org/content/4/6/662 |
| Crizotinib | ROS1 | G2032R |  | http://www.nejm.org/doi/full/10.1056/NEJMoa1215530 |
| Crizotinib | PIK3CA | E542K |  | http://www.mycancergenome.org/content/disease/breast-cancer/ |
| Trastuzumab | Her2 | E545K |  | http://www.mycancergenome.org/content/disease/breast-cancer/ |
| Trastuzumab | Hwe2 | H1047R |  | http://www.mycancergenome.org/content/disease/breast-cancer/ |
| Trastuzumab | AKT1 | E17K |  | http://www.ncbi.nlm.nih.gov/pmc/articles/PMC2834432/ |
| Trastuzumab | BRAF |  | V600E |  |
| Vemurafenib | MEK1 | Q56P |  | http://www.ncbi.nlm.nih.gov/pubmed/23569304 |
| Vemurafenib | MEK1 | E203K |  | http://www.ncbi.nlm.nih.gov/pubmed/23569304 |
| Vemurafenib | MEK1 | C121S |  | http://cancerdiscovery.aacrjournals.org/content/4/1/94.long |
| Vemurafenib | NRAS | Q61K/L |  | http://www/ncbi.nlm.nih.gov/pubmed/23569304 |
| Vemurafenib | NRAS | Q61R |  | http://cancerdiscovery.aacrjournals.org/content/4/1/94.long |
| Vemurafenib | NRAS | T58I |  | http://cancerdiscovery.aacrjournals.org/content/4/1/94.long |
| Vemurafenib | MEK2 | C125S |  | http://cancerdiscovery.aacrjournals.org/content/4/1/94.long |
| Vemurafenib | MEK1 | V60E |  | http://cancerdiscovery.aacrjournals.org/content/4/1/94.long |

TABLE 5-continued

| Drug | Gene | Resistance mutation | Sensitive | Refs |
|---|---|---|---|---|
| RAF/MEK | MEK1 | G128V | | http://cancerdiscovery.aacrjournals.org/content/4/1/94.long |
| RAF/MEK | MEK1 | V154I | | http://cancerdiscovery.aacrjournals.org/content/4/1/94.long |
| RAF/MEK | MEK1 | P124S | | http://cancerdiscovery.aacrjournals.org/content/4/1/94.long |
| RAF/MEK | MEK1 | P124L | | http://cancerdiscovery.aacrjournals.org/content/4/1/94.long |
| RAF/MEK | RAC1 | P29S | | http://cancerdiscovery.aacrjournals.org/content/4/1/94.long |
| RAF/MEK | ESR1 | S463P | | http://cancerdiscovery.aacrjournals.org/content/4/1/94.long |
| Antiestrogen therapy | AR | V534E | | http://www.mycancergenome.org/content/disease/breast-cancer/er/314/ |
| Antiestrogen therapy | AR | P535H | | http://www.mycancergenome.org/content/disease/breast-cancer/er/314/ |
| Antiestrogen therapy | AR | L536Q | | http://www.mycancergenome.org/content/disease/breast-cancer/er/314/ |
| Antiestrogen therapy | AR | L536R | | http://www.mycancergenome.org/content/disease/breast-cancer/er/314/ |
| Antiestrogen therapy | AR | Y537C | | http://www.mycancergenome.org/content/disease/breast-cancer/er/314/ |
| Antiestrogen therapy | AR | Y537S | | http://www.mycancergenome.org/content/disease/breast-cancer/er/314/ |
| Antiestrogen therapy | AR | Y537N | | http://www.mycancergenome.org/content/disease/breast-cancer/er/314/ |
| Antiestrogen therapy | AR | D538G | | http://www.mycancergenome.org/content/disease/breast-cancer/er/314/ |
| Antiestrogen therapy | AR | F876L | | http://cancerdiscovery.aacrjournals.org/content/early/2013/06/18/2159-8290.CD-13-0226 |

A number of these examples have been used to predict immunogenic epitopes. These results are summarized in Table 6, in which for each resistance mutation, the number of potential binding peptides (with predicted affinity <500 nM) for each mutation are shown for multiple Human HLA alleles.

TABLE 6

| RES 500 | Caucasian | Black | Asian | ABL1:p.T315I 80 | ALK:p.F1174C 80 | ALK:p.F1174L 80 | ALK:p.G1202R 80 | ALK:p.G1269A 80 | ALK:p.L1196M 80 | ALK:p.S1206Y 80 | AR:p.F876L 80 |
|---|---|---|---|---|---|---|---|---|---|---|---|
| hla_a_01_01 | 0.143 | 0.047 | 0.012 | | | | | | | | |
| hla_a_02_01 | 0.283 | 0.114 | 0.097 | | | | | | | 1 | |
| hla_a_02_03 | 0 | 0 | 0.052 | | | | | | | | |
| hla_a_02_07 | 0 | 0 | 0.08 | | 1 | | | | | | |
| hla_a_03_01 | 0.137 | 0.071 | 0.009 | | | 1 | | | | | |
| hla_a_11_01 | 0.06 | 0.01 | 0.224 | | | | | 1 | 2 | | |
| hla_a_23_01 | 0.023 | 0.116 | 0.002 | 2 | | 2 | | 1 | 2 | | 2 |
| hla_a_24_02 | 0.093 | 0.02 | 0.231 | 1 | | | | | 1 | | |
| hla_a_30_01 | 0.016 | 0.065 | 0.014 | | 1 | 1 | 2 | | | 1 | 1 |
| hla_a_30_02 | 0.005 | 0.066 | 0 | 2 | | | | | | 2 | |
| hla_a_33_03 | 0.004 | 0.041 | 0.072 | | | | 3 | 1 | | 3 | |
| hla_a_68_02 | 0.007 | 0.064 | 0 | | | | 1 | | | | |
| hla_a_74_01 | 0 | 0.051 | 0.001 | | | | | | | | |
| hla_b_07_02 | 0.118 | 0.062 | 0.015 | | | | 1 | | 2 | 3 | 1 |
| hla_b_08_01 | 0.098 | 0.039 | 0.002 | | | | 2 | | 1 | 3 | |
| hla_b_15_01 | 0.058 | 0.008 | 0.121 | 1 | | | 3 | | | | 1 |
| hla_b_15_02 | 0 | 0 | 0.066 | 1 | | | 1 | | | | 1 |
| hla_b_15_03 | 0.001 | 0.065 | 0.001 | 5 | | 3 | 1 | 2 | 4 | 4 | 4 |
| hla_b_18_01 | 0.061 | 0.035 | 0.004 | 2 | | 1 | 1 | | 1 | | |
| hla_b_35_01 | 0.056 | 0.061 | 0.024 | 3 | | | 1 | | 1 | 2 | 2 |
| hla_b_40_01 | 0.04 | 0.01 | 0.12 | 3 | 1 | 1 | 1 | 1 | 1 | | 1 |
| hla_b_40_02 | 0.016 | 0.003 | 0.076 | 3 | | 1 | | | 2 | | 2 |
| hla_b_42_01 | 0 | 0.057 | 0 | | | | | | | | |
| hla_b_44_02 | 0.071 | 0.014 | 0.002 | | | 1 | | | | | 1 |
| hla_b_45_01 | 0.004 | 0.053 | 0 | | | 1 | | | | | 1 |
| hla_b_46_01 | 0 | 0 | 0.082 | | | | | | | | |
| hla_b_51_01 | 0.051 | 0.021 | 0.04 | | | | | | 2 | | |
| hla_b_53_01 | 0.003 | 0.11 | 0 | 1 | | | | | | 1 | |

| RES 500 | Caucasian | Black | Asian | BTK:p.C481S 80 | EGFR:p.T790M 80 | KRAS:p.G12D 80 | MAP2K1:p.C121S 80 | MAP2K1:p.E203K 80 | MAP2K1:p.G128V 80 | MAP2K1:p.P124L 80 | MAP2K1:p.P124S 80 |
|---|---|---|---|---|---|---|---|---|---|---|---|
| hla_a_01_01 | 0.143 | 0.047 | 0.012 | 2 | 1 | 1 | 1 | 3 | | 1 | 2 |
| hla_a_02_01 | 0.283 | 0.114 | 0.097 | 1 | 2 | 2 | 1 | 3 | | 2 | 1 |
| hla_a_02_03 | 0 | 0 | 0.052 | 2 | 1 | | | | | 2 | 1 |
| hla_a_02_07 | 0 | 0 | 0.08 | | | | | | | | |
| hla_a_03_01 | 0.137 | 0.071 | 0.009 | 1 | | | | | | 1 | |
| hla_a_11_01 | 0.06 | 0.01 | 0.224 | 2 | | 2 | | | 1 | | |

TABLE 6-continued

| | | | | MAP2K1:p.Q56P 80 | MAP2K1:p.V154I 80 | MAP2K1:p.V60E 80 | MAP2K2:p.C125S 80 | MAP2K2:p.L46F 80 | MAP2K2:p.N126D 80 | MAP2K2:p.V35M 80 | NRAS:p.Q61R 80 |
|---|---|---|---|---|---|---|---|---|---|---|---|
| hla_a_23_01 | 0.023 | 0.116 | 0.002 | 1 | | | | | 1 | | 2 |
| hla_a_24_02 | 0.093 | 0.02 | 0.231 | 1 | | | | | 1 | 1 | 1 |
| hla_a_30_01 | 0.016 | 0.065 | 0.014 | | 2 | | | | | | 1 |
| hla_a_30_02 | 0.005 | 0.066 | 0 | 2 | | | | | | 4 | 5 |
| hla_a_33_03 | 0.004 | 0.041 | 0.072 | 2 | | | 3 | | 3 | | |
| hla_a_68_02 | 0.007 | 0.064 | 0 | 1 | 2 | | | 1 | | | 1 |
| hla_a_74_01 | 0 | 0.051 | 0.001 | 1 | | 1 | | 2 | | | |
| hla_b_07_02 | 0.118 | 0.062 | 0.015 | | | | | 2 | | | |
| hla_b_08_01 | 0.098 | 0.039 | 0.002 | | | | | | | | |
| hla_b_15_01 | 0.058 | 0.008 | 0.121 | 3 | 2 | | 2 | 1 | 3 | 1 | 2 |
| hla_b_15_02 | 0 | 0 | 0.066 | 3 | 2 | | 2 | 1 | 3 | 3 | 3 |
| hla_b_15_03 | 0.001 | 0.065 | 0.001 | 8 | 7 | | 7 | 2 | 6 | 8 | 8 |
| hla_b_18_01 | 0.061 | 0.035 | 0.004 | 2 | | | | | 1 | 1 | 1 |
| hla_b_35_01 | 0.056 | 0.061 | 0.024 | 3 | 1 | | 2 | 1 | 3 | | 3 |
| hla_b_40_01 | 0.04 | 0.01 | 0.12 | 2 | 1 | | 2 | | 3 | 1 | 1 |
| hla_b_40_02 | 0.016 | 0.003 | 0.076 | 2 | 3 | | 3 | | 1 | 1 | 1 |
| hla_b_42_01 | 0 | 0.057 | 0 | | | | | | | | |
| hla_b_44_02 | 0.071 | 0.014 | 0.002 | | | 1 | | | | | |
| hla_b_45_01 | 0.004 | 0.053 | 0 | 3 | 1 | | 2 | | 1 | 1 | 1 |
| hla_b_46_01 | 0 | 0 | 0.082 | | | | 1 | 1 | | | |
| hla_b_51_01 | 0.051 | 0.021 | 0.04 | | | | | 1 | | | |
| hla_b_53_01 | 0.003 | 0.11 | 0 | 2 | | | | 2 | | | |

| RES 500 | Caucasian | Black | Asian | MAP2K1:p.Q56P 80 | MAP2K1:p.V154I 80 | MAP2K1:p.V60E 80 | MAP2K2:p.C125S 80 | MAP2K2:p.L46F 80 | MAP2K2:p.N126D 80 | MAP2K2:p.V35M 80 | NRAS:p.Q61R 80 |
|---|---|---|---|---|---|---|---|---|---|---|---|
| hla_a_01_01 | 0.143 | 0.047 | 0.012 | | 1 | | 1 | | 1 | 1 | 1 |
| hla_a_02_01 | 0.283 | 0.114 | 0.097 | | 1 | | 1 | | 1 | 1 | |
| hla_a_02_03 | 0 | 0 | 0.052 | | | | | | | | |
| hla_a_02_07 | 0 | 0 | 0.08 | | | | | | | | |
| hla_a_03_01 | 0.137 | 0.071 | 0.009 | 1 | 1 | | | | | | |
| hla_a_11_01 | 0.06 | 0.01 | 0.224 | 1 | | | | | | | |
| hla_a_23_01 | 0.023 | 0.116 | 0.002 | | | | | | | | |
| hla_a_24_02 | 0.093 | 0.02 | 0.231 | | | | | | | | |
| hla_a_30_01 | 0.016 | 0.065 | 0.014 | 2 | | 1 | | | | | 1 |
| hla_a_30_02 | 0.005 | 0.066 | 0 | | 1 | | 3 | | 4 | | 1 |
| hla_a_33_03 | 0.004 | 0.041 | 0.072 | 1 | | | | | | | |
| hla_a_68_02 | 0.007 | 0.064 | 0 | | | | | | | | |
| hla_a_74_01 | 0 | 0.051 | 0.001 | 1 | | | | 1 | | | |
| hla_b_07_02 | 0.118 | 0.062 | 0.015 | 1 | | | | | | | |
| hla_b_08_01 | 0.098 | 0.039 | 0.002 | | | | 2 | | 1 | | |
| hla_b_15_01 | 0.058 | 0.008 | 0.121 | | | | | | | | |

TABLE 6-continued

| RES 500 | Caucasian | Black | Asian | NRAS:p.T58I 80 | PIK3CA:p.E545K 80 | PLCG2:p.R665W 80 | ROS1:p.G2032A 80 |
|---|---|---|---|---|---|---|---|
| hla_b_15_02 | 0 | 0 | 0.066 | | | | |
| hla_b_15_03 | 0.001 | 0.065 | 0.001 | | | | |
| hla_b_18_01 | 0.061 | 0.035 | 0.004 | | | | |
| hla_b_35_01 | 0.056 | 0.061 | 0.024 | 1 | | | |
| hla_b_40_01 | 0.04 | 0.01 | 0.12 | 2 | | 2 | 1 |
| hla_b_40_02 | 0.016 | 0.003 | 0.076 | 7 | | | |
| hla_b_42_01 | 0 | 0.057 | 0 | 2 | | | |
| hla_b_44_01 | 0.071 | 0.014 | 0.002 | 2 | | | 1 |
| hla_b_44_02 | 0.004 | 0.053 | 0 | 3 | | | 1 |
| hla_b_45_01 | 0 | 0 | 0.082 | 2 | | | |
| hla_b_46_01 | 0 | 0 | 0.04 | 1 | | | |
| hla_b_51_01 | 0.051 | 0.021 | 0.04 | | | | |
| hla_b_53_01 | 0.003 | 0.11 | 0 | | | | 3 |

| RES 500 | Caucasian | Black | Asian | NRAS:p.T58I 80 | PIK3CA:p.E545K 80 | PLCG2:p.R665W 80 | ROS1:p.G2032A 80 |
|---|---|---|---|---|---|---|---|
| hla_a_01_01 | 0.143 | 0.047 | 0.012 | 1 | | | 1 |
| hla_a_02_01 | 0.283 | 0.114 | 0.097 | 1 | | | 3 |
| hla_a_02_03 | 0 | 0 | 0.052 | 1 | | | 3 |
| hla_a_02_07 | 0 | 0 | 0.08 | | | | |
| hla_a_03_01 | 0.137 | 0.071 | 0.009 | | | | |
| hla_a_11_01 | 0.06 | 0.01 | 0.224 | | | | 2 |
| hla_a_23_01 | 0.023 | 0.116 | 0.002 | | | | |
| hla_a_24_02 | 0.093 | 0.02 | 0.231 | | | | |
| hla_a_30_01 | 0.016 | 0.065 | 0.014 | 1 | | 1 | 2 |
| hla_a_30_02 | 0.005 | 0.066 | 0 | | | 1 | 1 |
| hla_a_33_03 | 0.004 | 0.041 | 0.072 | | | | 2 |
| hla_a_68_02 | 0.007 | 0.064 | 0 | | | 1 | |
| hla_a_74_01 | 0 | 0.051 | 0.001 | | | | 2 |
| hla_b_07_02 | 0.118 | 0.062 | 0.015 | | | 1 | 2 |
| hla_b_08_01 | 0.098 | 0.039 | 0.002 | 3 | | 4 | 5 |
| hla_b_15_01 | 0.058 | 0.008 | 0.121 | | | 1 | 2 |
| hla_b_15_02 | 0 | 0 | 0.066 | | | 1 | 1 |
| hla_b_15_03 | 0.001 | 0.065 | 0.001 | | 2 | | 3 |
| hla_b_18_01 | 0.061 | 0.035 | 0.004 | | | | 3 |
| hla_b_35_01 | 0.056 | 0.061 | 0.024 | | | 1 | |
| hla_b_40_01 | 0.04 | 0.01 | 0.12 | | | | |
| hla_b_40_02 | 0.016 | 0.003 | 0.076 | | 1 | 2 | 2 |
| hla_b_42_01 | 0 | 0.057 | 0 | | | | |
| hla_b_44_01 | 0.071 | 0.014 | 0.002 | | | 1 | |
| hla_b_44_02 | 0.004 | 0.053 | 0 | | | 1 | |
| hla_b_45_01 | 0 | 0 | 0.082 | | | | |
| hla_b_46_01 | 0 | 0 | 0.04 | | | | |
| hla_b_51_01 | 0.051 | 0.021 | 0.04 | | | | |
| hla_b_53_01 | 0.003 | 0.11 | 0 | | | | |

In all of the above examples, predictions are only shown for a subset of HLA alleles. These are often but not exclusively the most abundant alleles in each ethnic population. Additional alleles are readily predicted.

Moreover, for a given immunization designed to attack resistant variants for a given resistance mutation, multiple peptides, each targeting a separate possible resistance variant that may arise, are utilized to benefit the broadest set of patients.

Example 4

Cancer Subtype Specific Immunogenic Compositions.

Table 7 shows a data summary for the number of mutations found within a population of samples specific to a cancer subtype. Each mutation found within the data set for each disease leads to at least one predicted binder to any one of 33 HLA alleles selected based on being found in at least 5% of any one of the three ethnic populations (Caucasian, Black, Asian). A combination of neoantigenic peptides derived from polypeptides resulting from these mutations can be used in an immunogenic composition. Based on the number of peptides from the mutations selected, a larger percentage of patients may receive a benefit from the vaccine. Table 7 shows the number of mutations that are recurrent in each cancer specific data set. Also shown are the percentage of subjects in each data set that will have at least a single mutation when selecting recurrent mutations. For example, an immunogenic composition for SKCM that includes neoantigenic peptides derived from 64 recurrent mutations described herein covers 90.91% of patients in this population, whereby each subject will contain at least one of the neoantigenic mutations.

| Exemplary disease | recurrence (muts that occur in >= given # samples) | # unique muts in the set | # samples that have at least one mutation in the set | total # samples | percentage |
|---|---|---|---|---|---|
| SKCM | 5 | 64 | 230 | 253 | 90.91 |
| SKCM | 4 | 200 | 241 | 253 | 95.26 |
| SKCM | 3 | 707 | 247 | 253 | 97.63 |
| SKCM | 2 | 4437 | 250 | 253 | 98.81 |
| SKCM | 1 | 103732 | 253 | 253 | 100 |
| ACC | 5 | 161 | 90 | 90 | 100 |
| ACC | 4 | 219 | 90 | 90 | 100 |
| ACC | 3 | 299 | 90 | 90 | 100 |
| ACC | 2 | 546 | 90 | 90 | 100 |
| ACC | 1 | 10310 | 90 | 90 | 100 |
| BLCA | 5 | 6 | 35 | 130 | 26.92 |
| BLCA | 4 | 9 | 47 | 130 | 36.15 |
| BLCA | 3 | 26 | 77 | 130 | 59.23 |
| BLCA | 2 | 181 | 121 | 130 | 93.08 |
| BLCA | 1 | 25605 | 130 | 130 | 100 |
| BRCA | 5 | 18 | 320 | 888 | 36.04 |
| BRCA | 4 | 25 | 337 | 888 | 37.95 |
| BRCA | 3 | 35 | 357 | 888 | 40.2 |
| BRCA | 2 | 148 | 475 | 888 | 53.49 |
| BRCA | 1 | 31457 | 886 | 888 | 99.77 |
| CESC | 5 | 4 | 46 | 194 | 23.71 |
| CESC | 4 | 7 | 55 | 194 | 28.35 |
| CESC | 3 | 12 | 65 | 194 | 33.51 |
| CESC | 2 | 145 | 133 | 194 | 68.56 |
| CESC | 1 | 25585 | 194 | 194 | 100 |
| CRC | 5 | 15 | 132 | 233 | 56.65 |
| CRC | 4 | 22 | 142 | 233 | 60.94 |
| CRC | 3 | 53 | 160 | 233 | 68.67 |
| CRC | 2 | 711 | 209 | 233 | 89.7 |
| CRC | 1 | 55287 | 233 | 233 | 100 |
| DLBCL | 5 | 0 | 0 | 58 | 0 |
| DLBCL | 4 | 2 | 8 | 58 | 13.79 |
| DLBCL | 3 | 4 | 13 | 58 | 22.41 |
| DLBCL | 2 | 30 | 38 | 58 | 65.52 |
| DLBCL | 1 | 7435 | 57 | 58 | 98.28 |
| HNSC | 5 | 10 | 83 | 384 | 21.61 |
| HNSC | 4 | 15 | 97 | 384 | 25.26 |
| HNSC | 3 | 27 | 123 | 384 | 32.03 |
| HNSC | 2 | 154 | 227 | 384 | 59.11 |
| HNSC | 1 | 43143 | 384 | 384 | 100 |
| KICH | 5 | 0 | 0 | 66 | 0 |
| KICH | 4 | 0 | 0 | 66 | 0 |
| KICH | 3 | 0 | 0 | 66 | 0 |
| KICH | 2 | 24 | 33 | 66 | 50 |
| KICH | 1 | 2576 | 66 | 66 | 100 |
| KIRP | 5 | 9 | 68 | 161 | 42.24 |
| KIRP | 4 | 18 | 86 | 161 | 53.42 |
| KIRP | 3 | 35 | 104 | 161 | 64.6 |
| KIRP | 2 | 117 | 139 | 161 | 86.34 |
| KIRP | 1 | 10482 | 161 | 161 | 100 |
| LIHC | 5 | 2 | 13 | 198 | 6.57 |
| LIHC | 4 | 5 | 25 | 198 | 12.63 |
| LIHC | 3 | 10 | 38 | 198 | 19.19 |
| LIHC | 2 | 33 | 73 | 198 | 36.87 |
| LIHC | 1 | 18574 | 198 | 198 | 100 |
| LUAD | 5 | 11 | 134 | 401 | 33.42 |
| LUAD | 4 | 17 | 152 | 401 | 37.91 |
| LUAD | 3 | 35 | 185 | 401 | 46.13 |
| LUAD | 2 | 611 | 330 | 401 | 82.29 |
| LUAD | 1 | 101222 | 399 | 401 | 99.5 |
| MM | 5 | 6 | 49 | 205 | 23.9 |
| MM | 4 | 8 | 55 | 205 | 26.83 |
| MM | 3 | 16 | 71 | 205 | 34.63 |
| MM | 2 | 51 | 101 | 205 | 49.27 |
| MM | 1 | 7116 | 204 | 205 | 99.51 |
| PRAD | 5 | 24 | 104 | 261 | 39.85 |
| PRAD | 4 | 38 | 133 | 261 | 50.96 |
| PRAD | 3 | 83 | 174 | 261 | 66.67 |
| PRAD | 2 | 205 | 213 | 261 | 81.61 |
| PRAD | 1 | 10174 | 261 | 261 | 100 |
| STAD | 5 | 150 | 141 | 289 | 48.79 |
| STAD | 4 | 245 | 156 | 289 | 53.98 |
| STAD | 3 | 613 | 201 | 289 | 69.55 |
| STAD | 2 | 2729 | 269 | 289 | 93.08 |
| STAD | 1 | 97578 | 289 | 289 | 100 |
| TGCT | 5 | 14 | 80 | 155 | 51.61 |
| TGCT | 4 | 25 | 99 | 155 | 63.87 |
| TGCT | 3 | 64 | 124 | 155 | 80 |
| TGCT | 2 | 338 | 149 | 155 | 96.13 |
| TGCT | 1 | 7632 | 155 | 155 | 100 |
| THCA | 5 | 5 | 283 | 405 | 69.88 |
| THCA | 4 | 5 | 283 | 405 | 69.88 |
| THCA | 3 | 7 | 287 | 405 | 70.86 |
| THCA | 2 | 31 | 300 | 405 | 74.07 |
| THCA | 1 | 4439 | 405 | 405 | 100 |
| UCS | 5 | 2 | 9 | 56 | 16.07 |
| UCS | 4 | 10 | 31 | 56 | 55.36 |
| UCS | 3 | 19 | 41 | 56 | 73.21 |
| UCS | 2 | 55 | 53 | 56 | 94.64 |
| UCS | 1 | 3805 | 56 | 56 | 100 |
| CLL | 5 | 6 | 46 | 263 | 17.49 |
| CLL | 4 | 19 | 74 | 263 | 28.14 |
| CLL | 3 | 38 | 100 | 263 | 38.02 |
| CLL | 2 | 157 | 167 | 263 | 63.5 |
| CLL | 1 | 7870 | 263 | 263 | 100 |
| GBM | 5 | 14 | 100 | 291 | 34.36 |
| GBM | 4 | 24 | 125 | 291 | 42.96 |
| GBM | 3 | 45 | 153 | 291 | 52.58 |
| GBM | 2 | 221 | 252 | 291 | 86.6 |
| GBM | 1 | 14142 | 291 | 291 | 100 |
| KIRC | 5 | 4 | 25 | 417 | 6 |
| KIRC | 4 | 8 | 41 | 417 | 9.83 |
| KIRC | 3 | 23 | 78 | 417 | 18.71 |
| KIRC | 2 | 291 | 292 | 417 | 70.02 |
| KIRC | 1 | 17725 | 417 | 417 | 100 |

| Exemplary disease | recurrence (muts that occur in >= given # samples) | # unique muts in the set | # samples that have at least one mutation in the set | total # samples | percentage |
|---|---|---|---|---|---|
| LAML | 5 | 11 | 93 | 196 | 47.45 |
| LAML | 4 | 12 | 95 | 196 | 48.47 |
| LAML | 3 | 16 | 101 | 196 | 51.53 |
| LAML | 2 | 27 | 114 | 196 | 58.16 |
| LAML | 1 | 1458 | 195 | 196 | 99.49 |
| LUSC | 5 | 2 | 14 | 178 | 7.87 |
| LUSC | 4 | 4 | 22 | 178 | 12.36 |
| LUSC | 3 | 15 | 50 | 178 | 28.09 |
| LUSC | 2 | 130 | 138 | 178 | 77.53 |
| LUSC | 1 | 42062 | 178 | 178 | 100 |
| OV | 5 | 10 | 72 | 316 | 22.78 |
| OV | 4 | 12 | 80 | 316 | 25.32 |
| OV | 3 | 14 | 86 | 316 | 27.22 |
| OV | 2 | 56 | 151 | 316 | 47.78 |
| OV | 1 | 12840 | 316 | 316 | 100 |
| PAAD | 5 | 53 | 146 | 146 | 100 |
| PAAD | 4 | 69 | 146 | 146 | 100 |
| PAAD | 3 | 123 | 146 | 146 | 100 |
| PAAD | 2 | 398 | 146 | 146 | 100 |
| PAAD | 1 | 23715 | 146 | 146 | 100 |
| UCEC | 5 | 30 | 168 | 248 | 67.74 |
| UCEC | 4 | 81 | 196 | 248 | 79.03 |
| UCEC | 3 | 302 | 217 | 248 | 87.5 |
| UCEC | 2 | 2797 | 237 | 248 | 95.56 |
| UCEC | 1 | 112636 | 248 | 248 | 100 |
| COAD | 5 | 3 | 19 | 70 | 27.14% |
| COAD | 4 | 7 | 20 | 70 | 28.57% |
| COAD | 3 | 11 | 25 | 70 | 35.71% |
| COAD | 2 | 84 | 44 | 70 | 62.86% |
| COAD | 1 | 16670 | 70 | 70 | 100.00% |
| READ | 5 | 0 | 0 | 39 | 0.00% |
| READ | 4 | 2 | 8 | 39 | 20.51% |
| READ | 3 | 5 | 16 | 39 | 41.03% |
| READ | 2 | 33 | 29 | 39 | 74.36% |
| READ | 1 | 12132 | 39 | 39 | 100.00% |

Table 8 shows the specific recurrent mutations for each cancer subtype, as well as the peptides that each mutation generates and the flanking peptide that includes the peptides ("ACC", "BLCA", "BRCA", "CESC", "COAD", "CLL", "CRC", "DLBCL", "GBM", "HNSC", "KICH", "KIRC", "KIRP", "LAML", "LIHC", "LUAD", "LUSC", "MM", "OV", "PAAD", "PRAD", "READ", "SKCM", "STAD", "TGCT", "THCA", "UCEC", and "UCS"). Frameshift mutations are denoted with a "fs". "Del" and "Ins" indicate deletions and inserts. The number of peptides that are generated from each mutation that binds to a specific HLA allele are shown. The recurrent mutations include frameshift mutations and create HLA binders across many alleles.

TABLE 8

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| A2M | c.2195G>A | p.R732Q | FYESDVMGRGHARLVHVEEPHTETV[p.R732Q]QKYFPETWIWDLVVVNSAGVAEVGVT | VQKYFPETW, QKYFPETWI, ETVQKYPFET, VQKYFPETWI.Q KYFPETWIW, EPHTETVQKY | CRC |
| A2ML1 | c.1960_1961 insC | p.S654fs | YDQCPVSGPWDFPQPLIDPMPQGHS [p.S654fs]EPAPHYLEALVL* | HSEPAFHYL, MPQGHSEPA, PQGHSEPAF, GHSEPAPHY, FH VLEALVL, EPAPHYLEA, QGHSEPAPHY, EPAPHYLEAL, MPQ GHSEPAF, SEPAPHYLEA | LUAD |
| AADAC L4 | c.796G>A | p.A266T | VPLLSRKFMVTSLCNVLAIDLSWRD[p.A266T]TILNGTCVPPDVNRKYEKWLSPDNIP | IDLSWRDTI, SWRDTILNG, DTILNGTCV, IDLSWRDTIL | CRC |
| AASS | c.2634_2635 insC | p.T878fs | KTIDLVAYGDINGFSAMAKTVGLPT[p.T878fs]RHGSQNVA* | MAKTVGLPTR, LPTRHGSQNV | GBM |
| ABCA 11P | c.1154G>T | p.R385I | TGEKPYTCGECGKTFRQSANLVHR[p.R385I]IIHTGEKP YKCEDCGKAFGRYTALNQ | VHRIIHTGEK, QSANLVHRI | UCEC |
| ABCA3 | c.285G>C | p.E95D | TFPPPGDTWELAYIPSHSDAAKTVT[p.E95D]DTVRRALVINMRVRGFPSEKDFEDYI | KTVTDTVRR, VTDTVRRALV, AAKTVTDTVR, DAAKTVT DTV, TVTDTVRRAL | KIRC |
| ABCA5 | c.4427G>A | p.R1476Q | PQITLLDEPSTGMDPKAKQHMWRAI[p.R1476Q]QTAFKNRKRAAILTTHYME EAEAVCD | HMWRAIQTA, IQTAFKNRK, MWRAIQTAFK, AIQTAFKNR, Q TAFKNRKR, MWRAIQTAFK, AIQTAFKNRK, HMWRAIQTAF, KQHMWRAIQ, RAIQTQFKNR, QHMWRAIQTA | UCEC |
| ABCA6 | c.917delT | p.L306fs | FVTIIITFTQIIVMTGFMVIFILFF[p.L306fs]YMAYLW* | MVIFILFFY, VIFILFFYM, ILFFYMAYL, LFFYMAYLW, FILF FYMAY, MVIFILFFYM, VIFILFFYMA, FILFFYMAYL, ILFFY MAYLW, FMVIFILFFY, IFILFFYMAY | STAD |
| ABCA8 | c.2086G>A | p.A696T | STQFMDEADILADRKVFLSQGKLKC[p.A696T]TGSSLFLKKKWGIGYHLSLQLN EICV | KLKCTGSSL, CTGSSLFLK, TGSSLFLKK, LKCTGSSLF, FLSQGKL KCT, CTGSSLFLKK, KCTGSSLFLK, KLKCTGSSLF, GKLKCTG SSL, LKCTGSSLFL | CRC |
| ABCA8 | c.2525G>A | p.R842Q | RLVEMEQVLSLNKMRKTIGGVALW[p.R842Q]QQQICAIARVRLLKLKHERKAL LALL | ALWQQQICA, WQQQICAIA, ALWQQQICAI | CRC |
| ABCA8 | c.3472G>A | p.E1158K | NSGIWSFCFYVVTVFSVAGFAPSIF[p.E1158K]KSDIPFIFTFLIPPATMIGCLFLSSH | AGPQFSIFK, IFKSDIPPI, SIFKSDIPF, FKSDIPFIF, SIFKSDIPF I, VAGFAPSIFK, IFKSDIPFIF, KSDIPFIFTF, FAFSIFKSDI, FSIFKSDIPF | CRC |
| ABCB1 | c.1400G>T | p.R467L | RLYDPTEGMVSVDGQDIRTINVRFL[p.R467L]LEIIGVVSQEPVLFATTIAENIRYGR | RTINVRFLL, FLLEIIGVV, RFLLEIIGV, INVRFLLEI, FLLEIIGVVS, TINVRFLLEI, RFLLEIIGVV, RTINVRFLLE | LUAD |
| ABCB1 | c.1581_1582 delAG | p.R527fs | VKEANAYDFIMKLPHKFDTLVGERG[p.R527fs]PVEWWAEAEDRHCTCPGSQP QDPPAG* | TLVGERGPV, GERGPVEWW, AEAEDRHCT, DTLVGERGPV, GERGPVEWWA | STAD |
| ABCB6 | c.953delG | p.G318fs | LTEKAPWNSLAWTVTSYVFLKFLQG[p.G318fs]VALAVQAS* | FLQGVALAV, FLKFLQGVA, LKFLQGVAL, YVFLKFLQGV, FLK FLQGVAL, KFLQGVALAV, LKFLQGVALA | STAD |
| ABCB8 | c.1034G>A | p.R345H | SRQCQEQIARAMGVADEALGNVRTV[p.R345H]HAFAMEQREEERY GAELEACRCRAEE | NVRTVHAFA, GNVRTVHAF, VRTVHAFAM, ALGNVRTVHA, TVHAFAMEQR, NVRTVHAFAM, LGNVRTVHAF | CRC |
| ABCC10 | c.1708C>T | p.R570W | RMLILPLNNFPVVINGLLEAKVSLD[p.R570W]MIQLFLDLLPNHNPQ AYYSPDPPAEPS | SLDWIQLFL, VSLDWIQLF, DWIQLFLDL, LEAKVSLDW, KVSL DWIQLF, AKVSLDWIQL, LEAKVSLDWI, LDWIQLFLDL | GBM |
| ABCC4 | c.2648delT | p.L883fs | VAVIPWIAIPLVPLGIIFILRRYF[p.L883fs]WKRQEM* | IFLRRYFWK, FIFLRRYFW, RYFWKRQEM, FLRRYFWKR, FIFL RRYFWK, IFIFLRRYFW, IFLRRYFWK, RRYFWKRQEM | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ABCC5 | c.3269de\|T | p.L1090fs | HAYNKKQEFLHRYQELLDDNQAPFF[p.L1090fs]CLRVRCGGWLCGWTSSASPSSPPRG* | WLCGWTSSA,SASPSSPPR,RVRCGGWLC,NQAPFFCLR,QA PFFCLRV,NQAPFFCLRV,SSASPSSPPR,RVRCGGWLCG,DN QAPFFCLR,CLRVRCGGWL | KIRC |
| ABCC8 | c.1535A>G | p.Y512C | STLEYSNERLKQTNEMLRGIKLLKL[p.Y512C]CAWENIFRTRVETTRRKEMTS LRAFA | IKLLKLCAW,LKLCAWENI,KLCAWENIF,LLKLCAWENI,KLC AWENIFR,CAWENIFRTR,LKLCAWENIF | TGCT |
| ABCC9 | c.1397T>C | p.L466P | IIMGVILLYNLLGSSALVGAAVIVL[p.L466P]PAPIQYFIATKLAEAQKSTLDYSTER | AVIVLPAPI,IVLPAPIQY,VLPAPIQYF,LPAPIQYFI,VLPAPIQY FI,IVLPAPIQYF,AAVIVLPAPI,VIVLPAPIQY,LPAPIQYFIA | TGCT |
| ABCD1 | c.1816T>C | p.S606P | DVVHLHHILQREGGWEAMCDWKDVL[p.S606P]PGGEKQRIGMARMFYHRPKYALLDEC | LPGGEKQRI,DVLPGGEKQR | CESC |
| ABCD1 | c.507C>A | p.H169Q | ATFVNSAIRYLEGQLALSFRSRLVA[p.H169Q]QAYRLYFSQQTYYRVSNMDCRLRNPD | RLVAQAYRL,VAQAYRLYF,RSRLVAQAY,LVAQAYRLY,RLV AQAYRLY,RSRLVAQAYF,LVAQAYRLYF,SFRSRLVAQA,FRSRL VAQAY,SRLVAQAYRL | TGCT |
| ABI1 | c.1335G>T | p.K445N | DYEDEEAAVQYNDPYADGDPAWAP[p.K445N]NNY IEKVVAIYDYTKDKDDELSFMEG | DPAWAPNNY,AWAPNNYIEK,WAPNNYIEKV,DPAWAPNNYI | UCEC |
| ABL2 | c.55C>A | p.P19T | MGQQVGRVGEAPGLQQPQ[p.P19T]TRGIRGSSAARP SGRRRDPAGRITET | LQQPQTRGI,QTRGIRGSSA | TGCT |
| ABTB1 | c.747_748 insC | p.L249fs | TIEPPPADPRLREDMALLADCALPP[p.L249fs]RAPR* | CALPPRAPR,LLADCALPPR,DCALPPRAPR | LAML |
| ACACA | c.5191C>T | p.R1731C | ARAEGIPRIYVSANSGARIGLAEEI[p.R1731C]CHMFH VAVVVDPEDPYKGYRYLYLTPQ | GLAEEICHM,EICHMFHVA,LAEEICHMF,ICHMFHVAW,EEI CHMFHV,GLAEEICHMF,IGLAEEICHM,EEICHMFHVA,AEE ICHMFHV | CRC |
| ACACB | c.6952G>C | p.E2318Q | VAVQFADFHDTPGRMLEKGVISDIL[p.E2318Q]WK TARTFLYWRLRRLLLEDQVKQEI | ILQWKTART,VISDILQWK,QWKTARTFL,DILQWKTAR,LQ WKTARTF,GVISDILQWK,ILQWKTARTF,QWKTARTFLY,LQ WKTARTFL | BLCA |
| ACACB | c.763de\|G | p.G255fs | EHKKLDLHRDFTVASPAEFVTRFGG[p.G255fs]IGSS RRCLLPTTGLPP* | SSRRCLLPT,RFGGIGSSR,RCLLPTTGL,SSRRCLLPTT,AEFVTR FGGI,RRCLLPTTGL | STAD |
| ACACB | c.143T>G | p.F48C | QHTKANRQREPGLGFSFEFTEQQKE[p.F48C]CQAT ARKFAREEIIPVAAEYDKTGEY | QQKECQATA,QQKECQATAR,CQATARKFAR, KECQATARKF,TEQQKECQAT | CRC |
| ACADS | c.989G>A | p.R330H | TKLQVIQFKLADMALALESARLLTW[p.R330H]HA AMLKDNKKPFIKEAAMAKLAASEA | RLLTWHAAM,LLTWHAAML,LLTWHAAMLK,HAAMLKDNK, SARLLTWHA,ARLLTWHAA,RLLTWHAAML,LLTWHAAMLK, SARLLTWHAA,HAAMLKDNKK,ESARLLTWHA,LESARLL TWH,ARLLTWHAAM | KIRC,PRAD |
| ACBD3 | c.671G>T | p.R224L | REEEEERLQKEEEKRRREEEERLR[p.R224L]LEE EERRRLEEERLRLEQQKQQIMAA | REEEEERLRL | LUAD |
| ACOT9 | c.149G>A | p.R50Q | GPQNPKKQGIFHIHEACSSIVHNHV[p.R50Q]QDKLR EIVGASTNWRDHVKAMEERKL | VQDKLREIV,SIHVNHVQDK,HVNHVQDKLR | CRC |
| ACP1 | c.368de\|A | p.Q123fs | DLNRKSNQVKTCKAKIELLGSYDPQ[p.Q123fs]NNLL LKIPIMGMTLTLRRCTSSVSGAAERSWRRPTEAGSCP AAASLTRPHPEVLHFSVGV* | SLTRPHPEV,LLKIPIMGM,TLRRCTSSV,IMGMTLTLR,MGM TLTLRR,SSVSGAAER,RSWRRPTEA,LTRPHPEVL,GAAERS WRR,CTSSVSGAA,EVLHFSVGV,RPHPEVLHF,HPEVLHFSV, NLLLKIPIM,GSYDPQNNL,TEAGSCPAA,GSCPAAASL,AAAS LTRPH,AERSWRRPT,LLLKIPIMGM,LTLRRCTSSV,SLTRPHP EVL,IMGMTLTLRR,SYDPQNNLLL,ASLTRPHPEV,LTRPHPE VLH,PIMGMTLTLR,SGAAERSWRR,IPIMGMTLTL,RPTEAG SCPA,GSYDPQNNLL,LKIPIMGMTL,TEAGSCPAAA,PEVLH FSVGV,DPQNNLLKI | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ACP6 | c.86T>G | p.V29G | GVFSMRLWTPVGVLTSLAYCLHQRR[p.V29G]GALAELQRADGQCPVDRSLLKLKMVQ | CLHQRRGAL, HQRRGALAE, QRRGALAEL, CLHQRRGALA, H QRRGALAEL, YCLHQRRGAL | KIRP |
| ACPP | c.127C>T | p.R43W | FLFLLFFWLDRSVLAEKLKFVTLVF[p.R43W]HGDRSPIDTFTDPIKESSWPQGFG | TLVFWHGDR, LKFVTLVFW, FWHGDRSPI, VTLVFWHGDR, VFWHGDRSPI | BRCA |
| ACPP | c.314G>A | p.R105Q | ELGEYIRKRYRKFLNESYKHEQVYI[p.R105Q]STDVDRTLMSAMTNLAALFPPEGVS | HEQVYIQST, IQSTDVDRTL | CRC |
| ACPP | c.961G>A | p.E321K | LQMALDVYNGLLPPYASCHLTELYF[p.E321K]KKGEYFVEMYYRNETQHEPYPLMLPG | HLTELYFKK, LYFKKGEYF, ELYFKKGEY, KKGEYFVEM, LYFKK GEYFV, SCHLTELYFK, ELYFKKGEYF, TELYFKKGEY, FKKGEYF VEM, KKGEYFVEMY | BLCA |
| ACR | c.837G>T | p.W279C | YVVVGITSWGVGCARAKRPGIYTAT[p.W279C]CPYLNWIASKIGSNALRMIQSATPPP | GIYTATCPY, IYTATCPYL, CPYLNWIAS, TATCPYLNW, GIYTA TCPYL, YTATCPYLNW, TATCPYLNWI | KICH |
| ACSBG2 | c.750T>G | p.I250M | AVLIYTSGTTGIPKGVMLSHDNITW[p.I250M]MAGAVTKDFKLTDKHETWSYLPLSH | NITWMAGAV, TWMAGAVTK, MAGAVTKDF, LSHDNITWM, MLSH DNITWM, ITWMAGAVTK, MAGAVTKDFK, DNIT WMAGAV, WMAGAVTKDF | KIRP |
| ACSL3 | c.562A>T | p.T188S | AIFCETRAEWMIAAQACFMYNFQLV[p.T188S]LYATLGGPAIVHALNETEVTNIITS | FMYNFQLVS, FQLVSLYAT, QLVSLYATL, MYNFQLVSL, YNF QLVSLY, FMYNFQLVSL, FQLVSLYATL, SLYATLGGPA, MYNF QLVSLY, YNFQLVSLYA | CLL |
| ACSM2A | c.1206_1207 insC | p.L402fs | PGYMGTAASCYDVQIIDDKGNVLPP[p.L402fs]RHRRRHWHQGQTHQAYRHLLWLCGQSRQDSSQHSRRLLAPWRPGNQR* | HQAYRHLLW, AYRHLLWLC, SSQHSRRLL, SQHSRRLLA, HSR RLLAPW, RLLAPWRPG, HQGQTHQAY, NVLPPRHRR, VLPP RHRRR, QSQTHQAYR, RHWHQGQTH, QAYRHLLWL, HQA YRHLLWL, THQAYRHLLW, QTHQAYRHLL, SSQHSRRLLA, H SRRLLAPWR, WHQGQTHQAY, NVLPPRHRRR, HQGQTHQ AYR, HLLWLCGQSR, LAPWRPGNQR, GQTHQAYRHL, GQSR QDSSQH, SQHSRRLLAP, QHSRRLLAPW | KIRC |
| ACSM2B | c.585G>T | p.K195N | VASECPSLRIKLLVSEKSCDGWLNF[p.K195N]KLLNEASTTHHCVETGSQEASAIYF | GWLNFNKLL | UCEC |
| ACTA1 | c.823G>T | p.G275C | ITIGNERFRCPETLFQPSFIGMESA[p.G275C]IHETTYNSIMKCDIDIRKDIYANNV | FIGMESACI, SACIHETTY, ESACIHET, MESACIHET, ESACIH ETTY, CIHETTYNSI, SFIGMESACI, MESACIHETT | LUAD |
| ACTG1 | c.64G>C | p.A22P | MEEEIAALVIDNGSGMCKAGF[p.A22P]PGDDAPRAVFPPSIVGRPRHQGVMGM | FPGDDAPRA, FPGDDAPRAV | MM |
| ACTL6A | c.264delA | p.L88fs | GPTYYIDTNALRVPRENMEAISPLK[p.L88fs]MGWLKTGIVSKLFWIIPTKCMSNQKPVSILFSCQRHRGILEQRERN* | KMGWLKTGI, GIVSKLFWI, WLKTGIVSK, KLFWIIPTK, ILFSC QRHR, VSILFSCQR, IVSKLFWII, NQKPVSILF, PTKCMSNQK, MEAISPLKM, LKTGIVSKL, SKLFWIIPT, MSNQKPVSI, KMG WLKTGIV, CMSNQKPVSI, ISPLKMGWLK, GWLKTGIVSK, SILFS CQRHR, NMEAISPLKM, LKMGWLKTGI, LKTGIVSKLF, MSN QKPVSIL, SNQKPVSILF, FSCQRHRGIL, EAISPLKMGW | STAD |
| ACTL7B | c.1061G>A | p.R354H | TGFKEEMAANVLLCGGCTMLDGFPE[p.R354H]HFQRELSLLCPGDSPAVAAAPERKTS | HFQRELSLL, DGFPEHFQR, FPEHFQREL, TMLDGFPEH, MLD GFPEHF, EHFQRELSL, MLDGFPEHF | CRC |
| ACTL7B | c.631G>A | p.E211K | IYSYGKTSGLVVESGHGVSHWPIS[p.E211K]GDVLPGLTSRADYAGGDLTNYLMQL | VSHVVPISK, VPISKGDVL, GVSHVVPISK, HVVPISKGDV | CESC |
| ACTL9 | c.992G>A | p.R331H | EVPGLSPVGLSTMAKQSLRKLSLEM[p.R331H]HADLAQNVLLCGGSSLFTGFEGRFRA | LEMHADLAQ, HADLAQNVL, KLSLEMHADL, EMHADLAQN V, MHADLAQNVL | CRC |
| ACTN2 | c.2677G>T | p.D893Y | AYSGPGSVPGALDYAAFSSALYGES[p.D893Y]YL* | SSALYGESY, SALYGESYL, FSSALYGESY, SSALYGESYL | LUAD |
| ACVR1 | c.617G>A | p.R206H | ADLLDHSCTSGSGSGLPFLVQRTVA[p.R206H]HQITLLECVGKGRYGEVWRGSWQGEN | HQITLLECV, TVAHQITLL, RTVAHQITL, FLVQRTVAH, VQRT VAHQI, RTVAHQITLL, VQRTVAHQIT, QRTVAHQITL, HQITLLECVG | UCEC |
| ACVR1 | c.869C>T | p.S290L | FIASDMTSRHSSTQLMLITHYHEMG[p.S290L]LLYDYLQLTTLDTVSCLRIVLSIASG | GLLYDYLQL, GLLYDYLQLT, LLYDYLQLT, ITHYHEMGL, HEM GLLY, YHEMGLLYDY, HEMGLLYDYL, MGLLYDYLQL, GLLYDYL, LLYDYLQLT, ITHYHEMGLL, THYHE MGLLY, YHEMGLLYDYL, HEMGLLYDYL, MGLLYDYLQL | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ADAD1 | c.32C>T | p.S1IL | MASNNHWFQS[p.S1IL]LQVPSFAQMLKKNLPVQPATKTITTP | SNNHWFQSL, FQSLQVPSF, LQVPSFAQM, FQSLQVPSFA, S LQVPSFAQM, LQVPSFAQML, WFQSLQVPSF, ASNNHWFQSL | UCEC |
| ADAD2 | c.131G>A | p.G44E | LAASLQISPQPRPWRPLPAQAQSAW[p.G44E]EPAPAPATYRAEGGWPQVSVLRDSGP | QSAWEPAPA, EPAPAPATY, AQAQSAWEP, AQSAWEPAP, WEPAPAPAT, AQAQSAWEPA, AQAQSAWEPA, SAWEPAP APA, WEPAPATY | ACC |
| ADAM23 | c.1139A>T | p.K380M | EKDQIDITTNPVQMLHEFSKYRQRI[p.K380M]MQHADAVHLISRVTFHYKRSSLSYFG | RIMQHADAV, MQHADAVHL, KYRQRIMQH, FSKYRQRIM, I MQHADAVH, IMQHADAVHL, MQHADAVHLI, KYRQRIMQ HA, RQRIMQHADA, SKYRQRIMQH, RIMQHADAVH | KIRC |
| ADAM28 | c.217_218 insA | p.K73fs | QEQFETELKYKMTINGKIAVLYLKK[p.K73fs]KQEPPCTRLHGNIL* | CTRLHGNIL, KQEPPCTRL, KIAVLYLKKK, YLKKKQEPPC, KKQ EPPCTRL, KQEPPCTRLH | STAD |
| ADAM29 | c.613G>A | p.V205I | IDNSTQKQSSTVGWHIHFRIVEIVV[p.V205I]IIDNYLYIRYERNDSKLLEDLYIVYN | RIVEIVVI, VIIDNYLYI, VVIIDNLYI, IVVIIDNYL, FRIVEIVVI, IIDNYLYIRY, VVIIDNYLYI, VIIDNYLYIR, HFRIVEIVVI, IVV IIDNYLY, EIVVIIDNYL, VEIVVIIDNY | GBM |
| ADAM30 | c.2223G>T | p.Q741H | LKPKQEKMPLSKAKTQEESKTKTV[p.Q741H]HEESKTKTGQEESEAKTGQEESKAKT | KTKTVHEES, KTKTVHEESK, KTVHEESKTK | LUAD |
| ADAM30 | c.289_290 GG>TT | p.G97L | KHVLHLWPKRLLLPRHLRVFSFTEH[p.G97L]LELLEDHPYIPKDCNYMGSVKESLDSK | RVFSFTEHL, SFTEHLELL, FSFTEHLEL, LELLEDHPY, HLELLED HPY, VFSFTEHLEL, LRVFSFTEHL, FSFTEHLELL, LELLEDHPYI | SKCM |
| ADAM30 | c.941C>A | p.S314Y | SSDWAHLYLQRKYNDALAWSFGKVC[p.S314Y]YLEYAGSVSTLLDTNILAPATWSAHE | WSFGKVCYL, CYLEYAGSV, AWSFGKVCY, FGKVCYLEY, SFG KVCYLEY, LAWSFGKVCY | CRC |
| ADAM32 | c.1676G>A | p.R559Q | DRNNKVFCGWRNLICGRLVCTYPT[p.R559Q]QKPFHQENGDVIYAFVRDSVCITVDY | LVCTYPTQK, CTYPTQKPF, RLVCTYPTQK, CTYPTQKPFH, VC TYPTQKPF | CRC |
| ADAM9 | c.767G>A | p.R256Q | NQTAVREEMILLANYLDSMYIMLNI[p.R256Q]QIVLVGLEIWTNGNLINIVGGAGDVL | YIMLNIQIV, IMLNIQIVL, MLNIQIVLV, MYIMLNIQI, SMYIM LNIQI, IMLNIQIVLV, IMLNIQIVL, MYIMLNIQIV, IQIVLVGLEI | UCEC |
| ADAMTS12 | c.1075G>A | p.E359K | LNPVHHDVAVLLTRKDICAGFNRPC[p.E359K]KTLGLSHLSGMCQPHRSCNINEDSGL | CAGFNRPCK, CKTLGLSHL, KTLGLSHLSG, FNRPCKTLGL, AGFNRPCKTL | UCS |
| ADAMTS12 | c.3157C>G | p.P1053A | RPRMLTPTGPESMSTSTPAISSPS[p.P1053A]ATTASKEDLGGKQWQDSSTQPELSS | TPAISSPSA, ISSPSATTA, AISSPSATTA, SSPSATTASK, STPAIS SPSA, TPAISSPSAT | CESC |
| ADAMTS14 | c.712G>T | p.G238C | QQEWAEPDGDLHNEAFGLGDLPNLL[p.G238C]CLVGDQLGDTERKRRHAKPGSYSIEV | DLPNLLCLV, NLLCLVGDQL | LUAD |
| ADAMTS16 | c.2449G>A | p.D817N | LRRYYLNGHWTVDWPGRYKFSGTTF[p.D817N]NYRRSYNPENLIATGPTNETLIVEL | FSGTTFNYR, KFSGTTFNY, TTFNYRRSY, SGTTFNYRR, FSGTT FNYRR, KFSGTTFNYR, YKFSGTTFNY, GTTFNYRRSY | CRC |
| ADAMTS17 | c.1715A>C | p.N572T | SPWGAWSMCSRTCGTGARFRQRKCD[p.N572T]TPPPGPGGTHCPGASVEHAVCENLPC | RQRKCDTPP, RQRKCDTPPP | TGCT |
| ADAMTS2 | c.2842G>A | p.D948N | WEPCSQTCGRTGMQVRSVRCIQPLH[p.D948N]NNTTRSVHAKHCNDARPESRRACSRE | LHNNTTRSV, SVRCIQPLHN, LHNNTTRSVH | CLL |
| ADAMTS20 | c.1622G>T | p.R541L | KLHKGCFTQHVPPADGTDCGPGMHC[p.R541L]LHGLCVNKETETRPVNGEWGPWEPYS | CLHGLCVNK, GMHCLHGLCV, GPGMHCLHGL | LUAD |
| ADAMTS20 | c.3751C>A | p.R1251S | GKTTRQVLCMNYHQPIDENYCDPEV[p.R1251S]SPLMEQECSLAACPPAHSHFPSSPVQ | SPLMEQECSL | LUAD |
| ADAMTS4 | c.466C>T | p.R156W | TINGDPESVASLHWDGGALLGVLQY[p.R156W]WGAELHLQPLEGGTPNSAGGPGAHIL | VLQYWGAEL, ALLGVLQYW, QYWGAELHL, LQYWGAELH, L LGVLQYWGA, LQYWGAELHL, GALLGVLQYW, WGAELHLQPL | CRC |
| ADAMTS5 | c.1645C>A | p.L549M | QGQMVCLTKKLPAVEGTPCGKGRIC[p.L549M]MQGKCVDKTKKKYSTSSHGNWGSWG | KGRICMQGK, TPCGKGRICM | LUAD |
| ADAMTS8 | c.1570G>A | p.V524M | TPCGPGHLCSEGSCLPEEEVERPKP[p.V524M]MADGGWAPWGECSRTCGGGVQFS | KPMADGGWA, EEVERPKPM, MADGGWAPW, PMADGG WAPW, EEEVERPKPM | GBM |
| ADAMTS9 | c.1975G>T | p.G659W | FKSCNTEPCLKQKRDFRDEQCAHFD[p.G659W]WKHFNINGLLPNVRWVPKYSGILMKD | HFDWKHFNI, CAHFDWKHF, WKHFNINGL, DEQCAHFDW, AHFDWKHFNI, WKHFNINGLL | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ADAMTSL4 | c.2332_2333 insG | p.G778fs | TSCSRSCGPGTQHRQLQCRQEFGGG[p.G778fs]WL LGAPGALWTSPPAQHHPVLPAAPLWPLGSWLSLEPV LRAVRPGPEKPAGSLCWEQW* | WLLGAPGAL,GSWLSLEPV,SLEPVLRAV,RAVRPGPEK,SWLSLEPVL, HPVLPAAPL,LPAAPLWPL,SPPAQHHPV,PPAQHH PVL,WPLGSWLSL,GPEKPAGSL,RQEFGGGWL,QEFGGGW LL,LLGAPGALW,AQHHPVLPA,QHHPVLPAA,APLWPLGS W,VLPAAPLWPL,AQHHPVLPAA,WLSLEPVLRA,LWPLGS WLSL,AVRPGPEKPA,SWLSLEPVLR,SLEPVLRAVR,TSPPAQHH PV,SPPAQHHPVL,APLWPLGSWL,RQEFGGGWLL,WLL GAPGALW,GSWLSLEPVL,QEFGGGWLLG,HPVLPAAPLW | STAD |
| ADCY2 | c.260C>T | p.A87V | LAVFFALGLEVEDHVAFLITVPTAL[p.A87V]VI FFAIFILVCIESVFKKLLRLFSLV | LVIFFAIPI,VIFFAIFIL,LITVPTALV,TVPTALVIF,TALVIFFAI, PTALVIFFA,ALVIFFAIF,ITVPTALVI,VPTALVIFF,FLITVPTALV, ALVIFFAIFI,VIFFAIFILV,TTVPTALVIF,TVPTALVIFF, TALVIFFAIF,PTALVIFFAI,LVIFFAIFIL,VPTALVIFFA | DLBCL |
| ADCY2 | c.2662G>A | p.V888I | HVAEHFLARSLKNEELYHQSYDCVC[p.V888I]IM FASIPDFKEFYTESDVNKEGLECL | SYDCVCIMF,IMFASIPDF,QSYDCVCIM,HQSYDCVCI,IMFA SIPDFK,CIMFASIPDF,HQSYDCVCIM,QSYDCVCIMF | OV |
| ADCY2 | c.3046C>A | p.P1016T | SFNDFKLRVGINHGPVIAGVIGAQK[p.1016] TQYDIWGNTVNVASRMDSTGVLDKIQ | AQKTQYDIW,TQYDIWGNTV,GVIGAQKTQY | LUAD |
| ADCY5 | c.1982G>A | p.R661H | SIETFLILRCTQKRKEEKAMIAKMN[p.R661H] HQRTNSIGHNPPHWGAERPFYN HLGG | MIAKMNHQR,KAMIAKMNH,KMNHQRTNS,HQRTNSIGH, MNHQRTNSI,KMNHQRTNSI,AMIAKMNHQR | CRC |
| ADD3 | c.1708G>A | p.E570K | HGPPAPNPFSHLTEGELEEYKRTI[p.E570K]K RKQQGLEDAEQELLSDDASSVSQIQ | TIKRKQQGL,RTIKRKQQGL | UCEC |
| ADGB | c.3371C>T | p.S1124L | PCNSFAIKEIRDYYIPNDKKILFRYI[p.S1124L]L VKVLTPQPATIQVRTSKPDAFIKLQ | ILFRYLVKV,KILFRYLVK,LFRYLVLKVL,KKILFRYLV,KILFRYLVK V,ILFRYLVKVL,KKILFRYLVK,LVKVLTPQPA | UCEC |
| ADH1A | c.461A>T | p.D154V | SRFTCRKPIHHFLGISTFSQYTVV[p.D154V]V ENAVAKIDAASPLEKVCLIGCGFST | YTVVVENAV,VVVENAVAK,TFSQYTVVV,SQYTVVVEN,STFSQYTV VV,SQYTVVENA,VVVENAVAKI,TVVVENAVAK,YTVVVENAV A,VENAVAKIDA | KIRC |
| ADNP2 | c.965del|C | p.S322fs | NSPSPAAGQPVTVAQGAPGSLTHSP[p.S322fs] LLLANPT* | SLTHSPLL,GSLTHSPLL,LTHSPLLLA,SLTHSPLLLA,APGSLTHSPL | STAD |
| AFF2 | c.1790G>A | p.R597H | VKTNASQVPAEPKERPLLSLIREKA[p.R597H]HP RPTQKIPETKLAKHKLSTTSETVS | KAHPRPTQK,LIREKAHPR,REKAHPRPT,KAHPRPTQKI,SLIREKAHPR | PRAD |
| AFF3 | c.2755G>A | p.E919K | INKNEKMLRSPISPLSDASKHKYTS[p.E919K]KD LTSSSRPNGNSLFTSASSSKKPKA | ASKHKYTSK,TSKDLTSSSR,SKHKYTSKDL | BLCA |
| AFP | c.545C>G | p.A182G | TFMNKFIYEIARRHPFLYAPTILLW[p.A182G]GAR YDKIIPSCCKAENAVECFQTKAA | LLWGARYDK,LWGARYDKI,TILLLWGARY,PTILLWGAR,PTIL LWGARY,YAPTILLWGA,LLWGARYDKI,ILLWGARYDK,LYAPTILLWG | LUAD |
| AGAP1 | c.381del|C | p.G127fs | GGRFKKEIVDGQSYLLLIRDEGGP[p.G127fs]R RRSLPCGWTLLYLSSAWRMK* | LPCGWTLL,SLPCGWTLL,LLYLSSAWR,YLLSSAWRMK,RSL PCGWTL,LYLSSAWRM,WTLLYLSSA,GPRRRSLPC,TLLYLSS AW,LLYLSSAWRM,RSLPCGWTLLY,RSLPCGWTLL,LIRDEGGPRR,LYLSSAW RMK,SLPCGWTLLY,TLLYLSSAWR,RRSLPCGWTL,WTLLYL SSAW,LPCGWTLLYL | STAD |
| AGAP3 | c.2296C>T | p.R766W | VWEGALGGYSKPGPDACREEKERWI[p.R766W] WAKYEQKLFLAPLPSSDVPLGQQLLR | WIWAKYEQK,IWAKYEQKL,KERWIWAKY,WAKYEQKLF,E EKERWIWA,WIWAKYEQKL,IWAKYEQKLF,RWIWAKYEQK, REEKERWIWA | GBM |
| AGAP6 | c.207del|C | p.D69fs | MAAAVQPAEVTVEVGEDLHMHVRD [p.D69fs]GRCLKLWSLTFLPIQSQAQYS RGTLKQKLWSLTFLLPIQRQA QYSRGTLKQML* | TLKQKLWSL,HVRDGRCLK,CLKLWSLTF,LWSLTFLPI,YSRG TLKQK,KQKLWSLTL,HMHHVRDGR,LPIQSQAQY,LKLWSL TFL,SQAQYSRGT,QKLWSLTLL,KLWSLTLLPI,KLWSLTLLPI, CLKLWSLTFL,KQKLWSLTL,RCLKLWSLTF,HVRDGRCLKL, FLPIQSQAQY,LTFLPIQSQA,DGRCLKLWSL,SQAQYSRGTL, LKQKLWSLTL,YSRGTLKQML | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| AGAP6 | c.380G>T | p.S127I | NPSANPEASTIFQRNSQTDVVEIRR[p.S127I]INCTNHVSAVRPSQQYSLCSTIFLDD | RRINCTNHV,RINCTNHVSA | CLL, PRAD |
| AGAP7 | c.211de|G | p.E71fs | AAAVQPAEVTVEVGEDLHMHVRDR[p.E71fs]RCLKLWSLTLLPIQRQAQYSRGTLKQML* | HMHHVRDRR,HVRDRRCLK,CLKLWSLTL,RRCLKLWSL,LKLWSLTLL,KLWSLTLLPI,CLKLWSLTLLL,HVRDRRCLKL,DRRCLKLWSL,RCLKLWSLTL,YSRGTLKQML | KIRC |
| AGAP9 | c.742A>G | p.M248V | STSQEDPQFSVPPTANTPTPVCKLS[p.M248V]VRWSNLFTSEKGSDPDERKAPENHA | KLSVRWSNL,LSVRWSNLF,SVRWSNLFT,KLSVRWSNLF,SVRWSNLFTS,TPTPVCKLSV,CKLSVRWSNL,TPVCKLSVRW | SKCM |
| AGBL5 | c.1260_1261 insC | p.1420fs | KLNSVWIMPQQSAGLEESAPDTIPP[p.I420fs]QREWRCLLCGPAWTCFQKGLLHVRKQL* | CFQKGLLHV,TIPPQREWR,FQKGLLHVR,RCLLCGPAW,LCGPAWTCF,REWRCLLCG,CGPAWTCFQK,DTIPPQREWR,CFQKGLLHVR,LLCGPAWTCF,WRCLLCGPAW,REWRCLLCGP | STAD |
| AGMAT | c.937G>A | p.V313M | TGTPEIAGLTPSQALEIIRGCQGLN[p.V313M]MMGCDLVEVSPPYDLSGNTALLAANL | MMGCDLVEV,IIRGCQGLNM,RGCQGLNMM,GLNMMGCDLV,NMMGCDLVEV,IIRGCQGLNMM,IRGCQGLNMM | CRC |
| AGPAT4 | c.634G>A | p.A212T | ISMQVARAKGLPRLKHHLLPRTKGF[p.A212T]ITVRSLRNVSAVTDCTLNFRNNEN | RTKGFTITV,FTITVRSLR,LPRTKGFTI,LLPRTKGFTI,RTKGFTITVR,KGFTITVRSL,GFTITVRSLR,LPRTKGFTIT | CRC |
| AGRN | c.3851_3853 de|TGA | p.1284_1285 VT>A | GATSGAIAAGATARATATASRLPSSA[p.1284_1285 VT>A]APRAPHPSHTSQPVAKTTAAPTTRRPPTFSQTFRIAPSMCITKPEVDFAVEVF[p.R502C]CSALTQHMERRAK* | ASRLPSSAA,RLPSSAAPR,SSAAPRAPH,APRAPHPSH,LPSSAAPRA,RLPSSAAPRA,APRAPHPSHT | KICH |
| AGXT2 | c.1504C>T | p.R502C | FSQTFRIAPSMCITKPEVDFAVEVF[p.R502C]CSALTQHMERRAK* | FAVEVFCSA,FCSALTQHM,VEVFCSALT,FAVEVFCSAL,CSALTQHMER,VFCSALTQHM | UCEC |
| AHI1 | c.909_910 insA | p.K303fs | DDEISSMEQSTEDSMQDDTKPKPK[p.K303fs]NKKED* | KPKPKKNKK | STAD |
| AHNAK | c.12449C>T | p.S4150F | KAPKISMPEVDLNLKGPKMKGDVDV[p.S4150F]FLPKVEGDLKGPEVDIKGPKVDIDVP | KMKGDVDVF,KMKGDVDVFL,KGDVDVFLPK,PKMKGDVDVF | BLCA |
| AHNAK | c.15_16 insGAG | p.5_6insE | MEKEE[p.5_6insE]ETTRELLLPNWQGSGSHGLITAQRDDGV | KEEETTREL,EEETTRELL,KEEETTRELL,EEETTRELLL | KIRC |
| AHNAK | c.3658G>A | p.V1220I | ISMPDVDLHLKGPKVKGDVDVSVPK[p.V1220I]IEGEMKVPDVEIKGPKMDIDAPDVEV | IEGEMKVPDV,VPKIEGEMKV | CLL |
| AHNAK | c.6341C>G | p.A2114G | PDVSLREGPEGKLKGPKLKMPEMHFK[p.A2114G]GPKISMPDVDLHLKGPKVKGDVDVSL | HFKGKPISM,MHFKGPKISM,PEMHFKGPKI | CLL |
| AHNAK | c.8665C>G | p.D2889H | LKGPEVDLKGPKVDIDVPDVNVQGP[p.D2889H]HWHLKMPKMKMPKFSMPGFKAEGPEV | VQGPHWHLK,NVQGPHWHL,NVQGPHWHLK,HWHLKMPKMK,VQGPHWHLKM | BLCA |
| AHNAK2 | c.3643C>T | p.P1215S | APKVEADVSLPSMQGDLKTTDLSIQ[p.P1215S]SPSADLEVHAGQVDVKLLEGHVPEGA | SPSADLEVH | KIRP |
| AHNAK2 | c.4918C>A | p.L1640M | PDVKMSLSSMEVDVQAPRAKLDGAQ[p.L1640M]MEGDLSLADKAVTAKDSKFKMPKFKM | AQMEGDLSL,QMEGDLSLA,RAKLDGAQM,AQMEGDLSLA | TGCT |
| AHNAK2 | c.6497C>T | p.S2166F | LANKDLTTKDSKFKMPKFKMPSFGV[p.S2166F]FAPGKSIEASVDVSPPKAPHPKMSLPS | KMPSFGVFA,SFGVFAPGK,FKMPSFGVF,GVFAPGKSI,MPSFGVFAP,PSFGVFAPGK,KFKMPSFGVF,MPSFGVFAPG,FKMPSFGVFA | KIRP |
| AICDA | c.391C>G | p.R131G | LRIFTARLYFCEDRKAEPEGLRRLH[p.R131G]GAGVQIAIMTFKDYFYCWNTFVENHE | RLHGAGVQI,GLRRLHGAGV,RLHGAGVQIA,RRLHGAGVQI,LHGAGVQIAI,HGAGVQIAIM | LUSC |
| AICDA | c.431A>T | p.Y144F | RKAEPEGLRRLHRAGVQIAIMTFKD[p.Y144F]FFYCWNTFVENHERTFKAWEGLHENS | IMTFKDFFY,MTFKDFFYC,FFYCWNTFV,TFKDFFYCW,DFFYCWNTF,IAIMTFKDF,AIMTFKDFF,KDFFYCWNT,AIMTFKDFFY,IAIMTFKDFF,MTFKDFFYCW,KDFFYCWNTF,DFFYCWNTFV | GBM |
| AIDA | c.740A>T | p.K247M | VDIELQKHVEKLTKGAAIFFEFKHY[p.K247M]MPKKRFTSTKCFAFMEMDEIKPGPIV | IFFEFKHYM,EFKHYMPKK,MPKKRFTST,FEFKHYMPK,KHYMPKKRF,YMPKKRFTST,MPKKRFTSTK,FFEFKHYMPK,EFKHYMPKKR,AIFFEFKHYM,FKHYMPKKRF | KIRC |
| AK302879 | c.572A>G | p.Q191R | AVSTQQQEEDRSSSCREAVLQWRLQ[p.Q191R]RTIKEQALLNAHTQVTESLKQVQLE | AVLQWRLQR,QWRLQRTIK,RTIKEQALL,LQWRLQRTI,VLQWRLQRTI,EAVLQWRLQR,LQRTIKEQAL | PRAD |
| AK7 | c.476C>T | p.A159V | SALSEEVSHFEKRKLFILLSTVMTW[p.A159V]VRSKALDPEDSEVPFTEEDYRRRKSH | LLSTVMTWV,VMTWVRSKA,ILLSTVMTWV,TVMTWVRSK,MTWVRSKAL,LSTVMTWVR,ILLSTVMTWVR,TVMTWVRSKA,VMTWVRSKAL,STVMTWVRSK,LLSTVMTWVR,KAL,STVMTWVRSK,LLSTVMTWVR | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| AK8 | c.728A>C | p.D243A | KLLEYHRNIVRVIPSYPKILKVISA[p.D243A]AQ PCVDVFYQALIYVQSNHRTNAPFT | KILKVISAA,VISAAQPCV,AAQPCVDVFY,AAQPCVDVF,KVIS AAQPCV,AAQPCVDVFY,SAAQPCVDVF | GBM |
| AKAP12 | c.3844G>A | p.E1282K | ILSKTEGTQEADQYADEKTKDVPFF[p.E1282K]KG LEGSIDTGITVSREKVTEVALKGE | KTDVPFFK,KDVPFFKGL,KTKDVPFFKG | CRC |
| AKAP13 | c.8353del A | p.K2785fs | QAPASTSASTRLFGLTKPKEKKEKK[p.K2785fs]RR TKPAALSPVMVPRQKYQQRVKRSSADPLPLC* | ALSPVMVPR,KRRTKPAAL,RTKPAALSP,RQKYQQRVK,QQRVKRSSA, RVKRSSADP,RSSADPLPL,KPAALSPVM,EKKRRT KPA,YQQRVKRS,VKRSSADPL,RTKPAALSPV,AALSPVM PVMV,VPRQKYQQRV,KRRTKPAAL,TKPAALSPVM,YQQRVKRSSA, KRSSADPLPL,SPVMVPRQKY PR,RQKYQQRVKR,RVKRSSADPL,MVPRQKYQQR,KPAALS | STAD |
| AKAP9 | c.10444C>A | p.L3482I | RRILYQNLNEPTTWSLTSDRTRNWV[p.L3482I]IQ QKIEGETKESNYAKLIEMNGGGTG | RTRNWVIQQ,SDRTRNWVI,RNWVIQQKI,RTRNWVIQQK | CRC |
| AKAP9 | c.11229del G | p.M3743fs | YLLLLGGFQECEDATLALLARMGG[p. M3743fs]SQLSRI* | RMGGSQLSR,LARMGGSQL,RMGGSQLSRI,LLARMGGSQL | STAD |
| AKD1 | c.3625del A | p.R1209fs | DMKAKIRVDTIAKRRAELILERDKK[p.R1209fs] GGRMLLEMMKRLVRKNLKKT MMILKTSLKMSFQKMRKR* | MLLEMMKRL,TMMILKTSL,NLKKTMMIL,RMLLEMMKR,E MMKRLVRK,RLVRKNLKK,MMILKTSLK,TSLKMSFQK,KMS FQKMRK,MSFQKMRKR,KRLVRKNLK,KNLKKTMMI,LKKT MMILK,KTMMILKTS,KTSLKMSFQ,SLKMSFQKM,MKRLV RKNL,MILKTSLKM,KGGRMLLEM,RNLKKTMM,LKTSLK MSF,MLLEMMKRLV,MMILKTSLKM,NLKKTMMILK,TMM ILKTSLK,KTSLKMSFQK,KMSFQKMRKR,GGRMLLEMMK, MMKRLVRKNL,MKRLVRKNLK,KRLVRKNLKK,KTMMILKTS L,SLKMSFQKMR,ILKTSLKMSF,LERDKKGGRM,KKGGRML LEM,RMLLEMMKRL,RKNLKKTMMI,TSLKMSFQKM | STAD |
| AKNAD1 | c.1859A>G | p.K620R | AEMTAPSPSCAFCRRLLEWKQNVEK[p.K620R]RGHG RINCGRFSIVLHEKAPHSDSTP | NVEKRGHGR,RGHGRINCGR | HNSC |
| AKT1 | c.49G>A | p.E17K | MSDVAIVKEGWLHKRG[p.E17K]KYIKTWRPR YFLLKNDGTFIGYKERP | WLHKRGKYI,LHKRGKYIK,RGKYIKTWR,KYIKTWRPR,GWL HKRGKY,WLHKRGKYIK,KYIKTWRPRY,HKRGKYIKTW | BRCA, CESC, THCA |
| AKT2 | c.867C>G | p.I289M | EYLHSRDVVYRDIKLENLMLDKDGH[p.I289M]MKI TDFGLCKEGISDGATMKTFCGTP | LMLDKDGHM,HMKITDFGL,MLDKDGHMK,MLDKDGHM KI,LMLDKDGHMK | BRCA |
| ALAS1 | c.904G>C | p.G302R | PRVCGAVMDTLKQHGAGAGGTRNIS[p.G302R]RTS KFHVDLERELADLHGKDAALLFS | GTRNISRTS,ISRTSKFHV,RTSKFHVDL,RNISRTSKF,NISRTS KFHV,GTRNISRTSK,TRNISRTSKF | KIRC |
| ALB | c.881C>T | p.S294L | CCHGDLLECADDRADLAKYICENQD[p.S294L] LISSKLKECCEKPLLEKSHCIAEVEN | YICENQDLI,KYICENQDL,NQDLISSKL,CENQDLISS,KYICEN QDLI,AKYICENQDL | CRC |
| ALDH1A2 | c.253C>T | p.R85C | PATGEQVCEVQEADKADIDKAVQAA[p.R85C]CLAFS LGSVWRRMDASERGRLLDKLA | CLAFSLGSV,QAACLAFSL,AVQAACLAF,VQAACLAFSL,KAV QAACLAF,CLAFSLGSVW | PRAD |
| ALDH1L1 | c.2608G>A | p.A870T | KALYVSDKLQAGTVFVNTYNKTDVA[p.A870T]TPFGG FKQSGFGKDLGEAALNEYLRV | VATPFGGFK,DVATPFGGF,NKTDVATPF,DVATPFGGFK,YN KTDVATPF,TDVATPFGGF | CRC |
| ALDH2 | c.858del G | p.L286fs | TEIGRVIQVAAGSSNLKRVTLELGG[p.L286fs]RAPTS SCQMPIWIGPWNRPTSPCSSTRASAAVPAPGPSCRRTS MMSLWSGALPGPSLGWSGTPLIARPSRGRRWMKLSLR RSSATSTRGSKRGRSCCCVVGALLLTVVTSSS PLCLEMCRMA* | SMMSLWSGA,MMSLWSGAL,SLGWSGTPL,VVGALLLTV,K LSLRRSSA,ATSTRGSKR,QMPIWIGPW,STRASAAVP,RTSM MSLWS,IARPSRGRR,PSRGRRWMK,RGRRWMKLS,RWM KLSLRR,SLRRSSATS,SATSTRGSK,STRGSKRGR,RGRSCCVV G,SSSPLCLEM,PIWIGPWNR,SSTRASAAV,TVVTSSSPL,RP TSPCSST,GPSCRRTSM,RPSRGRRWM,LELGGRAPT,RAPTS SCQM,CRRTSMMSL,RRTSMMSLW,SLWSGALPG,SGALP GPSL,LGWSGTPLI,GRRWMKLSL,RSCCVVGAL,MPIWIGP WN,SMMSLWSGAL,SLGWSGTPLI,CVVGALLLTV,VVGALL LTVV,SATSTRGSK,CQMPIWIGPW,STRASAAVPA,RASAA VPAPG,SCRRTSMMSL,RTSMMSLWSG,TSMMSLWSGA,R | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ALDH3A1 | c.1685de lC | p.P562fs | ETFSHRRSCLVRPLMNDEGLKVRYP[p.P562fs]R ARPR* | PSRGRRWMK,RGRRWMKLSL,GSKRGRSCCVV,RGRSCCVV GA,RSCCVGALL,MPIWIGPWNR,LIARPSRGRR,SATSTRG SKR,CSSTRASAAV,LTVVTSSSPL,APTSSCQMPI,GPWNRPT SPC,SPCSSTRASA,GPSCRRTSMM,GRAPTSSCQM,CRRTS MMSLW,MSLWSGALPG,WSGALPGPSL,GALPGPSLGW,I ARPSRGRRW,MKLSLRRSSA,GRSCCVVGAL,TSSSPLCLEM, LELGGRAPTS,SPLCLEMCRM | STAD |
| ALG2 | c.905C>A | p.S302Y | NVEHYQELKKMVQQSDLGQYVTFLR[p.S302Y]YFSD KQKISLLHSCTCVLYTPSNEHF | GLKVRYPRA,KVRYPRARP,EGLKVRYPR,GLKVRYPRAR,KV RYPRARPR | CRC |
| ALKBH1 | c.409A>G | p.K137E | WHWVKQCLKLYSQKPNVCNLDKHMS[p.K137E]EEE TQDLWEQSKEFLRYKEATKRRPR | TFLRYFSDK,QYVTFLRYF,RYFSDKQKI,GQYTFLRY,YVTFL RYFS,LGQYVTFLRY,VTFLRYFSDK,FLRYFSDKQK,GQYVTFLRYF | LUAD |
| ALPK2 | c.1067de lT | p.L356fs | ECSDVMTDYSNAVWQRNLLGTEHVF[p.L356fs]Y* | SEEETQDLW,HMSEEETQDL,MSEEETQDLW | STAD |
| ALPK2 | c.1568de lA | p.K523fs | LLSGESENSGMSQCWETAADKRVGG[p.K523fs]RT YGARGVQGNLPG* | LLGTEHVFY,NLLGTEHVFY | UCEC |
| ALPK2 |  |  |  | RVGGRTYGA,RTYGARGVQ,RVGGRTYGAR,RTYGARGVQ G,TAADKRVGGR,ADKRVGGRTY |  |
| ALPPL2 | c.157G>A | p.D53N | DAVLRCIISGQPKPEVTWYKNGQAI[p.D53N]NGS GIISNYEFFENQYIHVLHLSCCT | NGSGIISNY,GQAINGSGI,INGSGIISNY,GQAINGSGII | LUSC |
| ALX4 | c.92G>C | p.W31S | VLLLGLRLQLSLGIIPVEEENPDF[p.W31S]SN RQAAEALGAAKKLQPAQTAAKNLI | SNRQAAEAL,FSNRQAAEAL | TGCT |
| AMBN | c.377G>A | p.R126Q | PPPQPQPQQQQPQPQPPAQPHLYLQ[p.R126Q]QG ACKTPPDGSLKLQEGSSGHSAALQ | YLQQGACKT,HLYLQQGACK,LQQGACKTPP | BLCA |
| AMDHD1 | c.674C>A | p.S225Y | QGPSLPGLDFADPQGSTIFQIARLI[p.S225Y]YH GPMPQNKQSPLYPGMLYVPFGANQ | IFQIARLIY,FQIARLIYH,ARLIYHGPM,TIFQIARLIY,IARLIYH GPM,IYHGPMPQNK,FQIARLIYHG | UCEC |
| AMPH | c.7A>G | p.S3G | MA[p.S3G]GGHSLLLENAQQVVLVCARGERFLAR | MAGGHSLLL | ACC |
| ANAPC1 | c.874C>T | p.R292W | PSPLPSPTASPNHTLAPASPAPARP[p.R292W]WS PSQTRKGPPVPLPKVTPTKELQQ | APARPWSPS,RPWSPSQTRK | CRC |
| ANAPC1 | c.1609A>G | p.T537A | PGLPAPSLTMSNTMRPRSTPLDGVS[p.T537A]APK PLSKLLGSLDEVVLLSPVPELRD | VSAPKPLSK,APKPLSKLL,GVSAPKPLSK | PAAD,PRAD |
| ANK2 | c.1358A>G | p.N453S | TESGLTPIHVAAFMGHLNIVLLLLQ[p.N453S]SG ASPDVTNIRGETALHMAARAGQVE | VLLLLQSGA,LQSGASPDV,LLQSGASPDV,LQSGASPDVT | KIRC |
| ANK2 | c.9227A>T | p.Q3076L | DDEAFEARVKEEEQKIFGLMVDRQS[p.Q3076L]LG TTPDTTPARTPTEEGTPTSEQNPF | GLMVDRQSL,RQSLGTTPD,LMVDRQSLGT,FGLMVDRQSL, RQSLGTTPDT | LUAD |
| ANK3 | c.3966T>A | p.D1322E | LATQLYRELICVPYMAKFVVFAKMN[p.D1322E]E PVESSLRCFCMTDDKVDKTLEQQEN | KMNEPVESS,VVFAKMNEPV,KMNEPVESSL,EPVESSLRCF | TGCT |
| ANKDD1A | c.71G>A | p.R24H | MQEELAWETDGLLPLERQLHEAA[p.R24H]HQNN VGRMQELIGRRVNTRARNHVGR | HEAAHQNNV,AHQNNVGRM,EAAHQNNVGR,LERQLHEA AH,RQLHEAAHQN,AAHQNNVGRM | UCEC |
| ANKFN1 | c.840G>T | p.M280I | YRLYRRMKTGPEHARAPEMPTNVCL[p.M280I]IVT SSTSLTVSFQEPLSVNAAVVTRY | EMPTNVCLI,LIVTSSTSL,MPTNVCLIV,CLIVTSSTSL,EMPTN VCLIV,IVTSSTSLTV,MPTNVCLIVT,PEMPTNVCLI | LUSC |
| ANKLE1 | c.1930_1933 de lTGTT | p.C644fs | TAAPISGFRRGVCVCVCVCVCVCVC[p.C644fs]VCV CVCREHPGRSPPG* | CVCREHPGR,REHPGRSPP,CVCVCVCVCR,REHPGRSPPG | TGCT |
| ANKLE1 | c.1932_1933 de lTT | p.C644fs | TAAPISGFRRGVCVCVCVCVCVCVC[p.C644fs]VCV CVCVGSTQADLPQAERGLCYRWYCWRGSK* | RWYCWRGSK,CYRWYCWRG,QAERGLCYR,LCYRWYCWR, PQAERGLCY,AERGLCYRW,RGLCYRWYCW,GLCYRWYCW R,LPQAERGLCY,AERGLCYRWY | TGCT |
| ANKMY1 | c.905A>T | p.N302I | KELDARIFLNEIPPFVEDGEPWFII[p.N302I]IE TPLLVKIQKQTYKFRNKPAHTSWN | FIIIETPLL,IIIETPLLV,IETPLLVK,IETPLLVKI,FIIIETPLLV, IIIETPLLVK,WFIIIETPLL,GEPWFIIIET | THCA |
| ANKRD11 | c.1106A>G | p.K369R | KDEYEFDEDDEQDRVPPVDDKHLLK[p.K369R]RD YRKETKSNSFISIPKMEVKSYTKN | HLLKRDYRK,KHLLKRDYR,KHLLKRDYRK | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ANKRD11 | c.6044A>C | p.Y2015S | SPKRFCPADPLHSAAPGPFSASEAP[p.Y2015S]S PAPPASPAPYALPVAEPGLEDVKDG | SASEAPSPA, EAPSPAPPA, SPAPPASPA, FSASEAPSPA, SPAP PASPAP, SEAPSPAPPA | TGCT |
| ANKRD12 | c.1879G>A | p.E627K | HKEKSKHQKDFHLEFGEKSNAKIKD[p.E627K]KD HSPTFENSDCTLKKMDKEGKTLKK | KSNAKIKDK, KDKDHSPTF, IKDKDHSPTF | BLCA |
| ANKRD12 | c.2161G>C | p.E721Q | WKENFFKSDETEDLFLNMEHESLTL[p.E721Q]QK KSKLEKNIKDDKSTKEKHVSKERN | LQKKSKLEK, TLQKKSKLEK | CESC |
| ANKRD32 | c.2996C>A | p.T999N | SEFILASKGLTHLNELLMACKSHKE[p.T999N]N TSVHTDWLLDLYAGNIKTLQKLPHI | KSHKENTSV, NTSVHTDWLL, NTSVHTDWL, KSHKENTSVH, KENTSVHTDW | BLCA |
| ANKRD36 | c.1010C>G | p.P337R | TSDKDDSVSNTATEIKDEQKSGTVL[p.P337R]RA VEQCLNRSLYRPDAVAQPVTENEF | KSGTVLRAV, EQKSGTVLR, QKSGTVLRAV | CLL |
| ANKRD36 | c.1133A>G | p.K378R | VAQPVTENEFSLESEIISKLYIPKR[p.K378R]R IISPRSIKDVLPPVEEAVDRCLYLL | RIISPRSIK, LYIPKRRI, KLYIPKRRI, KRRIISPRS, IPKRRIISP, RRIISPRSI, ISKLYIPKRR, KLYIPKRRII, KRRIISPRSI, IPKRRIISPR | KIRC |
| ANKRD36 | c.3040G>T | p.D1014Y | SEKPPGLKATSDEKDSVLNIARGKK[p.D1014Y]Y GEKTRTVSSQKPPTLKATSDEDDSV | RGKKYGEKTR, KKYGEKTRTV | CLL |
| ANKRD36 | c.3431T>C | p.M1144T | KSRTVSSPKQPALKAICDKEDSVPN[p.M1144T]TATE KKDEQLSGTVSCQKQPALKATS | SVPNTATEK, KEDSVPNTA, SVPNTATEKK, KEDSVPNTAT | CESC |
| ANKRD36C | c.1313A>G | p.H438R | LEKDTIKNQNLEKKYLKDFEIVKRK[p.H438R] REDLQKA | IVKRKREDL | PAAD, PRAD |
| ANKRD50 | c.1909G>A | p.V637M | WTALRSAAWGGHTEVVSALLYAGVK[p.V637M]MD CADADSRTALRAAAWGGHEDIVLN | ALLYAGVKM, SALLYAGVKM | TGCT |
| ANKRD6 | c.1435C>T | p.R479C | TQHQMRVLDKLMVERLSAERTECLN[p.R479C]CL QQHSDTEKHEGEKRQISLVDELKT | CLQQHSDTEK, AERTECLNCL | CRC |
| ANO2 | c.1000C>T | p.R334C | PLHDGEYDSPEDDMNDRKLLYQEWA[p.R334C]CY GVFYKFQPIDLIRKYFGEKIGLYF | YQEWACYGV, WACYGVFYK, ACYGVFYKF, LLYQEWACY, E WACYGVFY, QEWACYGVF, LYQEWACYGV, YQEWACYGVF, WACYGVFYKF, KLLYQEWACY, EWACYGVFYK, QEWACYGVFY | GBM |
| ANO3 | c.121G>T | p.A41S | GMNISKSEITKETSLKPSRRSLPCL[p.A41S]SQ SYAYSKLSQSTSLFQSTESESQA | LSQSYAYSK, SLPCLSQSY, SLPCLSQSYA, CLSQSYAYSK, RSLP CLSQSY, SQSYAYSKSL, LPCLSQSYAY | LUAD |
| ANO3 | c.2868G>T | p.M956I | IAYLIPDVPKGLHDRIRREKYIVQE[p.M956I]IM YEAELEHLQQQRRKSGQPVHHEWP | LVQEIMYEA, KYLVQEIMY, IMYEAELEH, REKYLVQEI, EKYLV QEI, QEIMYEAEL, YLVQEIMYEA, IMYEAELEHL, RREKYLV QEI, REKYLVQEIM, EKYLVQEIMY, VQEIMYEAEL | CESC |
| ANXA6 | c.692G>A | p.R231Q | RSKQHLRLVFDEYLKTTGKPIEASI[p.R231Q]Q GELSGDFPEKLMLAVVKCIRSTPEYF | IQGELSGDF, IEASIQGEL | HNSC |
| AOC3 | c.237_238 insG | p.L79fs | QSQLFADLSREELTAVMRFLTQRLG[p.L79fs]A RAGGCSPGPALGQLCLLSGVAAASQGCSPGSLG QGEPPTCPGGTGHRLLWQATPAQRE* | GQLCLLSGV, CLLSGVAAA, RLLWQATPA, RFLTQRLGA, FLT QRLGAR, LWQATPAQR, SPGPALGQL, GPALGQLCL, CPGGT GHRL, TQRLGARAG, SQGCSPGSL, FLTQRLGARA, RFLTQRL GAR, LLWQATPAQR, GPALGQLCLL, CPGGTGHRLL, MRFLT QRLGA, GQLCLLSGVA, HRLLWQATPA | STAD |
| AOX1 | c.1520C>T | p.A507V | GRHWNEQMLDIACRLLINEVSLLGS[p.A507V]V PGGKVEFKRTLIISFLFKFYLEVSA | LLGSVPGGK, NEVSLLGSV, LLGSVPGGKV, SLLGSVPGGK, SV PGGKVEFK, GSVPGGKVEF | GBM |
| AP1G1 | c.2168G>T | p.R723L | NDIAAGIPSITAYSKNGLKIEFTFE[p.R723L]L SNTNPSVTVITIQASNSTELDMTDF | ELSNTNPSV, LKIEFTFEL, FELSNTNPS, IEFTFELSN, GLKIEFTF EL, IEFTFELSNT, FELSNTNPSV | LUAD |
| AP1G2 | c.727G>A | p.D243N | PQLVHLIRTLVTMGYSTEHSISGVS[p.D243N]N PFLQVQILRLLRILGRNHEESSETM | GVSNPFLQV, NPFLQVQIL, SISGVSNPF, SISGVSNPFL, HSISGVS NPF, NPFLQVQILR, VSNPFLQVQI | HNSC |
| AP3S1 | c.121_124 del AAGA | p.K41fs | LSKFYQPYSEDTQQQIIRETFHLVS[p.K41fs]E MKMFVIS* | LVSEMKMF, TFHLVSEMK, ETFHLVSEM, FHLVSEMKM, HL VSEMKMF, SEMKMFVIS, RETFHLVSE, HLVSEMKMFV, LVS EMKMFVI, ETFHLVSEMK, RETFHLVSEM, FHLVSEMKMF | PAAD |
| AP4B1 | c.826C>T | p.R276W | VVMGATKLFLILAKMPHVQTDVLVL[p.R276W]W VKGPLLAACSSSSRELCFVALCHVR | VQTDVLVWV, VLVWVKGPL, QTDVLVWVK, HVQTDVLVW, VLVWVKGPLL, HVQTDVLVWV, VQTDVLVWVK, DVLVWVKGPL | PRAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| APBA1 | c.1870G>A | p.E624K | LIAQSIGQAFSVAYQEFLRANGINPK[p.E624K]K DLSQKEYSDLLNTQDMYNDDLIHFS | FLRANGINPK, GINPKDLSQK, NPKDLSQKEY | CRC |
| APBA1 | c.2190G>T | p.K730N | QIMSINGTLSVLQPLSTCQSIIKGL[p.K730N]NN QSRVKLNIVRCPPVTVLIRRPDL | GLNNQSRVK, KGLNNQSRVK, IIKGLNNQSR | CRC |
| APBB2 | c.729_730 insC | p.T243fs | EDGQVATVSSSPETKKDHPKTGAKT[p.T243fs]R LCTAPDPEPGTER* | GAKTRLCTA, KTRLCTAPD, KTRLCTAPDP, HPKTGAKTRL | LUAD |
| APC | c.2540de1A | p.E847fs | PYLNTTVLPSSSSRGLDSSRSEK[p.E847fs] IEVWRENAELV* | SSRSEKIEV, EWRENAEL, EWRENAELV, SSRSEKIEVW, IE VWRENAEL | CRC |
| APC | c.4060de1T | p.F1354fs | PRTKSRLQGSSLSSESARHKAVEF[p.F1354fs]L QERNLPPKVLRHPKVHLNTMFRRPHSCLADVLLSVHLI VLRVRLPAPFRVNHAVEW* | CLADVLLSV, VLLSVHLIV, LLSVHLIVL, TMFRRPHSC, SVHLIV LRV, KVHLNTMFR, LSVHLIVLR, VVRLPAPFR, RVVRLPAPF, K VVLRHPKV, VLRHPKVHL, MFRRPHSCL, VLRVVRLPA, KAVE FLQER, NLPPKVVLR, HLIVLRVVR, DVLLSVHLI, HPKVHLNT M, RPHSCLADV, APFRVNHAV, ARHKAVEFL, RNLPPKVVL, F RVNHAVEW, LPAPFRVNH, VEFLQERNL, QERNLPPKV, ADV LLSVHL, TMFRRPHSCL, VLLSVHLIVL, SVHLIVLRVV, HLIVLR VVRL, FLQERNLPPK, KVHLNTMFRR, RVVRLPAPFR, SARHK AVEFL, RNLPPKVVLR, MFRRPHSCLA, VVRLPAPFRV, LLSVHLIVLR, DVLLSVHLIV, LSVHLIVLR, HPKVHLNTMF, RPHSCL ADVL, LPAPFRVNHA, NTMFRRPHSC, LQERNLPPKV, RHPK VHLNTM, HLNTMFRRPH, CLADVLLSVH, LRWRLPAPF, ADVLLSVHLI | CRC |
| APOB | c.128C>T | p.A43V | LLLLLAGARAEEEMLENVSLVCPKD[p.A43V]VTRFKH LRKYTYNYEAEESSGVPGTA | VTRFKHLRK, LVCPKDVTR, DVTRFKHLR, VTRFKHLRKY, SLV CPKDVTR, DVTRFKHLRK, LVCPKDVTRF | CRC |
| APOB | c.2917C>A | p.L973M | TKTEVIPPLIENRQSWSVCKQVFPG[p.L973M]MN YCTSGAYSNASTDSASYYPLTGD | GMNYCTSGA, KQVFPGMNY, MNYCTSGAY, GMNYCTSGA Y, SVCKQVFPGM, CKQVFPGMNY, KQVFPGMNYC | LUAD |
| APOB | c.9306C>A | p.F3102L | FLSPSAQQASWQVSARFNQYKYNQN[p.F3102L]L SAGNNENIMEAHVGINGEANLDFLN | NQYKYNQNL, YKYNQNLSA, NLSAGNNENI, QYKYNQNLSA, FNQYKYNQNL, NQYKYNQNLS, YKYNQNLSAG, LSAGNNENIM | UCEC |
| APOB | c.9406C>T | p.R3136C | MEAHVGINGEANLDFLNIPLTIPEM[p.R3136C]C LPYTIITTPPLKDFSLWEKTGLKEP | TIPEMCLPY, PEMCLPYTI, LTIPEMCLPY, PEMCLPYTII, IPLTI PEMCL, IPEMCLPYTI | CRC |
| APOBR | c.2519G>T | p.R840L | SQVEAFESREGGPWGGRVEAEESAG[p.R840L]V EDSCGLDPAGSQTARAEGMGAMVEA | VEAEESAGV, VEDSCGLDPA | LUAD |
| APOD | c.344C>T | p.S115L | IEGEATPVNLTEPAKLLEVKFSWFMP[p.S115L]LA PYWILATDYENYALVYSCTCIIQL | FMPLAPYWI, WFMPLAPYW, KFSWFMPLA, SWFMPLAPY, MPLAPYWIL, VKFSWFMPL, FSWFMPLAPY, FMPLAPYWIL, SWFMPLAPYW, WFMPLAPYWI, EVKFSWFMPL, VKFSWF MPLA, MPLAPYWILA | CESC |
| APOE | c.388T>C | p.C130R | EETRARLSKELQAAQARLGADMEDV[p.C130R]R GRLVQYRGEVQAMLGQSTEELRVRL | RGRLVQYRG, MEDVRGRLV, DVRGRLVQYR | ACC |
| APOOL | c.412A>C | p.I138L | PKMGVITVSGLAGLVSARKGSKFKK[p.I138L]L TYPLGLATLGATVCYPVQSVIIAKV | KLTYPLGLA, KFKKLTYPL, GSKFKKLTY, KKLTYPLGL, LTYPLGL ATL, KFKKLTYPLG, KGSKFKKLTY, SKFKKLTYPL, FKKLTYPLGL | CLL |
| APPL1 | c.2002C>T | p.R668W | ERVKEKQQKELNKQKQIEKDLEEQS[p.R668W]W LIAASSRPNQASSEGQFVVLSSSQS | SWLIAASSR, LEEQSWLIA, EEQSWLIAA, QSWLIAASSR, IEK DLEEQSW, LEEQSWLIAA, EEQSWLIAAS, KDLEEQSWLI | CRC |
| AQP10 | c.782A>T | p.Q261L | SAGNGWWWVPVVAPLVGATVGTATY[p.Q261L]L LLVALHHPEGPEPAQDLIVSAQHKAS | GTATYLLIV, ATYLLVAL, ATVGTATYL, TVGTATYLL, GTATYL LLVA, ATYLLVALH, ATVGTATYLL | LUAD |
| AQP2 | c.203A>C | p.N68T | QIAMAFGLGIGTLVQALGHISGAHI[p.N68T]TPAV TVACLVGCHVSVLRAAFYVAAQ | HITPAVTVA, SGAHITPAV, TPAVTVACL, AHITPAVTV, HISG AHITPA, ITPAVTVACL, TPAVTVACLV, AHITPAVTVA | KIRP |
| AQPEP | c.925G>A | p.A309T | KEDVNGSKWTVTFSTTPHMPTYLV[p.A309T]TFVI CDYDHVNRTERGKEIRIWARKD | HMPTYLVTF, PTYLVTFVI, TYLVTFVIC, LVTFVICDY, MPTYLVTFV, HMPTYLVTFV, PHMPTYLVTF, YLVTFVICDY, MPTYLVTFVI | CRC |
| ARAP3 | c.3677G>T | p.R1226L | ASLLLKKVPLAQAGCLFTGIRRESP[p.R1226L]L VGLLRCREEPPRLLGSRFQERFFLL | GIRRESPLV, TGIRRESPL, RRESPLVGL, RESPLVGLL, FTGIRRE SPL, IRRESPLVGL | LUAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ARF4 | c.446G>A | p.R149H | FANKQDLPNAMAISEMTDKLGLQSLp.R149H]H NRTWYVQATCATQGTGLYEGLDWLS | SLHNRTWYV,HNRTWYYQA,QSLHNRTWY,LQSLHNRTW,QS LHNRTWYV,LQSLHNRTWY,KLGLQSLHNR,GLQSLHNRTW | CRC |
| ARFGAP2 | c.113G>A | p.S38N | LFKRLRAVPTNKACFDCGAKNPSWA[p.S38N]N ITYGVFLCIDCSGVHRSLGVHLSFI | SWANITYGV,NPSWANITY,WANITYGVF,AKNPSWANI,ANITYGVF L,SWANITYGVF,GAKNPSWAN,KNPSWANIT,NI TYGVFLCI,WANITYGVFL | PRAD |
| ARFGAP3 | c.896de|A | p.N299fs | SLRLAYKDLEIQMKKDEKMNISGKK[p.N299fs] MLTQTDSAWDLEIAEVLFHIQ* | KMLTQTDSA,EIAEVLFHI,KMNISGKKM,DSAWDLEIA,MLT QTDSAW,TQTDSAWDL,LEIAEVLFH,WDLEIAEVL,QTDSA WDLEI,SAWDLEIAEV,KMNISGKKML,EKMNISGKKM,KK MLTQTDSA,KMLTQTDSAW,LEIAEVLFHI,WDLEIAEVLF | PRAD |
| ARFGEF1 | c.4654_4655 insC | p.P1552fs | LDIFKTIPHALLTWRPNSGETAPP[p.P1552fs]T SISCK* | ETAPPTSIS,GETAPPTSI,ETAPPTSISC | STAD |
| ARFGEF1 | c.4894G>A | p.D1632N | KPPEQKLFAALLIKCVQLELIQTI[p.D1632N] NNIVFFPATSKKEDAENLAAAQRDAV | ELIQTINNI,LIQTINNIV,QTINNIVFF,IQTINNIVF,TINNIVFFP A,ELIQTINNIV,IQTINNIVF,LIQTINNIVF,LELIQTINNI | CRC |
| ARFIP2 | c.257G>T | p.R86L | GLIPTGSGRHPSHSTTPSGPGDEVA[p.R86L]L GIAGEKPDIVKKWGINTYKCTKQLL | VALGIAGEK,ALGIAGEKF,DEVALGIAG,VALGIAGEKF,DEVAL GIAGE | LUAD |
| ARHGAP24 | c.103A>G | p.T35A | NPQQGQGRQNAIKCGWLRKQGGFVK[p.T35A]A WHTRWFVLKGDQLYYFKDEDETKPL | KAWHTRWFV,AWHTRWFVL,GFVKAWHTR,RKQGGFVKA, KQGGFVKAW,FVKAWHTRW,VKAWHTRWF,AWHTRWF VLK,GFVKAWHTRW,KAWHTRWFVL,FVKAWHTRWF,RKQGGFVKAW | TGCT |
| ARHGAP32 | c.3757G>A | p.E1253K | LEFADKSPTPNLPSDKIYPSGSPI[p.E1253K] KENTSTATMTYMTTTPATAQMSTKEA | SPKENTSTA,KENTSTATM,KIYPPSGSPK,SPKENTSTAT,KENT STATMT | CRC |
| ARHGAP36 | c.382C>T | p.R128C | GQQRAVSHKTFGISLEEVLVNEFTR[p.R128C] CKHLELTATMQVEEATGQAAGRRRGN | LVNEFTRCK,FTRCKHLEL,CKHLELTAT,NEFTRCKHL,VLVNE FTRCK,CKHLELTATM | CRC |
| ARHGAP36 | c.440C>T | p.A147V | VNEFTRRKHLELTATMQVEEATGQA[p.A147V] VGRRRGNVVRRVFGR.IRRFFSRRNE | VGRRRGNVV,VEEQTGQAV,VGRRRGNVR | CRC |
| ARHGAP36 | c.47C>A | p.P16H | MGGCIPPLKAARALC[p.P16H]HRIMPPL LLLSAFIFLVSVLGGAPGH | KAARALCHR,AARALCHRI,RALCHRIMP,LKAARALCH,ARA LCHRIM,HRIMPPLLL,ALCHRIMPPL,KAARALCHRI,AARAL CHRIM,RALCHRIMPP,HRIMPPLLL | LUAD |
| ARHGAP5 | c.2071A>T | p.M691L | ESLSFIGEFIGKIRTEASQIRKDKY[p.M691L] LANLPFTLILANQRDSISKNLPILRH | YLANLPFTL,KYLANLPFT,QIRKDKYLA,LANLPFTLI,DKYLAN LPF,SQIRKDKYL,RKDKYLANL,YLANLPFTLI,KYLANLPFTL,K DKYLANLPF,LANLPFTLIL | GBM |
| ARHGAP5 | c.2670de|T | p.D890fs | RAFLSEVQDTIPVQLVAVTDSQADF[p.D890fs] LKMRLSKS* | VTDSQADFL,FLKMRLSKS,DFLKMRLSK,VTDSQADFLK,SQ ADFLKMRL,DSQADFLKMR | CRC,STAD |
| ARHGAP9 | c.409C>T | p.R137C | QQVSLAEGDRFLLLRKTNSDWWLAR[p.R137C]C LEAPSTSRPIFVPAAYMIEESIPSQ | SDWWLARCL,WLARCLEAPS | BRCA |
| ARHGEF17 | c.1844de|C | p.A615fs | VQEARQVFEKIQRMGAQQDDGSDAP[p.A615fs] LEALTQGGM* | LEQLTGQGM,QQDDGSDAPL | STAD |
| ARHGEF5 | c.1460A>G | p.E487G | PISLLGSFLITEESPDKEIDQNSQQE[p.E487G]GSRL RKGTVSSQGTEVVFASASVTPP | GSRLRKGTV,SQQEGSRLRK | KIRC |
| ARHGEF5 | c.4535de|C | p.S1512fs | EKLRWISALAMPREELDLLECYNSP[p.S1512fs] RYSAFEPTSPERMMWHWRKPTW* | RMMNWHWRK,NWHWRKPTW,CYNSPRYSA,LLECYNSP R,YNSPRYSAF,LECYNSPRY,LLECYNSPRY,MMNWHWRKP T,SAFEPTSPER,CYNSPRYSAF,RMMNWHWRKP,DLLECYN SPR,SPRYSAFEPT,MNWHWRKPTW,FEPTSPERMM,SPERMMNWHW | STAD |
| ARID1A | c.1841C>T | p.S614L | QTAYSQORFPPPQELSQDSFGSQAS[p.S614L]LA PSMTSSKGGQEDMNLSLQSRPSSL | SLAPSMTSS,LAPSMTSSK,DSFGSQASL,SQASLAPSM,SLAP SMTSSK,DSFGSQASLA,GSQASLAPSM,SQASLAPSMT | BLCA |
| ARID1A | c.3211de|A | p.K1071fs | KPLDLYRLYVSVKEIGLTQVNKNK[p.K1071fs]N GGNLQPTSMWAHQAVLPAP* | SMWAHQAVL,NLQPTSMWA,TSMWAHQAV,WAHQAVL PA,LQPTSMWAH,TSMWAHQAVL,SMWAHQAVLP,MWAHQAVLPA | STAD |
| ARID1A | c.3972de|C | p.Y1324fs | STGPQPNLMPSNPDSGMYSPSRYP[p.Y1324fs]RSS SSSSNDMIPWAISSPPKAPLLAAPSPASRLQCINSN SRITSGQWMAHMALLPSGTKGRCTACHTALGRGSLSSS | GQWMAHNAL,KMYTTSNAM,YYTSMAMPI,SNAMPILP L,HMALLPSGT,LLSADQQAA,MALLPSGTK,KLPSLPLSK,PM AISSPPK,QWMAHMALL,MYSPSRYPR,KGRCTACHT,LSKM | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| | | | SCPQPSPSLPASNKLPSLPLSKMYTTSMAMPILPLPQLL SADQQAAPRTNFHSSLAETVSLHPLAPMPSKTCHHK* | YTTSM, RTNFHSSLA, HPLAPMPSK, LAAPSPASR, TACHTAL GR, HTALGRGSL, TTSMAMPIL, ETVSLHPLA, YPRSSSSSS, IP MAISSPP, SPASRLQCI, LPASNKLPS, LPSLPLSKM, MPILPLP QL, APRTNFHSS, QQAAPRTNF, SSSNDMIPM, VSLHPLAPM, SSSSSSNDM, ISSPPKAPL, SRITSGQWM, MAHMALLPS, AH MALLPSG, RCTACHTAL, SNKLPSLPL, SKMYTTSMA, FHSSLA ETV, SSLAETVSL, AETVSLHPL, LPLPQLLLS, GQWMAHMAL L, AMPILPLPQL, LLLSADQQAA, WMAHMALLPS, KLPSLPLSK M, GMYSPSRYPR, HMALLPSGTK, CTACHTALGR, MYTTSM AMPI, IPMAISSPPK, RLQCINSNSR, KGRCTACHTA, ASNKLP SLPL, LSKMYTTSMA, TSMAMPILPL, RTNFHSSLAE, ITSGQ WMAHM, LLAAPSPASR, LSADQQAAPR, SSNDMIPMAI, YT TSMAMPIL, TVSLHPLAPM, YPRSSSSSSS, SPPKAPLLAA, APL LAAPSPA, CPQPSPSLPA, SPSLPASNKL, LPASNKLPSL, MPIL PLPQLL, APRTNFHSSL, SKMYTTSMAM, LPSLPLSKMY, SSSS SSSNDM, SSSSNDMIPM, ISSPPKAPLL, LAAPSPASRL, LQCI NSNSRI, SGQWMAHMAL, GRCTACHTAL, SSCPQPSPSL, K MYTTSMAMP, DQQAAPRTNF, QQAAPRTNFH, HSSLAETVSL, LAETVSLHPL, LPLPQLLLSA, AETVSLHPLA | |
| ARID1A | c.5542de|G | p.G1848fs | VDCSDKLGRVQEFDSGLLHWRIGGG[p.G1848s] TPLSISRPTSRARQSCCLPGLT HPAHQPIGSM* | RQSCCLPGL, CLPGLTHPA, LSISRPTSR, ISRPTSRAR, RARQSCCLP, LTHPAHQPL, RPTSRARQS, WRIGGGTPL, LPGLTHPA H, GLTHPAHQPL, LLHWRIGGGT, SISRPTSRAR, HWRIGGGT PL, TSRARQSCCL, RARQSCCLPG, RPTSRARQSC, HPAHQPL GSM, RIGGGTPLSI, ARQSCCLPGL, RQSCCLPGLT | STAD |
| ARID1A | c.6415de|C | p.P2139fs | RLVLETLSKLLSIQDNNVDLILATPP[p.P2139fs] AAWRSCIALWCASSVTERTRCAGRWLWYCWPTWLRGTA WQLVPLQCRRAVSATSWAS* | IALWCASSV, ALWCASSVT, WLRGTAWQL, GTAWQLVPL, IL ATPPSAA, AWRSCIALW, RWLWYCWPT, WLWYCWPTW, LWYCWPTWL, RTRCAGRWL, RAVSATSWA, RCAGRWLWY, WYCWPTWLR, QLVPLQCR, WPTWLRGTA, VPLQCRRAV, SAAW RSCIA, LATPPSAAW, AAWRSCIAL, LQCRRAVSA, RR AVSATSW, CIALWCASSV, WLWYCWPTWL, WLRGTAWQL V, CAGRWLWYCW, RWLWYCWPTW, TWLRGTAWQL, RTR CAGRWLW, LATPPSAAWR, LWCASSVTER, VTERTRCAGR, LWYCWPTWLR, SAAWRSCIAL, WPTWLRGTAW, ILATPPSA AW, AAWRSCIALW, TERTRCAGRW, RGTAWQLVPL, LQCR RAVSAT, CRRAVSATSW, RAVSATSWAS | STAD |
| ARID3A | c.1649_1650 de|GA | p.G550fs | NGIMYTGVLFAQPPAPTPTSAPNKG[p.G550fs]R RRRRQQQQRRRPGRKHRNQRRPGWASGAVHTLHIYLK* | QQRRRPGRK, AVHTLHIYL, GAVHTLHIY, WASGAVHTL, RPG WASGAV, NQRRPGWAS, AVHTLHIYLK, GWASGQVHTL, Q QQRRRPGRK, SGAVHTLHIY, RQQQQRRRPG | CLL |
| ARID4A | c.3462T>A | p.D1154E | LNVSKPQKLARSPARISPHIKDGEK[p.D1154E]EK HREKHPNSSPRTYKWSFQLNELDN | HIKDGEKEK | CLL |
| ARL13B | c.1073G>T | p.R358L | ETDRPSLESANGKKKTKKLRMKRNH[p.R358L]L VEPLNIDDCAPESPTPPPPPPVGW | KLRMKRNHL, RMKRNHLVE, LRMKRNHLV, KRNHLVEPL, KL RMKRNHLV, RMKRNHLVEP, MKRNHLVEPL, KKLRMKRNHL | LUAD |
| ARL16 | c.16G>A | p.G6R | MRVAG[p.G6R]RRALSRGAELRVPGGAKHGMCLLLGA | RVAGRRALS, MRVAGRRAL, RVAGRRALSR, AGRRALSRGA, RRALSRGAEL | SKCM |
| ARL6IP1 | c.223A>T | p.M75L | GVVSLVFLIIYYLDPSVLSGVSCFV[p.M75L]L FLCLADYLVPILAPRIFGSNKWTTE | GVSCFVLFL, SGVSCFVLF, VLFLCLADY, LSGVSCFVL, VLSGVS CFVL, VLFLCLADYL, LSGVSCFVLF, FVLFLCLADY | MM |
| ARMC3 | c.1540G>A | p.A514T | LRSKNDEVRKHASWAVMVCAGDELT[p.A514T]TNEL CRLGALDILEEVNVSGTRKNKF | TTNELCRLGA | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ARMC4 | c.64G>A | p.E22K | MGVALRKLTQWTAAGHTGIL[p.E22K]KITPL NEAILKEIIVFVESFIYKHPQ | KITPLNEAI,AGHGTGILK,TGILKITPL,LKITPLNEA,ILKITPLNE A,AAGHGTGILK,LKITPLNEAI | SKCM |
| ARNTL | c.1184C>T | p.T395M | GTSCYEYFHQDDIGHLAECHRQVLQ[p.T395M] MREKITTNCYKFKIKDGSFITLRSRW | RQVLQMREK,LQMREKTT,AECHRQVLQM,RQVLQMREKI, LQMREKITTN,MREKITTNCY | CRC |
| ARPC1A | c.636C>A | p.F212L | SKMPFGQLMSEFGGSGTGGVVHGVS[p.F212L]L SASGSRLAVVVSHDSTVSVADASKSV | WVHGVSLSA,VSLSASGSRL,GGWVHGVSL,SLSASGSRLA,GV SLSASGSR,VSLSASGSRL,LSASGSRLAW | LUSC |
| ARPP21 | c.1013G>A | p.R338H | SSSENELKWSDHQRAWSTDSDSSN[p.R338H]HNLK PAMTKTASFGGITVLTRGDSTS | HNLKPAMTK,SNHNLKPAM,SSNHNLKPAM | CRC |
| ARPP21 | c.388del|A | p.I130fs | HNVEKDIATYYCALWEVHSKLGKK[p.I130fs]S RYLVPEQSLSLQINNLMQMFPPSPLFFFLQLLKQS SRRLEHTFVFLRNFSLMLLRYIGKKRRA TRFWDPRRGTP* | SLSLQINNL,MQMFPPSPL,RLEHTFVFL,FVFLRNFSL,FLRNF SLML,LQINNLMQM,LFFFLQLLK,LMLLRYIGK,MLLRYIGKK, RNFSLMLLR,RATRFWDPR,RYLVPEQSL,QMFPPSPLF,MF PPSPLFF,RRLEHTFVF,VFLRNFSLM,HSKLGKKSR,KLGKKSR YL,LGKKSRYLV,KSRYLVPEQ,KQSSRRLEH,SRRLEHTF,RYI GKKRRA,IGKKRRATR,ATRFWDPRR,NFSLMLLRY,LLRYIGKKR, SPLFFFLQL,LLKQSSRRL,YIGKKRAT,QINNLMQMF,HT FVFLRNF,SKLGKKSRY,LSLQINNLM,LRNFSLMLL,GKKRRA TRF,KKRRATRFW,FPPSPLFFF,PPSPLFFFL,KLGKKSRYLV,Y LVPEQSLSL,LMQMFPPSPL,FVFLRNFSLM,FLRNFSLMLL,S LSLQINNLM,PLFFFLQLLK,RLEHTFVFLR,SLMLLRYIGK,LML LRYIGKK,LQINNLMQMF,MQMFPPSPLF,QMFPPSPLFF,M FPPSPLFFF,RRLEHTFVFL,TFVFLRNFSL,VFLRNFSLML,KSR YLVPEQS,SSRRLEHTFV,HTFVFLRNFS,RATRFWDPRR,ATR FWDPRRG,HSKLGKKSRY,RNFSLMLLRY,FLQLLKQSSR,ML LRYIGKKR,LLRYIGKKRR,YIGKKRRQTR,FPPSPLFFFL,SPLFF FLQLL,SRYLVPEQSL,SLQINNLMQM,LKQSSRRLEH,KQSSR RLEHT,QSSRRLEHTF,SRRLEHTFVF,VPEQSLSLQI | STAD |
| ARRB2 | c.295A>C | p.T99P | LSFRKDLFIATYQAFPPVPNPRPP[p.T99P]PR LQDRLLRKLGQHAHPFFTVRMPL | RPPPRLQDRL | TGCT |
| ARRDC4 | c.235A>G | p.T79A | ALRLEAQGRATAAWGPSTCPRASAS[p.T79A]A AALAVFSEVEYLNVRLSLREPPAGE | RASASAAAL,ASASASAAA,SASAAALA,SASAAALAV,CPRASASAA,ASA AALAVF,AAALAVFSEV,STCPRASASA,RASASAAALA,ASAS AALAV,CPRASASAAA,SASAAALAVF | ACC |
| ARSD | c.701C>G | p.A234G | LGILTLAAGQTCGFFSVSARAVTGM[p.A234G]GGVG CLFFISWYSSFGFVRRWNCILM | MGGVGCLFF,SARAVTGMG,GMGGVGCLF,GMGGVGCLF F,SARAVTGMGG,TGMGGVGCLF | KIRC |
| ARSD | c.701_709 del|CCGGC GTGG | p.AGV234 del | LGILTLAAGQTCGFFSVSARAVTGM[p.AGV234de|] GCLFFISWYSSFGFVRRW NCILMRNHDVTEQPMV | TGMGCLFFI,VTGMGCLFF,SARAVTGMG,AVTGMGCLF, GMGCLFFISW,MGCLFFISWY,RAVTGMGCLF,AVTGMGCLFF | KIRC |
| ARSG | c.391G>A | p.V131I | FAVTSVGGLPLNETTLAEVLQQAGY[p.V131I]ITG IIGKWHLGHHGSYHPNFRGFDYY | QQAGYITGI,EVLQQAGYI,LQQAGYITG,LQQAGYITGI,QQAGYI TGII,AGYITGIIGK,GYITGIIGKW,AEVLQQAGYI | CRC |
| ART1 | c.729del|C | p.I243fs | IWTCLGAPIKGYSFFPGEEEVLIPP[p.I243fs] LRPSK* | LIPPLRPSK,EEEVLIPPL,VLIPPLRPSK,GEEEVLIPPL | STAD |
| ASB16 | c.745A>G | p.T249A | QHVALYLEHGADVGLRTSQGETALN[p.T249A]AA CAGAEGPGSCRRHQAAARRLLEAG | ALNAACAGA,ETALNAACA,SQGETALNA,GETALNAAC,SQ GETALNAA,GETALNAACA | ACC |
| ASCC1 | c.619C>T | p.H207Y | QEEVLAKCSMDHGVDSSIFQNPKKL[p.H207Y]YL TIGMLVLLSEEEIQQTCEMLQQCK | YLTIGMLVL,FQNPKKLYL,KLYLTIGM,KLYLTIGMLV,YLTIGMLVLL, KKLY,NPKKLYLTI,KKLYLTIGM,KLYLTIGMLV,YLTIGMVLL, IFQNPKKLYL,LYLTIGMLVL,SIFQNPKKLY,KKLYLTIGML | CESC |
| ASCC2 | c.1094G>T | p.R365L | CDNIQGFIEEFLQIFSSLLQEKRFL[p.R365L]L DYDALFPVAEDISLLQQASSVLDET | LLQEKRFLL,FLLDYDAL,RFLLDYDAL,QEKRFLLDY,LDYDAL FPV,SLLQEKRFLL,FLLDYDALFP,LLDYDALFPV,RFLLDYDAL F,LQEKRFLLDY,KRFLLDYDAL,LDYDALFPVA | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ASCC3 | c.3590G>A | p.R1197Q | VKQCVHQIPSVMMEASIQPITRTVL[p.R1197Q]QVTLSIYADFTWNDQVHGTVGEPWWI | TVLQVTLSI,VLQVTLSIY,LQVTLSIYA,VLQVTLSIYA,ITRTV LQVTL,RTVLQVTLSI,TVLQVTLSIY,QPITRTVLQV | CRC |
| ASCC3 | c.407G>A | p.R136Q | ETKAIKQMFGPFPSSSATAACNATN[p.R136Q]QIISHFSQDDLTALVQMTEKEHGDRV | ATNQIISHF,TAACNATNQI,NATNQIISHF | UCEC |
| ASCL4 | c.105de|C | p.D35fs | ALPYSLRTAPLGVPGTLPGLPRRDP[p.D35fs]SGSPCVWTPRAGSGRAAAAHGDSTCPCRWTAPSSPPSSASATSASGSGCAA* | RAGSGRAA,STCPCRWTA,WTAPSSPPS,TPRAGSGRA,AP SSPPSSA,DPSGSPCVW,RAGSGRAAAA,RWTAPSSPPS,SG SPCVWTPR,TPRAGSGRAA | STAD |
| ASIC2 | c.137G>T | p.R46L | RMAREEPAPAALAAAGQPGGGRGGE[p.R46L]LALQGPGVARRGRPSLSRAKLHGLRH | ELALQGPGV,GELALQGPG,QPGGGRGGEL,GELQLQGPGV | KIRP |
| ASPDH | c.797A>G | p.Q266R | AVHTRRENPAEPGAVTGSATVTAFW[p.Q266R]RSLLACCQLPSRPGIHLC* | SATVTAFWR,TAFWRSLLA,RSLLACCQL,TVTAFWRSL, VTAFWRSLL,GSATVTAFWR,ATVTAFWRSL, TVTAFWRSLL,VTAFWRSLLA,WRSLLACCQL | ACC |
| ASPM | c.719C>T | p.S240F | EENKIPISPISPAFNECHGATCLPL[p.S240F]FVRRSTTYSSLHASENRELLNVHSAN | ATCLPLFVR,HGATCLPLF,FVRRSTTYS,LFVRRSTTY, TCLPLFVRR,LPLFVRRST,ATCLPLFVRR,LPLFVRRSTT, PLFVRRSTTY,CHGATCLPLF | LUAD |
| ASPN | c.201de|T | p.F67fs | DDDDDDDDEDNSLFPTREPRSHFF[p.F67fs]HLICFQCVHLDVSAIHELYIAQI* | DVSAIHELY,SHFFHLICF,CFQCVHLDV,RSHFFHLIC, EPRSHFFHL,HLICFQCVH,LDVSAIHEL,HLICFQCVHL, HLDVSAIHEL,AIHELYIAQI,RSHFFHLICF,DVSAIHELYI, EPRSHFFHLI,REPRSHFFHL,FQCVHLDVSA,LDVSAIHELY | STAD |
| ASTN2 | c.661_663 de|CTG | p.L221de| | EIVEEQMHILHISVMGGLIALLLLL[p.L221de|]VFTVALYAQRRWQKRRRIPQKSASTEAT | LIALLLLIV,ALLLLLVFT,IALLLLIVF,GLIALLLLIV, ALLLLLVFTV,LIALLLLVF | PRAD |
| ASXL2 | c.3242C>T | p.S1081L | EGLSKATQDQILQTLIQRVRRQNLL[p.S1081L]LVVPPSQFNFAHSGFQLEDISTSQRF | RVRRQNLLL,LLLVVPPSQF,RRQNLLLVV,RQNLLLVVP,RVRR QNLLV,LLLVVPPSQF,LVVPPSQFNF,RQNLLLVPP | LUSC |
| ASXL3 | c.2618de|A | p.E873fs | SIPELASTEMIKVKNHSVLQRTEKK[p.E873fs]CYLHHWNYLSFLKGQIIREMSFHLLNYRTSNISHQWIRLHFQKALEIKHISKGVHRVG* | EMSFHLLNY,YLHHWNYLS,IIREMSFHL,YLSFLKGQI,LLNYR TSNI,HISKGVHRV,MSFHLLNYR,ALEIKHISK,HWNYLSFLK, QWIRLHFQK,CYLHHWNYL,LHHWNYLSF,SHQWIRLHF,W IRLHFQKA,KCYLHHWNY,RTSNISHQW,SFLKGQIIR,SNISH QWIR,EIKHISKGV,GQIIREMSF,LQRTEKKCY,HWWNYLSFL, LSFLKGQII,LKGQIIREM,REMSFHLLN,IRLHFQKAL,LHFQK ALEI,FQKALEIKH,YLHHWNYLSF,HLLNYRTSNI,YLSFLKGQI I,FLKGQIIREM,QIIREMSFHL,IIREMSFFLL,RLFIFQKALEI,H QWIRLHFQK,KALEIKHISK,HHWNYLSFLK,LSFLKGQIIR,CY LHHWNYLS,NYLSFLKGQI,ISHQWIRLHF,KCYLHHWNYL,R TSNISHQWI,KKCYLHHWNY,REMSFHLLNY,EMSFHLLNYR, SNISHQWIR,MSFHLLNYRT,WIRLHFQKAL,LQRTEKKCYL, LHFIWNYLSFL,KGQIIREMSF,LNYRTSNISH,YRTSNISHQW, FQKALEIKHI,LEIKHISKGV,KHISKGVHRV,TEKKCYLHHW | STAD |
| ASXL3 | c.4409C>A | p.P1470Q | NRADNSGKPQQPPGGPAPAAINRSI[p.P1470Q]CKVIVDHSTTLTSSLSLTVSVSESSE | AINRSIQCK,RSIQCKVIV,AINRSIQCKV,AINRSIQCKV | LUAD |
| ATAD5 | c.913A>G | p.I305V | EIPDSTMSICVPSETVDEIVKSGYI[p.I305V]GESENSEISQQVRFKTVTVLAQVHPI | YIGESENSEI | TGCT |
| ATM | c.2399C>T | p.S800F | SLRNMMQLCTRCLSNCTKKSPNKIA[p.S800F]FGFFLRLLTSKLMNDIADICKSLASF | KIAFGFFLR,APGFFLRLL,SPNKIAGFF,KKSPNKIAF,NKIAFGF FL,IAFGFFLRL,KIAFGFFLRL,KSPNKIAFGF,NKIAFGFFLR,SP NKIAGFF,TKKSPNKIAF,IAFGFFLRLL | CESC |
| ATP10B | c.3910C>A | p.L1304I | CNSPTNPYWVMEGQLSNPTFYLVCF[p.L1304I]ITPVVALLPRYFFLSLQGTCGKSLIS | YLVCFITPV,LVCFITPVV,FITPVVAL,CFITPVVAL,YLVCFI TPVV,FVLVCFITPV,CFITPVALL,ITPVVALLPR,NPTFYLVCFI | UCEC |
| ATP10D | c.932G>A | p.R311H | AVVGIVVYAGHETKAMLNNSGPRYK[p.R311H]HSKLERRANTDVLMCVMLLVIMCLTG | SGPRYKHSK,RYKHSKLER,GPRYKHSKL,NSGPRYKHSK | CRC |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ATP12A | c.2572C>T | p.R858C | LGTDIIPSIALAYEKAESDIMNRKP[p.R858C]C HKNKDRLVNQPLAVYSLHIGLMQA | IMNRKPCHK, MNRKPCHKNK, DIMNRKPCHK | BLCA |
| ATP2A1 | c.2110G>T | p.G704C | VEPSHKSKIVEYLQSYDEITAMTGD[p.G704C]CV NDAPALKKAEIGIAMGSGTAVAKT | CVNDAPALK, ITAMTGDCV, AMTGDCVNDA, CVNDAPALK K, EITAMTGDCV | KIRC |
| ATP2A1 | c.2457_2458 insC | p.R819 fs | LVTDGLPATALGFNPPDLDIMDRPP[p.R819fs]PE PQGAPHQWLALLPLHGNRGLCGCSHRGSSCLVVPVR* | HQWLALLPL, GSSCLVVPV, RGLCGCSHR, ALLPLHGNR, SSCL VVPVR, APHQWLALL, LPLHGNRGL, LPLHGNRGL, CSHRGSSCL, EPQGAP HQW, LLPLHGNRGL, GSSCLVVPVR, CSHRGSSCLV, LALLPL HGNR, HQWLALLPLH, SHRGSSCLW, RGSSCLVVPV | STAD |
| ATP2B4 | c.548G>A | p.R183H | SVIIVIVLVTAFNDWSKEKQFRGLQC[p.R183H]HIE QEQKFSIIRNGGLIQLPVAEIVV | KQFRGLQCH, CHIEQEQKF, KQFRGLQCHI | CLL |
| ATP2C1 | c.2170G>A | p.E724K | GTDVCKEAADMILVDDDFQTIMSAI[p.E724K]KE GKGIYNNIKNFVRFQLSTSIAALT | IMSAIKEGK, AIKEGKGIY, TIMSAIKEGK, SAIKEGKGIY, DFQTI MSAIK, KEGKGIYNNI | UCEC |
| ATP6 AP2 | c.355G>C | p.E119Q | ISYPLENAVPFSLDSVANSIHSLFS[p.E119Q] QETPVVLQLAPSEERVYMVGKANSV | SLFSQETPV, FSQETPVVL, QETPVVLQL, SLFSQETPVV, HSLFSQETPV, LFSQETPVVL, SQETPVVLQL, QETPVVLQLA | HNSC |
| ATP6 V0A4 | c.572G>A | p.R191Q | MTGKLGFIAGVINRERMASFERLLW[p. R191Q]QICRGNVYLKFSEMDAPLEDPV TKEE | SFERLLWQI, WQICRGNVY, FERLLWQIC, LL WQICRGNV, WQICRGNVYL, QICRGNV YLK, LWQICRGNVY, ASFERLLWQI | CRC |
| ATP6 V1A | c.710T>C | p.L237P | RQVRPVTEKLPANHPLLTGQRVLDA[p.L237P]PF PCVQGGTTAIPGAFGCGKTVISQS | VLDAPFPCV, GQRVLDAPF, RVLDAPFPCV, TGQRVLDAPF | THCA |
| ATP6 V1B1 | c.1149de|C | p.Y383 fs | DLTGFITEGQIYDVDRQLHNRQIYPP[p.Y383fs]STCS LPCRG* | IYPPSTCSL, RQIYPPSTC, QIYPPSTCSL, RQIYPPSTCS | STAD |
| ATP6 V1C2 | c.934_935 insAG | p.R312fs | STFPDHKVKVTPLGNPDRPAAGQTD[p.R312fs]KE RERVRARVRAPCCAGSR* | KERERVRAR, RERVRARVR, RVRARVRAP, RARVRAPCC, RV RAPCCAG, RAPCCAGSR, RVRARVRAPC, RARVRAPCCA, RV RAPCCAGS, KERERVRARV, RERVRARVRA | STAD |
| ATP7A | c.2968_2969 insA | p.Q990 fs | IVETYFPGYNRSISRTETIIRFAFQ[p.Q990fs]SL YHSSVVCMSLFTGTGHSNCCDGGYRSRCSKWHTNKRWR AIGDGS* | HSNCCDGGY, FQSLYHSSV, SLYHSSVVC, LYHSSVVCM, IIRFA FQSL, RFAFQSLYH, GGYRSRCSK, RSRCSKWHT, RCSKWHT NK, CSKWHTNKR, KWHTNKRWR, HTNKRWRAI, RWRAIGD GS, IRFAFQSLY, QSLYHSSVV, SSVVCMSLF, FAFQSLYHS, HSS VYCMSL, MSLFTGTGFI, SKWHTNKRW, SLYFISSVYCM, TIIR FAFQSL, HSNCCDGGYR, IIRFAFQSLY, RSRCSKWHTN, KWH TNKRWRA, HTNKRWRAIG, FQSLYHSSVY, HSVYCMSLF, G HSNCCDGGY, ETIIRFAFQS, FAFQSLYHSS, YHSSVVCMSL, G GYRSRCSKW | KIRC |
| ATP9A | c.1556G>A | p.R519Q | VYQASSPDEVALIVQWTESVGLTLVG[p.R519Q]Q DQSSMQLRTPGDQILNFTILQIFPF | LVGQDQSSM, GQDQSSMQL, TLVGQDQSSM | BLCA |
| ATP9A | c.869G>A | p.R290Q | ASGTVVGVLYTGRELRSVMNTSNP[p.R290Q]QS KIGLFDLEVNCLTKLLFGALVVVS | NTSNPQSKI, NPQSKIGLF, VMNTSNPQSK | UCEC |
| ATP9B | c.115A>G | p.S39G | AAAANRKRAAYYSAAGPRPGADRH[p.S39G]GR YQLEDESAHLDEMPLMMSEEGFEN | RPGADRHGRY | ACC |
| ATR | c.5440de|A | p.R1814 fs | NYLAADGKSTTWSVRLGQLLLSAKK[p.R1814fs]E ISQLFMTH* | AKKEISQLF, KKEISQLFM, KEISQLFMT, SAKKEISQLF, AKKEI SQLFM, KEISQLFMTH | UCEC |
| ATRN | c.590C>A | p.P197Q | LRFNHFATECSWDHLYVYDGDSIYA[p.P197Q]QL VAAFSGLIVPERDGNETVPEWAT | SIYAQLVAA, QLVAAFSGL, IYAQLVAAF, AQLVAAFSG, AQLIV AAFSGL, QLVAAFSGLI, SIYAQLVAAF, DSIYAQLVAA | LUAD |
| ATRNL1 | c.3732A>T | p.L1244F | IAFSQHNTIMDLVQFFVTFFSCFLS[p.L1244F] FLLVAAVWKIKQTCWASRREQLLR | FSCFLSFLL, FLSFLLVAA, FFSCFLSFL, LSFLLVAAV, TFFSCFLSF, FLLVAAVVW, FSCFLSFLLV, FFSCFLSFLL, FLSFLLVAAV, VTF FSCFLSF, TFFSCFLSFL, SFLLVAAVVW, LSFLLVAAVV | CLL |
| ATRX | c.5807A>G | p.K1936R | IASDSDETSMSLSSDDYTKKKKKGK[p.K1936R]RG KKDSSSGSGSDNDVEVIKVNNSR | YTKKKKKGKR | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ATXN1 | c.651G>T | p.Q217H | GHKAEQQQQQQQQQQQQHQHQQQQQ[p.Q217H]H QQQQQQQHLSRAPGLITPGSPPPA | HQHQQQQQH, HQQQQQQQH | LIHC |
| AURKA | c.1160C>T | p.S387L | RLLKHNPSQRPMLREVLEHPWITAN[p.S387L]L SKPSNCQNKESASKQS* | HPWITANLS, LSKPSNCQNK, LEHPWITQNL | CESC |
| AVIL | c.190G>T | p.G64W | EGDCYVILSTRRVASLLSQDIHFWI[p.G64W] WKDSSQDEQSCAAIYTTQLDDYLGGS | SQDIHFWIW, SQDIHFWIWK, LSQDIHFWIW | LUAD |
| AVIL | c.896_897 insG | p.G299 fs | DLLNHDDCYILDQSGTKIYVWKGKG[p.G299fs] SHKG* | VWKGKGSHK, YVWKGKGSHK | KIRC |
| AVL9 | c.102C>A | p.F34L | DGVPRGPVLHIVVGHHHKKGCQVE[p.F34L]LSY PPLIPGDHDSHTLPEEWKYLPF | KGCQVELSY, HKKGCQVEL, CQVELSYPP, VELSYPPLI, CQVEL SYPPL, KKGCQVELSY | UCEC |
| AVL9 | c.21_22insG | p.G7fs | MEKARRGG[p.G7fs]GWRPPGARTAHRGGRISPQE GLPG* | KARRGGWR, RTAHRGGRI, RPPGARTAH, GRISPQEGL, KA RRGGGWRP, GWRPPGARTA, GARTAHRGGR, MEKARRGGGW | ACC |
| AVPR1A | c.1053del|T | p.F351fs | ENPTITITALLGSLNSCCNPWIYMF[p.F351fs]LV AISFKTVFKASHAAKT* | WIYMFLVAI, YMFLVAISF, FLVAISFKT, LVAISFKTV, TVFKAS HAA, MFLVAISFK, AISFKTVFK, IYMFLVAIS, KTVFKASHA, VF KASHAAK, VAISFKTVF, ISFKTVFKA, FKTVFKASH, NPWIYM FLV, FLVAISFKTV, AISFKTVFKA, YMFLVAISFK, VAISFKTVFK, TVFKASHAAK, PWIYMFLVAI, IYMFLVAISF, SFKTVFKASH, KTVFKASHAA, LVAISFKTVF, NPWIYMFLVA | STAD |
| AVPR1B | c.115G>A | p.G39R | RGTLSAPNATTPWLGRDEELAKVEI[p.G39R]R VLATVLVLATGGNLAVLLTLGQLGR | RVLATVLVL, ELAKVEIRV, EIRVLATVL, VEIRVLATV, RVLATVLVLA, KVEIRVLATV, EIRVLATVLV, AKVEIRVLAT, VEIRVLAT VL, IRVLATVLVL, EELAKVEIRV | TGCT |
| AXDND1 | c.2790G>T | p.E930D | WRESAKQGTLAQKYLEAMAVIEHMQ[p.E930D]K LLEVENRARQAEKFEDAYEKLHH | HMQDKLLEV, AVIEHMQDK, IEHMQDKLL, AVIEHMQDKL | CRC |
| AXDND1 | c.301T>C | p.W101R | CPENLLPPKKIKTPKGTLPRLVDHV[p.W101R]RH HPVRRNKFKYLIDHPVSLTGAGRD | HVRHHPVRR, RHHPVRRNK, RLVDHVRHH, LVDHVRHHPV, HVRHHPVRRN, RHHPVRRNKF | LUAD |
| AXIN2 | c.1988_199 4de|GGGGGG | p.W663fs | QSTKKAYPLESARSSPGERASRHHL[p.W663fs]ST AGTPAPPVPTCSPRTLRCLP* | HLSTAGTPA, RASRHHLST, ASRHHLSTA, PTCSPRTLR, TPAPPVPT, VPTCSPRTL, RASRHHLSTA, ASRHHLSTAG, HHLSTAGTPA | CRC |
| AXIN2 | c.1993_1994 insG | p.G665fs | KKAYPLESARSSPGERASRHHLWGG[p.G665fs]QQ RAPPHHPPCPPVHPGPCDASPDPTQHAGSAGGGLSQAS* | HLWGGQQRA, GQQRAPPHH | CRC |
| AXIN2 | c.1994de|G | p.G665fs | TKKAYPLESARSSPGERASRHHLWG[p.G665fs]AT AGTPAPPVPTCSPRTLRCLP* | HLWGATAGT, ASRHHLWGA, PTCSPRTLR, TPAPPVPT, VP TCSPRTL, RASRHHLWGA, WGATAGTPA, RASRHHLWGA, ASRHHLWG AT, RHHLWGATAG | STAD |
| B2M | c.1A>G | p.M1V | [p.M1V]VSRSVALAVLALLSLSGLEAIQRTPK | VSRSVALAV, VRSVALAVL | OV |
| B2M | c.37_38de|CT | p.L13fs | MSRSVALAVLALLS[p.L13fs]FWPGGYPAYSK DSGLLTSSSREWKVKFPELLCVWVSSIRH* | LLSFWPGGY, LLCVWVSSI, LITSSSREWK, SSSREWKVK, KFPE LLCVW, KVKFPELLC, FWPGGYPAY, TSSSREWKV, EWKVKF PEL, LAVLALLSF, SFWPGGYPA, LLITSSSREW, SSSREWKVKF, WKVKFPELL, VKFPELLCV, REWKVKFPE, FPELLCVWV, ELLC VWVSSI, ALLSFWPGGY, LLTSSSREWK, TSSSREWKVK, SFW PGGYPAY, KFPELLCVWV, KVKFPELLCV, DSGLLTSSSR, LLCV WVSSIR, LSFWPGGYPA, LTSSSREWKV, YPAYSKDSGL, ALA VLALLSF, LAVLALLSFW, GLLTSSSREW, SSSREWKVKF, REW KVKFPEL, VKFPELLCVW | CRC, STAD |
| B2M | c.3G>A | p.M1I | [p.M1I]ISRSVALAVLALLSLSGLEAIQRTPK | ISRSVALAV, IRSVALAVL | HNSC |
| B3GALNT1 | c.434G>A | p.R145Q | QEAEKEDKMLALSLEDEHLLYGDII[p.R145Q]Q QDFLDTYNNLTLKTIMAFRWVTEFC | IQQFLDTY, LYGDIIQQDF, IIQQDFLDTY | CRC |
| B3GAT1 | c.374G>T | p.R125L | AELTRMANTLLHVPNLHWLVVEDAP[p.R125L]LRTP LTARLLRDTGLNYTHLHVETPR | WLVVEDAPL, VEDAPLRTPL | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| B3GNT5 | c.88del T | p.F30fs | GRRVKKWQLIIQLFATCFLASLMFF[p.F30fs]GNQSIITL* | FLASLMFFG, LMFFGNQSI, MFFGNQSII, FGNQSIITL, FLASL MFFGN, SLMFFGNQSI, LMFFGNQSII, FFGNQSIITL | STAD |
| B4GALNT1 | c.263_264insG | p.G88fs | PVRIKEQVVGLLAWNNCSCESSGGG[p.G88fs]PPPPLPETSPSY* | PLPETSPSY, PPLPETSPSY | PRAD |
| BACH1 | c.1613G>A | p.R538Q | ESCSAREQECEVKLPFNAQRIISLS[p.R538Q]QNDQSLLKMHKLTPEQLDCIHDIRR | SQNDFQSLL, AQRIISLSQ, IISLSQNDF, LSQNDFQSL, SLSQN DFQSL, SQNDFQSLLK, RIISLSQNDF, LSQNDFQSLL | CRC |
| BAG1 | c.133G>C | p.G45R | RLRALRPGREPRQSEPPAQRGPPPS[p.G45R]RRPPARSTASGHDRPTRGAAAGARRP | AQRGPPPSR, AQRGPPPSRR, GPPPSRRPPA | ACC |
| BAI2 | c.692C>G | p.A231G | EECGRAAGRACGFAQPGCSCPGEAG[p.A231G]GSTTTTSPGPPAAHTLSNALVPGGP | GEAGGGSTT, GEAGGGSTTT | TGCT |
| BAIAP2L2 | c.1186G>A | p.V396M | SSASGWFPEATVKALEEGPVNPMTP[p.V396M]MTPMTSMTSMSPMTPMNPGNELPSRS | NPMTPMTPM, GPVNPMTPM, TPMTPMTSM, MTPMTPM TSM, MTPMTSMTSM, TPMTPMTSMT | KIRP |
| BAP1 | c.233A>G | p.N78S | IEERRSRRKVSTLVDDTSVIDDDIV[p.N78S]SNMFFAHQLIPNSCATHALLSVLLNC | IVSNMFFAH, DIVSNMFFA, SNMFFAHQL, SNMFFAHQLI, V SNMFFAHQL | KIRC |
| BAP1 | c.679C>T | p.R227C | WTDKARRVIMERIGLATAGEPYHDI[p.R227C]CFNLMAVPDRRIKYEARLHVLKVNR | PYHDICFNL, DICFNLMAV, YHDICFNLM, GEPYHDICF, HDIC FNLMA, PYHDICFNLM, DICFNLMAW, EPYHDICFNL, HDICFNLMAV | OV |
| BARX2 | c.203G>C | p.R68P | SLYSVCPSLVVRPKPLHSCTGSPSL[p.R68P]PAYPLLSVITRQPTVISHLVPATPGI | TGSPSLPAY, LPAYPLLSV, SPSLPAYPL, CTGSPSLPAY, SLPAY PLLSV, SPSLPAYPLL, LPAYPLLSVI | LUAD |
| BAX | c.114_115insG | p.M38fs | SEQIMKTGALLLQGFIQDRAGRMGG[p.M38fs]GTRAGPGPGASGCVHQEAERVSQAHRGRTGQ* | RMGGGGTRA, GTRAGPGPG, RVSQAHRGR, QEAERVSQA, AGRMGGGGTR, GTRAGPGPGA, RMGGGGTRAG, HQEAER VSQA, QEAERVSQAH | STAD |
| BBOX1 | c.526T>G | p.F176V | RLTGASDKPGEVSKLGKRMGFLYLT[p.F176V]VYGHTWQVQKIDANNVAYTTGKLSF | RMGFLYLTV, TVVGHTWQV, YLTVYGHTW, MGFLYLTVV, FLYLT VYGHT, FLYLTVVYG, RMGFLYLTVV, LYLTVYGHTW, KRMGFLYLTV | CRC |
| BBS9 | c.802del T | p.F268fs | ALDICIVSFNQSASSVFVLGERNFF[p.F268fs]ALRIMDKFDS* | VLGERNFFA, FALRIMDK, RNFFALRIM, FVLGERNFFA, VLGERN FFAL, NFFALRIMDK, FFALRIMDKF, GERNFFALRI, ERNFFALRIM | PRAD |
| BC139719 | c.398T>G | p.L133R | SSKSRNAPRSSCGNCGARAPEHPPV[p.L133R]RVESLNLPLLNGLREEGPGVFSRSV | PPVRRVESL, HPPVRRVESL, RVESLNLPL | PRAD |
| BCAS3 | c.641C>T | p.T214M | DLHCNKRILVVVLQEKIAAFDSCTF[p.T214M]MKKFFVTSCYPCPGPNMNPIALGSRW | CTFMKKFFV, AFDSCTFMK, TFMKKFFVT, AAFDSCTFM, FM KKFFVTS, MKKFFVTSC, FMKKFFVTSC, AAFDSCTFMK, AFD SCTFMKK, MKKFFVTSCY, IAAFDSCTFM, FDSCTFMKKF | BLCA |
| BCKDHA | c.111del C | p.H37fs | RGLSQAALLLRQPGARGLARSHPP[p.H37fs]GSSSSFHLWMTSPSSQGPRRSL* | SSSSFHLWM, RSHPPGSSS, HPPGSSSSF, SSQGPRRSL, GSSS SFHLW, FHLWMTSPS, WMTSPSSQG, MTSPSSQGPR, RGLARSH PPG, RSHPPGSSSS, SHPPGSSSSF, GSSSSFHLWM, FHLWMTSPSS | STAD |
| BCKDHA | c.385_395del GGGGACTGGGC | p.G129fs | LCCFWPVGIAAPCLAQKVSLCVGLG[p.G129fs]IKEKNAPQKQRAIYLRREGGR* | SLCVGLGIK, CVGLGIKEK, KQRAIYLRR, IYLRREGGR, APQKQ RAIY, KVSLCVGLGI, VSLCVGLGIK, GIKEKNAPQK, KQRAIYLR RE, AIYLRREGGR, APQKQRAIYL | PAAD |
| BCL11A | c.1735G>A | p.E579K | SMQHFSEAFHQVLGEKHKRGHLAEA[p.E579K]KGHRDTCDEDSVAGESDRIDDGTVNG | HLAEAKGHR, AEAKGHRDT | HNSC |
| BCL2 | c.515A>G | p.N172S | IVAFFEPFGGVMCVESVNREMSPLVD[p.N172S]SIALWMTEYLNRLHLTWIQDNGGWDA | LVDSIALWM, SIALWMTEY, EMSPLVDSI, MSPLVDSIA, SPL VDSIAL, REMSPLVDS, DSIALWMTEY, SIALWMTEYL, MSPL VDSIAL, REMSPLVDSI, SPLVDSIALW | DLBCL |
| BCL2 | c.6C>T>G | p.H20Q | MAHAGRTGYDNREIVMKYI[p.H20Q]QYKLSQRGYEWDAGDVGAAPPGAAPA | VMKYIQYKL, IVMKYIQYK, YIQYKLSQR, IQYKLSQRG, REIVM KYIQ, IVMKYIQYKL, EIVMKYIQYK, IQYKLSQRGY, KYIQYKLS QR, REIVMKIYQY | DLBCL |
| BCL2 | c.97G>A | p.G33R | GYDNREIVMKYIHYKLSQRGYEWDA[p.G33R]DVGAAPPGAAPAPGIFSSQPGHTPH | YEWDARDVG, SQRGYEWDAR, YEWDARDVGA | DLBCL |
| BCL2L11 | c.272G>A | p.R91Q | PPASPGPFATRSPLFIFMRRSSLLS[p.R91Q]QSSSGYFSFDTDRSPAPMSCDKSTQT | QSSSGYFSF, LLSQSSSGY, LSQSSSGYF, SQSSSGYFS, SQSSSG YFSF, SLLSQSSSGY, LLSQSSSGYF, FMRRSSLLSQ | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| BCL2L11 | c.560_561 insA | p.L187fs | YARRVFLNNYQAAEDHPRMVILRLL[p.L187fs]T LHCPPGVENALTGSLRSRDTMQTFCLFK TRPSTAVSWCHYAASGSLVEGAGDVSEDT ELDGTTFLFITTQQNF* | STAVSWCHY,TAVSWCHYY,ELDGTTFLF,LTLHCPPGV,AVS WCHYYA,SLVEGAGDV,MVILRLLTL,TMQTFCLFK,DTMQTFCLF,H YYAASGSL,YYAASGSLV,LFITTQQNF,RSRDTMQTF, LFKPTRPST,VSWCHYYAA,TFCLFKPTR,CPPGVENAL,KPTR PSTAV,RMVILRLLT,VENALTGSL,GSLRSRDTM,TELDGTTF L,STAVSWCHYY,ELDGTTFLFI,RMVILRLLTL,LLTLHCPPGV, AVSWCHYYAA,FLFITTQQNF,DTMQTFCLFK,QTFCLFKPTR, HYYAASGSLV,TELDGTTFLF,RSRDTMQTFC,LFKPTRPSTA, PSTAVSWCHY,NALTGSLRSR,TAVSWCHYYQ,LRSRDTMQ TF,RDTMQTFCLF,MQTFCLFKPT,CHYYAASGSL | UCS |
| BCL7A | c.155C>T | p.T52M | KVRKWEKKWTVGDTSLRIYKVVVPV[p.T52M]ME PKVDDKNKNKKKGKDEKCGSEVTT | RIYKWPVM,KWVPVMEPK,LRIYKWVPVM | CRC |
| BCL9L | c.2938G>T | p.G980C | PQTPSQMVPLPSANPPGPLKSPQVL[p.G980C]CSSL SVRSPTGSPSRLKSPSMAVPSP | QVLCSSLSV,SPQVLCSSSL,QVLCSSLSVR | LUAD |
| BCL9L | c.3379_3380 insC | p.P1127fs | YHNAIKTIATSDDELLPDRPLLPPP[p.P1127fs]T TTAGLRARDQQQPAQPDAPELSRCPEPYGH EPARPAAPV* | LLPPPTTTA,RARDQQQPA,LSRCPEPYG,ELSRCPEPY,TTTA GLRAR,EPARPAAPV,RPLLPPPTT,LPPPTTTAGL,QPAQPD APEL,YGHEPARPAA,HEPARPAAPV | STAD |
| BCLAF1 | c.109_110 insCA | p.R37fs | RSKSRSQSSSRSRSRSHSRKKRYSS[p.R37fs]T GLVPEHIQGLVVEIVCILEIIVAITEIEE* | LVVEIVCIL,CILEIIVAI,IVAITEII,LVPEHIQGL,HIQGLV VEI,GLVVEIVCI,EIVCILEII,EIIVAITEI,SRKKRYSST,KKRY SSTGL,KRYSSTGLV,VEIVCILEI,VPEHIQGLV,GLVPEHIQGL,LVP EHIQGLV,HIQGLVVEIV,GLVVEIVCIL,HSRKKRYSST,KKRYSSTGL V,EIVCILEIIV,EIIVAITEII,VPEHIQGLVV,RKKRYSSTGL,LEIIV AITEI,VEIVCILEII | CRC |
| BCOR | c.4376A>G | p.N1459S | LPCSSSPQETTQSRPMPPEARRLIV[p.N1459S]S KNAGETLLQRAARLGYEEVVLYCLE | EARRLIVSK,VSKNAGETL,SKNAGETLL | LUAD |
| BEND2 | c.1607C>A | p.P536Q | RILFSKEILISSSVDIHLKDSQSLD[p.P536Q]QN KMAALREYLATTFPTCDLHEHGKD | DQNKMAALR,SQSLDQNKM,SLDQNKMAAL | LUAD |
| BEND2 | c.1888G>A | p.E630K | NDQRGRDGEGCSWMFQPMNNSKMR[p.E630K]K KRNLQPNSNAIPEGMREPSTDNPEE | PMNNSKMRK,MNNSKMRKK,KMRKKRNLQ,SKMRKKRNL, KMRKKRNLQP,MNNSKMRKKR,NSKMRKKRNL | MM |
| BEND3 | c.793del|G | p.D265fs | FQPPPEYQLTAAELKQIVDQSLSGG[p.D265fs]T WPAACWCSSSPSSSATWTSPGAAVPVALRPSASWSR CTCSSSATMWRSTTPR* | SLSGGTWPA,TWWRSTTPR,GAAVPVALR,CSSSATMWR,T SPGAAVPV,VPVALRPSA,RPSASWSRC,CTCSSSATM,DQSL SGGTW,VALRPSASW,WPAACWCSS,SLSGGTWPAA,ATW TSPGAAV,WTSPGAAVPV,ALRPSASWSR,ATMWRSTTPR, WSRCTCSSSA,SSATWTSPGA,SPGAAVPVAL,RPSASWSRC T,SSSPSSSATW,RCTCSSSATM,WPAACWCSSS | STAD |
| BEND5 | c.592C>T | p.R198C | LEDAVVPRALYEELLRNYQQQQEEM[p.R198C]CH LQQELERTRRQLVQQAKKLKEYGA | QQQEEMCHL,YQQQQEEMCH,QQQQEEMCHL,EEMCHLQQEL | CRC |
| BEST3 | c.1148C>T | p.P383L | SFLGSTVQMGKQMPKNEWKMEDIKI[p.P383L]LLP QPQFQCAKSDPGG* | KMEDIKILL,WKMEDIKIL,KILLPQPQF,LLPQPQFQCA,WK MEDIKILL,IKILLPQPQF | TGCT |
| BEST3 | c.1331_1332 insC | p.P444fs | SSMFLPRDDLSPARDLLDVPSRNPP[p.P444fs]QG LTHLEEILLPRKPHAALQHGRAVHHQGDQPDKH FTEPDPTVQCENFPHQNATGT* | HLEEILLPR,LPRRKPHAA,AALQHGRAV,FPHQNATGT,LQH GRAVHH,CENFPPIQNA,LLPRRKPHAA,HLEEILLPRR,HAAL QHGRAV,VPSRNPPGQL,LPRRKPHAAL,AALQHGRAVH,LQ HGRAVHHQ,HQGDQPDKHF,KHFTEPDPTV,CENFPHQNAT | STAD |
| BHLHE22 | c.185T>A | p.L62Q | STPPGMDLSLAPPPRERPASSSSSP[p.L62Q]QG CFEPADDPEGAGLLLLPPGGGGGGS | SPQGCFEPA,SSSSPQGCF,RPASSSSSPQ,SSSSPQGCF | ACC |
| BICD2 | c.485G>A | p.R162H | SENERLASVAQELKEINQNVEIQRG[p.R162H]HL RDDIKEYKFRERARLLQDYSELEEE | RGHLRDDIK,HLRDDIKEY,HLRDDIKEYK,NVEIQRGHLR,IQR GHLRDDI,GHLRDDIKEY | CRC |
| BIRC6 | c.1240G>C | p.V414L | SCFGSGSCPHFLAAATKRGKICIWD[p.V414L]LSK LMKVHLKFEINAYDPAIVQQLIL | KICIWDLSK,CIWDLSKLMK,LSKLMKVHLK,ICIWDLSKLM | TGCT |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| BIRC8 | c.673_674 GC>AT | p.A225M | VFIPCGHLVTCKQCAEAVDRCPMCS[p.A225M]M VIDFKQRVFMS* | MVIDFKQRV, MCSMVIDFK, VDRCPMCSM, PMCSMVIDF, S MVIDFKQRV, PMCSMVIDFK, CSMVIDFKQR, CPMCSMVID F, MVIDFKQRVF | TGCT |
| BLM | c.1980T>A | p.H660Q | ASRNLKHERFQSLSFPHTKEMMKIF[p.H660Q]Q KKFGLHNFRTNQLEAINAALLGEDC | KIFQKKFGL, EMMKIFQKK, KEMMKIFQK, MMKIFQKKF, FQ KKFGLHN, QKKFGLHNF, KIFQKKFGLH, EMMKIFQKKF, FQK KFGLHNF, KEMMKIFQKK, MMKIFQKKFG, MKIFQKKFGL | KIRC |
| BLVRA | c.131C>T | p.S44L | AGSVRMDLRNPHPSSAFLNLIGFV[p.S44L]LR RELGSIDGVQQISLEDALSSQEVE | FLNLIGFVL, VLRRELGSI, NLIGFVLRR, IGFVLRREL, FVLRREL GSI, AFLNLIGFVL, FLNLIGFVLR | CRC |
| BMP2K | c.1461C>G | p.H487Q | QQQQQQQQQQQQQQQQQQQQ[p.H487Q]QH HHHHHHLLQDAYMQQYQHATQQQQ | QQHHHHHHHL, QHHHHHHHL | TGCT |
| BMP3 | c.1030C>T | p.R344W | KPYKTLQAQAPEKSKNKKQRKGPH[p.R344W]WK SQTLQFDEQTLKKARRKQWIEPRN | HWKSQTLQF, KQRKGPHWK, GPHWKSQTL, KKQRKGPHW, KKQRKGPHWK, KORKGPHWKS, KKKQRKGPHW, PHWKSQTLQF | CRC |
| BMP6 | c.353A>T | p.Q118L | PRPLHGLQQPOPPALRQQEEQQQQ[p.Q118L]L LPRGEPPPGRLKSAPLFMLDLYNAL | QEEQQQQQL, QQEEQQQQQL, QEEQQQQQLL | KIRP |
| BMPER | c.1329_1340 del|GCGCA TCGCGCT | p.RIAL4 44del | KSVELVLGESRVSLQQHLTVRWNGS[p.RIAL444del|] PCRAPHFHIDLDGYLLKVTTKAGLEISWDGDSFVEVM | RWNGSPCRA, TVRWNGSPCR, NGSPCRAPHF, SPCRAPHFHI | KIRC |
| BMPER | c.722G>A | p.R241 Q | PPGQCCPKCLQRKVFDLPFGSCLF[p.R 241Q]QSDVYDNGSSFLYDNCTACTCR DSTV | SCLFQSDVY, GSCLFQSDVY, LPFGSCLFQS | UCEC |
| BMS1 | c.1364G>T | p.G455V | KAIFGDEDESGSDDEEDDEMSEDD[p.G455V]VLE NGSSDEEAEEENAEMTDQYMAV | DEMSEDDVL | LUAD |
| BMS1 | c.2634G>T | p.E878D | GEMQKQAQLNRAEFEDQDDEARVQY[p.E878D]DG FRPGMYVRIEINVPCEFVQNFDP | YDGFRPGMY, DGFRPGMYV, VQYDGFRPG, QYDGFRPGM Y, EARVQYDGFR, DGFRPGMYVR, VQYDGFRPGM, DEARVQYDGF | KIRP |
| BNC1 | c.2809T>A | p.Y937 N | MEKADQSLASLPSGLPITCHLCQKT[p.Y 937N]NSNKGTFRAHYKTVHLRQLHKC KVPG | KTNSNKGTF, TNSNKGTFR, HLCQKTNSNK, KTNSNKGTFR, QKTNSNKGTF | CLL |
| BNC2 | c.1534C>T | p.R512 W | NRHSANPNPRLHMPMLRNNRDKDLI [p.R512W]WATSGAATPVIASTKSNLAL TSPGRP | LIWATSGAA, DLIWATSGA, DLIWATSGAA, WATSGAATPV | CRC |
| BNC2 | c.1723A>C | p.S575 R | LQNPLPSQLVFSGLKTVQPVPPFYR[p.S 575R]RLLTPGEMVSPPTSLPTSPIIPTSG T | RLLTPGEMV, QPVPPFYRR, VPPFYRRLL, RRLLTPGEM, QPV PPFYRRL, YRRLLTPGEM | STAD |
| BPI | c.765G>T | p.M25 5I | IDSVAGINYGLVAPPATTAETLDVQ[p. M255I]IKGEFYSENHHNPPPFAPPVME FPAA | LDVQIKGEF, TTAETLDVQI, LDVQIKGEFY | BLCA |
| BRAF | c.1208de|C | p.P403f s | NIDDLIRDQGFRGDGGSTTGLSATP[p.P 403fs]LPHYLAH* | LSATPLPHY, SATPLPHYL, GLSATPLPH, TPLPHYLAH, GLSAT PLPHY, STTGLSATPL, LSATPLPHYL | STAD |
| BRAF | c.1397G>T | p.G466 V | LGRRDSSDDWEIPDGQITVGQRIGS[p. G466V]VSFGTVYKGKWHGDVAVKML NVTAPT | SVSFGTVYK, GSVSFGTVY, GQRIGSVSF, RIGSVSFGTV, GSVS FGTVYK, VSFGTVYKGK, IGSVSFGTVY, ITVGQRIGSV, VQQRI GSVSF | LUAD |
| BRAF | c.1406G>C | p.G469 A | RDSSDDWEIPDGQITVGQRIGSGSF[p. G469A]ATVYKGKWHGDVAVKMLNVT APTPQQ | GSGSFATVY, SGSFATVYK, SFATVYKGK, FATVYKGKW, RIGS GSFATV, GSGSFATVYK, GSFATVYKGK, SFATVYKGKW, GQR IGSGSFA, GSGSFATVY | MM, PRAD |
| BRAF | c.1406G>T | p.G469 V | RDSSDDWEIPDGQITVGQRIGSGSF[p. G469V|VTVYKGKWHGDVAVKMLNVT APTPQQ | SGSFVTVYK, SFVTVYKGK, GSGSFVTVY, RIGSGSFVTV, GSG SFVTVYK, GSFVTVYKGK, SFVTVYKGKW, GQRIGSGSFV, IGS GSFVTVY | LUAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| BRAF | c.1798_1799GT>AA | p.V600K | RDLKSNNIFLHEDLTVKIGDFGLAT[p.V600K]KKSRWSGSGHQFEQLSGSILWMAPEVIR | ATKKSRWSG,KKSRWSGSH,ATKKSRWSGS,DFGLATKKSR, FGLATKKSRW | SKCM |
| BRAF | c.1799T>A | p.V600E | RDLKSNNIFLHEDLTVKIGDFGLAT[p.V600E]KKSRWSGSHQFEQLSGSILWMAPEVI | DFGLATEKSR, FGLATEKSRW | CRC, GBM, LUAD, MM, SKCM, THCA |
| BRAF | c.1801A>G | p.K601E | DLKSNNIFLHEDLTVKIGDFGLATV[p.K601E]ESRWSGSHQFEQLSGSILWMAPEVIR | VESRWSGSH,DFGLATVESR,ESRWSGSHQF,FGLATVESRW | DLBCL, SKCM |
| BRAF | c.1803A>T | p.K601N | DLKSNNIFLHEDLTVKIGDFGLATV[p.K601N]NSRWSGSHQFEQLSGSILWMAPEVIR | GLATVNSRW,DFGLATVNSR,NSRWSGSHQF,FGLATVNSRW | CLL |
| BRD3 | c.70_71insC | p.P24fs | MSTATTVAPAGIPATPGPVNPPPP[p.P24fs]GGLQPQQARPQDQPAAVHAECGGEDAL,LETPVRLAL,GEDALETPV,LLPARGRNQI,PVRLAL GEDALETPVRLALLPARGRNQIEPAGLS* | RGRNQIEPA,ETPVRLALL,RPQDQPAAV,LPARGRNQI,AEC LPAR,RLALLPARGR,TPVRLALLPA,QQARPQDQPA,ALETP VRLAL,LETPVRLALL | STAD |
| BRD9 | c.988G>T | p.G330W | HAADEARDRINRFLPGGKMGYLKRN[p.G330W]WDGSLLYSVVNTAEPDADEEETHPVD | RNWDGSLLY,KMGYLKRNW,LKRNWDGSL,KRNWDGSLL, WDGSLLYSV,YLKRNWDGSL,KRNWDGSLLY,GKMGYLKRN W,LKRNWDGSLL,WDGSLLYSVV | LUAD |
| BRF1 | c.1405G>T | p.V469L | DGELDLSGIDDLEIDRYILNESEAR[p.V469L]LKAELWMRENAEYLREQREKEARIAK | ILNESEARL,RLKAELWMR,SEARLKAEL,ARLKAELWM,NES EARLKA,YILNESEARL,ILNESEARLK,SEARLKAELW | LUAD |
| BRK1 | c.208A>C | p.K70Q | SRLATLNEKLTALERRIEYIEARVT[p.K70Q]QGETLT* | ARVTQGETL,EARVTQGET | KIRC |
| BRMS1 | c.321del|G | p.G107fs | LSQLRLREEVGAERAPEYTEPLGG[p.G107fs]CSGASRFAFRWQGSTRASVWM* | WQGSTRASV,SGASRFAFR,ASRFAFRWQ,AFRWQGSTR,G GCSGASRF,CSGASRFAF,FAFRWQGST,FRWQGSTRA,GAS RFAFRW,CSGASRFAFR,FAFRWQGSTR,ASRFAFRWQG,RF AFRWQGST,AFRWQGSTRA,RWQGSTRASV,LGGCSGASR F,GCSGASRFAF,SGASRFAFRW,FRWQGSTRAS,WQGSTR ASVW | STAD |
| BRPF1 | c.196C>T | p.R66C | HLYHYDHDNPPPQQTPLRKHKKKG[p.R66C]CQSRPANKQSPSPSEVSQSPGREVMS | GCQSRPANK,KHKKKGCQSR,KGCQSRPANK | CRC |
| BRWD1 | c.3956A>G | p.K1319R | TSSGRRRVHDGKKSIRATNYVESNW[p.K1319R]RKQCKELVNLIFQCEDSEPFRQPVDL | NYVESNWRK,ATNYVESNWR,RKQCKELVNL | TGCT |
| BRWD3 | c.2359C>T | p.R787C | TVEKKKPSYTTQRNDYEPSCCGRSL[p.R787C]CRTQRKRQHTYQTRSNIEHNSQASCQ | RSLCRTQRK,CGRSLCRTQR,RSLCRTQRKR | CRC |
| BRWD3 | c.478C>A | p.H160N | VNYVKPPNVVNITSARQLTGCSRFG[p.H160N]NIFPSSAYQHIKMHKRILGHLSSVYC | CSRFGNIFP,RFGNIFPSS,GNIFPSSAY,GCSRFGNIF,SRFGNI FPS,CSRFGNIFPS,RFGNIFPSSA,FGNIFPSSAY,TGCSRFGNI F | LUAD |
| BST1 | c.107G>C | p.G36A | LLQLLIQLLLLLLLLAAGGARARWR[p.G36A]AEGTSAHLRDIFLGRCAEYRALLSPE | RARWRAEGT,RWRAEGTSA,WRAEGTSAH,RAEGTSAHL,G ARARWRAEG,RARWRAEGTS,RWRAEGTSAH,ARWRAEG TSA,WRAEGTSAHL | KIRP |
| BTBD11 | c.1352del|C | p.T451fs | LSDLVSRAMHHLQPLNAKHHCNGTP[p.T451fs]CTTSRGHCTGSPRPCTPFAISCTAHKWNGKTPTWSLPKSTSRWKGPSSCCRR* | CTAHKWNGK,KIPTWSLPK,FAISCTAHK,KWNGKTPTW,R GHCTGSPR,TSRWKGPSS,WSLPKSTSR,SPRPCTPFA,NGKT PTWSL,KHHGNGTPC,GSPRPCTPF,HKWNGKTPT,TPFAISC TA,SLPKSTSRWK,RWKGPSSCCR,TWSLPKSTSR,CTPFAISC | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| BTBD11 | c.1682C>T | p.A561V | LLPGVDCEPRQLRADDCFCASRKLD[p.A561V]VVAIEAKFKQDLGFRMLNCGRTDLVK | TA,SPRPCTPFAI,AKHHGNGTPC,TGSPRPCTPF,FAISCTAH KW,HKWNGKTPTW,WSLPKSTSRW,TPFAISCTAH KLDVVAIEA,VVAIEAKFK,ASRKLDVVA,KLDVVAIEAK,ASRK LDVVAI,DVVAIEAKFK,RKLDVVAIEA,LDVVAIEAKF | STAD |
| BTBD11 | c.794G>C | p.G265A | CMESLFRDIYSRVVASGVPRSCSGP[p.G265A]ASGSGSGPGPSSGPGAAPAADK EREA | VPRSCSGPA,VPRSCSGPAS | ACC |
| BTBD7 | c.1307C>T | p.S436L | HPYGSKWVHRQALHFLCEEFSQVMTL[p.S436L]LDVFYELSKDHLLTAIQSDYLQA SEQ | MTLDVFYEL,QVMTLDVFY,SQVMTLDVF,EEFSQVMTL,V MTLDVFYEL,TLDVFYELSK,FSQVMTLDVF,SQVMTLDVFY, MTLDVFYELS,CEEFSQVMTL | CRC |
| BTG1 | c.91C>T | p.L31F | TRAATMIGEIAAAVSFISKFLRTKG[p.L31F]FTSERQLQTFSQSLQELLAEHYKHH W | RTKGFTSER,FLRTKGFTS,SKFLRTKGF,KGFTSERQL,FLRTK GFTSE,FTSERQLQTF,ISKFLRTKGF | DLBCL |
| BTLA | c.256C>A | p.Q86K | KYCANRPHVTWCKLNGTTCVKLEDR[p.Q86K]KTSWKEEKNISFFILHFEPVLPND NG | KLEDRKTSW,KLEDRKTSWK,TTCVKLEDRK,VKLEDRKTSW | CLL |
| BTN2A2 | c.43C>T | p.L15F | MEPAAALHFSLLPAS[p.L15F]FLLLLLLLLLSLCALVSAQFTVVGPA | FSLPASFLL,SLPASFLLL,SFLLLLLLL,LPASFLLLL, LHFSLPASF,ASFLLLLLL,FSLPASFLLL,SLPASFLLLL, HFSLPASFLL,SFLLLLLLLL,ALHFSLPASF,LPASFLLLLL, LHFSLPASFL,ASFLLLLLLL | TGCT |
| BTN3A2 | c.457G>A | p.E153K | FQDGDFYEKALVELKVAALGSNLHV[p.E153K]KVKGYEDGGIHLECRSTGWYPQ PQIQ | ALGSNLHVK,GSNLHVVK,NLHVKVKGY,ALGSNLHVKV,A ALGSNLHVK | UCEC |
| BTRC | c.1248T>G | p.I416M | FNNGMMVTCSKDRSIAVWDMASPTD[p.I416M]MTLRRVLVGHRAAVNVVDF DDKYIVS | MASPTDMTL,WDMASPTDM,MASPTDMTLR,MTLRRVLV GH,DMASPTDMTL,SPTDMTLRRV | KIRC |
| BTRC | c.778G>T | p.G260W | TDSLWRGLAERRGWGQYLFKNKPPD[p.G260W]WNAPPNSFYRALYPKIIQDIE TIESN | KNKPPDWNA,WNAPPNSFY,YLFKNKPPDW,DWNAPPNS FY,WNAPPNSFYR | LUAD |
| BUB1B | c.2988C>A | p.F996L | VFWDGSFWKLSQNISELKDGELWNK[p.F996L]LFVRILNANDEATVSVLGELAAE MNG | KLFVRILNA,LWNKLFVRI,ELWNKLFVR,GELWNKLFV | CRC |
| BZRAP1 | c.4248_4249 insA | p.P1416fs | CLEDMPGLVGGSSRRRGGGSPEKPP[p.P1416fs]KPQAASRSPRTLQPTSQQQW APGLWTTGPHTGEGWPPRN* | SQQQWAPGL,HTGEGWPPR,QQQWAPGLW,QWAPGLW TT,ASRSPRTLQ,AASRSPRTL,LQPTSQQQW,QQWAPGLW T,SQQQWAPGLW,ASRSPRTLQP,TLQPTSQQQW,QQWA PGLWTT | STAD |
| BZRAP1 | c.4879G>A | p.V1627I | VLRPSTAELVPARSPSETLAYQHLP[p.V1627I]IRIFVALFDYDPVSMSPNPDAGE EEL | TLAYQHLPI,HLPIRIFVA,AYQHLPIR,LAYQHLPIR,LPIRIFVA L,YQHLPIRIF,YQHLPIRIFV,HLPIRIFVAL,AYQHLPIRIF, IRIFVALFDY,TLAYQHLPIR,ETLAYQHLPI,LPIRIFVALF, LAVQHLPIRI | CRC |
| C10orf95 | c.253G>T | p.A85S | GRRRRSCSPAPTWPPLCCYPQSRPT[p.A85S]SSAAGPGACMRASGRPHGNTTA STAP | QSRPTSSAA,YPQSRPTSS,YPQSRPTSSA,SSAAGPGACM | ACC |
| C11orf30 | c.3331C>T | p.R1111C | KQTASQVEQPIITQGSSVTKITFEG[p.R1111C]CQPPTVTKITGGSSVPKLTSPVTSIS | FEGCQPPTV | CRC |
| C11orf68 | c.403G>T | p.V135L | PGSPNSEPVGWIAVYQGGYSPNSGD[p.V135L]LQGLQAAWEALQTSGRPITPG TLRQL | GDLQGLQAA,SPNSGDLQGL,GDLQGLQAAW | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| C11orf9 | c.782_783 insC | p.S261fs | QLLQQHGAELPTHPSKKRKHSESPP[p.S261fs]QHPQCPDAEWNDQTGAWDRD SPASAPHSSPIATLASPGSALPGWFLA SQHCPCPDTALAPARCPLPRPPAGQ* | SALPGPWFL,ALPGPWFLA,FLASQHCPC,ALAPARCPL,TLA SPGSAL,ASAPHSSPI,ATLASPGSA,HSSPIATLA,APHSSPIAT, AEWNDQTGA,RDSPASAPH,GSALPGPWF,HPQCPDAEW, LPGPWFLAS,CPDTALAPA,ASAPHSSPIA,ATLASPGSAL,SA LPGPWFLA,LAPARCPLPR,APHSSPIATL,TALAPARCPL,RK HSESPPQH,AEWNDQTGAW,SQHCPCPDTA,SPIATLASPG, SPGSALPGPW | STAD |
| C12orf32 | c.179A>T | p.D60V | LPITHTRQVPSKPIDHSTITSWVSP[p.D6 0V]VFDTAAGSLFPAYQKHQNRAHSS RK | TITSWVSPV,WVSPVFDTA,ITSWVSPVF,SPVFDTAAG,STIT SWVSPV,WVSPVFDTAA,VFDTAAGSLF,TITSWVSPVF | TGCT |
| C12orf4 | c.1004G>A | p.R335Q | KLHRLQTALSLYSTSLCGLVLLVDN[p.R 35Q]QINSYSGIKRDFATVCQECTDFHF PR | LVDNQINSY,NQINSYSGI,QINSYSGIK,GLVLLVDNQI,LLVD NQINSY,QINSYSGIKR | UCEC |
| C12orf43 | c.82G>C | p.E28Q | APSGTVSDSESSNSSDAEELERCR[p.E 28Q]QAAMPAWGLEQRPHVAGKPRA GAANS | RCRQAAMPA,QAAMPAWGL,LERCRQAAM,CRQAAMPA W,RQAAMPAWG,EELERCRQA,RQAAMPAWGL,ELERCR QAAM,RCRQAAMPAW,EELERCRQA,AEELERCRQA | CESC |
| C12orf65 | c.428A>C | p.K143T | VFYNGENSPVHKEKREAAKKKQERK[p.- K143T]TRAKETLEKKKLLKELWESSKKVH* | KQERKTRAK,KITRAKETL,RKTRAKETL,KITRAKETLEK,ERKT RAKETL | TGCT |
| C13orf33 | c.200de|G | p.R67fs | QPGAFQLSGDQLVVARPGEPAAARG[p.R67fs]ASTSSVTASCASTGSSTASAATS RGMWN* | STASAATSR,STGSSTASA,ASAATSRGM,SAATSRGMW,GE PAAARGA,SSTASAATSR,AARGASTSSV,STSSVTASCA,EPA AARGAST,RGASTSSVTA,TASAATSRGM,ASAATSRGMW | STAD |
| C14orf101 | c.883G>A | p.E295K | FSLAKSEIGSSMSEILLSQVTNMRT[p.E2 95K]KLSFNIQALAVCANICLATKDRQNPS | KLSFNIQAL,RTKLSFNIQ,TNMRTKLSF,KLSFNIQALA,NMR TKLSFNI,LSQVTNMRTK,RTKLSFNIQA,SQVTNMRTKL,VT NMRTKLSF,KLSFNIQAL | CRC |
| C14orf102 | c.268de|A | p.R90fs | SSDESDTNKKLKQTSRKKKKKKK[p.R 90fs]GSISIIRKQRGSMGRRVAAGLRQT PILKRTNLPEALEAVKRNLRNRIKEIMLQ LILDIALFGLRTFRL* | NL,PEALEAV,IMLQLILDI,MLQLILDIA,ILDIALFGL,RIKEIML QL,GLRQTPILK,ALFGLRTFR,KGSISIIRK,IALFGLRTF,LFGLR TPRL,IIRKQRGSM,KQRGSMGRR,RGSMGRRVA,GSMGRR VAA,MGRRVAAGL,AVKRNLRNR,KRNLRNRIK,RNRIKEIML, SISIIRKQR,TPILKRTNL,SMGRRVAAG,NLRNRIKEI,QLILDI ALF,KKKKGSISI,KKKKGSISII,KRTNLPEAL,LRNRIKEIM,KEIM LQLIL,LQLILDIAL,SMGRRVAAGL,IMLQLILDIA,MLQLILDIA L,LILDIALFGL,ALFGLRTFRL,ILKRTNLPEA,RIKEIMLQLI,AG LRQTPILK,IALFGLRTFR,KQRGSMGRRV,RGSMGRRVAA, MGRRVAAGLR,GLRQTPILKR,RTNLPEALEA,AVKRNLRNRI, EAVKRNLRNR,EIMLQLILDI,SIIRKQRGSM,NLRNRIKEIM,L QLILDIALF,DIALFGLRTF,KKKKGSISII,RRVAAGLRQT,VAAG LRQTPI,LKRTNLPEAL,IKEIMLQLIL | STAD |
| C14orf102 | c.343G>A | p.D115N | RKHQHHKKTKRKHGPSSSSRSETDT[p.- D115N]NSEKDKPSRGVGGSKKESEEPN QGNN | RSETDTNSEK | CRC |
| C14orf105 | c.299G>T | p.R100I | ASRDMYFDIPLEHRETSIIKRHPPQ[p.R1 00I]ILQKLEPIDLPRVITSGRLLSQREAR GECVPGFTVPNLLPKWAPDHCSEVE[p.- | IIKRHPPQI,IKRHPPQIL,SIIKRHPPQI,IIKRHPPQIL,KRHPPQ ILQK | CRC |
| C14orf118 | c.836G>T | p.R279I | R279I]IMDSGLDKFSDSTFLLPSRPAQR GYH | EIMDSGLDK,IMDSGLDKF,EIMDSGLDKF,SEVEIMDSGL | UCEC |
| C14orf126 | c.16C>T | p.R6W | MAEGS[p.R6W]WIPQARALLQQCLHA RLQIRPADGDV | EGSWIPQAR,SWIPQARAL,QEGSWIPQA,SWIPQARALL,G SWIPARAL | KIRP |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| C14orf166B | c.690C>A | p.F230L | DSAALLCQALSTNYQIKKLDLSHNQ[p.F230L]LSDVGGEHLGQMLAINVGLTSLDLSW | KLDLSHNQL,QLSDVGGEHL,KKLDLSHNQL | UCEC |
| C14orf177 | c.269G>T | p.G90V | CCGECSTCFCTEEKSECQRHEETSP[p.G90V]VSCNHQIMSASTISAFCATPRFKQLF | SPVSCNHQI,CQRHEETSPV,SPVSCNHQIM | CLL |
| C14orf43 | c.939del C | p.P313fs | GLQPAGPLGQSHLAHHSMAPYPFPP[p.P313fs]TQI* | PYPFPPTQI,MAPYPFPPT,SMAPYPFPT,APYPFPPTQI | STAD |
| C15orf2 | c.1462G>A | p.V488I | LALPADIVPILGDQSNEKGGSYNSV[p.V488I]IGAAPLTSDPPTPPSSTPSFKPPVTR | NSVIGAAPL,KGGSYNSVI,GSYNSVIGAA,YNSVIGAAPL | CRC |
| C15orf2 | c.2257G>T | p.V753F | PGSGNTQPSGNTASVQGSTSLPAQS[p.V753F]FRAPATASNHPLNPGATPQKFGAPD | SLPAQSFRA,TSLPAQSFR,QSFRAPATA,LPAQSFRAP,STSLPAQSF,AQSFRAPAT,STSLPAQSFR,SFRAPATASN,LPAQSFRAPA,GSTSLPAQSF,AQSFRAPATA | LUAD |
| C15orf2 | c.2716G>T | p.G906W | RPPTTTSSHPLNTGSISHSTLGATD[p.G906W]WQQKSDSSFILGNPATPAPVIGLTSP | WQQKSDSSF,LGATDWQQK,WQQKSDSSFI | LUAD |
| C15orf23 | c.71C>T | p.S24F | MAAPEAPPLDRVFRITWLSTECD[p.S24F]FHPLPPSYRKFLFETQAADLAGGTTV | TWLSTECDF,DFHPLPPSY,STECDFHPL,DFHPLPPSYR,LSTECDFHPL,CDFHPLPPSY | SKCM |
| C15orf33 | c.1018G>A | p.D340N | GSKKAPAKSVKERIADSQEHLSTSI[p.D340N]NFNIIKILNNPRAYTLPISKEESRLS | SINFNIIKI,TSINFNIIK,ISTSINFNI,STSINFNII,EHIST SINF,INFNIIKIL,HISTSINFNI,STSINFNIIK,TSINFNIIKI,QEHISTSINF,ISTSINFNII | CRC |
| C15orf52 | c.294del G | p.G98fs | RKKNQALLRRYQEIQEDRRQAEQGG[p.G98fs]WL* | RQAEQGGWL | STAD |
| C16orf3 | c.193G>A | p.G65S | RACPVACPVGCPIACPVSCPVACPV[p.G65S]SCPVGSMATAPQGLSPQEWEADRETG | VACPVSCPV,PVACPVSCPV,CPVSCPVGSM | CESC |
| C16orf55 | c.353A>C | p.D118A | RASNETLVSCSSSGSDQQRTIREPE[p.D118A]AWGPYRRHRNPSTADAYNSHLKE* | REPEAWGPY,RTIREPEAW,EAWGPYRHR,IREPEAWGPY | KIRC |
| C16orf62 | c.730C>A | p.L244I | SDTSVIQFYPSKFVLITDILDTFGK[p.L244I]IVYERIFSMCVDSRSVLPDHFSPENA | IVYERIFSM,TFGKIVYER,DILDTFGKI,LDTFGKIVY,GKIVYERIF,ILDTFGKIVY,TFGKIVYERI,KIVYERIFSM,DTFGKIVYER,FGKIVYERIF | TGCT |
| C16orf74 | c.61_63delAGC | p.S21del | MGLKMSCLKGFQMCVSSSSS[p.S21del]HDEAPVLNDKHLDVPDIIITPPTTGMM | MCVSSSSSH,QMCVSSSSSH | PRAD |
| C16orf87 | c.452G>T | p.R151I | ANLSDEKAFVFSVALAEINRKIINQ[p.R151I]LLIL* | KIINQILIL,NRKIINQIL,RKIINQILI,EINRKIINQI,RKIINQILIL | CRC |
| C17orf96 | c.187C>G | p.L63V | LCLRALAFCALAKPRASSLGPGPGE[p.L63V]VAARSPVLRGPQAPLRPGGWAPDGLK | SLGPGPGEV,VAARSPVLR,EVAARSPVL,GEVAARSPV,EVAARSPVL,GEVAARSPVL | ACC |
| C19orf10 | c.34G>C | p.G12R | MAAPSGGWNGV[p.G12R]RASLWAALLLGAVALRPAEAVSEPTT | GVRASLWAA,RASLWAALL,VRASLWAAL,GVRASLWAAL,GWNGVRASLW,RASLWAALLL,GGWNGVRASL,VRASLWAALL | ACC |
| C19orf21 | c.784C>T | p.R262C | PHLANGHVVPIKPQVKGVVREENKV[p.R262C]CAVPTWASVQVVDDPGSLASVESPGTYDQELLGPSDKSQAALQKAGEVVPP[p. | CAVPTWASV,RENKVCAV,NKVCAVPTW,EENKVCAVPT | STAD |
| C19orf70 | c.150del C | p.P50fs | P50fs]PCTSSASTCVSRQACRYPSSQPLQRFTFPSVTPGMQAS* | CVSRQACRY,LQRFTFPSV,SSASTCVS,SQPLQRFTF,TFPPSVTPGM,RQACRYPSS,CTSSASTCV,FTFPSVTPG,VPPCTSSA,CRYPSSQPL,GEVVPPCT,PLQRFTFPSV,FTFPSVTPGM,TSSASTCVSR,STCVSRQACR,SSQPLQRFTF,YPSSQPLQRF,FPSVTPGMQA,RQACRYPSSQ,LQRFTFPSVT | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| C1QBP | c.674C>T | p.T225I | ESDIFSIREVSFQSTGESEWKDTNV[p.T225I]ILNTDSLDWALYDHLMDFLADRGVDN | NYILNTDSL, SEWKDTNYI, ILNTDSLDW, ILNTDSLDWA, SEWKDTNYI, YILNTDSLDW | TGCT |
| C1QTNF5 | c.582_583 insG | p.G194fs | CVWHIQVATDHAIQLKIEALSIESV[p.G194fs]GLLPF* | ALSIESVGL, IESVGLLPF, LSIESVGLL, ALSIESVGLL, EALSIESVGL, SIESVGLLPF | STAD |
| C1QTNF5 | c.924de|C | p.P308fs | NCADGSETNCSAKFSGSVEQSHPP[p.P308fs]PRLLAP* | QSHPPRLLA, VEQSHPPRL | STAD |
| C1R | c.647de|C | p.P216fs | AECSSELYTEASGYISSLEYPRSYP[p.P216fs]LTCAATTASGWSGASPCTSSSWSLLILMTTSKYTAPMTSYRSMPTGRTLASSVGSKGPPTSTPAAMLWICCSSOMSRGTAGAGSCATPPRSSSAPSPRP* | TSSSWSLLI, ILMTTSKYT, SMPTGRTLA, QMSRGTAGA, LLILMTTSK, TLASSVGSK, YTAPMTSYR, RSSSAPSPR, RSYPLTCAA, TTSKYTAPM, MTSYRSMPT, SYRSMPTGR, RSMPTGRTL, RTLASSVGS, SSQMSRGTA, AGSCATPPR, ATPPRSSSA, LILMTTSKY, KYTAPMTSY, TTASGWSGA, CTSSSWSLL, STPAAMLWI, YPRSYPLTC, APMTSYRSM, MPTGRTLAS, LEYPRSYPL, CAATTASGW, SSSWSLLIL, SSWSLLILM, LMTTSKYTA, SKYTAPMTS, LWICCSSQM, SQMSRGTAG, YPLTCAATT, PPTSTPAAM, TSTPAAMLW, TPAAMLWIC, CTSSSWSLLI, SLEYPRSYP, L, ILMTTSKYTA, MLWICCSSOM, SQMSRGTAGA, SLLILMTT SK, RTLASSVGSK, TSYRSMPTGR, RSYPLTCAAT, MTTSKYTAPM, KYTAPMTSYR, RSMPTGRTLA, LLILMTTSKY, SKYTAPM TSY, WICCSSQMSR, TTASGWSGAS, YTAPMTSYRS, YPRSYPLTCA, YPLTCAATTA, SPCTSSSWSL, MPTGRTLASS, GPPTST PAAM, LEYPRSYPLT, GASPCTSSSW, TSSSWSLLIL, SSSWSLLILM, YRSMPTGRTL, SKGPPTSTPA | STAD |
| C1RL | c.1051de|C | p.L351fs | PDYRQNESHNFSGDIALLELQHSIP[p.L351fs]WAPTSSRSVCPIMRPSTAAACWATSVGLAWRWAG* | AAACWATSV, ELQHSIPWA, IMRPSTAAA, ATSVGLAWR, SS RSVCPIM, IPWAPTSSR, STAAACWAT, APTSSRSVC, CPIMR PSTA, LELQHSIPW, LQHSIPWAP, WATSVGLAW, RPSTAAA CW, TSVGLAWRW, TAAACWATSV, CWATSVGLAW, SSRSV CPIMR, IMRPSTAAAC, SIPWAPTSSR, WATSVGLAWR, STA AACWATS, CPIMRPSTAA, RPSTAAACWA, LLELQHSIPW, LE LQHSIPWA, LQHSIPWAPT, TSSRSVCPIM, AACWATSVGL, GEWELCRAA, CRAAPGPAY, WELCRAAPG, LCRAAPGPAY, WELCRAAPGP, GEWELCRAAP | CRC |
| C1orf106 | c.1612C>T | p.R538C | PPGYFPAGRYVVAESPLPGEWEL[p.R538C]CRAAPGPAYEEEGTPLRYQRLVPSRS | LEPLGSSTL, ALEPLGSSTL | ACC |
| C1orf167 | c.367A>G | p.S123G | WWHLRALGPDATSSCTKTPSALEPL[p.S123G]GSSTLQDSLEKVPRAPTLPDTLQGSL | LEPLGSSTL, ALEPLGSSTL | TGCT |
| C1orf173 | c.2063C>A | p.S688Y | ESFENVLKEGTEKGTQEIAEGLSEK[p.S688Y]YGKHVSAEEKEKDKSKLWEESTAQVK | IAEGLSEKY, GLSEKYGKHV, YGKHVSAEEK, EIAEGLSEKY, SEKYGKHVSA | LUAD |
| C1orf173 | c.4360G>A | p.G1454S | AGVGTPGALERKTSGLGQEQEGSE[p.G1454S]SQEFAATGSGDGRQETGAAEKFRLGLS | EERGSESQEA, QEEGSESQEA, EEGSESQEAA | LUAD |
| C1orf74 | c.760G>A | p.D254N | PGLRDILNTWEKDLRTRFRTQNDFA[p.D254N]NLSISSEIVTLPAVAL* | NLSISSEIV, RTQNDFANL, FANLSISSEI, RFRTQNDFAN, FRT QNDFANL, TQNDFANLSI | LUSC |
| C1orf87 | c.1622G>T | p.R541L | LSPQKIDQALRFRSGENMLLEPAL[p.R541L]LYLKEL* | MLLEPALLY, NMLLEPALL, LLEPALLYL, MLLEPALLYL, LLEPA LLYLK, NMLLEPALLY, EPALLYLKEL | LUAD |
| C20orf132 | c.1146A>C | p.E382D | LKLPLRFQRLGHLVALMALLCGDPQ[p.E382D]DKVAEEAAEGIHSLLHITLRLKYITH | LLCGDPQDKV | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| C20orf160 | c.136delC | p.P46fs | KAGRRAACRSSVSRRPLHSMPLYPP[p.P46fs]TTSTPRFCCVTTWRKRSSSWATLPG* | HSMPLYPPT,SSTPRFCCV,RFCCVTTWR,RKRSSSWAT,KRSSSWATL,MPLYPPTTS,RFCCVTTWRK,TWRKRSSSWA,RKRSSSWATL,RSSSWATLPG,TSSTPRFCCV,MPLYPPTSS,HSMPLYPPTT,TTWRKRSSSW,TPRFCCVTTW | STAD |
| C20orf26 | c.3263G>A | p.R1088Q | LEVQMAQPNYGLELVTGSAKNGTYF[p.R1088Q]QIHINKYKMVETITCLSREPFPASNY | TYFQIHINK,FQIHINKYK,YFQIHINKY,AKNGTYFQI,GTYFQIHINK,TYFQIHINKY,SAKNGTYFQI,YFQIHINKYK,FQIHINKYKM,AKNGTYFQIH | CRC |
| C22orf26 | c.83C>T | p.P28L | ASATAAWHCPPLCLPLPASAPTSP[p.P28L]LNPATRPAPGPRRARCPQSAHPAPT | APTSPLNPA,LPASAPTSPL,SPLNPATRPA | ACC |
| C22orf40 | c.96_97insC | p.P32fs | RPLGVFECELCTLTAPYSYVGQKPP[p.P32fs]QHPVDGPPGGKLCHEGSLHLRQGQIPGPRLVLQFVQQAGVCGPGMQFILLQEILPLCPGEHQCFSSGNSARLGEKESSIKEDPQPARFSDVSATGARSSGGTLHRAPGPACARDAAELGAAMPGLVSGPLGAALQPRGAGVQLGAATGPGSCSKRVVQRMPDKTQPGTRPGPPTCPSGPRPE* | LQFVQQAGV,MQPILLQEI,LLQEILPPL,RLGEKESSI,ALQPRGAGV,GQIPGPRLV,TLHRAPGPA,GLVSGPLGA,LVSGPLGAA,ATGPSCSK,RSSGGTLHR,VVQRQMPDK,GQKPPQHPV,HLRQGQIPG,GNSARLGEK,KTQPGTRPG,GTRPGPPTC,CFSSGNSAR,FSSGNSARL,DAAELGAAM,GPRLVLQFV,GARSSGGTL,GPACARDAA,MPGLVSGPL,QPRGAGVQL,SLHLRQGQI,GKLCHEGSL,LCHEGSLHL,GVCGPGMQF,GEHQCFSSG,KEDPQPARF,ARFSDVSAT,LHRAPGPAC,VSGPLGAAL,SKRVVQRQM,RQMPDKTQP,AELGAAMPG,KLCHEGSLHL,VLQFVQQAGV,GMQFILLQEI,MQFILLQEIL,ILLQEILPPL,LLQEILPPLC,AMPGLVSGPL,RLVLQFVQQA,ELGAAMPGLV,GLVSGPLGAA,LVSGPLGAAL,RLGEKESSIK,RVVQRQMPDK,AATGPGSCSK,SGNSARLGEK,SIKEDPQPAR,RSSGGTLHRA,GTLHRAPGPA,IPGPRLVLQF,QQAGVCGPGM,RQGQIPGPRL,GQIPGPRLVL,LQFVQQAGVC,AGVCGPGMQF,HQCFSSGNSA,IKEDPQPARF,RDAAELGAAM,AELGAAMPGL,LQPRGAGVQL,VQLGAATGPG,CSKRVVQRQM,RQMPDKTQPG,GEHQCFSSGN | CRC |
| C22orf43 | c.55A>G | p.K19E | MGNILTCCINSHCGWPRG[p.K19E]EDAPCYESDTDIYETVAATSESTTV | WPRGEDAPC,GEDAPCYES,WPRGEDAPCY | TGCT |
| C22orf44 | c.1368T>A | p.N456K | IMLEEEPSITSGESQTTYSTFSAPL[p.N456K]KANRKKLIESLSPDFCHQNKGLLLT | YSTFSAPLK,STFSAPLKK,PLKKANRKK,SAPLKKANR,TYSTFSAPLK,YSTFSAPLKK,STFSAPLKKA,SAPLKKANRK,FSAPLKKANR | CLL |
| C2orf53 | c.815C>A | p.P272H | VEYPICLVCLRPRSPSCPLPRYRTG[p.P272H]RLLAPPQLLPCVQQESGPLRIGIGGRPQPPTLDPTSTSYESQLGQNSSSS | RYRTGHRLL,RTGHRLLAF,HRLLAPPQL,RYRTGHRLLA,LPRYRTGHRL,YRTGHRLLAP,GHRLLAPPQL,HRLLAPPQLL | LUAD |
| C2orf71 | c.3675_3676insAGC | p.1225_1226insS | 225_1226inss]SEESPKKDTEPCSSPCSPELQGGTRRAS | SSSEESPK,SSSSEESPKK,SQLGQNSSSS | KIRC |
| C2orf81 | c.943A>C | p.T315P | LELRSEGVPCIASGVLVSYPSVGGA[p.T315P]PRPSASCQQQRAGHSDVRLSAHHHRM | YPSVGGAPR,SYPSVGGAPR | ACC |
| C3 | c.2670delC | p.P890fs | LLHNPAFCSLATTKRRHQQTVTIPP[p.P890fs]SPRCPFHMSSCR* | TVTIPPSPR,IPPSPRCPF,QTVTIPPSPR,SPRCPFHMSS,HQQTVTIPPS | STAD |
| C3orf15 | c.1655G>A | p.R552Q | RTCHALQEDEKLVKKAEKQVTLALQ[p.R552Q]QQRNLHEHKVSLVENHLAGLEGRALA | VTLALQQQR,QQRNLHEHK,KQVTLALQQ,QQQRNLHEH,QVTLALQQQR,KQVTLALQQQ,LQQQRNLHEH,QQRNLHEHKV | CLL |
| C3orf20 | c.2219G>T | p.R740L | IISSQNYTSTGQLQWLLNTLYNHQQ[p.R740L]LGRGSPCIQCRYDSYRLLQYDLDSPL | LYNHQQLGR,QQLGRGSPC,TLYNHQQLGR,HQQLGRGSPC,QQLGRGSPCI | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| C3orf23 | c.649C>T | p.R217C | SWLDNNGKSAVKKLKNSLPLRKELD[p.R217C]CLKDELSHQLQLSDIRWQRSWGIAHR | CLKDELSHQL, KELDCLKDEL, LPLRKELDCL | UCEC |
| C3orf30 | c.681C>A | p.D227E | AERRTSEQITHRLSKLSERRPSVQI[p.D227E]ESGSSVPSDQSPSVQIDSGSSVPSDQ | VQIESGSSV, IESGSSVPS, SVQIESGSSV, VQIESGSSVP | LUSC |
| C3orf39 | c.997C>T | p.R333W | LALAQFPQMKTVTVSLEDHTFADVV[p.R333W]WLVSNASMLVSMHGAQLVTTLFLPRG | TFADVVWLV, WLVSNASML, HTFADVVWL, DVVWLVSNA, VWLVSNASM, HTFADVVWLV, WLVSNASMLV, VWLVSNASML, VVWLVSNASM | CRC |
| C3orf62 | c.554G>A | p.R185Q | SNMPLNNSSQEVTKDLLDMIDHTSI[p.R185Q]QTIEELAGKIEFENELNHMCGHCQDS | QTIEELQGK, IDHTSIQTI, TSIQTIEEL, MIDHTSIQTI, HTSIQTIEEL, QTIEELQGKI | UCEC |
| C3orf70 | c.17C>T | p.S6L | MSAAA[p.S6L]LPASERGWKSEKLDEAQALARSCAAAR | AAALPASER, SAAALPASER, AALPASERGW | BLCA, CESC |
| C4orf21 | c.2398G>C | p.E800Q | SKDTEAHISEPEDLGKIRSPPPDHV[p.E800Q]QVETAREGKQYWNPRNSSELSGLVNT | VQVETAREG | CESC |
| C5orf30 | c.10G>A | p.D4N | MEV[p.D4N]NINGESRSTLTLPFPGAEANSPGKA | EVNINGESR | CRC |
| C5orf4 | c.341G>A | p.R114Q | LFFWSFNGLLLVVDTTGKPNFISRY[p.R114Q]QIQVGKNEPVDPVKLRQSIRTVLFNQ | FISRYQIQV, ISRYQIQVGK, KPNFISRYQI, YQIQVGKNEP | CRC |
| C5orf65 | c.734A>G | p.Q245R | PRAAGAPRPRLLLRTGSLDESLGPL[p.Q245R]RAAAGFVQTALARKLSPEAPAPSSAT | SLGPLRAAA, GPLRAAAGF, RAAAGFVQTA, ESLGPLRAAA, D ESLGPLRAA | ACC |
| C6orf170 | c.2171A>C | p.K724T | RTGAINECVTFIFNRYAKKLQVSRH[p.K724T]TKFGYGVLVTRVASTAAGGIALKKSG | KLQVSRHTK, VSRHTKFGY, HTKFGYGVL, LQVSRHTKF, RHTKFGYGV, TKFGYGVLV, KLQVSRHTKF, KKLQVSRHTK, VSRHTKFGYG, HTKFGYGVLV, QVSRHTKFGY, RHTKFGYGVL, TKFGYGVLVT | CRC |
| C6orf89 | c.172_173insC | p.P58fs | GMSEKAIEKEIRQLLEKNEPQRPPP[p.P58fs]AVSSPYSCV* | AVSSPYSCV, EPQRPPPAV, PPPAVSSPY, RPPPAVSSPY | STAD |
| C7 | c.2059C>A | p.R687S | GMSLEGPSAFLCGSSLKWSPEMKNA[p.R687S]SCVQKENPLTQAVPKCQRWEKLQNSR | EMKNASCVQK, SPEMKNASCV | LUAD |
| C7orf49 | c.389delG | p.G130fs | GSSEEEDSGHKQALAPGLSPSQRPG[p.G130fs]VPALPVAGALRRRRKRMC* | SORPGVPAL, AGALRRRRK, GALRRRRKR, ALRRRRKRM, RP GVPALPV, GLSPSQRPGV, VAGALRRRRK, SPSQRPGVPA, RP GVPALPVA, VPALPVAGAL, ALRRRRKRMC, SQRPGVPALP | STAD |
| C7orf50 | c.535delC | p.L179fs | RARELITVQKAEALMRELEDEGSDPP[p.L179fs]CRGGPSASDRCCSCSPSGFSAGRGRCPVQGCLRPHRVQLLRRWGPGSPAGQRLSKGFQLLRWWGPGSPAPEPRKGPFPPDPDPWPVTAVTVMAGSVPSAQSVDALESPGPLALEGPSSPRNLLWREMSIFLPGIF* | RLSKGFQLL, VWAGSVPSA, NLLWREMSI, CLRPHRVQL, EM SIFLPGI, LSKGFQLLR, MSIFLPGIF, RPFHVQLLR, RVQLLRR WG, RWWGPGSPA, LWREMSIFL, TVMAGSVPS, APEPRKG PF, WPVTAVTVM, GPSSPRNLL, LLWREMSIF, RRWGPGSPA, QRLSKGFQL, SKGFQLLRW, KGFQLLRWW, LESPGPLAL, RE MSIFLPG, DPPWPVTAV, TVMAGSVPSA, LLWREMSIFL, FSA GRGRCPV, CLRPHRVQLL, RLSKGFQLLR, REMSIFLPGI, RGR CPVQGCL, RPHRVQLLR, GSPAGQRLSK, CSPSGFSAGR, LA LEGPSSPR, FPPPDPPWPV, TAVTVMAGSV, GPGSPAGQRL, VPSAQSVDAL, SPRNLLWREM, EMSIFLPGIF, RCCSCSPSGF, LRRWGPGSPA, RRWGPGSPAG, GQRLSKGFQL, QRLSKGFQ LL, LSKGFQLLRW, FQLLRWWGPG, LRWWGPGSPA, ALESP GPLAL, LEGPSSPRNL, RNLLWREMSI, NLLWREMSIF, CPVQ | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| C7orf57 | c.88G>A | p.E30K | SKELQGATHRYAPCDWYHVPVKRS[p.E30K]KKAVDAPPASQIPGLSNLGDSHSENL | GCLRPH,WPVTAVTVMA,PPWPVTAVTV,GFPPPDDPW,GPSSPRNLLW HVPVKRSKK,KKAVDAPPA,YYHVPVKRSK,RSKKAVDAPP,V PVKRSKKAV | HNSC |
| C7orf58 | c.418G>T | p.G140W | HQHILTQHGYTVVIAEERLNAGLGP[p.G140W]WLLEQGDLGSWDLLICLSSKK AEGTP | RLNAGLGPW,RLNAGLGPWL | LUAD |
| C7orf58 | c.713G>T | p.R238L | PSVCLDQGMQLKPSTSSHLLKTVKP[p.R238L]LVWKPGDWSREQLNETTVLAP HETIF | LLKTVKPLV,KTVKPLVWK,HLLKTVKPL,LKTVKPLVW,HLLK TVKPLV,LVWKPGDWSR,SHLLKTVKPL,LLKTVKPLVW | LUAD |
| C7orf63 | c.28G>A | p.A10T | MWTEEAGAT[p.A10T]TEAQESGIRNKSSSSQIPVVGVVTE | EEAGATTEA,TEEAGATTEA | CRC |
| C9orf131 | c.1024del|C | p.P342fs | GYETHLETTGHKKMPQAFEPPMPPP[p.P342fs]ANPQLLCQNPEKLALKEDLLYL RTSGEPWDTERNLRPLSLQCQSLALP* | LALKEDLLY,ALKEDLLYL,SLQCQSLAL,KLALKEDLL,QLLCQN PEK,MPPPANPQL,ERNLRPLSL,YLRTSGEPW,CQNPEKLAL, FEPPMPPPA,QLLCQNPEKL,KLALKEDLLY,CQNPEKLALK,L YLRTSGEPW,ALKEDLLYLR,MPPPANPQLL,RPLSLQCQSL,L ALKEDLLYL,TERNLRPLSL,LSLQCQSLAL,GEPWDTERNL | STAD |
| C9orf174 | c.406C>T | p.R136W | ITNHREKKLQQSTKVWCLNQSAESL[p.R136W]ICAMRGGENRPPARVQSSS EELELR | ESLWICAMR,NQSAESLWI,AESLWICAM,QSAESLWICA,CL NQSAESLWM,SAESLWICAM | BRCA |
| CABP5 | c.433del|C | p.R145fs | NGDGEITLVELQQAMQRLLGERLTP[p.R145fs]GRSLRLSGRLMLMETAQLTLKS L* | RLSGRLMLM,LMLMETAQL,MLMETAQLT,RLTPGRSLR,RS LRLSGRL,SLRLSGRLM,ERLTPGRSL,LRLSGRLML,LMETAQ LTL,RLMLMETAQL,MLMETAQLTL,RLTPGRSLRL,LMETAQ LTLK,RSLRLSGRLM,SLRLSGRLML,SGRLMLMETA,ETAQLT LKSL,GERLTPGRSL,LRLSGRLMLM | STAD |
| CACHD1 | c.2159C>A | p.S720Y | SLMDKAFDPTRRQWYLHAVANPGLI[p.S720Y]YLTGPYLDVGGAGVVTI SHTIHSSS | AVANPGLIY,LIYLTGPYL,YLTGPYLDV,GLIYLTGPY,VANPGL IYL,AVANPGLIYL,GLIYLTGPYL,YLTGPYLDV,HAVANPGLIY | CRC |
| CACNA1A | c.1994C>T | p.T665M | NFDEGTPPTNFDTFPAAIMTVFQIL[p.T665M]MGEDWNEVMYDGIKSQGGVQ GGMVFS | LMGEDWNEV,IMWFQIIM,FQIIMGEDW,MGEDWNEV M,MGEDWNEVMY,ILMGEDWNEV,LMGEDWNEVM,VF QIIMGEDW,AIMTVFQIIM | CRC |
| CACNA1A | c.2315C>A | p.S772Y | EVSPLSAANMSIAVKEQQKNQKPAK[p.S772Y]YVWEQRTSEMRKQNLLASREA LYNEM | PAKYVWEQR,NQKPAKYVW,YVWEQRTSEM,QQKNQKPA KY | LUAD |
| CACNA1C | c.2129C>T | p.S710L | RRSTFDNFPQSLLTVFQILTGEDWN[p.S710L]LVMYDGIMAYGGPSFPGMLVCIY FII | ILLTGEDWNL,LTGEDWNLV,GEDWNLVMY,NLVMYDGIM, TGEDWNLVMY,ILLTGEDWNLV,LVMYDGIMAY,LTGEDWN LVM | UCEC |
| CACNA1D | c.3218G>T | p.R1073L | AKSNPEECRGLFLIYKDGDVDSPVV[p.R1073L]LERIWQNSDFNFDNVLSAMMA LFTVS | SPVVLERIW,DVDSPVVLER,LERIWQNSDF | LUAD |
| CACNA2D1 | c.1055C>A | p.A352E | AKGITDYKKGFSFAFEQLLNYNVSR[p.A352E]ENCNKIIMLFTDGGEERAQEIFNK YN | RENCNKIIM,RENCNKIIML | LUAD |
| CACNA2D3 | c.994G>A | p.A332T | CLNGTLVQADRTNKEHFREHLDKLF[p.A332T]TKGIGMLDIALNEAFNILSDFNH TGQ | KLFTKGIGM,REHLDKLFT,KLFTKGIGML | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CACNB2 | c.1823G>A | p.R608H | ASHRDHNRDETHGSDHRHRESRH[p.R608H]HSRDVDREQDHNECNKQRSRHKSKDR | RHRESRHHSR,RESRHHSRDV | CRC |
| CACNG3 | c.400G>A | p.V134I | ILSVTLLFFGGLCVAASEFHRSRHN[p.V134I]ILSAGIFFVSAGLSNIIGIIVYISA | RSRHNILS,FHRSRHNII,HRSRHNIIL,SRHNIILSA,RSRHNIILSA,EFHRSRHNII,FHRSRHNIL,SEFHRSRHNI | CRC |
| CACNG3 | c.413C>T | p.A138V | TLLFFGGLCVAASEFHRSRHNVILS[p.A138V]GIFFVSAGLSNIIGIIVYISANAGD | ILSVGIFFV,VILSVGIFF,NVILSVGIF,SRHNVILSV,VILSVGIFFV,RSRHNVILSV,LSVGIFFVSA,NVILSVGIFF,RHNVILSVGI,HNVILSVGIF | CRC |
| CACNG3 | c.694C>T | p.R232W | LRAKSHSEFLKKSTFARLPPYRYRF[p.R232W]WRRSSSRSTEPRSRDLSPISKGFHTI | RYRFWRRSS,RFWRRSSSR,PPYRYRFWR,PYYRFWRR,YRFWRRSSS,LPPYRYRFW,RLPPYRYRFW,RYRFWRRSSS,RFWRRSSSR,LPPYRYRFWR,PPYRYRFWR,YRYRFWRRSS | LUAD |
| CACNG5 | c.361G>A | p.G121R | MIRSATPFPLVSLFFMFIGFILNNI[p.G121R]RHIRPHRTILAFVSGIFFILSGLSLV | FILNNIRHI,NIRHIRPHR,ILNNIRHIR,RHIRPHRTI,GFILNNIRHI,FIGFILNNIR,FILNNIRHIR,NNIRHIRPHR,RHIRPHRTIL | CRC |
| CACNG8 | c.437T>G | p.V146G | LRVRASSIFPLSAILLLLGGVCV[p.V146G]GASRVYKSKRNIILGAGILFVAAGLS | LLGGVCVGA,CVGASRVYK,GASRVYKSK,VCVGASRVY,LLLGGVCVGA,VGASRVYKSK,GVCVGASRVY | BLCA |
| CADM1 | c.569C>T | p.S190L | NCTAMASKPATTIRWFKGNTELKGK[p.S190L]LEVEEWSDMYTVTSQLMLKVHKEDDG | LEVEEWSDM,TELKGKLEV,LEVEEWSDMY | CRC |
| CADPS | c.2875C>A | p.R959S | DAALEVQPPDTWDSPLFQLLNDFL[p.R959S]STDYNLCNGKFHKHLQDLFAPLWRY | LNDFLSTDY,FLSTDYNLC,DFLSTDYNL,LLNDFLSTDY,STDYNLCNGK,FQLLNDFLST,NDFLSTDYNL | LUAD |
| CADPS | c.3217G>A | p.A1073T | PSWMAAIYDADNGSGTSEDLFWKLD[p.A1073T]TLQTFIRDLHWPEEFGKHLEQRLKL | KLDTLQTFI,WKLDTLQTF,KLDTLQTFIR,FWKLDTLQTF,WKLDTLQTFI | CRC |
| CALB2 | c.180G>C | p.K60N | YIEGKELENFFQELEKARKGSGMMS[p.K60N]NSDNFGEKMKEFMQKYDKNSDGKIEM | NSDNFGEKM,GMMSNSDNF,SNSDNFGEK,MSNSDNFGEK,SGMMSNSDNF | CESC |
| CALB2 | c.772C>T | p.R258C | KEMNIQQLTNYRKSVMSLAEAGKLY[p.R258C]CKDLEIVLCSEPPM* | KLYCKDLEI,KLYCKDLEIVL,LYCKDLEIVL | LUAD |
| CALCB | c.242G>C | p.R81T | DYVQMKASELKQEQETQGSSSAAQK[p.R81T]TACNTATCVTHRLAGLLSRSGGMVKS | AQKTACNTA,KTACNTATCV,AQKTACNTAT | CESC |
| CALD1 | c.1018G>A | p.E340K | ERMREEKRAAEERQRIKEEEKRAA[p.E340K]KERQRIKEEEKRAAEERQRIKEEEKR | AAKERQRIK,RAAKERQRI,RAAKERQRIK | CLL |
| CALN1 | c.691G>A | p.V231I | LNETSGNCQTEFEGVHSQKQNRQTC[p.V231I]IRKSLICAFAMAFIISVMLIAANQIL | KQNRQTCIR,QNRQTCIRK,CIRKSLICA,RQTCIRKSL,IRKSLICAF,KQNRQTCIRK,SQKQNRQTCI,CIRKSLICAF,RQTCIRKSLI | GBM |
| CAMK2B | c.392G>T | p.G131V | EYYSEADASHCIQQILEAVLHCHQM[p.G131V]VVHRDLKPENLLLASKCKGAAVKLA | AVLHCHQMV,VLHCHQMVV,MVVHRDLK,AVLHCHQMVV,VLHCHQMVVV,QMVVHRDLK,EAVLHCHQMV,HQMVVVHRDL | LUAD |
| CAMSAP1 | c.1396_1397insA | p.T466fs | RHRSNSLTRVDGQPRGAAIAWPEKK[p.T466fs]NQACVPANTFCSTSRCEL* | VPANTFCST,QACVPANTF,KKNQACVPA,WPEKKNQACV,NQACVPANTF | BLCA |
| CAMSAP1 | c.1396del|A | p.T466fs | RHRSNSLTRVDGQPRGAAIAWPEKK[p.T466fs]PGLRPSQHLLYITLRVVKWIPALATASAWPAPSAKTVWHPTLLI* | LLLYITLRV,LLYITLRVV,RVVKWIPAL,GLRPSQHLL,VVKWIPALA,SAWPAPSAK,HLLLYITLR,KWIPALATA,LYITLRVVK,ASAWPAPSA,SAKTVWHPT,KTVWHPTLL,IPALATASA,WPAPSAKTV,SQHLLYIT,AMPA,TVWHPTLLI,IPALATASA,WPAPSAKTV,SQHLLYIT,VKWIPALAT,AKTVWHPTL,LLLYITLRV,ALA | KICH |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CANT1 | c.392A>G | p.K131R | RIAVIADLDTESRAQEENTWFSYLK[p.K131R]RGYLTLSDSGDKVAVEWDKDHGVLES | TASAWPA, GLRPSQHLLL, YITLRVVKWI, RVVKWIPALA, WI PALATASA, LLYITLRVVK, ASAWPAPSAK, LYITLRVVKM, TLR VVKWIPA, SAKTVWHPTL, KTVWHPTLLI, LRPSQHLLLY, TAS AWPAPSA, KPGLRPSQHL, RPSQHLLLYI, IPALATASAW, WP APSAKTVW, SAHLLLYITL, LRVVKWIPAL, VKWIPALATA, AK TVWHPTLL | PRAD |
| CAPN S1 | c.906_911 de\|GCTGGT | p.LV303 de\| | LHTSSELQSPSSYFASRPWVRAKGL[p.LV303de\|]LGFPVLTLHPLPLPSGCS* | YLKRGYLTL, NTWFSYLKR, SYLKRGYLT, WFSYLKRGY, FSYLK RGYL, YLKRGYLTLS, SYLKRGYLTL, TWFSYLKRGY, ENTWFSY LKR | TGCT |
| CAPRIN2 | c.37G>A | p.E13K | MEVQVSQASLGF[p.E13K]KLTSVEKSLREWSRLSREVIAWLCPS | GLLGFPVLT, WVRAKGLLG, VRAKGLLGF, AKGLLGPV, KGLL GFPVL, GLLGFPVLTL, RAKGLLGFPV, WVRAKGLLGF, RPWV RAKGLL, AKGLLGFPVL | CRC |
| CARD11 | c.1268G>A | p.R423Q | IEKDKYRKQIRELEEKNDEMRIEMV[p.R423Q]QREACIVNLESKLRRLSKDSNNLDQS | SLGFKLTSV, VSQASLGFK, GFKLTSVEK, SQASLGFKL, QVSQ ASLGFK, LGFKLTSVEK, KLTSVEKSLR, SQASLGFKLT, FKLTSV EKSL | CRC |
| CARD11 | c.1876G>A | p.E626K | LDDDSHERYSFGPSSIHSSSSHQS[p.E626K]KGLDAYDLEQVNLMFRKFSLER PFRP | EMRIEMVQR, DEMRIEMVQ, IEMVQREAC, MRIEMVQREA, IEMVQREACI, VQREACIVNL | DLBCL |
| CARD11 | c.279G>C | p.E93D | SKINRAGRLLDILHTKGQRGVVFL[p.E93D]DSLEFYYPELYKLVTGKEPTRRFSTI | SSSSSHQSK, HQSKGLDAY, HSSSSSHQSK, SHQSKGLDAY | DLBCL |
| CARD11 | c.3195C>G | p.I1065M | ANIEAVAAKNHCLLEAGIGCTRDL[p.I1065M]MKSNIYPIVLFIRVCEKNIKRFR KLL | FLDSLEFYY, GYVVFLDSL, VVFLDSLEF, VFLDSLEFY, FLDSLEF YYP, VVFLDSLEFY, YVVFLDSLEF, RGYVVFLDSL, VFLDSLEFY Y, DSLEFYYPEL | LUAD |
| CARM1 | c.605C>T | p.A202V | LQNHTDFKDKIVLDVGCGSGILSFF[p.A202V]VAQAGARKIYAVEASTMAQHAE VLVK | LMKSNIYPI, RDLMKSNIY, MKSNIYPIV, DLMKSNIYPI, LMKS NIYPIV, GIGCTRDLMK, CTRDLMKSNI, MKSNIYPIVL | GBM |
| CASC1 | c.161G>A | p.R54Q | ERRLKEEEARLKYEKEEMERLEIQ[p.R54Q]QIEKEKWHRLEAKDLERRNEEL EELY | ILSFFVAQA, FVAQAGARK, SFFVAQAGA, FFVAQAGAR, LSF FVAQAG, GILSFFVAQA, FVAQAGARKI, SFFVAQAGAR, VA QAGARKIY, CGSGILSFFV, LSFFVAQAGA RLEIQQIEK, MERLEIQQI | CRC |
| CASC3 | c.1808C>T | p.P603L | MNLPHPGLHPHQTPAPLPNPGLYPP[p.P603L]LVSMSPGQPPPQQLLAPTYFSA PGVM | GLYPPLVSM, NPGLYPPLIV, GLYPPLVSMS, LPNPGLYPPL | STAD |
| CASC3 | c.1934C>T | p.P645L | TYFSAPCVMNFGNPSYPYAPGALPP[p.P645L]LPPPHLYPNTQAPSQVYGGVTY YNPA | YAPGALPPL, LPPLPPPHL, ALPPLPPHL, PYAPGALPPL, LPPL PPPHLY | STAD |
| CASC3 | c.1973>T | p.S658L | PSYPYAPGALPPPPPHLYPNTQAP[p.S658L]LQVYGGVTYNPAQQQVQPKPS PPRR | NTQAPLQVY, LYPNTQAPL, LQVYGGVTY, APLQVYGGV, HL YPNTQAPL, LQVYGGVTYY, QAPLQVYGGV, YPNTQAPLQV | STAD |
| CASC3 | c.695C>T | p.S232F | RQRKLWKDEGRWEHDKFREDEQAPK[p.S232F]FRQELIALYGYDIRSAHNPDDI KPRR | KFRQELIAL, APKFRQELI, REDEQAPKF, FRQELIALY, KPRQEL IALY, EQAPKFRQEL | STAD |
| CASD1 | c.2341de\|T | p.F781fs | DLAQIIIPKDNSSLLKRLACIAAFF[p.F781fs]VDSSSYHPFKINQNIRFQKF* | DSSSYHPFK, INQNIRFQK, AFFVDSSSY, LACIAAFFV, HPFKIN QNI, VDSSSYHPF, FKINQNIRF, NQNIRFQKF, FVDSSSYHPF, RLACIAAFFV, KINQNIRFQK, INQNIRFQKF, AAFFVDSSSY, H PFKINQNIR, DSSSYHPFKI | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CASP14 | c.13C>T | p.R5W | MSNP[p.R5W]WSLEEEKYDMSGARLALILCVTKARE | NPWSLEEEKY | CRC |
| CASP5 | c.67del|A | p.R23fs | MAAVPRVEGVFIFLIEDSGKKK[p.R23fs]GVRILKLCSKVSFRVDWITS* | RILKLCSKV, KVSFRVDWI, KLCSKVSPR, KKKGVRILK, GKKKG VRIL, KKGVRILKL, LKLCSKVSF, SKVSFRVDW, KLCSKVSFRV, GVRILKLCSK, SGKKKGVRIL, ILKLCSKVSF, KKKGVRILKL, SKV SPRVDWI | KIRC |
| CASP8 | c.1413del|A | p.R471fs | YEVSNKDDKKNMGKQMPQPTFTLRK[p.R471fs]NLSSLLIDGAILFVLFCFV FLRQNLALSPRLECSGVISAHRKLRLPG SGHSPASASRVAGTTGARHHTWLIF* | LLIDGAILF, LIDGAILFV, IDGAILFVL, DGAILFVLF, FVLFCFVFL, TLRKNLSSL, FVFLRQNLA, VLPCFVFLR, AILFVLFCF, LFVLFCVFV, CSGVISAHR, SGVISAHRK, RVAG TTGAR, DGAILFVLF, AILFVLFCF, LFVLFCVFV, CFVFLRQNL, V FLRQNLAI, RQNLALSPR, VISAHRKLR, KLRLPGSGH, GARHH TWLI, LPGSGHSPA, LRKNLSSLI, RKNLSSLLI, ARHHTWLIF, I DGAILFVL, FTLRKNLSSL, NLSSLLIDGA, LLIDGAILFV, LIDGAI LFVL, AILFVLFCFV, FVFLRQNLAL, TLRKNLSSLI, RLECSGVIS A, RLPGSGHSPA, FVLFCFVFLR, CSGVISAFIRK, IDGAILFVLF, GAILFVLFCF, ILFVLFCVFV, RQNLALSPRL, KLRLPGSGHS, SG HSPASASR, ASRVAGTTGA, GARHHTWLIF, RVAGTTGARH, ECSGVISAHR, GVISAHRKLR, QPTFTLRKNL, SLLIDGAILF | STAD |
| CAST | c.1917T>A | p.D639E | DDALDKLSDSLGQRQPDPDENKPME[p.D639E]EKVKEKAKAEHRDKLGERDDTI PPEY | MEEKVKEKA | CLL |
| CATSPER4 | c.1274C>T | p.T425M | MIVEEVRAIRFNQEQESEVLNRRSS[p.T425M]MSGSLETTSSKDIRQMSQQQDL LSAL | SMSGSLETT, EVLNRRSSM, RRSSMSGSL, NRRSSMSGSL, SE VLNRRSSM | KIRC |
| CBFB | c.454G>A | p.E152K | FDEERAQQEDALAQQAFEEARRRTR[p.E152K]KFEDRDRSHREEMEVRVSQLLA VTGK | EARRRTRKF, RTRKFEDRDR, RKFEDRDRSH, EEARRRTRKF | CRC |
| CBLL1 | c.413del|A | p.E138fs | PIKIYGRMIPCKHVFCYDCAILHEK[p.E138fs]REIRCVQAVVILCSELSSVHEVL SSCVALFKGAREHICLRETYRLISTIAI* | ILCSELSSV, VLSSCVALF, CLRETYRLI, LSSCVALFK, CVALFKG AR, HICLRETYR, GAREHICLR, TYRLISTIA, ILHEKREIR, EIRCV QAVV, ELSSVHEVL, EVLSSCVAL, ETYRLISTI, REIRCVQAV, R CVQAVVIL, SELSSVFIEV, HEVLSSCVA, ALFKGAREH, EHICLR ETY, RETYRLIST, YRLISTIAI, REHICLRET, HEKREIRCV, VILCSELSSV, SVHEVLSSCV, ALFKGAREHI, VLSSCVALFK, TYRLISTIAI, EHICLRETYR, ETYRLISTIA, EVLSSCVAL, REIRCVQAVV, SELSSVHEVL, HEVLSSCVAL, REHICLRETY, RETYRLISTI | STAD |
| CBLN3 | c.206del|C | p.P69fs | ECLVVCEPGRAAAGPGGAALGEAP[p.P69fs]LGEWHLLRSEATTMSQQGKPA MAPVGPSTSTRSW* | AMAPVGPST, ATTMSQQGK, QGKPAMAPV, APLGEWHLL, MSQQGKPAM, APVGPSTST, LLRSEATTM, GAALGEAPL, GE WHLLRSE, GPSTSTRSW, EAPLGEWHLL, TTMSQQGKPA, KP AMAPVGPS, TMSQQGKPAM, HLLRSEATTM, GEAPLGEW HL, GEWHLLRSEA, QQGKPAMAPV, AMAPVGPSTS | STAD |
| CBWD6 | c.304_305 insG | p.E102fs | ESGEGSALEKSLAVSQGGELYEEWL[p.E102fs]GT* | GELYEEWLGT | KICH |
| CC2D2A | c.3850C>T | p.R1284C | ESQEDEKLLQATEKFQAECALKFPN[p.R1284C]CQCLTTVIDISGKTVFITRY LKPLNP | LKFPNCQCL, FPNCQCLTT, ALKFPNCQCL, CQCLTTVIDI, FPN CQCLTTV, AECALKFPNC | CRC |
| CCDC108 | c.3492del|C | p.P1164fs | LERDPTPCELTYKVPTRHSMSQIPP[p.P1164fs]SSPL* | SQIPPSSPL, MSQIPPSSPL | STAD |
| CCDC111 | c.1250G>T | p.R417L | GIKGGIRRWNYFPEELLVDICKY[p.R417L]LWCENIGRAFIKSNNIMILVDL | LVYDICKYL, VYDICKYLW, YLWCENIGR, CKYLWCENI, LLVYD ICKYL, YLWCENIGRA, LVYDICKYLW | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CCDC120 | c.22A>G | p.I8V | KNEVW MEVKGQL[p.I8V]VSSPTFNAPAALFGE AAPQVKSERLR | LVSSPTFNA,GQLVSSPTF,MEVKGQLVS,QLVSSPTFNA,ME VKGQLVSS,KGQLVSSPTF | KIRC |
| CCDC121 | c.1190G>T | p.W397L | IEQAQKLTATQSHLENRKQQLQQEQL[p. W397L]LYLESLIQARQRLQGSHNQCLN RQDV | QQLQQEQLY,KQQLQQEQL,QEQLYLESL,QLYLESLIQA,KQ QLQQEQLY,LYLESLIQAR,RKQQLQQEQL,QQLQQEQLYL, QQEQLYLESL,QEQLYLESLI | LUSC |
| CCDC132 | c.2512C>T | p.R838C | NIYVDALLKEFQFNRRLNEVSKRV[p.R 838C]CIPLPVSNILWEHCIRLANRTIV EGY | CIPLPVSNI,VSKRVCIPL,KRVCIPLPV,NEVSKRVCI,EVSKRVC IPL,SKRVCIPLPV | UCEC |
| CCDC135 | c.937G>A | p.E313K | AEKAKPDALHGLRVHSWVLVLSGKR[p. E313K]KVPENFFIDPFTGHSYSTQDEHF LGI | GKRKVPENF,RKVPENFFI,WVLVLSGKR,KRKVPENFFI,GK RKVPENFF | HNSC |
| CCDC144A | c.3791C>T | p.S1264L | NTTSIKTQMELTIKDLESEISRIKT[p. S1264L]LQADFNKTELERYKELYLEEV KVRES | KTLQADFNK,ISRIKTLQA,RIKTLQADF,SEISRIKTL,LQADFN KTEL,RIKTLQADFN,EISRIKTLQA,SRIKTLQADF | UCEC |
| CCDC148 | c.1260del A | p.K420fs | KEEEKEKLWKKELLQRAEKKKKIK[p. K420fs]NTGPRKNRSGKKWK* | KIKNTGPRK,KNRSGKKWK,RKNRSGKKW | STAD |
| CCDC15 | c.1463C>A | p.P488H | ILPKYQDQNFLPKDQNFLSRDQHVL[p. P488H]HKDQDILPKYQDQNFLPKDQN FLSRD | LSRDQHVLH,LSRDQHVLHK | CLL |
| CCDC152 | c.457G>C | p.E153Q | GYKKEISKLYQDMQRKVELNEEKHK[p. E153Q]QLIEKKEMEISELNAKLRSQEKE KQN | KHKQLIEKK,KQLIEKKEMEI,QLIEKKEMEI,HKQLIEKKEM | CESC |
| CCDC153 | c.598_599insC | p.P200fs | QWDGAALRLHARHKEQQRQFGLTPP[p. P200fs]WIFEATSP* | LTPPWIFEA,RQFGLTPPWI,QFGLTPPWI,FGLTPPWIF,RQF GLTPPWI,GLTPPWIFEA,QFGLTPPWIF,QROFGLTPPW | STAD |
| CCDC153 | c.599del C | p.P200fs | QQWDGAALRLHARHKEQQRQFGLTP[p. P200fs]LDL* | QRQFGLTPL,RQFGLTPLD,RQFGLTPLDL,QQRQFGLTPL | STAD |
| CCDC159 | c.994G>T | p.A332S | KELSDIWSAVHVLQNSIDSLTLCSG[p.A 332S]SCPKASSLRGHKGHQCLSPPLPS WDS | TLCSGSCPK,TLCSGSCPKA,LTLCSGSCPK,GSCPKASSLR | TGCT |
| CCDC168 | c.15058G>T | p.D5020Y | GYTLSNSKGPVQPTAQGEEKGGLRI[p. D5020Y]YMEDKMLPKCTDLKAKQLLLS DILNT | YMEDKMLPK,GLRIYMEDK,EEKGGLRIY,LRIYMEDKM,RIY MEDKML,IYMEDKMLPK,GEEKGGLRIY,EEKGGLRIYM | UCEC |
| CCDC169-SOHLH2 | c.485A>G | p.K162R | LDDCIFNMVLLKVPSSLSAEELEAI[p.K1 62R]RLIRFGKKKNTHSLFVFIIPENFKGC | AIRLIRFGK,RLIRFGKKK,ELEAIRLIR,LEAIRLIRF,EELE AIRLI,AEELEAIRL,AIRLIRFGKK,EAIRLIRFGK,EELEAI RLIR,AEELEAIRLI | STAD |
| CCDC19 | c.620G>T | p.R207L | KLRMEQEEELKDMSKIILNAKCHAI[p.R 207L]LDAQILEKQAIQKELDTEEKRLDQ MM | ILDAQILEK,LNAKCHAIL,HAILDAQIL,ILNAKCHAIL, AIILDAQILEK | LUAD |
| CCDC19 | c.836G>T | p.R279L | RIRGRRQIVEQMEKNQEERSLLAEQ[p. R279L]LEQEKEQMLEYMEQLQEEDLK DMERR | LEQEKEQML,EERSLLAEQL | LUAD |
| CCDC36 | c.626G>T | p.R209I | AQNDLVFEAVQDKGNMEQAILEMKK[p. R209I]IFEARQGEFIEMKSNLKHLEVL VAQQ | IFEARQGEF,EMKKIFEAR,AILEMKKIF,LEMKKIFEA, KIFEARQGEF,QAILEMKKIF | UCEC |
| CCDC53 | c.172C>T | p.R58C | FVVHTVQFLNRFSTVCEEKLADLSL[p.R 58C]CIQQIETTLNILDAKLSSIPGLDDVT | KLADLSLCI,ADLSLCIQQI | CESC |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CCDC60 | c.689G>A | p.R230H | GQKWEHFITAPKTKKFKIPTMRVTN[p.R230H]HKPSRRGSTLSLSRASGGSSPQSSMI | PTMRVTNHK, RVTNHKPSR, VTNHKPSRR, RVTNHKPSRR | CRC |
| CCDC79 | c.1319A>C | p.N440T | IEQLEREGNEEEIQRENYQDNISSM[p.N440T]TISIQNTWKHLHADRIGRGSKAEDED | NISSMTISI, TISIQNTWK, MTISIQNTW, YQDNISSMT, YQDNISSMTI, MTISIQNTWK, SMTISIQNTW | CLL |
| CCDC81 | c.776G>T | p.R259I | NRERKCKLKDQSDKEEGTRDISSPK[p.R259I]LLRDRQALFPAKVTNVSLLEKFERSEITCEKIEALEQENSELERENRKLKK[p.K6 77fs]NIG* | ILRDRQALF, DISSPKILR, RDISSPKIL, KILRDRQAL, GTRDISSPKI, KILRDRQALF, RENRKLKKNI | CRC |
| CCDC88A | c.2031_2032 insA | p.K677fs | | | STAD |
| CCDC88C | c.5553_5554 insC | p.P1851fs | QKLGAPEALGGRETGSHTLQSPAPP[p.P1851fs]QLP* | LQSPAPPQL, TLQSPAPPQL | CRC |
| CCKAR | c.811C>A | p.L271M | QKKSAKERKPSTTSSGKYEDSDGCY[p.L271M]MQKTRPPRKLELRQLSTGSSSRANRI | YMQKTRPPR, MQKTRPPRK, YEDSDGCYM, YMQKTRPPRK, MQKTRPPRKL, CYMQKTRPPR | LUAD |
| CCKBR | c.706G>A | p.V236M | SARVRQTWSVLLLLLLFFIPGVVMA[p.V236M]MAYGLISRELYLGLRFDGDSDSDSQS | FIPGVVMAM, VVMAMAYGL, VMAMAYGLI, AMAYGLISR, MAMAYGLIS, FIPGVVMAMA, VVMAMAYGLI, MAMAYGLISR, FFIPGVVMAM, MAYGLISREL, IPGVVMAMAY | CRC |
| CCNB3 | c.2794G>A | p.A932T | ETLLKKPLALKMSTINEAVLFEDMI[p.A932T]TLNEKPTTGKELSFKEPLAIQESPTY | VLFEDMITL | CLL |
| CCR5 | c.554G>T | p.S185I | SLPGIIFTRSQKEGLHYTCSSHFPY[p.S185I]IQYQFWKNFQTLKIVILGLVLPLLVM | SSHFPYIQY, HPFYIQYQF, IQYQFWKNF, FPYIQYQFW, CSSHFPYIQY, YTCSSHFPYI, SHFPYIQYQF, HFPYIQYQFW, YIQYQFWKNF | KIRC |
| CCZ1 | c.642G>C | p.E214D | IFGGISFFPLDKMTYLKIQSFINRM[p.E214D]ESLNIVKYTAFLYNDLIWSGLEQD | FINRMDESL, RMDESLNIV, DESLNIVKY, RMDESLNIVK, SFINRMDESL, MDESLNIVKY | KIRC |
| CD101 | c.1781G>A | p.R594Q | SDLKVPLTVTWQFQPASSHIFHQLI[p.R594Q]QITHNGTIEWGNFLSRFQKKTKVSQS | HIFHQLIQI, IQITHNGTI, SHIFHQLIQI | CRC |
| CD101 | c.847G>T | p.D283Y | PDETWMFITKKQTDQTTLRIQPAVK[p.D283Y]YFQVNITADSLFAEGKPLELVCLVVS | RIQPAVKYF, KYFQVNITA, AVKYFQVNI, LRIQPAVKY, QPAVKYFQV, IQPAVKYFQV, TLRIQPAVKY, LRIQPAVKYF, VKYFQVNITA | CRC |
| CD109 | c.1409T>A | p.L470Q | AYFLGSKSSMAVHSLFKSPSKTYIQ[p.L470Q]QKTRDENIKVGSPFELVVSGNKRLKE | KTYIQQKTR, PSKTYIQQK, QQKTRDENIK, IQQKTRDENI | CLL |
| CD163L1 | c.2161G>A | p.V721M | SDMELRLVGGSSRCAGKVEVNVQGA[p.V721M]MGILCANGWGMNIAEVVCRQLECGSA | VEVNVQGAM, MGILCANGW, EVNVQGAMGI, KVEVNVQGAM, VQGAMGILCA, AMGILCANGW | GBM |
| CD180 | c.683A>C | p.N228T | SLNFNGNNVKGIELGAFDSTIFQSL[p.N228T]TFGGTPNLSVIFNGLQNSTTQSLWLG | LTFGGTPNL, STIFQSLTF, SLITFGGTPNL, FQSLITFGGTP | CRC |
| CD1B | c.122G>T | p.W41L | GNSEHAFQGPTSFHVIQTSSFTNST[p.W41L]LAQTQGSGWLDDLQIHGWDSDSGTAI | FTNSTLAQT, SSFTNSTLA, TSSFTNSTL, LAQTQGSGW, QTSSFTNSTL, TSSFTNSTLA, TLAQTQGSGW | LUAD |
| CD1C | c.265C>T | p.R89C | TIIFLHNWSKGNFSNEELSDLELLF[p.R89C]CFYLFGLTREIQDHASQDYSKYPFEV | LSDLELLFC, ELLFCFYLF, LFCFYLFGL, CFYLFGLTR, SDLELLFCF, LELLFCFYL, LSDLELLFCF, LLFCFYLFGL, SDLELLFCFY, FCFYLFGLTR, LELLFCFYLF | SKCM |
| CD1D | c.74del|T | p.L25fs | MGCLLFLLLMLALLLQAWGSAEVPQRL[p.L25fs]SPSAASRSRSPIAAGRAPTAWR | RLSPSAASR, ASRSRPSI, RSRSPIAA, AGRAPTAWR, VPQRLSPSA, SPIAAGRAP, AAGRAPTAW, AASRSRPSI, ASRSRPS | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CD1E | c.253T>G | p.F85V | GWGSCRRTAGATTRIPSAL* | PIA,RSRPSPIAAG,AWRGWGSCRR,TAWRGWGSCR,EVPQ RLSPSA,VPQRLSPSAA,RPSPIAAGRA,SPIAAGRAPT,AEVP QRLSPS,IAAGRAPTAW | STAD |
| CD209 | c.847G>A | p.A283T | GDLQTHGWDTVLGTIRFLKPWSHGN[p. F85V]VSKQELKNLQSLFQLYFHSFIQI VQA | KPWSHGNVS,FLKPWSHGNV,KPWSHGNVSK,HGNVSKQE LK | GBM |
| CD4 | c.492del G | p.Q164fs | WEWTFFQGNCYFMSNSQRNWHDSIT [p.A283T]TCKEVGAQLVVIKSAEEQNF LQLQSS | DSITTCKEV | STAD |
| CD55 | c.466G>A | p.E156K | TLESPPGSSPSVQCRSPRGKNIQGG[p. Q164fs]RPSPCLSWSSRIVAPGHALSCR TRRRWSSK* | CLSWSSRIV,RIVAPGHAL,RTRRRWSSK,RGKNIQGGR,SSRI VAPGH,HALSCRTRR,LSWSSRIVA,SSRIVAPGHA,HALSCRT RRR,IQGGRPSPCL,GGRPSPCLSW,SRIVAPCHAL,SPCLSW SSRI | UCEC |
| CD7 | c.521del C | p.P174fs | PGYRREPSLSPKLTCLQNLKWSTAV[p.E 156K]KFCKKKSCPNPGEIRNGQIDVPG GIL | NLKWSTAVK,STAVKFCKK,WSTAVKFCK,TAVKFCKK,LK WSTAVKF,KWSTAVKFCK,WSTAVKFCKK,STAVKFCKKK,NL KWSTAVKF | KIRC |
| CD79B | c.589T>C | p.Y197H | ASALPAPPTGSALPDPQTASALPDP[p.P 174fs]QQPLPSLRPWR* | ALPDPQQPL,DPQQPLPSL,QPLPSLRPW,SALPDPQQPL,Q QPLPSLRPW | DLBCL |
| CD79B | c.589T>G | p.Y197D | LFIIVPIFLLLDKDSKAGMEEDHT[p.Y1 97H]HEGLDIDQTATYEDIVTLRTGEVK WS | EEDHTHEGL,MEEDHTHEGL,HEGLDIDQTA | DLBCL |
| CD93 | c.838del G | p.D280fs | LFIIVPIFLLLDKDSKAGMEEDHT[p.Y1 97D]DEGLDIDQTATYEDIVTLRTGEVK WS | MEEDHTDEGL | STAD |
| CDAN1 | c.1936_1937 insC | p.L646fs | PLCVSPKYGCNFNNGGCHQDCFEGG[p. D280fs]MAPSSAAADQDSGCWMTW* | GMAPSSAAA,HQDCFEGGM,FEGGMAPSS,FEGGMAPSSA | KIRC |
| CDC14A | c.369del C | p.N123fs | GERKQFAVVLLSLRLLAKFLGFVAF[p.L6 46fs]PAIPGA* | FLGFVAPPA,FVAFPAIPG,LGFVAFPAI,FLGFVAFPAI, FVAFPAIPGA,KFLGFVAFPA | STAD |
| | | | AYAVIYLKKTPEEAYRALLSGSNPP[p.N1 23fs]IFHSGMLPLEIALTISPFSTVCRE SERDYNMDFLTLRHLMWMNMNIMSELK MVTSTGLFQENF* | NMDFLTLRH,LLSGSNPPI,GMLPLEIAL,MLPLEIALT,LTI SPFSTV,HLMWMNMNI,NIMSELKMV,IMSELKMVT,STVCRES ER,NMNIMSELK,IFHSGMLPL,DYNMDFLTL,KMVTSTGLF, YNMDFLTLR,EIALTISPF,MNMNIMSEL,PPIFFISGML,LPLEI ALTI,LMWMNMNIM,LSGSNPPIF,LEIALTISP,RESERDYN M,SERDYNMDF,MDFLTLRHL,LRHLMWMNM,MNIMSEL KM,SELKMVTST,LKMVTSTGL,RDYNMDFLT,ALLSGSNPPI, MLPLEIALTI,ALTISPFSTV,NMDFLTLRHL,FLTLRHLMWM, HLMWMNMNIM,WMNMNIMSEL,TISPFSTVCR,MNMNI MSELK,DFLTLRHLMW,RHLMWMNMNI,TLRHLMWMN M,FSTVCRESER,DYNMDFLTLR,EIALTISPFS,NPPIFHSGML, ELKMVTSTGL,LLSGSNPPIF,LEIALTISPF,LKMVTSTGLF, FHSGMLPLEI,SGMLPLEIAL,SERDYNMDFL,RDYNMDFLTL, YNMDFLTLRH,MDFLTLRHLM,NMNIMSELKM,TSTGLFQEN F,LPLEIALTIS | |
| CDC14B | c.1123C>T | p.R375C | GSVIGPQQQFLVMKQTNLWLEGDYF[p. R375C]CQKLKGQENGQHRAAFSKLLS GVDDI | LEGDYFCQKL | CRC |
| CDC25C | c.965del A | p.K322fs | ENLNRPRLKQVEKFKDNTIPDKVKK[p.K 322fs]SIFLAKESSGRAYV* | KVKKSIFLA,IPDKVKKSI,AKESSGRAV,KESSGRAVV,FLAKES SGRA,KVKKSIFLAK,LAKESSGRAY,IFLAKESSGR, IPDKVKKSIF | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CDC27 | c.1379de|T | p.L460fs | ITKLDSSIISEGKISTITPAIQAFN[p.L460fs]HKKQQQKV* | QIQAFNHKK, AFNHKKQQQK | UCS |
| CDC27 | c.1665T>G | p.D555E | EVRRIENYRVEGMEIYSTLWHLQK[p.D555E]EVALSVLSKDLTDMDKNSPEAWCAAG | TLWHLQKEV, LQKEVALSV, EVALSVLSK, WHLQKEVAL, QKEVALSVL, KEVALSVLS, HLQKEVALSV, LQKEVALSVL, TTLWHLQKEV, KEVALSVLSK | CRC |
| CDC27 | c.1712A>T | p.N571I | STTLWHLQKDVALSVLSKDLTDMDK[p.N571I]ISPEAWCAAGNCFSLQREHDIAIKFF | MDKISPEAW, KISPEAWCAA | TGCT |
| CDC27 | c.271de|A | p.I91fs | CTTPQCKYLLAKCCVDLSKLAEGEQ[p.I91fs]SYLVECLISRKAMMILLSLVIQLALLFHCWDMYIARQIGLPKDQNVTKRALV* | AMMILLLSL, MMILLLSLV, LLLSLVIQL, LLSLVIQLA, SLVIQLALI, ALLFHCWDM, CLISRKAMM, LISRKAMMI, LVECLISRK, IARQIGLPK, LVIQLALLF, LFHCWDMYI, MYIARQIGL, ISRKAMMIL, KLAEGEQSY, LLFHCWDMY, YIVECLISR, HCWDMYIAR, SRKAMMILL, RKAMMILLL, MLLLSLVI, LSLVIQLAL, DQNVTKRAL, AEGEQSYLV, GEQSYLVEC, VECLISRKA, WDMYIARQI, KLAEGEQSYL, CLISRKAMMI, KAMMILLLSL, AMMILLLSLV, MMILLLSLVI, ILLLSLVIQL, LLLSLVIQLA, LLSLVIQLAL, LLFHCWDMYI, YIARQIGLPK, YLVECLISRK, SLVIQLALLF, IQLALLFHCW, ISRKAMMILL, ALLFHCWDMY, SKLAEGEQSY, GEQSYLVECL, VECLISRKAM, SRKAMMILLL, LALLFFICWDM, VISSDTVPL, AVISSDTVPL, DSAVISSDTV | BLCA |
| CDC27 | c.724C>T | p.P242S | LESSNSKYSLNTDSSVSYIDSAVIS[p.P242S]SDTVPL6TGTSILSKQVQNKPKTGRS | KQISYSTGV, SYSTGVCSI, KQKQISYST, KQKQISYSTG, KQISYSTGVC, ISYSTGVCSI | CESC, TGCT |
| CDC4 2BPA | c.2023C>A | p.P675T | EQSEHYSKQLENELEGLKQKQISYS[p.P675T]TGVCSIEHQEITKLKTDLEKKSIFYGPCLRNRYGEDVRSALLDPDWVCPP[p. | AIAATVGSV, FIWPSFMVM, MVMTMLRNI, TMLRNIWRA, ATVGSVTAA, TVGSVTAAV, MTMLRNIWR, SSFIWPSFM, SF MVMTMLR, SFIWPSFMV, MLRNIWRAY, LRNIWRAYK, RNI WRAYKR, CPPVVGSAI, WPSFMVMTM, AAVPQESSF, ESSFI WPSF, VMTMLRNIW, QESSFIWPS, VPQESSFIW, DPDWVC PPV, VVGSAIAATV, ATVGSVTAAV, SSFIWPSFMV, FIWPSF MVMT, FMVMTMLRNI, MTMLRNIWRA, SAIAATVGSV, ML RNIWRAYK, PSFMVMTMLR, SFIWPSFMVM, IWPSFMVM TM, MVMTMLRNIW, TMLRNIWRAY, VMTMLRNIWR, WV CPPVVGSA, ESSFIWPSFM, WPSFMVMTML, TAAVPQESSF, IAATVGSVTA, QESSFIWPSF, DPDWVCPPVV, CPPVVGSAIA, VSSNGNAVK, AVSSNGNAVK, AVKDPMEILI | BRCA |
| CDCA 7L | c.1215de|C | p.P405fs | P405fs]VVGSAIAATVGSVTAAVPQESSFIWPSFMVMTMLRNIWRAYKRSW* | | CRC |
| CDH1 | c.727G>A | p.E243K | EPLDRERIATYTLFSHAVSSNGNAV[p.E243K]KDPMEILITVTDQNDNKPEFTQEVFK | | BRCA |
| CDH1 | c.760G>T | p.D254Y | TLFSHAVSSNGNAVEDDPMEILITVT[p.D254Y]YQNDNKPEFTQEVFKGSVMEGALPGT | TVTYQNDNK, MEILIVTY, YQNDNKPEF, ITVTYQNDNK, TY QNDNKPEF | STAD |
| CDH1 | c.1045G>A | p.E349K | DTQEGLIITVKKPLDYESRRLYTLKV[p.E349K]KAENTHVDPRFYYLGPFKDTTIVKIS | RLYTLKVKA, KVKAENTHV, LKVKAENTHV, LKVKAENTH, LKVKAENTHV | CRC |
| CDH1 | c.1414C>T | p.R472C | LDRELSQWHNLTVIAAEINNPKETT[p.R472C]CVAVFVRILDVNDNAPQFAVFYDTFV | TTCVAVFVR, ETTCVAVF, KETTCVAVF, ETTCVAVFVR, TTC VAVFVRI, NPKETTCVAV, KETTCVAVFV | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CDH10 | c.1731C>G | p.S577R | NGFNRHEISTYLLPVVISDNDYPIQ[p.S577R]RSTGTLTIRVCACDSQGNMQSCCSAEA | YPIQRSTGT, IQRSTGTLT, QRSTGTLTI, IQRSTGLTI, YPIQRSTGTL | LUAD |
| CDH10 | c.382C>A | p.R128S | IIDEKTGDIHATRRIDREEKAFYTL[p.R128S]SAQAINRRTLRPVEPESEFVIKIHDI | TLSAQAINR, FYTLSAQAI, EKAFYTLSA, KAFVTLSAQ, YTLSAQAINR, AFYTLSAQAI, KAFYTLSAQA, TLSAQAINRR, SAQAINRRTL, EEKAFYTLSA, REEKAFYTLS | LUAD |
| CDH11 | c.1070A>C | p.K357T | KKPVDFETKRAYSLKVEAANVHIDP[p.K357T]TFISNGPFKDTVTVKISVEDADEPPM | TFISNGPFK, NVHIDPTFI, ANVHIDPTF, PTFISNGPF, PTFISNGPFK, EAANVHIDPT, AANVHIDPTF, DPTFISNGPF | STAD |
| CDH2 | c.2020G>A | p.D674N | SKEDIRDNVIHYDDEGGGEEDTQAF[p.D674N]NIGALRNPKVIEENKIRRDIKPDSLC | TQAFNIGAL, QAFNIGALR, NIGALRNPK, DTQAFNIGA, EEDTQAFNI, TQAFNIGALR, DTQAFNIGAL, GEEDTQAFNI | CRC |
| CDH2 | c.2116C>A | p.P706T | PKVIEENKIRRDIKPDSLCLPRQRP[p.P706T]TMEDNTDIRDFIHQRLQENDVDPTAP | LCLPRQRPTM, RQRPTMEDNT | HNSC |
| CDH18 | c.2161G>T | p.A721S | KLTPRHQTSSTLESIDVQEFIKQRL[p.A721S]SEADLLDPSVPPYDSLQTYAYEGQRSE | FIKQRLSEA, KQRLSEADL, SEADLDPSV | LUAD |
| CDH18 | c.583G>A | p.A195T | EMSDMGTSVLQVTATDADDPTYGNS[p.A195T]TRVVYSILQGQPYFSVDPKTGVIRTA | STRVVYSIL, YGNSTRVVY, NSTRVVYSI, STRVVYSILQ | GBM |
| CDH20 | c.1639G>T | p.D547Y | QDPDRRTMQQNIRYTKLSDPANWLKI[p.D547Y]YPVNGQITTIAVLDRESPNVKNNIYN | KIYPVNGQI, DPANWLKIY, YPVNGQITT, YPVNGQITTI, LKIYPVNGQI | CRC |
| CDH20 | c.1298C>A | p.P433H | IQIISAKDPDVTNNSIRYSIDRSSD[p.P433H]HGRFFYVDITTGALMTARPLDREEFS | SSDHGRFFY, RSSDHGRFF, HGRFFYVDI, RSSDHGRFFY, SSDHGRFFYV, IDRSSDHGRF | LUAD |
| CDH23 | c.401C>T | p.A134V | IDDTTGDIHAIQRLDREERAQYTLR[p.A134V]VQALDRRTGRPMEPESEFIIKIQDIN | QYTLRVQAL, AQYTLRVQA, AQYTLRVQAL, YTLRVQALDR, R AQYTLRVQA, TLRVQALDRR | CRC |
| CDH23 | c.1207G>A | p.V403I | EGLNSMPEVLVGMNSHHFIISPTS[p.V403I]IQGKADIRIRVAIPLDYETVDRYDFD | HFIISPTSI, IQGKADIRI, IISPTSIQGK, HHFIISPTSI | STAD |
| CDH23 | c.3395T>A | p.F1132Y | ASVPEDIPEGHSILQLKATDADEGE[p.F1132Y]YGRVWYRILHGNHGNNFRIHVSNGLL | ATDADEGEY, EYGRVWYRI, YGRVWYRIL, DEGEYGRVW, EY GRVWYRII, KATDADEGEY, EGEYGRVWYR, GEYGRVWYRI, DEGEYGRVWY | KIRC |
| CDH23 | c.531C>A | p.F177L | FIVNATDPDLGAGGSVLYSFQPPSQ[p.F177L]LFAIDSARGIVTVIRELDYETTQAYQ | FQPPSQLFA, SFQPPSQLF, QLFAIDSAR, YSFQPPSQL, SQLFA IDSA, QPPSQLFAI, FQPPSQLFAI, LYSFQPPSQL, YSFQPPSQLF, SFQPPSQLFA, SQLFAIDSAR | CRC |
| CDH6 | c.709C>A | p.Q237K | SETGIKTALLNMDRENREQYQVVI[p.Q237K]KAKDMGGQMGGLSGTTTVNITLTDVN | KAKDMGGQM, REQYQWIKA, YQVVIKAKDM, IKAKDMGG QM | LUAD |
| CDH7 | c.673C>A | p.Q225K | PYFSVEPKTGVIKTALPNMDREAKD[p.Q225K]KYLLVIQAKDMVGQNGGLSGTTSVTV | KYLLVIQAK, EAKDKYLLV, REAKDKYLL, AKDKYLLVI, NMDRE AKDKY, EAKDKYLLVI, REAKDKYLLV | HNSC |
| CDH9 | c.1569C>A | p.F523L | ENAKPGQLIQTVSVMDKDDPPRGHK[p.F523L]LFFEPVPEFTLNPNFTIVDNKDNTAG | LFFEPVPEF, KLFFEPVPEF, RGHKLFFEPV | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CDHR1 | c.652A>G | p.R218G | QAGATLDYERSRTHYITVAKDGGG[p.R218G]GLHGADVVFSATTVTVNVED VQDMA | GLHGADVVF, GGLHGADVVF | MM |
| CDK1B | c.237_239 del\|AGA | p.E79 del\| | SPYRREDSMEDRGEEDDSLAIKPPQ[p.E79de\|]MSRKEKVHRKDEKRKEKCRHH SHSAEG | SLAIKPPQM, AIKPPQMSR, AIKPPQMSRK, LAIKPPQMSR | HNSC |
| CDK1 | c.2638C>A | p.R880S | DFGLARLYSSEESRPYTNKVITLWY[p.R880S]SPPELLLGEERRTPAIDVWSCGCIL G | TLWYSPPEL, LWYSPPELL, WYSPPELLI, ITLWYSPPEL, TLWY SPPELL, LWYSPPELLL | LUAD |
| CDK3 | c.322C>T | p.R108C | GSDGESDQASATSSDEVQSPVRVRM[p.R108C]CNHPPRKISTEDINKRLSLPADI RLP | RMCNHPPRK, RVRMCNHPP, RVRMCNHPPR, RMCNHPPR KI | CRC |
| CDK6 | c.4776C>G | p.H1592Q | LDEEHRRLREASGEWGKGQDPFRDL[p.H1592Q]QSLLMEIQALRLQLERSIETSS TLQS | RDLQSLLMEI, LQSLLMEIQA, DPFRDLQSLL | KIRC |
| CDK5 RAP2 | c.1226_1227 CA>TG | p.P409L | YKFPSLFINQFYPRPGTPAAKMEQV[p.P409L]LAQVKKQRTKDLSRVFHSYSPYD HKIG | KMEQVLAQV, AAKMEQVLA, AKMEQVLAQ, MEQVLAQVK, KMEQVLAQVK, LAQVKKQRTK, QVLAQVKKQR, TPAAKME QVL, AKMEQVLAQV | TGCT |
| CDKAL1 | c.247C>T | p.H83Y | RVAELLLHGAEPNCADPATLTRPV[p.H83Y]YDAAREGFLDTLVVLHRAGARLDV RD | VVDAAREGF, LTRPVYDAA, TLTRPVYDAA, LTRPVYDAAR, D PATLTRPVY | HNSC |
| CDKN2A | c.322G>T | p.D108Y | HDAAREGFLDTLVVLHRAGARLDVR[p.D108Y]YAWGRLPVLDLAEELGHRDVAR YLRAA | RYAWGRLPV, GARLDVRYA, AGARLDVRY, ARLDVRYAW, R AGARLDVRY, RLDVRYAWGR, GARLDVRYAW, VRYAWGRL PV, YAWGRLPVDL | LUSC |
| CDKN2A | c.92T>C | p.V31A | DVDFLEDVPLLEDIPLLED[p.V31A]APLLEDTSRLEDINLMEDMALLEDV D | PLLEDAPLL, VPLLEDAPL, APLLEDTSRL, LEDVPLLEDA, VPLL EDAPLL | KIRP |
| CDR1 | c.179C>G | p.A60G | VSAPDGPSDPSLSVSSEQSGAQQPP[p.A60G]GLQVERIVDKRKNKKGKTEYLVR WKG | AQQPPGLQV, AQQPPGLVQE | TGCT |
| CDYL | c.1918C>A | p.L640I | CHSASNPSPQYSWRINGIPQQHTQV[p.L640I]IFIAKITPNNNGTYACFVSNLATG RN | HTQVIFIAK, IPQQHTQVI, PQQHTQVIF, QQHTQVIFI, TQVIF IAKI, HTQVIFIAKI, IPQQHTQVIFIA | CRC |
| CEACAM5 | c.925G>C | p.A309P | YLNPMAAFAAAQMQQMAALNMNGL A[p.A309P]PAPMTPTSGGSTPPGITAP AVPSIPS | APAPMTPTS, LNMNGLAPA, MNGLAPAPM, ALNMNGLAP A, GLAPAPMTPT, NMNGLAPAPM | LUAD |
| CELF4 | c.1841del\|G | p.G614fs | AVDADSGENARLHYRLVDTASTFLG[p.G614fs]AAALGLRILPPPLTSPSRSTTAP VGSQCVPSWTARRWSTTASGWRRWT TARPP* | FLGAAALGL, STFLGAAAL, STTASGWRR, GLRILPPPL, PSRST TAPV, TARRWSTTA, SGWRRWTTA, GWRRWTTAR, CVPSW TARR, DTASTFLGA, TASTFLGAA, GAAALGLRI, AAALGLRIL, VGSQCVPSW, SQCVPSWTA, RRWSTTASG, RWSTTASGW, RRWTTARPP, VPSWTARRW, ILPPPLTSPS, TFLGAAALGL, R WSTTASGWR, ASGWRRWTTA, SGWRRWTTAR, SQCVPS WTAR, DTASTFLGAA, TASTFLGAAA, TTAPVGSQCV, WTAR RWSTTA, SPSRSTTAPV, ASTFLGAAAL, GAAALGLRIL, RRWS TTASGW | STAD |
| CELSR1 | c.34_35ins CGC | p.16_17 insP | MRSPATGVPLTPPPP[p.16_17insP]P LLLLLLLLPPPLLGDQVGPCRSLGSR | LPTPPPPPL, TPPPPPLL, LPTPPPLL, TPPPPLLL | ACC |
| CELSR2 | c.50T>C | p.L17P | MRSPATGVPLTPPPP[p.L17P]PLLLLL LLLPPPLLGDQVGPCRSLGS | LPTPPPPPL, TPPPPPLL, LPTPPPLL, TPPPPLLL | TGCT |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CEP15 2 | c.61G>A | p.E21K | MSLDFGSVALPVQNEDEEYD[p.E21K]KEDYEREKELQQLLTDLPHDMLDDDL | KEDYEREKEL | CRC |
| CEP19 2 | c.6173C>T | p.S205 8L | TEVYDLPQRPNDVQLFYGSMCKIIL[p.S2058L]IVIGEFRDCISSREFLQPSSKASLE S | SMCKIIILLV, IILLVIGEF, GSMCKIIILLV, SMCKIIILVI, IILLVIGEFR, KIILLVIGEF | BLCA |
| CEP44 | c.758C>T | p.S253 L | VNVNPEITALQTMLAECQENLKKLT[p.S253L]LIEKRLDCLEQKMKGKVMDENTWTN | QENLKKLTL, TLIEKRLDCL, NLKKLITLIEK, CQENLKKLTL, KKLTLIEKRL, QENLKKLTLI | UCEC |
| CERCAM | c.254_260del CGGCTGT | p.A85 fs | RARMALWCATDHNVDNTTEMLQEWL[p.A85fs]GAMTMLLWSGGLRASPGSTQMKRVPSTGPKKGTSF* | MLQEWLGAM, WLGAMTMLL, TMLLWSGGL, LLWSGGLRA, MLLWSGGLR, RVPSTGPKK, RASPGSTQM, STQMKRVPS, MTMLLWSGG, TQMKRVPST, LQEWLGAMT, QEWLGAMTM, LGAMTMLLW, MLQEWLGAMT, MTMLLWSGGL, MLL WSGGLRA, TMLLWSGGLR, RASPGSTQMK, EWLGAMTML L, WLGAMTMLLW, MKRVPSTGPK, EMLQEWLGAM, LQEW LGAMTM, QEWLGAMTML, LRASPGSTQM, TQMKRVPSTG, EMLQEWLGA | KIRC |
| CERS3 | c.285G>T | p.E95D | FVASPLAKSFGIKETVRKVTPNTVL[p.E95D]DNFFKHSTRQPLQTDIYGLAKKCNL T | NTVLDNFFK, TVLDNFFKH, DNFFKHSTR, TPNTVLDNF, VTP NTVLDNF, TPNTVLDNFF | CRC |
| CETN3 | c.189delA | p.K63 fs | TDKDEAIDYHELKVAMRALGFDVKK[p.K63fs]LMY* | GFDVKKLMY, LGFDVKKLM, LGFDVKKLMY, RALGFDVKKL | STAD |
| CFB | c.940_941C G>AT | p.R314 M | INVSVAIITFASEPKVLMSVLNDNS[p.R314M]MDMTEVISSLENANYKDHENGTGTNTY | VLNDNSMDM, NSMDMTEVI, MSVLNDNSM, LMSVLNDNS M, VLNDNSMDMT, MDMTEVISSL | SKCM |
| CFDP1 | c.386_387i nsC | p.P129 fs | ARKKKEDELWASFLNDVGPKSKVPP[p.P129fs]KYTS* | GPKSKVPPK, KSKVPPKYT, KSKVPPKYTS | LUAD |
| CFHR5 | c.1322G>A | p.R441 H | LCKENYLLPEAKEIVCKDGRWQSLP[p.R441H]HCVESTAYCGPPPSINNGDTTSF PLS | SLPHCVEST, RWQSLPHCV, LPHCVESTA, SLPHCVESTA, LPH CVESTAY, GRWQSLPHCV, WQSLPHCVES | CESC |
| CFI | c.111delA | p.K37 fs | CFHLRFCKVTVTSQEDLVEKKCLAK[p.K37fs]NILTSPAIKSSASHGRDALRAPVFVNYRISAQRMALQCVQLTGEASQHTVNKRVWNVFIQGQSF* | RMALQCVQL, TVNKRVWNV, AQRMALQCV, NILTSPAIK, A SHGRDALR, RAPVFVNYR, RISAQRMAL, LRAPVFVNY, VNYR ISAQR, DALRAPVFV, SPAIKSSAS, SASFIGRDAL, APVFVNYRI, NVFIQGQSF, KKCLAKNIL, AKNILTSPA, KNILTSPAI, RDALR APVF, YRISAQRMA, SQHTVNKRV, VNKRVWNVF, RMALQC VQLT, ALRAPVFVNY, FVNYRISAQR, RAPVFVNYRI, TVNKRV WNVF, LAKNILTSPA, KNILTSPAIK, AIKSSASHGR, KSSASHG RDA, HGRDALRAPV, SASHGRDALR, EASQHTVNKR, LTSPAI KSSA, LTGEASQHTV, HTVNKRVWNV, SPAIKSSASH, SSASH GRDAL, AKNILTSPAI, GRDALRAPVF, VNYRISAQRM, YRISA QRMAL, QRMALQCVQL, VQLTGEASQH, SQHTVNKRVW, WNVFIQGQSF, VEKKCLAKNI | STAD |
| CGB8 | c.52A>G | p.T18A | MEMFQGLLLLLLLSMGG[p.T18A]AWASREMLRPRCRPINATLAVEKEGC | AWASREMLR, GGAWASREM, GAWASREML, GAWASREM LR, MGGAWASREM | BLCA |
| CHCH D4 | c.236C>T | p.T79M | PCLGGMASGPCGEQFKSAFSCFHYS[p.T79M]MEEIKGSDCVDQFRAMQECM QKYPDL | AFSCFHYSM, SAFSCFHYS, CFHYSMEEIK, MEEIKGSDCV | HNSC |
| CHD3 | c.1789delC | p.P597 fs | WRWGEPPVAVPAPQQADGNPDVPPP[p.P597fs]VLFKADQSESSLSSG* | NPDVPPPVL, KADQSESSL, VPPPVLFKA, DVPPPVLFKA, FKA DQSESSL, NPDVPPPVLF | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CHD4 | c.2924G>A | p.R975H | LGPHMLRRLKADVFKNMPSKTELIV[p. R975H]HVELSPMQKKYYKILTRNFEAL NAR | HVELSPMQK, IVHVELSPM, TELIVHVEL, HVELSPMQKK, LIV HVELSPM, MPSKTELIVH, ELIVHVELS | CRC, UCEC |
| CHD5 | c.2401G>A | p.A801T | YVVTYTGDKESRSVIRENEFSFEDN[p.A 801T]TIRSGKKVFRMKKEVQIKFHVLLT SY | FSFEDNTIR, NTIRSGKKV, TIRSGKKVFR, EFSFEDNTIR, NTIR SGKKVF, NEFSFEDNTI | CRC |
| CHDH | c.119A>C | p.E40A | ARGALGQQQSLGARALASAGSESRD[p. E40A]AYSYVVVGAGSAGCVLAGRLTED PAE | AGSESRDAY, SESRDAYSY, ESRDAYSYV, RDAYSYVV, GSES RDAYSY, ESRDAYSYVV, DAYSYVVGA, SAGSESRDAY, SESR DAYSYV | ACC |
| CHEK2 | c.1116_1117 CA>TG | p.K373E | LKPENVLLSSQEEDCLIKITDFGHS[p.K3 73E]EILGETSLMRTLCGTPTYLAPEVLVS V | ITDFGHSEI, EILGETSLM, SEILGETSL, TDFGHSEIL, KITDFGHSEI, EILGETSLMR, SEILGETSLM | GBM |
| CHEK2 | c.1117A>G | p.K373E | LKPENVLLSSQEEDCLIKITDFGHS[p.K3 73E]EILGETSLMRTLCGTPTYLAPEVLVS | ITDFGHSEI, EILGETSLM, SEILGETSL, TDFGHSEIL, KITDFGHSEI, EILGETSLMR, SEILGETSLM | KIRC, PRAD, UCS |
| CHIT1 | c.851_852i nsC | p.P284fs | LILGMPTYGRSFTLASSSDTRVGAP[p.P 284fs]SHRVWHSRPLHQGRRDAGLL* | RVWHSRPLH, RVGAPSHRV, HSRPLHQGR, PSHRVWHSR, H RVWHSRPL, VGAPSHRVW, HQGRRDAGL, RVWHSRPLHQ, HSRPLHQGRR, DTRVGAPSHR, RPLHQGRRDA, SHRVWHS RPL, RVGAPSHRVW, HQGRRDAGLL | KIRC |
| CHN1 | c.792G>C | p.K264N | CGLNVHQCSKMVPNDCKPDLKHVK[p. K264N]NVYSCDLTTLVKAHTTKRPM VVDMCI | DLKHVKNW, VKNVYSCDL, NVYSCDLTTL, HVKNVYSCDL | LUAD |
| CHN2 | c.129C>G | p.I43M | AEEYQPPIWKSYLYQLQQEAPRPKR[p. I 43M]MICPREVENRPKYYGREFHGIISR EQ | RPKRMICPR, APRPKRMIC, QEAPRPKRM, KRMICPREV, RM ICPREVE, MICPREVENR, QQEAPRPKRM | LUSC |
| CHRNA3 | c.67_69de|CTG | p.L23del | MGSGPLSLPLAL|SPPRLLLLL[p.L23 de|SLLPVARASRAEHRLFERLFEDY NEIIR | RLLLLLLSL, RLLLLLLSLL | BLCA |
| CHRNA4 | c.1188C>G | p.S396R | LIESMHKMASAPRFWEPEGEPPAT[p. S396R]RGTQSLHPPSPSFCVPLDVPAEP GPS | ATRGTQSLH, PPATRGTQSL | LUAD |
| CHRNA9 | c.1082C>A | p.P361Q | WARVVILKYMSRVLFVYDVGESCLS[p.P 361Q]QHHSRERDHLTKVYSKLPESNLK AAR | ESCLSQHHSR, CLSQHHSRER, SQHHSRERDH, GESCLSQHH S | LUAD |
| CIC | c.1521de|C | p.R507fs | PEGNKGFGPGRKVFSPVIRSSFTHCRP[p.R 507fs]HWTLSPQGPRILL* | TLSPQGPRI, WTLSPQGPR, SFTHCRPH, SSFTHCRPH, RPH WTLSPQ, SPQGPRILL, FTHCRPHWTL, RSSFTHCRPH, HWTL SPQGPR, WTLSPQGPRI, SSFTHCRPHW | STAD |
| CIC | c.3341_3342 insG | p.A1114fs | ITAFYSGSPAPTSSAPLAQPSQAPP[p.A 1114fs]KPGLHCGHQHNPTCSHHSAQ GPASPCHCHPSPD* | AQPSQAPPK, SQAPPKPGL, HQHNPTCSH, SHHSAQGPA, A QGPASPCH, NPTCSHHSA, LAQPSQAPPK, SQAPPKPGLH, H QHNPTCSHH | STAD |
| CIC | c.3341 de|C | p.A1114fs | VITAFYSGSPAPTSSAPLAQPSQAP[p.A 1114fs|QAWSTLWPPAQPHLQPPFCP RARQPLPLPQPRLALSPAPQVP* | ALSPAPQQV, HLQPPFCPR, LWPPAQPHL, AWSTLWPPA, R ARQPLPLP, LPLPPQPRL, LPPQPRLAL, QPRLALSPA, AQPHL QPPF, SQAPQAWST, TLWPPAQPH, QPSQAPQAW, APQA WSTLW, TLWPPAQPHL, SQAPQAWSTL, HLQPPFCPRA, RA RQPLPLPP, CPRARQPLPL, AQPSQAPQAW, QAWSTLWPP A, LPLPPQPRLA, LALSPAPQQV | STAD |
| CIITA | c.2182G>A | p.E728K | AESELAFPSFLLQCPLGALWLALSG[p.E7 28K]KIKDKELPQYLALTPRKKRPYDNW LE | ALWLALSGK, LWLALSGKI, ALWLALSGKI, GALWLALSGK, L WLALSGKIK, KIKDKELPQY | UCEC |

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CILP2 | c.1657G>A | p.V553M | VTFVDPSGEFMDAVRVLPFDPRGAG[p.V553M]MYHEVKAMRKKAPVILHTSQSNTIPL | GMYHEVKAM,MYHEVKAMR,RGAGMYHEVK,MYHEVKAMRK,GMYHEVKAMR,LPFDPRGAGM,AGMYHEVKAM | GBM |
| CIRH1A | c.749G>T | p.S250I | TGTLVKSHLIANADVQSIAVADQED[p.S250I]IFVVGTAEGTVFHFQLVPVTSNSSEK | AVADQEDIFV,IAVADQEDIF,QEDIFVVGTA | HNSC |
| CIZ1 | c.2003T>C | p.V668A | SEPQHQGRLGEIQHMSQACLLSLLP[p.V668A]APRDVLETEDEEPPPRRWCNTCQLYY | SLLPAPRDV,LLSLLPAPR,CLLSLLPAPR,SLLPAPRDVL,LPAPRDVLET | CRC |
| CIZ1 | c.266T>C | p.L89P | QLLQLQOLLQQSPPQAPLPMAVSRG[p.L89P]PPPQQPQQPLLNLQGTNSASLLNGSM | LPMAVSRGPP | GBM |
| CKAP2 | c.2050T>A | p.*684K | GRETDAFVCRPNAALCRVYYEADTT[p.*684K]KEK* | RVYYEADTTK | CLL |
| CKAP5 | c.1727G>C | p.G576A | AGGPPKKGKPAAPGGAGNTGTKNKK[p.G576A]ALETKEIVEPELSIEVCEEKASAVLP | KNKKALETK,KKALETKEI | TGCT |
| CLCN2 | c.1934_1935insCCG | p.645_645R>RR | ILLGSIERSQVVALLGAQLSPARRR[p.645_645R>RR]RQHMQERRATQTSPLSDQEGPPTPEASV | QLSPARRRR,SPARRRRQ,RRRRQHMQER,SPARRRRQHM | KIRC |
| CLCNKA | c.371C>A | p.P124Q | YPVALVSFSSGFSQSITPSSGGSGI[p.P124Q]QELKTMLAGVILEDYILDIKNFGAKVV | SGIQELKTM,QELKTMLAGV,QELKTMLAG | LUAD |
| CLDN23 | c.628G>A | p.V210M | CDERCRRRKGPSAGPRRSSVSTIQ[p.V210M]MEWPEPDLAPAIKYYSDGQHRPPPAQ | RSSVSTIQM,IQMEWPEPD,MEWPEPDLA,IQMEWPEPDL,RRSSVSTIQM,SVSSTIQMEW,MEWPEPDLAP | ACC |
| CLDN7 | c.514T>G | p.S172A | DFYNPLIPTNIKYEFGPAIFIGWAG[p.S172A]AALVIGGALLSCSCPGNESKAGYRV | AIFIGWAGA,FIGWAGAAL,GWAGAALVI,FIGWAGAALV,A IFIGWAGA,IFIGWAGAAL,GWAAGAALVIL,IGWAGAALVI | KIRP |
| CLEC12B | c.650G>T | p.W217L | MSQPLLMFSFFWLGLSWDSSGRSWF[p.W217L]LEDGSVPSPSLFSTKELDQINGSKGC | FLEDGSVPS,DSSGRSWFL,RSWFLEDGSV | LUAD |
| CLEC18A | c.1268G>A | p.R423H | GQPDNHGFGNCVELQASAAFNWNNQ[p.R423H]HCKTRNRYICQFAQEHISRWGPGS* | NQHCKTRNR,AAFNWNNQH,AFNWNNQPICK,NWNNQHCKTR,NQHCKTRNRY | CRC |
| CLEC4A | c.626G>A | p.R209H | YNESSTFWHPREPSDPNERCVVLNF[p.R209H]HKSPKRWGWNDVNCLGPQRSVCEMMK | VLNFHKSPK,RCVVLNFHK,LNFHKSPKR,VVLNFHKSPK,VLNFHKSPKR,LNFHKSPKRW,NERCVVLNPH | PRAD |
| CLEC4C | c.536G>T | p.R179L | QWVDQTPYNENVTFWHSGEPNNLDE[p.R179L]LCAIINFRSSEEWGWNDIHCHVPQKS | NLDELCAII,ELCAIINFR,DELCAIINF,GEPNNLDEL | LUSC |
| CLIC6 | c.892C>G | p.Q298E | EGPAGDSMDAEGPAGRARRVSGEPQ[p.Q298E]ESGDGSLSPQAEAIEVAAGESAGRSP | EPQESGDGSL | ACC |
| CLIP1 | c.3052_3053insA | p.S1018fs | AAKKHEEKKELERKLSDLEKKMET[p.S1018fs]KPQPVSGAESQV* | KMETKPQPV,METKPQPVS,ETKPQPVSGA,KKMETKPQPV | BLCA,KIRP |
| CLK4 | c.203G>T | p.R68L | CKPHHQFKESDCHYLEARSLNERDY[p.R68L]LDRRYVDEYRNDYCEGYVPRHYHRDI | RSLNERDYL,LDRRYVDEY,RDYLDRRYV,YLDRRYVDEY,SLNERDYLDR,NERDYLDRRY | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CLN3 | c.616G>A | p.G206S | ISWWSSGTGGAGLLGALSYLGLTQA[p.G206S]SLSPQQTLLSMLGIPALLLASYFLLL | YIGLTQASL,SLSPQQTLL,ASLSPQQTL,SYLGLTQASL,LSYLG LTQAS,ASLSPQQTLL | LUSC |
| CLSTN1 | c.1844C>T | p.T615M | LEGEDLGELDKAMQHISYLNSRQFP[p.T615M]MPGIRRLKITSTIKCFNEATCISVP | YLNSRQFPM,RQFPMPGIR,QFPMPGIRR,FPMPGIRRL,MP GIRRLKI,RQFPMPGIRR,SYLNSRQFPM,NSRQFPMPGI | STAD |
| CLSTN2 | c.2276C>T | p.P759L | YSIYGVGSMSRYEQVLHHIRYRNWR[p.P759L]LASLEARRFRRIKCSELNGRYTSNE FN | HIRYRNWRL,RYRNWRLAS,RLASLEARR,YRNWRLASL,LAS LEARRF,RYRNWRLASL,HIRYRNWRLA,RLASLEARRF,NWR LASLEAR,LASLEARRFR,HHIRYRNWRL,RNWRLASLEA | HNSC |
| CLUL1 | c.1387G>C | p.G463R | SELANQAPETEIIFNSIQVVPRIHE[p.G463R]RNISKQDETMTDLSILPSSNFTLKI | RIHERNISK,QVVPRIFIER,VPRIHERNI,RNISKQDETM | KIRC |
| CMA1 | c.242T>A | p.I81K | IRRNFVLTAAHCAGRSITVTLGAHN[p.I81K]KTEEEDTWQKLEVIKQFRHPKYNTST | TVTLGAHNK,ITVTLGAHNK,KTEEEDTWQK | CLL |
| CMAS | c.329G>A | p.R110Q | FQSVWVSTDHDEIENVAKQFGAQVH[p.R110Q]QRSSEVSKDSSTSLDAIIEFLNYHNE | HQRSSEVSK,QFGAQVHQR,KQFGAQVHQ,AQVHQRSSEV, KQFGAQVHQR | CRC |
| CMIP | c.688G>A | p.A230T | EIVSKLLSENTNLTTQEHENIIVAI[p.A230T]TPLLENNHPPDLCEFFCKHCRERPR | IIVAITPLL,NIIVAITPL,HENIIVAIT,NIIVAITPLL | CLL |
| CMTM8 | c.77G>C | p.S26T | MEEPQRARSHTVTTASSFAENFST[p.S26T]TSSSFAYDREFLRTLPGFLIVAEIVL | STTSSSFAY,TSSSFAYDR,FSTTSSSFA,AENFSTTSS, NSSFAENFST,FSTTSSSFAY,TSSSFAYDR,ENFSTTSSSF, SSFAENFSTT,AENFSTTSSS | TGCT |
| CNBD1 | c.1187T>C | p.L396P | RSIIGFVKLRSNKVKRSQKLVYMGK[p.L396P]PKEKESFGEISVLLQVPFTCTIITKK | KLVYMGKPK,LVYMGKPEK,MGKPKEKESF | STAD |
| CNGA4 | c.1529A>C | p.K510T | AEIALQEATESRLRGLDQQLDDLQT[p.K510T]TFARLLAELESSALKIAYRIERLEWQ | TFARLLAEL,QLDDLQTTF,LQTTFARLL,QLDDLQTTFA,TTFA RLLAEL,QOLDDLQTTF,LQTTFARLLA | STAD |
| CNKSR2 | c.746C>T | p.P249L | SEGLGMYIKSTYDGLHVITGTTENS[p.P249L]LADRCKKIHAGDEVIQVNHQTVVGWQ | SLADRCKKI,NSLADRCKK | TGCT |
| CNOT3 | c.58G>A | p.E20K | MADKRKLQGEIDRCLKKVS[p.E20K]KGVEQFEDIWQKLHNAANANQKEKYE | CLKKVSKGV,KVSKGVEQF,KKVSKGVEQF | PRAD |
| CNOT6 | c.744del|T | p.S248fs | QEILSCNADIVSLQEVETEQYYSFF[p.S248fs]W* | TEQYYSFFW | STAD |
| CNRIP1 | c.304C>T | p.R102W | EPDGDRMYTGTYDTEGVTPTKSGE[p.R102W]WQPIQITMPFTDIGTFETVWQVKFYN | EWQPIQITM,TKSGEWQPI,GEWQPIQIT,WQPIQITMPF,G EWQPIQITM | CRC |
| CNTFR | c.754G>T | p.D252Y | QTPSTWPDPESSPLKFFLRYRPLIL[p.D252Y]YQWQHVELSDGTAHTITDAYAGKEYI | LILYQWQHV,YRPLLIYQW,LYQWQHVEL,RYRPLLILYQ,LRYR PLILY,YQWQHVELS,ILYQWQHVEL,PLILYQWQHV,FLRYR PLILY,RYRPLLILYQ,YQWQHVELSD | LUAD |
| CNTN5 | c.1136C>T | p.S379F | LEIPNVQLDDAGIYECRAENSRGKN[p.S379F]FFRGQLQVTYPHHVEKLNDTQLDSG | NSRGKNFFR,FFRGQLQVY,AENSRGKNF,GKNFFRGQL,RG KNFFRGQL,KNFFRGQLQV,NFFRGQLQVY,ENSRGKNFFR, RAENSRGKNF,AENSRGKNFF | SKCM |
| CNTN5 | c.533C>A | p.T178N | IDGTFIISNPSEAKDSGHYQCLATN[p.T178N]NVGSILSREATLQFAYLGNFSGRTRS | YQCLATNNV,LATNNVGSI,CLATNNVGSI,HYQCLATNNV,Y QCLATNNVG,LATNNVGSIL | LUSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CNTN6 | c.2420G>T | p.R807M | NNEGEGSLSTVTIVYSGEDEPQLAP[p.R807M|MGTSLQSFSASEMEVSWNAIA WNRNT | QLQPMGTSL,PMGTSLQSF,APMGTSLQSF,GEDEPQLAPM, PQLAPMGTSL | LUAD |
| CNTNAP1 | c.3086G>T | p.S1029I | EPGTWMRYNLQSALRSAAREFSHML[p.S1029I]IRPVPGYEPGYIPGYDTPGYVP GYHG | FSHMLIRPV,MLIRPVPGY,REFSHMLIR,AAREFSHMLI,HM LIRPVPGY,EFSHMLIRPV,REFSHMLIRP | PRAD |
| CNTNAP2 | c.1185C>A | p.F395L | EPYTVPFFNATSYLEVPGRLNQDL[p.F395L]LSVSFQFRTWNPNGLLVFSHFAD NLG | RLNQDLLSV,LLSVSFQFR,DLLSVSFQF,NQDLLSVSF,LLSVSF QFRT,DLLSVSFQFR,LNQDLLSVSF,QDLLSVSFQF | LUAD |
| CNTNAP4 | c.1307A>C | p.Y436S | LFSELQLISGGILLFLSDGKLKSNL[p.Y436S]SQPGKLPSDITAGVELNDGQWHSV SL | KSNLSQPGK,KLKSNLSQPG,KSNLSQPGKL | KIRC |
| CNTNAP4 | c.34A>T | p.I12F | MLLFYLLVVLS[p.I12F]FDSTKASALTNPNVALFLLADDCDDP | VLSFDSTKA,VVLSFDSTK,FYLLVVLSF,FDSTKASAL,LVVLSF DSTK,LFYLLVVLSF,LSFDSTKASA | CLL |
| CNTRL | c.553C>T | p.P185S | SKIEGIENMCNLQKLNLAGNEIEHI[p.P185S]SVWLGKKLKSLRVLNLKGNKISSLQ D | HISVWLGKK,SVWLGKKLK,EIEHISVWL,NEIEHISVW,ISVW LGKKL,ISVWLGKKLK,NEIEHISVWL | CESC |
| CNTROB | c.2759_2760 insG | p.R920fs | PKTEKPPARKKSGHPAPSSMRSRGG[p.R920fs]SLEMSPPTLSPLCSLIVILINAH* | TLSPLCSLI,SMRSRGGSL,MSPPTLSPL,RSRGGSLEM,SPLCS LIVV,SLEMSPPTL,LEMSPPTLS,TLSPLCSLIV,SLVVILINA, EMSPPTLSPL,SMRSRGGSL,SMRSRGGSLE,RSRGGSLEMS, SPLCSLIVVI,MRSRGGSLEM,GSLEMSPPTL,LEMSPPTLSP IDNNSTASY,RIDNNSTASY,IDNNSTASYL | STAD |
| COBLL1 | c.2196A>C | p.K732N | DPLTVKDPICAHGNDDLLPPVDRID[p.K732N]NNSTASYLKNYPLYRQDYNPKPK PSN | | CRC |
| COG5 | c.1850A>G | p.H617R | TKVVSSQSSFPLAAEQTIISALKA[p.H617R]RALMENAVQPLLTSVGADIEAIITM STVGALNKIGTDGTQVAMVQFTDDP[p.R1082I]ITEFKLNAYKTKETLLDAIKHISY KG | ALKAIRALM,AIRALMENA,IISALKAIR,SALKAIRAL, AIRALMENAV,SALKAIRALM,TIISALKAIR,ISALKAIRAL FTDDPITEF,ITEFKLNAY,MVQFTDDPI,VQFTDDPIT,FTDDP ITEFK,AMVQFTDDPI,ITEFKLNAYK,QFTDDPITEF | TGCT |
| COL14A1 | c.3245G>T | p.R108I | | | CRC |
| COL15A1 | c.2123A>G | p.K708R | ARGPNGSVGEKGDPGNRGLPGPPGK[p.K708R]RGQAGPPGVMGPPGPGPP GPPGPGC | RGQAGPPGVM | TGCT |
| COL18A1 | c.2652de|C | p.G884fs | DRGSRGEKGDPGKDGVGQPGLPGPP[p.G884fs]DPRDLWSTCRSRTDPS* | DLWSTCRSR | KIRP |
| COL19A1 | c.1613C>A | p.P538Q | GPPGLIGSPGLKGQQQSAGSMGPRG[p.P538Q]QPGDVGLPGEHGIPGKQGLKG EKGDP | GPRGQPGDV | LUAD |
| COL4A6 | c.16480A | p.L550I | GPAGAPGLVGPLGPSGPKGKKGEPI[p.L550I]ISTIQGMPGDRGDSGSQGFRGV IGEP | KGKKGEPII,KKGEPIISTI,EPIISTIQGM | CRC |
| COL5A2 | c.1546G>T | p.G516W | QGPIGPPGEEGKRGPRGDPGTVGPP[p.G516W]WPVGERGAPGNRGFPGSDGL PGPKGA | GTVGPPWPV,DPGTVGPPW | LUAD |
| COL5A2 | c.1834G>T | p.G612W | LGPLGAPGEDGRPGPPGSIGIRGQP[p.G612W]WSMGLPGPKGSSGDPGKPGE AGNAGV | WSMGLPGPK,SIGIRGQPW,RGQPWSMGL,QPWSMGLPG, GSIGIRGQPW,IGIRGQPWSM | LUAD |
| COL6A3 | c.7133C>A | p.A2378D | GQKGDPGYPGAPGPKGNRGDSIDQC[p.A2378D]DLIQSIKDKCPCCYGPLECPV FPTEL | DSIDQCDLI | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| COL6A3 | c.8374G>A | p.D2792N | YFFVVLGIGRKVNIKEVYTFASEPN[p.D2792N]NVFFKLVDKSTELNEEPLMRFGRLLP | NVFFKLVDK, FASEPNNVF, ASEPNNVFF, EPNNVFFKL, YTFASEPNNV, ASEPNNVFFK, TFASEPNNVF, FASEPNNVFF, EPNNVFFKLV, SEPNNVFFKL | CRC |
| COL6A5 | c.6671C>T | p.T2224M | QEDFLGGNGFIGQELNSGRESPFVK[p.T2224M]MEDNGSDYLVLYLPSQMFEPQKLMINY | KMEDNGSDY, MEDNGSDYL, KMEDNGSDYL, SGRESPFVK, M, VKMEDNGSDY, MEDNGSDYLV | GBM |
| COL9A1 | c.632C>A | p.P211Q | GVERSSATLFVDCNRIESLPIKPRG[p.P211Q]QIDIDGFAVLGKLADNPQVSVPFELQ | QIDIDGFAV, GQIDIDGFA, LPIKPRGQI, GQIDIDGFAV | LUAD |
| COL9A1 | c.848del C | p.P283fs | RITPSQTTDERGPPGPGQGPGPGP[p.P283fs]LEFQASMASTVTEVLRAPRAPRVLQVNRESQELQASLAHLALMD* | FQASMASTV, SMASTVTEV, ELQASLAHL, LQASLAHLA, VLRAPRAPR, ASLAHLALM, VTEVLRAPR, MASTVTEVL, ESQELQASL, GPLEFQASM, LEFQASMAS, RESQELQAS, QELQASLAH, QASLAHLAL, TEVLRAPRA, ASMASTVTEV, SMASTVTEVL, L QASLAHLAL, FQASMASTVT, VLRAPRAPRV, ELQASLAHLA, MASTVTEVLR, TVTEVLRAPR, EVLRAPRAPR, ESQELQASLA, APPRAPRVLQV, LEFQASMAST, LRAPRAPRVL, LQVNRESQE L, RESQELQASL, SQELQASLAH, QELQASLAHL, QASLAHLALM | STAD |
| COPB1 | c.1273C>T | p.R425C | NVIPVLMEFLSDNNEAAAADVLEFV[p.R425C]CEAIQRFDNLRMLIVEKMLEVFHAIK | EFVCEAIQR, DVLEFVCEA, FVCEAIQRF, EFVCEAIQRF, DVLEFVCEAI, CEAIQRFDNL | CRC |
| COQ2 | c.196G>T | p.V66L | SFALARAAGAPHGGDLQPPACPEPR[p.V66L]WRQLSLSAAAVVDSAPRPLQPYLRLM | RWRQLSLSA, CPEPRWQL, EPRWRQLSL, WRQLSLSAA, R WRQLSLSAA, WRQLSLSAAA, QPPACPEPRW | ACC |
| CORO2A | c.1576T>A | p.*526R | LTQREVQAKQLELEIKNLRMGSEQL[p.*526R]RAETSALLTLRDTTRLHGEV* | QLRAETSAL, TLRDTTRLH, ETSALLTLR, LLTLRDTTR, DTTRLH GEV, LRAETSALL, AETSALLTL, SEQLRAETS, QLRAETSALL, LLTLRDTTRL, NLRMGSEQLR, SEQLRAETSA, EQLRAETSAL, RA ETSALLTL | CRC |
| COX15 | c.256C>A | p.L86I | PSKAABRVVGRWLLVCSGTVAGAVI[p.L86I]IGGVTRLTESGLSMVDWHLIKEMKPP | VIIGGVTRL | CRC |
| COX6A1 | c.23C>T | p.S8L | MAVVGVS[p.S8L]LIVSRLLGRSRPQLGRPMSSGAHGEEG | MAVVGVSLIV, SLVSRLLGR, AVVGVSLVSR, VSLVSRLLGR, LV SRLLGRSR | BLCA |
| CPAMD8 | c.2352de1 C | p.P784fs | TDEAVPAFQPHTGSLVAVAPSRHPP[p.P784fs]EQRREKGLSSPKHGFGIVSTSVTHLVRGHSV* | IVSTSVTHL, STSVTHLVR, REKGLSSPK, VSTSVTHLV, SPKHG FGIV, GLSSPKHGF, IVSTSVTHLV, GIVSTSVTHL, VSTSVTHLV R, VTHLVRGHSV, HGFGIVSTSV, KGLSSPKFGF, FGIVSTSVT H | STAD |
| CPE | c.869C>A | p.P290Q | SAHEYSSSPDDAIFQSLARAYSSFN[p.P290Q]QAMSDPNRPPCRKNDDDSSFVDGTTN | RAYSSFNQA, AYSSFNQAM, RAYSSFNQAM | LUAD |
| CPNE8 | c.381G>T | p.Q127H | SKSPNLSKHDFPLGQVFCTLGEIVGS[p.Q127H]HGSRLLEKPIVGIPGKKCGTILITAE | GSHGSRLEK, EIVGSHGSR, GEIVGSHGS, VGSHGSRLEK, EIV GSHGSRL | LUAD |
| CPS1 | c.2564C>A | p.T855K | TPRLPMNKEWPSNLDLRKELSEPSS[p.T855K]KRIYAIAKAIDDNMSLDEIEKLTYID | SSKRIYAIA, SKRIYAIAK, ELSEPSSKR, SEPSSKRIY, LSEPSSKRIY, SSKRIYAIAK, EPSSKRIYAI, KRIYAIAKAI | LUSC |
| CPSF4 | c.656C>A | p.P219Q | NPPLQRSSSLIQLTSQNSSPNQQRT[p.P219Q]QQVIGVMQSQNSSAGNRGPRPLEQVT | RTQQVIGVM, NQQRTQQVI, SPNQQRTQQV, QQRTQQVIG V, QRTQQVIGVM | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CR1L | c.237del A | p.L79 fs | PIGTYLNYECRPGYSGRPFSIICLK[p.L79 fs]TQSGQVLRTSANVNHVILQIL* | CLKTQSGQV,QVLRTSANV,RTSANVNHV,KTQSGQVLR,TS ANVNHVV,LKTQSGQVL,SANVNHVVI,ANVNHVVIL,,GQVL RTSANV,RTSANVNHVV,TSANVNHVVI,NVNHVVILQI,CLK TQSGQVL,SANVNHVIL | STAD |
| CR2 | c.618del C | p.V206 fs | ESGYLLVGEKIINCLSSGKWSAVPP[p.V 206fs]HVKRHAVNL* | WSAVPPHVK,KWSAVPPHV,HVKRHAVNL,SAVPPHVKR,P PHVKRHAV,GKWSAVPPH,SGKWSAVPPH,KWSAVPPHVK, WSAVPPHVR,VPPHVKRHAV,GKWSAVPPHV | STAD |
| CRB1 | c.1883del T | p.L628 fs | SICAFQNSFLGGLPVGMTSNGVALL[p.L 628fs]TSIICHPHLRL* | SIICHPHLR,SIICHPHLRL,TSIICHPHLR,MTSNGVALLT, LTSIICHPHL | HNSC |
| CRB1 | c.1888T>G | p.F630 V | ICAFQNSFLGGLPVGMTSNGVALLN[p. F630V]VYNMPSTPSFVGCLQDIKIDWN HITL | NGVALLNVY,VALLNVINM,LLNVYNMPST,VYNMPSTPSF, SNGVALLNVY,TSNGVALLNV | STAD |
| CRB2 | c.3329C>T | p.T111 0M | GWEGPRCEAHVDPCHSAPCARGRCH[p. T1110M]MHPDGRFECRCPPGFGGP RCRLPVPS | RGRCHMHPD,CHMHPDGRF,RGRCHMHPDG,APCARGRC HM,RCHMHPDGRF,HMHPDGRFEC | ACC |
| CREBB P | c.4303G>C | p.D143 5H | FGMHVQEYGSDCPPPNTRRVVISYL[p. D1435H]HSIHFFRPRCLRTAVHEILIGY LEY | YLHSIHFPR,HSIHFPRPR,VYISYLHSI,ISYLHSIHF,SYLHS IHFF,RVYISYLHS,YISYLHSIH,RVYISYLHSI,SYLHSIHF FR,YISYLHSIHF,ISYLHSIHFF | BLCA |
| CREBB P | c.4337G>A | p.R144 6H | CPPPNTRRVVISYLDSIHFFRPRCL[p.R1 446H]HTAVVHEILIGYLEVVKKLGYVTG HI | HFFPRRCLH,HTAVVHEIL,RPRCLHTAV,FFRPRCLHT,CLHT AVVHEI,FFRPRCLHTA,RPRCLHTAVV,HTAVVHEILI | DLBCL |
| CREBB P | c.6281C>T | p.P209 4L | DLLRTLKSPSSPQQQQQVLNILKSN[p.P 2094L]LQLMAAFIKQRTAKYVANQPG MQPQP | VLNILKSNL,ILKSNLQLM,NLQLMAAFI,LQLMAAFIK,KSNL QLMAA,SNLQLMAAF,LKSNLQLMA,ILKSNLQLMA,NLQL MAAFIK,KSNLQLMAAF,LKSNLQLMAA | UCEC |
| CREBB P | c.142_143i nsCG | p.M48 fs | PACSCAHVECPPAHTCRCGVPACSH[p. M48fs]TCPCGVPACSHVPMRSARLLT HVSMWSAHLLMCPCGVPTCSHVPM WSATCSHTCPCGVPACSRAHVECPPAH TCRCGVPACSHVPMRSARLLTRAHAEC PPAHTCPCGVPACSHVPTWSARLLTRA HVECPPAHTCQRGVPA* | SMWSAHLLM,HLLMCPCGV,WSARLLTHV,HVSMWSAHL, RLLTHVSMW,LTHVSMWSA,HTCQRGVPA,MWSARLLTH, TWSARLLTR,VPTCSHVPM,VPACSRAHV,VPTWSARLL,AR LLTHVSM,THVSMWSAH,VSMWSAHLL,LMCPCGVPT,SH VPMWSAT,LLTHVSMWSA,SMWSAHLLMC,LLMCPCGVP T,HVSMWSAHLL,GVPACSRAHV,SARLLTHVSM,PTWSAR LLTR,HVPTWSARLL,ARLLTHVSMW,LTHVSMWSAH,THV SMWSAHL,VSMWSAHLLM,VPTCSHVPMW,VPMWSATC SH | BLCA |
| CRIPA K | c.427T>C | p.C143 R | SHVPMRSARLLTRAHAECPPAHTCP[p. C143R]RGVPACSHVPMRSARLLTRAD VECPP | HTCPRGVPA,CPPAHTCPR,RGVPACSHV | ACC |
| CRIPA K | c.520T>C | p.C174 R | SHVPMRSARLLTRADVECPPAHTCP[p. C174R]RGVPACSHVPTWSARLLTRAHV ECSP | HTCPRGVPA,CPPAHTCPR,RGVPACSHV | ACC |
| CRIPA K | c.538_568 del TCA CACCT GCCAA CGTGG AGTGC | p.S180 fs | LTRADVECPPAHTCPCGVPACSHVP[p. S180fs]MWSARLLTRADVECLPAHTCP CGVFACSHVPMRSARLLTRADAECPPA HTCPCGVPACSRADVECPPAHTCPCGV PACSRADVGCPPAHMCRCGVPACSHV PMWSARLLTRADVECPPAHVPIWSARL LTRAIVECPPAHTHADVECPPAHTCPCG VPACSHVPMWSARLLTHVPMWSARLL TRAHVECLPAHTRAHVECPPAHTKPW HGGSVGFLSCRPSQTLLPYILLMVAF* | FLSCRPSQT,TLLPYILLM,LLPYILLMV,CLPAHTCPC,HMCRC GVPA,WSARLLTHV,GSVGFLSCR,VFACSHVPM,RLLTHVP MW,PWHGGSVGF,PYILLMVAF,HTCPCGVFA,SARLLTRAI, LTRAHVECL,RAHVECLPA,MWSARLLTH,RPSQTLLPY,FAC SHVPMR,IWSARLLTR,DVECPPAFV,HVPIWSARL,QTLLPYI LL,VPACSRADV,VPIWSARLL,LPAHTRAHV,AHTCPCGVF,R AIVECPPA,ARLLTHVPM,AHVECLPAH,LSCRPSQTL,SQTLL PYIL,LPYILLMVA,CPPAHVPIW,CPPAHTKPW,LLTRAHVEC L,CLPAHTRAHV,FLSCRPSQTL,TLLPYILLMV,LLPYILLMVA, LLTRADVECL,HVECPPAHTK,GVFACSHVPM,SARLLTRAD | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CRIPAK | c.568A>C | p.I190L | ECPPAHTCPCGVPACSHVPTWSARL[p. I190L]LTRAHVECSPAHTCRCGVPACSH VPM | A, SARLLTRAIV, SARLLTHVPM, HTKPWHGGSV, VFACSHVP MR, PAHVPIWSAR, PIWSARLLTR, HVECLPAHTR, HVPIWS ARLL, WSARLLTRAI, KPWHGGSVGF, RPSQTLLPYI, LPYILLM VAF, SRADVGCPPA, ADVGCPPAHM, AHMCRCGVPA, VECP PAHVPI, AHVPIWSARL, RAIVECPPAH, ARLLTHVPMW, RA HVECLPAH, LSCRPSQTLL, CRPSQTLLPY, SQTLLPYILL, VECL PAHTRA, VECPPAHTA, LPAHTCPCGV, CPPAHTHADV | ACC |
| CRISPLD1 | c.664C>T | p.R222W | PKAVYLVCNYSPKGNWWGHAPYKHG[p. R222W]WPCSACPPSFGGGCRENLC YKEGSDR | TWSARLLTR, VPTWSARLL, PTWSARLLTR, HVPTWSARLL | BRCA |
| CROCC | c.1063G>C | p.A355P | RTSRAVQEAGLGLSTGLRLAESRAE[p.A 355P]PALEKQALLQAQLEEQLRDKVLR EKD | APYKHGWPC, YKHGWPCSA, WPCSACPPS, WPCSACPPSF, YKHGWPCSAC | KIRP |
| CROT | c.1740G>T | p.Q580H | DPLFSKSGGGNFVLSTSLVGYLRV[p.Q 580H]HGVVVPMVHNGYGFFYHIRDDR FVVA | EPALEKQAL, AESRAEPAL, RLAESRAEPA, ESRAEPALEK, AEP ALEKQAL | LUAD |
| CROT | c.96delA | p.L32fs | TEERTPQYQDSLPSLPVPSLEESLK[p.L 32fs]NTLNQSPEHATR* | YLRVHGVVV, GYLRVHGVV, RVHGVVVPM, RVHGVVVPMV, LVGYLRVHGV, GYLRVHGVVV, LRVHGVVVPM | STAD |
| CRTC3 | c.1088C>T | p.S363L | NKTVLSSSLNNHPQTSVPNASALHP[p.S 363L]LLRLFSLSNPSLSTTNLSGPSRRRQ P | LEESLKNTL | LUAD |
| CRYGB | c.427A>G | p.R143G | HLTEIHSLNVLEGSWILYEMPNYRG[p.R 143G]GQYLLRPGEYRRFLDWGAPNAK VGSL | ASALHPLLR, ALHPLLRLF, NASALHPLL, HPLLRLFSL, SALHPL LRLF, NASALHPLLR, VPNASALHPL | TGCT |
| CRYGD | c.476delG | p.G159fs | YEMPNYRGRQYLLRPGDYRRYHDWG[p. G159fs]VQMPKSAL* | NYRGGQYLL, MPNYRGGQY, YEMPNYRGG, EMPNYRGGQ Y, GQYLLRPGEY, NYRGGQYLR, MPNYRGGQYL | STAD |
| CRYM | c.943T>A | p.*315K | FKSLGMAVEDTVAAKLLYDSWSSGK[p. *315K]KNKGT* | RYHDWGVQM, GVQMPKSAL, RRYHDWGVQM, WGVQM PKSAL | CLL |
| CSDE1 | c.658C>T | p.R220C | NVQLETGDKINFVIDNNKHTGAVSA[p. R220C]CNIMLLKKKQARCQGVVCAMK EAFGF | SWSSGKKNK | UCEC |
| CSF2RB | c.892G>A | p.G298S | SFGLFYKPSPDAGEEECSPVLREGL[p.G 298S]SSLHTRHHCQIPVPDPATHGQYI VSV | SACNIMLLK, GAVSACNIM, AVSACNIMLL, VSACNIMLLK, S ACNIMLLKK, HTGAVSACNI | GBM |
| CSF3R | c.1404delC | p.P468fs | SLWVGWEPPNPWPQGVVIEWGLGPP[p. P468fs]ARAIATRPGGWNRMGEPRG FC* | VLREGLSSL, EGLSSLHTR, REGLSSLHT | STAD |
| CSGALNACT2 | c.1086G>T | p.L362F | VSLNEEFNRGRGLNVGARAWDKGEV[p. L362F]FMFFCDVDIYFSAEFLNSCRL NAEPG | ATRPGGWNR, RAIATRPGG, EWGLGPPAR, IEWGLGPPA, A TRPGGWNRM, IATRPGGWNR, RAIATRPGGW, IEWGLGPP AR | ACC, KIRP, TGCT |
| CSHL1 | c.350G>A | p.R117Q | SSNMEETQQKSNLELHISLLLIES[p.R1 17Q]QLEPVRFLRSTFTNNLVYDTSDSD DY | FMFFCDVDI, EVFMFFCDV, RAWDKGEVF, GEVFMFFCD, A WDKGEVFMF, VFMFFCDVDI, RAWDKGEVFM, FMFFCDV DIY, ARAWDKGEVF, GEVFMFFCDV | CESC |
| CSMD2 | c.5564C>A | p.P1855Q | PTCVVPCGGNLTERRGTILSPGFPE[p.P 1855Q]QYLNSLNCVWKIVVPEGAGIQI QVVS | SLLLIESQL, LIESQLEPV, SQLEPVRFL, QLEPVRFLR, LLI ESQLEPV, SQLEPVRFLR, LIESQLEPVR, LSLLLIESQL, IESQLEPVRF | LUAD |

Additional peptides for last row: QYLNSLNCV, FPEQYLNSL, GFPEQYLNSL, QYLNSLNCVW, IL SPGFPEQY, EQYLNSLNCV TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CSMD3 | c.2071C>A | p.Q691K | DPGTPLYGIREGDGFSNRDVLRFEC[p.Q691K]KFGFELIGEKSIVCQENNQWSANIPI | LRFECKFGF,FECKFGFEL,RFECKFGFEL,VLRFECKFGF,RDVLRFECKF,FECKFGFELI | LUSC |
| CSMD3 | c.2854C>T | p.H952Y | AEPGHSIKITFERFQTELNYDVLEV[p.H952Y]YDGPNLLSPLLGSYNGTQVPQFLFS | LNYDVLEVY,EVVDGPNLL,LEVYDGPNL,ELNYDVLEVY,EVYDGPNLLS,LEVYDGPNLL,YDGPNLLSPL | CESC |
| CSMD3 | c.3281C>A | p.T1094K | GDVRGPSGTILSPGYPEFYPNSLNC[p.T1094K]KWTVDVTHGKVQFNFHTPHLEDHHD | NSLNCKWTV,YPNSLNCKW,SLNCKWTVDV,FYPNSLNCKW,KWTVDVTHGK,EFYPNSLNCK | LUSC |
| CSMD3 | c.511G>A | p.E171K | STKSVFSLRLTSDFAVSAHGFKVYY[p.E171K]KELQSSSCGNPGVPPKGVLYGTRFDV | AHGFKVYYK,SAHGFKVYYK,HGFKVYYKEL | GBM |
| CSMD3 | c.522G>T | p.Q174H | SVFSLRLTSDFAVSAHGFKVYYEEL[p.Q174H]HSSSCCNPGVPPKGVLYGTRFDVGDK | YEELHSSSC,HSSSCGNPGV | LUAD |
| CSMD3 | c.7149_7150insT | p.F2383fs | LESVYSTSNQILIKFHSDFTTSGFF[p.F2383fs]CAQLSRLSTKGVPTSTTCAQC* | FTTSGFFCA,AQLSRLSTK,GFFCAQLSR,LSRLSTKGV,QLSRLSTKGV,SGFFCAQLSR,CAQLSRLSTK,TTSGFFCAQL,AQLSRLSTKG | LIHC |
| CSMD3 | c.8179C>A | p.P2727T | LEHGRMRIVNGSHYEYKTKVVFSCD[p.P2727T]TGYHGLGPASIECLPNGTWSWRNERP | VVFSCDTGY,VVFSCDTGYH,KTKVVFSCDT,KVVFSCDTGY,FSCDTGYHGL,DTGYHGLGPA | LUAD |
| CSMD3 | c.8429C>A | p.T2810N | CDLGFMLVGSAVRECLSSGLWSESE[p.T2810N]NRCLAGHCGIPELIVNGQVIGENYGY | SESENRCLA,SENRCLAGH | LUAD |
| CSPG5 | c.355G>A | p.D119N | AVTGTAWLEADSPGLGGVTAEAGSG[p.D119N]NAQALPATLQAPHEVLGQSIMPPAIP | VTAEAGSGNA,AEAGSGNAQA | BLCA |
| CT47B1 | c.702728de|GAAGCTCACAGAGAGGCCACAGAGGA | p.234_243EKLTEEATEE>E | DLAEMAREPAEEAADEKPPEEAAEE[p.234_243EKLTEEATEE>E]PAAEEPTSEEAVAPEEVTKSQPEKMDEEAQDAAGEEEKEQEKEDVENKVKN | EEEAAEEPAA,AEEPAAEEPT | BRCA |
| CTAGE15P | c.1091C>T | p.A364V | IIQISFVDKTKFFITFHIKNIQTQQ[p.A364V]VSLQSENIYFESENQKLQQKLKIMTE | VSLQSENIY,NLQTQQVSL,HIKNLQTQQV,QVSLQSENIY,K NLQTQQVSL,QQVSLQSENI,VSLQSENIYF | KIRP |
| CTCF | c.604_605insAA | p.K202fs | EQGELPQEDPSWQKDPDYQPPAKK[p.K202fs]KQRKPKRANCVIQRRAKM* | RANCVIQRR,KPKRANCVI,KQRKPKRANC,RANCVIQRRA | STAD |
| CTCF | c.604del|A | p.K202fs | EQGELPQEDPSWQKDPDYQPPAKK[p.K202fs]QRKPKRANCVIQRRAKM* | RANCVIQRR,KPKRANCVI,KQRKPKRANC,RANCVIQRRA | STAD |
| CTCFL | c.1267G>A | p.E423K | YECHICHTRFTQSGTMKIHILQKHG[p.E423K]KNVPKYQCPHCATTIARKSDLRVHMR | ILQKHGKNV,KHGKNVPKY,KIHILQKHGK,LQKHGKNVPK,QKHGKNVPKY | CRC |
| CTDNEP1 | c.376G>A | p.E126K | KHPVRFVHKRPHVDFFLEVVSQWY[p.E126K]KLVVFTASMEIYGSAVADKLDNSRSI | KLVVFTASM,VVSQWYKLV,SQWYKLVVF,WYKLVVFTA,EV VSQWYKL,YKLVVFTAS,FLEVVSQWYK,VSQWYKLVVF,EV VSQWYKLV,YKLVVFTASM,LEVVSQWYKL,SQWYKLVVFT | CRC |
| CTNNA3 | c.2567_2568insAA | p.K856fs | IIRIQSPAGPRHPVVWMRMKAPAKK[p.K856fs]NP* | RMKAPAKKNP | STAD |
| CTNNB1 | c.1004A>T | p.K335I | ESKLIILASGGPQALVNIMRTYTYE[p.K335I]ILLWTTSRVLKVLSVCSSNKPAIVEA | IMRTYTYEI,YTYEILLWT,ILLWTTSRV,TYTYEILLW,TYE ILLWTT,RTYTYEIL,EILLWTTSR,MRTYTYEIL,YEILLW | LIHC |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CTNNB1 | c.100G>A | p.G34R | ELDMAMEPDRKAAVSHWQQQSYLDS[p.G34R]RIHSGATTTAPSLSGKNPEEEDVDT | TTS,NIMRTYTYEI,YTYEILLMTT,ILLWTTSRVL,IMRTY TYEIL,RTYTYEILLM,EILLWTTSRV,MRTYTYEILL,YEI LLWTTSR QQSYLDSRI,RIHSGATTT,YLDSRIHSGA,RIHSGATTTA,QQ QSYLDSRI,QQSYLDSRIH | UCEC |
| CTNNB1 | c.101G>T | p.G34V | ELDMAMEPDRKAAVSHWQQQSYLDS[p.G34V]VIHSGATTTAPSLSGKNPEEEDVDT | QQQSYLDSV,YLDSVIHSG,QQQSYLDSVI,WQQQSYLDSV,YL DSVIHSGA,VIHSGATTTA,QQQQSYLDSVI,QQSYLDSVIH | LIHC |
| CTNNB1 | c.107A>C | p.H36P | DMAMEPDRKAAVSHWQQQSYLDSGI[p.H36P]PSGATTTAPSLSGKGNPEEEDVDTSQ | YLDSGIPSG,IPSGATTTA,YLDSGIPSGA | LIHC |
| CTNNB1 | c.109T>G | p.S37A | MAMEPDRKAAVSHWQQQSYLDSGIH[p.S37A]AGATTTAPSLSGKGNPEEEDVDTSQV | YLDSGIHAG,IHAGATTTA,YLDSGIHAGA,GIHAGATTTA,AG ATTTAPSL | UCEC |
| CTNNB1 | c.110C>G | p.S37C | MAMEPDRKAAVSHWQQQSYLDSGIH[p.S37C]CGATTTAPSLSGKGNPEEEDVDTSQV | YLDSGIHCGA,GIHCGATTTA | UCEC |
| CTNNB1 | c.110C>T | p.S37F | MAMEPDRKAAVSHWQQQSYLDSGIH[p.S37F]FGATTTAPSLSGKGNPEEEDVDTSQV | YLDSGIHFG,SYLDSGIHF,IHFGATTTA,YLDSGIHFGA, GIHFGATTTA,QSYLDSGIHF,IHFGATTTAP,FGATTTAPSL | LUAD,UCEC |
| CTNNB1 | c.1161G>A | p.N387K | GMQALGLHLTDPSQRLVQNCLWTLR[p.N387K]KLSDAATKQEGMEGLLGTLVQLLGSD | VQNCLWTLRK | LIHC |
| CTNNB1 | c.121A>G | p.T41A | PDRKAAVSHWQQQSYLDSGIHSGAT[p.T41A]ATAPSLSGKGNPEEEDVDTSQVLYEW | ATAPSLSGK,GATATAPSL,GIHSGATATA,TATAPSLSGK,SG ATATAPSL | PRAD |
| CTNNB1 | c.122C>T | p.T41I | PDRKAAVSHWQQQSYLDSGIHSGAT[p.T41I]ITAPSLSGKGNPEEEDVDTSQVLYEW | ITAPSLSGK,SGIHSGATI,TITAPSLSGK,SGATTTAPSL | UCEC |
| CTNNB1 | c.133T>C | p.S45P | AAVSHWQQQSYLDSGIHSGATTTAP[p.S45P]PLSGKGNPEEEDVDTSQVLYEWEQGF | TTAPPLSGK,GATTTAPPL,TTAPPLSGK,SGATTTAPPL | ACC,LIHC |
| CTNNB1 | c.94G>A | p.D32N | LMELDMAMEPDRKAAVSHWQQQSYL[p.D32N]NSGIHSGATTTAPSLSGKGNPEEEDV | YLNSGIHSG,QQQSYLNSGI,WQQQSYLNS,QQQSYLNSGI, NSGIHSGA,QQQSYLNSGI,WQQQSYLNSG,QQSYLNSGIH | LIHC,UCEC |
| CTNNB1 | c.94G>T | p.D32Y | LMELDMAMEPDRKAAVSHWQQQSYL[p.D32Y]YSGIHSGATTTAPSLSGKGNPEEEDV | YLYSGIHSG,QQSYLYSGIH,HWQQQSYLY,WQQQSYLYS,QQ QSYLYSG,QSYLYSGIH,YLYSGIHSGA,QQQSYLYSGI,SHWQ QSYLY,WQQQSYLYSG,QQSYLYSGIH | UCEC |
| CTNNB1 | c.95A>G | p.D32G | LMELDMAMEPDRKAAVSHWQQQSYL[p.D32G]GSGIHSGATTTAPSLSGKGNPEEEDV | YLGSGIHSG,WQQQSYLGS,QQQSYLGSG,QQSYLGSGI,QS YLGSGIH,YLGSGIHSGA,WQQQSYLGSG,QQQSYLGSGI,Q QSYLGSGIH | CESC,LIHC |
| CTNNB1 | c.95A>T | p.D32V | LMELDMAMEPDRKAAVSHWQQQSYL[p.D32V]VSGIHSGATTTAPSLSGKGNPEEEDV | QQSYLVSGI,YLVSGIHSG,LVSGIHSGA,HWQQQSYLV,WQ QQSYLVS,QQQSYLVSG,QSYLVSGIH,YLVSGIHSGA,QQQS YLVSGI,SHWQQQSYLV,WQQQSYLVSG,QQSYLVSGIH | LIHC |
| CTNNB1 | c.97T>C | p.S33P | MELDMAMEPDRKAAVSHWQQQSYLD[p.S33P]PGIHSGATTTAPSLSGKGNPEEEDV | YLDPGIHSG,WQQQSYLDP,QQSYLDPG,QSYLDPGI,YL DPGIHSGA,WQQQSYLDPG,QQQSYLDPGI,QQSYLDPGIH | LIHC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CTNNB1 | c.98C>A | p.S33Y | MELDMAMEPDRKAAVSHWQQQSYL D[p.S33Y]YGIHSGATTTAPSLSGKGNPE EEDVD | YLDYGIHSG, WQQQSYLDY, YLDYGIHSGA, H WQQQSYLDY, QQQSYLDYGI, QQSYLDYGIH | UCEC |
| CTNNB1 | c.98C>G | p.S33C | MELDMAMEPDRKAAVSHWQQQSYL D[p.S33C]CGIHSGATTTAPSLSGKGNP EEDVD | YLDCGIHSG, WQQQSYLDC, QQQSYLDCGI, YLDCGIHSGA, Q QQSYLDCGI, QQSYLDCGIH | LIHC,UCEC |
| CTNNB1 | c.98C>T | p.S33F | MELDMAMEPDRKAAVSHWQQQSYL D[p.S33F]FGIHSGATTTAPSLSGKGNPE EEDVD | YLDFGIHSG, WQQQSYLDF, QQQSYLDFGI, QSYLDFGIH, YLDF GIHSGA, HWQQQSYLDF, QQQSYLDFGI, QQSYLDFGIH | UCEC |
| CTNND1 | c.1341del A | p.I447 fs | VHLGACGALKNISFGRDQDNKIAIK[p.I 447fs]TVMVCLPLCDCFERLVIWTLLKLL PEPCGIFHPMTQSKWRLWTMHCMP* | KIAIKTVMV, KLLPEPCGI, AIKTVMVCL, LVIWTLLKL, RLVI WTLLK, KTVMVCLPL, IFHPMTQSK, QSKWRLWTM, KWRLWT MHC, EPCGIFHPM, NKIAIKTVM, LPEPCGIFH, RLVIWTLLI, LLPEPCGIF, S KWRLWTMH, WRLWTMHCM, LPEPCGIFH, RLVIWTLKL, L VIWTLLKLL, GIFHPMTQSK, CFERLVIWTL, KLLPEPCGIF, IFHPMTQSKW, KWRLWTMHCM, HPMTQSKWRL, TQSKWRL WTM, IAIKTVMVCL, IKTVMVCLPL, FERLVIWTLL, LPLCDCF ERL, PEPCGIFHPM | STAD |
| CTSC | c.315del T | p.F105 fs | NSGHFTIYNQGFEIVLNDYKWFAF[p.F 105fs]LSIKKRAR* | FLSIKKRAA, KWFAFLSIK, WFAFLSIKK, LSIKKRAAR, FAFL SIKKR, YKWFAFLSI, NDYKWFAFL, KWFAFLSIKK, DYKWF AFLSI, WFAFLSIKKR, FLSIKKRAAR | STAD |
| CTSD | c.267_268i nsC | p.P89 fs | GPIPEVLKNYMDAQYYGEIGIGTPP[p.P 89fs]PVLHSRLRHGLLQPVGPLHPLQTA GHRLLDPPQVQQRQVQHLREEWYLV* | GLLQPVGPL, HLREEWYLV, HSRLRHGLL, RLRHGLLQP, QQR QVQHLR, VQHLREEWY, QPVGPLHPL, IGIGTPPPV, LRHGLL QPV, LQTAGHRLL, VQQRQVQEIL, RQVQHLREE, RLRHGLLQ PV, VLHSRLRHGL, HSRLRHGLLQ, QVQHLREEWY, EIGIGTP PPV, PPPVLHSRL, HPLQTAGHRL, IGIGTPPPVL, LQPVGPL HPL, RQVQHLREEW, VQHLREEWYL, GEIGIGTPPP | STAD |
| CTTNBP2 | c.1259C>T | p.S420 L | TSSTPLPSNAAPPTAQTPGIAPQN[p.S 420L]LQAPPMHSLHSPCANTSLHPGLN PRI | LQAPPMHSL, PQNLQAPPM, NLQAPPMHSL, QTPGIAPQN L, APQNLQAPPM, LQAPPMHSLH | UCEC |
| CTTNBP2 | c.490C>T | p.R164 C | LEMEKLQLQALEQEHKLAARLEEE[p.R 164C]CGKNKQVVLMLVKECKQLSGKVI EEA | CGKNKQVVL, KLAARLEEEC, AARLEEECGK | CRC |
| CUBN | c.1786G>T | p.G596 C | EHLRNGRGFTVRWETQQPECGGILT[p. G596C]CPYGSIKSPGYPGNYPPGRDCV WIVV | ILLTCPYGSI, LTCPYGSIK, CGGILTCPY, ILLTCPYGSIK | LUAD |
| CUBN | c.8448C>G | p.I281 6M | GGGFYATWNTQTLGCCGIFHSDNGT[p. I2816M]MRSPHWPQNFPENSRCSWT AITHKSK | TMRSPHWPQ, IFHSDNGTM, TMRSPHWPQN, IFHSDNGT MR, GIFHSDNGTM, MRSPHWPQNF | KIRP |
| CUL1 | c.1453G>A | p.E485 K | DVFQKFYAKMLAKRLVHQNSASDDA[p. E485K]KASMISKLKQACGFEYTSKLQR MFQD | KASMISKLK, DAKASMISK, AKASMISKL, SASDDAKASM | BLCA |
| CUL7 | c.1113G>C | p.L371 F | QAQPSFRRSRRFPRSEFASGNTYA[p.L 371F]FYVRDTLQPGMRVRMLDDYEEIS AGD | ASGNTYAFY, FASGNTYAF, YAFYVRDTL, FASGNTYAFY, EFA SGNTYAF, TYAFYVRDTL, SGNTYAFYVR | LUAD |
| CUL9 | c.5178T>G | p.D172 6E | SPRCWPVSPLCVLYHPRKCLPTEFC[p.D 1726E]EALDRFSSFYSQSQNHPVLDMG PHRR | CLPTEFCEA, LPTEFCEAL, EALDRFSSF, CEALDRFSS, CLPTEF CEAL, EALDRFSSFY, TEFCEALDRF, CEALDRFSSF | KIRC |
| CUX1 | c.1316_131 7insC | p.A439 fs | LSGSARRKGKDQPESRRPGSLPAPP[p.A 439fs]SFSVAPQPGGAGFQY* | LPAPPSFSV, APQPGGAGF, GSLPAPPSF, QPGGAGFQY, SLP APPSFSV, FSVAPQPGGA, LPAPPSFSVA | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| CWC2 5 | c.1090A>G | p.K364 E | EELERKRQEMMENAKWREEERLNIL[p. K364E]ERHAKDEREQRLEKLDSRDGK FIHR | RLNILERHAK | KIRC |
| CXCL9 | c.366G>C | p.K122 N | KKQKNGKKHQKKKVLLKVRKSQRSRQ[p. K122N]NKT* | KSQRSRQNK | LUAD |
| CXCR4 | c.1033G>C | p.E345 Q | VSRGSSLKILSKGKRGGHSSVSTES[p.E3 45Q]QSSSFHSS* | STESQSSSF, SQSSSFHSS, VSTESQSSSF | LUAD |
| CXXC1 | c.468G>C | p.Q156 H | MLARGSASPHKSSPQPLVATPSQHH[p. Q156H]HQQQQQIKRSARMCGECEAC RRTEDC | HHHQQQQQI | TGCT |
| CXorf 51B | c.127G>A | p.V43I | QTPSTSTKGRKKGKTPQRRSRSGI[p. V43I]IKGLKTTRKAKRPLRGSSSQKAGE TN | RQRRSRSGI, QRRSRSGIK, RSRSGIKGL, RSRSGIKGLK, RQRR SRSGIK, GIKGLKTTRK, RRSRSGIKGL | KIRC |
| CXorf 59 | c.593G>T | p.R198 M | LLHLSGKMPPGINSSQSLPVDNHEK[p. R198M]MVIQLHLQHSSLLDFLNAQGG CISHV | LPVDNHEKM, HEKMVIQLH, HEKMVIQLHL, LPVDNHEKM V | LUAD |
| CYP11 B1 | c.1492C>G | p.R498 G | LVRVFLYSLGRNPALFPRPERYNPQ[p.R 498G]GWLDIRGSGRNFYHVPFGFGMR QCLG | RYNPQGWLDI | LUAD |
| CYP19 A1 | c.1216T>C | p.F406 L | DVIDGYPVKKGTNIILNIGRMHRLE[p.F 406L]LFPKPNEFTLENFAKNVPYRYFQP FG | IGRMHRLEL, MHRLELFPK, ELFPKPNEF, GRMHRLELF, RMH RLELFPK, LFPKPNEFTL, NIGRMHRLEL, IGRMHRLELF, LELFP KPNEF | TGCT |
| CYP19 A1 | c.338G>T | p.S113 I | WISGEETLIISKSSSMFHIMKHNHY[p.S 113I]ISRFGSKLGLQCIGMHEKGIIFNN NP | HIMKHNHYI, YISRFGSKL, HYISRFGSK, ISRFGSKLG, KHNHYI SRF, HYISRFGSKL, IMKHNHYISR, NHYISRFGSK, ISRFGSKLG L, MKHNHYISRF, FHIMKHNHYI | THCA |
| CYP1A 2 | c.1447G>A | p.V483 M | CIGEVLAKWEIPLFLAILLQQLEFS[p.V48 3M]MPPGVKVDLTPIYGLTMKHARCEH VQ | LLQQLEFSM, FSMPPGVKV, MPPGVKVDL, QQLEFSMPP, LE FSMPPGV, ILLQQLEFSM, QLEFSMPPGV, SMPPGVKVDL, L QQLEFSMPP, QQLEFSMPPG | BRCA |
| CYP27 A1 | c.335C>A | p.P112 Q | LYKAKYGPMWMSYLGPQMHVNLASA [p.P112Q]QLLEQVMRQEGKYPVRND MELWKEHR | ASAQLLEQV, HVNLASAQL, VNLASAQLL, SAQLLEQVM, LAS AQLLEQV, HVNLASAQLL, MHVNLASAQL, ASAQLLEQVM | LUAD |
| CYP2B 6 | c.1331C>A | p.A444 E | ALKKTEAFIPFSLGKRICLGEGIAR[p.A44 4E]EELFLFFTTILQNFSMASPVAPEDID | IAREELFLF, AREELFLFF, EELFLFFT, GEGIAREEL, REELFLFFT, GIAREELFLF, IAREELFLFF, EELFLFFTTI, GEGIAREELF, REELFLFFT | LUAD |
| CYP2D 6 | c.1055A>G | p.H352 R | VQRRVQQEIDDVIGQVRRPEMGDQA[p. H352R]RMPYTTAVIHEVQRFGDIVPL GVTHM | MGDQARMPY, RMPYTTAVI, QARMPYTTA, ARMPYTTAV, QARMPYTTAV, EMGDQARMPY, REMGDQARM, ARMPY TTAVI, RMPYTTAVIH | GBM |
| CYP4A 11 | c.553G>T | p.V185 F | GLMADSVRVMLDKWEELLGQDSPLE[p. V185F]FFQHVSLMTLDTIMKCAFSH QGSIQV | LGQDSPLEF, GQDSPLEFF, LEFFQHVSL, EFFQHVSLM, SPLE FFQHV, FFQHVSLMTL, DSPLEFFQFIV, LLGQDSPLEF, LEFFQ HVSLM, LGQDSPLEFF | OV |
| CYP4B 1 | c.1302G>T | p.E434 D | HIYALHRNSAVWPDPEVFDSLRFST[p.E 434D]DNASKRHPFAFMPFSAGPRNCI GQQF | SLRFSTDNQA, RPSTDNASK, TDNASKRHPF | CRC |
| CYP7B 1 | c.995A>C | p.K332 T | YLLRHPEAMAAVRDEIDRLLQSTGQ[p. K332T]TKGSGFPIHLTREQLDSLICLESSI F | QTKGSGFPI, RLLQSTGQTK, GQTKGSGFPI, TKGSGFPIHL | STAD |
| DAB2I P | c.481G>A | p.E161 K | ILGQDYCFEVTTSSGSKCFSCRSAA[p.E1 61K]KRDKWMENLRRAVHPNKDNSRR VEHI | CFSCRSAAK, FSCRSAAKR, RSAAKRDKW, KCFSCRSAAK, SC RSAAKRDK, CFSCRSAAKR, AKRDKWENL | BRCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| DACH2 | c.1615C>T | p.R539C | TMQKRLKKEKKTKRKLQEALEFESK[p.R539C]CREQVEQALKQATTSDSGLRMLKDTG | FESKCREQV, EALEFESKCR | CRC |
| DACH2 | c.1616G>T | p.R539L | TMQKRLKKEKKTKRKLQEALEFESK[p.R539L]LREQVEQALKQATTSDSGLRMLKDTG | KLREQVEQA, EALEFESKL, FESKLREQV, KLREQVEQAL, EALE FESKLR, QEALEFESKL | LUAD |
| DBC1 | c.646G>A | p.V216I | AIKVTETRTGPLGCNSYDNLDSVSS[p.V216I]ILLQSTESKLHLQGLQIIFPQYLQEK | NLDSVSSIL, ILLQSTESK, NLDSVSSILL, ILLQSTESKL, SILLQSTESK, YDNLDSVSSI | CRC |
| DBF4B | c.761C>A | p.S254Y | PFLKIEDESRKFRPFHHQFKSFPEI[p.S254Y]YFLGPKDASPFEAPTTLGSMHHTRES | KSFPEIYFL, SPPEIYPLG, QFKSFPEIY, FKSFPEIYF, QFKSFPEIYF, HQFKSFPEIY, FKSFPEIYFL | CRC |
| DCAF12L2 | c.737G>A | p.R246H | RMDPDMPNGSIAWHSEVGLPVYAHI[p.R246H]HPRDVEAIPRASTNPSNRKVRALAFS | PVYAHIHPR, HIHPRDVEA, HIHPRDVEAI, VYAHIHPRDV, LP VYAHIHPR | GBM |
| DCC | c.1337G>A | p.R446H | AIPSSSVLPSAPRDVVPVLVSSRFV[p.R446H]HLSWRPPAEAKGNIQTFTVFFSREGD | LVSSRFVHL, SSRFVHLSW, VLVSSRFVH, VHLSWRPPA, VLVSSRFVHL, FVHLSWRPPA, HLSWRPPAEA, SSRFVHL SWR, VSSRFVHLSW | LUAD |
| DCHS1 | c.703del|C | p.R235fs | LDRENRSHYMLQLEAYDGGSPPRRA[p.R235fs]RPCWT* | SPPRRARPC | STAD |
| DCHS2 | c.6447C>A | p.F2149L | TRENTVEYSIISGNSQNNFHVETK[p.F2149L]LFHSEYPYKQVGYIVLLHSLDREASA | KLFHSEYPY, LFHSEYPY, NFHVETKLF, ETKLFHSEY, KLFHSE YPYK, NNFHVETKLF, VETKLFHSEY, TKLFHSEYPY | CRC |
| DCLK2 | c.1646C>A | p.S549Y | HGLSIVHRDIKPENLLVCEYPDGTK[p.S549Y]YLKLGDFGLATWEGPLYTVCGTPTY | YLKLGDFGL, CEYPDGTKY, TKYLKLGDF, YLKLGDFGLA, KYLK LGDFGL, YPDGTKYLKL, CEYPDGTKYL | CRC |
| DCLRE1B | c.82T>A | p.F28I | GVLIPHTPIAVDFWSLRRAGTARLF[p.F28I]ILSHMHSDHTVGLSSTWARPLYCSPI | RLFILSHMH, RAGTARLFI, ARLFILSHM, ILSHMHSDHT, GTA RLFILSH, RAGTARLFIL, TARLFILSHM, RRAGTARLFI | TGCT |
| DCT | c.1595G>A | p.R532Q | LVVMGTLVALVGLFVLLAFLQYRRL[p.R532Q]QKGYTPLMETHLSSKRYTEEA* | RRLQKG, RLQKGYTPLM, AFLQYRRLQK, LQYRRLQKGY, RRL QKGYTPL, FLQYRRLQK, LQKGYTPLM, QYRRLQKGY, LQY | UCEC |
| DCUN1D4 | c.824T>C | p.L275P | EKDQRSLDINTAKCMLGLLLGKIWP[p.L275P]PFPVPHQFLEQSKYKVINKDQWCNVL | LLLGKIWPP, LLGKIWPPF, KIWPPFVF, PPFVPHQFL, GKIW PPFPV, PPFPVPHQF, LLLGKIWPPF, LGKIWPPFPV, KIWPPF PVFH, GKIWPPPFVF, WPPFPVPHQF | THCA |
| DDC | c.1297del|A | p.I433fs | LVCFRLKGSNKVNEALLQRINSAKK[p.I433fs]STWHFVTSGTSLSCALPSVLARWNLPMCSGPGNTSKSWRPTCCEQRGSRSEASCRNQKLRDISENWNKKQINIILPSWNSAVCGFPCLSPKLSRGL* | SLSCALPSV, VLARWNLPM, ILPSWNSAV, CGFPCLSPK, CAL PSVLAR, CSGPGNTSK, ASCRNQKLK, ALPSVLARW, SWNSA VCGF, SAKKSTWFH, GSRSEASCR, INSAKKSTW, AKKSTWFH V, KKSTWFFIVT, FHVTSGTSL, SGTSLSCAL, LSCALPSVL, LKR DISENW, KQINIILPS, SAVCGFPCL, LPSWNSAVC, CLSPKLLSR VL, VLARWNLPMC, IILPSWNSAV, ILPSWNSAVC, CLSPKLSR GL, RSEASCRNQK, CALPSVLARW, KQINIILPSW, SAKKSTWF HV, SVLARWNLPM, SWRPTCCEQR, STWHFVTSGT, TSLSCA LPSV, NIILPSWNSA, NSAVCGFPCL, LPSVLARWNL, WNKKQ INIIL, RINSAKKSTW, INSAKKSTWF, WFHVTSGTSL, SEASCR NQKL, KLKRDISENW, CGFPCLSPKL, CEQRGSRSEA | STAD |
| DDI1 | c.824G>A | p.R275Q | VNGHPLKAFVDSGAQMTIMSQACAE[p.R275Q]QCNIMRLVDRRWAGVAKGVGTQRIIG | AEQCNIMRL, SQACAEQCNI, AEQCNIMRLV | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| DDX1 | c.1126G>A | p.A376T | PYYGSRLAIPAAQLVVLPYQMLLHA[p.A376T]TTRQAAGIRLQDQVVIIDEAHNLIDT | LLHATTQA,TTRQAAGIR,QMLLHATTR,YQMLLHATT,LH ATTRQAA,MLLHATTQA,LLHATTRQA,TTRQAAGIRL,Y QMLLHATTR,LPYQMLLHAT | TGCT |
| DDX1 | c.622del|A | p.K208fs | AERLEQLESGEEELVLAEYESDEEK[p.K208fs]RWRAEWMRMRMTWRKNT* | MRMRMTWRK,RWRAEWMRM,EWMRMRMTW,RAEW MRMRM,WMRMRMTWR,RMRMTWRKN,EEKRWRAEW, AEWMRMRMT,WMRMRMTWRK,RWRAEWMRM,RM RMTWRKNT,EWMRMRMTWR,RWRAEWMRMR,WRAE WMRMRM,AEWMRMRMTW,DEEKRWRAEW | TGCT |
| DDX11L2 | c.382T>C | p.*128Q | CLFLSLEPPPRDHISHCLLSAQFH[p.*128Q]QK* | LLSAQFHQK,CLLSAQFHQK | UCS |
| DDX1 | c.488del|G | p.G163fs | HPEVARLTPYEVDELRRKKEITVRG[p.G163fs]EMFVLNPCLPSIMLTSHNM* | VLNPCLPSI,SIMLTSHNM,ITVRGEMFV,KEITVRGEM,GEM FVLNPC,EMFVLNPCL,NPCLPSIML,LPSIMLTSH,FVLNPCLP SI,VLNPCLPSIM,EITVRGEMFV,KKEITVRGEM,KEITVRGE MF,GEMFVLNPCL | STAD |
| DDX39B | c.447_448insT | p.F149fs | LAFQISKEYERPSKYMPNVKVAVFF[p.F149fs]WWSVYQEG* | VAVFFWWSV,AVFFWWSVY,FWMSVYQEG,VKVAVFFW W,KVAVFFWWSV,VAVFFWWSVY | KIRC |
| DDX5 | c.986G>T | p.R329L | FNQGFYDCVIATDAEVLGAPVKGKR[p.R329L]LGRGPKGDKASDPEAGVARGIDFHHV | LGRGPKGDK,KGKRLGRGPK,RLGRGPKGDK | LUAD |
| DEFA1 | c.270G>T | p.W90C | DCYCRIPACIAGERRYGTCIYQGRL[p.W90C]CAFCC* | IYQGRLCAF,IYQGRLCAFC,CIYQGRLCAF | LUAD |
| DENND2A | c.1496G>T | p.R499L | GRKKRKIPKLVLRINAIYEVRRGKK[p.R499L]LVKRLSQSMESNSGKVTDENSESD SD | RGKKLVKRL,LVKRLSQSM,YEVRRGKKL,KLVKRLSQSM,EV RRGKKLVK,YEVRRGKKLV | LUAD |
| DENND2A | c.2063G>A | p.R688Q | EVYCIVSRLGCFSLFSRILDEVEKR[p.R688Q]QGISPALVQPLMRSVMEAPF PALGKT | KRQGISPAL,RQGISPALV,EKRQGISPAL,VEKRQGISPA | LUAD |
| DENND4A | c.1070C>A | p.P357H | LYRYSISGPHVLPIEKHISHFMHKV[p.P357H]HFPSPQRPRILVQLSPHDNLI LSQPV | FMHKVHFPS,KVHFPSPQR,HFPSPQRPR,ISHFMHKVF,SH FMHKVHF,KVHFPSPQRP,ISHFMHKVHF,FMHKVHFPSP | CRC |
| DENND4C | c.3242G>A | p.R1081Q | ESEKSSPAVSRSKTFTGRFKQQTPS[p.R1081Q]THKERSTSLSALVRSSPHGSLG SVV | RFKQQTPSQ,KQQTPSQTH,RFKQQTPSQT,KQQTPSQTHK, FKQQTPSQTH | CRC |
| DENND5B | c.3068G>A | p.G1023E | GELGDTGVMQIPKNLLEMTFECQNL[p.G1023E]EKLTTVQIGHDNSGLLAKWLV DCVMV | FECQNLEKL,LEKLTTVQI,CQNLEKLTTV,MTFECQNLEK | HNSC |
| DGCR8 | c.1552G>A | p.E518K | SVQDAPTKKEFVINPNGKSEVCILH[p.E518K]KYMQRVLKVRPVYNFFECENPSE PFG | ILHKYMQRV,KSEVCILHK,CILHKYMQR,KYMQRVLKV,HKY MQRVLK,SEVCILHKY,LHKYMQRVL,KSEVCILHKY,CILHKY MQRV,ILHKYMQRVL,LHKYMQRVLK,KYMQRVLKVR,SEV CILHKYM,HKYMQRVLKV | THCA |
| DGKB | c.38C>T | p.S13L | MTNQEKWAHLSP[p.S13L]LEFSQLQK YAEYSTKKLKDVLEEFHG | EKWAHLSPL,WAHLSPLEF,LEFSQLQKY,HLSPLEFSQL,KW AHLSPLEF,QEKWAHLSPL,LEFSQLQKYA | BRCA |
| DHPS | c.147C>A | p.F49L | LPPESTQVRGYDFNRGVNYRALLEA[p.F49L]LGTTGFQATNFGRAVQQVNAMIE KKL | ALLEALGTT,ALGTTGFQA,NYRALLEAL,LEALGTTGF,EALGT TGFQA,LLEALGTTGF,VNYRALLEAL | CESC |
| DHRS4 | c.653T>C | p.I218T | LGLNKTLAIELAPRNIRVNCLAPGL[p.I218T]TKTSFSRMLWMDKEEESMKETL RIR | CLAPGLTKT,LTKTSFSRM,GLTKTSFSR,APGLTKTSF,TKTSFS RML,GLTKTSFSRM,LTKTSFSRML,LAPGLTKTSF,TKTSFSR MLW | LIHC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| DHTKD1 | c.1229G>A | p.R410Q | DIGKLVGCAIIHVNGDSPEEVVRAT[p.R410Q]QL4FEYQRQFRKDVIIDLLCYRQWGH | TQLAFEYQR,VVRATQLAF,RATQLAFEY,EVVRATQLA,EEVVRATQL,ATQLAFEYQR,VVRATQLAFE,VRATQLAFEY,QLAFEYQRQF,EVVRATQLAF,EEVVRATQLA | CRC |
| DHX9 | c.119T>G | p.V40G | RKMTPSYEIRAVGNKNRQKFMCEVQ[p.V40G]GEGYNYTGMGNSTNKKDAQSNAARDF | GEGYNYTGM,FMCEVQGEGY,CEVQGEGYNY | LUSC |
| DIAPH2 | c.361G>A | p.E121K | ERSLNLSEKEVLDLFEKMMEDMNLN[p.E121K]KEKKAPLRNKDFTTKREMVVQYISAT | MMEDMNLNK,LNKEKKAPL,KMMEDMNLNK,KEKKAPLRNK,NLNKEKKAPL | UCEC |
| DICER1 | c.5113G>A | p.E170 5K | KAYLLQAFTHASYHYNTITDCYQRL[p.E1705K]KFLGDAILDYLITKHLYEDPRQHSPG | RLKFLGDAI,ITDCYQRLK,LKFLGDAIL,ITDCYQRLKF,RLKFLGDAIL,TITDCYQRLK,KFLGDAILDY,YQRLKFLGDA | CLL |
| DIRAS1 | c.235G>T | p.G79C | VCTLQITDTTGSHQFPAMQRLSISK[p.G79C]CHAFILVFSVTSKQSLEELGPIYKLI | SISKCHAFI,RLSISKCHA,ISKCHAFIL,LSISKCHAF,MQRLSISKC,KCHAFILVF,SISKCHAFII,ISKCHAFIIV,LSISKCHAFI,RLSISKCHAF,MQRLSISKCH,SKCHAFILVF | KIRC |
| DIS3 | c.2339G>A | p.R780K | CSGMDNDFHHYGLASPIYTHFTSPI[p.R780K]KRYADVIVHRLLAVAIGADCTYPELT | YTHFTSPIK,HFTSPIKRY,FTSPIKRYA,SPIKRYADV,IKRYADVIV,KRYADVIVH,YTHFTSPIKR,ITYTHFTSPIK,SPIKRYADVI,THFTSPIKRY,IKRYADVIVH | MM |
| DISP1 | c.2194_2195GG>TT | p.G732L | EKVLPCIVIKPRYLWLFWFLALTVG[p.G732L]LAYIVCINPKMKLPSLELSEFQVFRSS | FLALTVGLA,ALTVGLAYI,LTVGLAYIV,WFLALTVGL,LALTVGLAY,FLALTVGLAY,ALTVGLAYIV,LAYIVCINPK,FWFLALTVGL,LALTVGLAYI | SKCM |
| DISP1 | c.2287C>T | p.R763C | INPKMKLPSLELSEFQVFRSSHPFE[p.R763C]YDAEYKKLFMFERVHHGEELHMPIT | RSSHPFECY,HPFECYDAE,CYDAEYKKLF,HPFECYDAEY,FRSSHPFECY | CRC |
| DISP2 | c.3062T>C | p.F1021S | VAGTVLLTVGLLVLLEWQLNTAEAL[p.F1021S]LSLSASVGLSVDFTVNYCISYHLCPHP | NTAEALSLS,EALSLSASV,LNTAEALSL,AEALSLSAS,LSLSASVGL,ALSLSASVGL,SLSASVGLSV,QLNTAEALSL,NTAEALSLSA,WQLNTAEALS,AEALSLSASV | KIRC |
| DKK2 | c.689G>A | p.R230H | KPVLHQGEVCTKQRKKGSHGLEIFQ[p.R230H]HCDCAKGLSCKVWKDATYSSKARLHV | EIFQHCDCA,FQHCDCAKGL,LEIFQHCDCA | CRC |
| DLC1 | c.1049C>T | p.A350V | LATQEPTDNQVRLRKKEIREDRDR[p.A350V]VRLDSMVLLIMKLDQLDQDIENALST | RVRLDSMVL,RDRVRLDSM,VRLDSMVLL,REDRDVRL,RV,RLDSMVLLI,EIREDRDVR,KEIREDRDRV | CRC |
| DLC1 | c.2222G>C | p.S741T | ISALNGNRINVPMVRKRSVSNSTQT[p.S741T]TSSSSQSETSSAVSTPSPVTRTRSLS | RSVSNSTQTT | BLCA,PRAD,TGCT,THCA |
| DLC1 | c.666G>T | p.E222D | ISLSELKDAPKVNAVDTLNVKDIAP[p.E222D]DKQLLNSAVIAQQRRKPDPPKDENER | NVKDIAPDK | CRC |
| DLEU7 | c.248C>T | p.A83V | RARPGPGREERGGVGTRSRRTAAR[p.A83V]VNSPEEEVVRGAEGGAELLPFPRDRG | RSRRTAARV,RTAARVNSP,RSRRTAARVN,RTAARVNSPE | ACC |
| DLG2 | c.1871C>T | p.S624L | KRRVERKERARLKTVKFNAKPGVID[p.S624L]LKGSFNDKRKKSFIFSRKPFFYKNKE | GVIDLKGSF,NAKPGVIDLK,DLKGSFNDKR | UCEC |
| DLGAP3 | c.1130delG | p.G377fs | GLLGPETKAKARTYHYLQVPQDDWG[p.G377fs]VTPPVARMGRSPAAGCGAAATSKPWGMRRAETQTAAPRHLPKQSPDASPPVAPPAWTRPGSTAVSHPGSTPGA | WTRPGSTAV,TAAPRHLPK,ATSKPWGMR,VARMGRSPA,TSKPWGMRR,PVAPPAWTR,QVPQDDWGV,QSPDASPPV,S TPGAPSLA,SPAAGCGAA,KPWGMRRAE,VPSPLDSSA,AR MGRSPAA,RMGRSPAAG,GAAATSKPW,MRRAETQTA,RR | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| DLL3 | | | PSLATAVPSPLDSSAMS* | AETQTAA, TQTAAPRHL, KQSPDASPP, GSTPGAPSL, LATAV PSPL, SPPVAPPAW, LQVPQDDWGV, KQSPDASPPV, SLATA VPSPL, QTAAPRHLPK, ATSKPWGMRR, VARMGRSPAA, TS KPWGMRRA, GMRRAETQTA, RAETQTAAPR, VSHPGSTPG A, DWGVTPPVAR, VTPPVARMGR, DASPPVAPPA, SPAAGC GAAA, KPWGMRRAET, VPSPLDSSAM, WGVTPPVARM, CG AAATSKPW, MRRAETQTAA | BLCA |
| DLL3 | c.952G>C | p.D318 H | PRSFECTCPRGFYGLRCEVSGVTCA[p.D 318H]HGPCFNGGLCVGGADPDSAYIC HCPP | VTCAHGPCF, CEVSGVTCAH, GVTCAHGPCF | BLCA |
| DMBT 1 | c.4562G>T | p.R152 1L | SRASTAGSESTLALRLVNGGDRCRG[p. R1521L]LVEVLYQGSWGTVCDDYWDT NDANVV | GLVEVLYQGS, RCRGLVEVLY | LUAD |
| DMD | c.5316G>C | p.K177 2N | DHCRKLVEPQISELNHRFAAISHRI[p.K1 772N]NTGKASIPLKELEQNSDIQKLLE PL | ISHRINTGK, RINTGKASI, NTGKASIPL, AISHRINTGK, NTGKA SIPLK, HRINTGKASI | BRCA |
| DMD | c.9584G>A | p.R319 5H | NVPLCVDMCLNWLLNVYDTGRTGRI[p. R3195H]HVLSFKTGIISLCKAHLEDKYR YLFK | TGRTGRIHV, HVLSFKTGI, TGRIHVLSF, TGRIHVLSFK, RTGRI HVLSF, RIHVLSFKTG, IFIVLSFKTGI | CRC |
| DMPK | c.131G>A | p.R44H | AGVGPGLPGAGAPARPSPGRPPGAG[p. R44H]HLRTGPGQVRGRLLAVGPKSRV FQSV | HLRTGPGQV, HLRTGPGQVR | CESC |
| DMRT 1 | c.133T>A | p.S45T | PGVPPQGRAGPGKASGALVGAASG[p. S45T]TSAGGSSRGGGSGSGASDLGA GSKKS | ALVGAASGT, GTSAGGSSR | ACC |
| DMRT 2 | c.317C>G | p.T106 S | RGGPQPRPPLAPQASPAGTGPRERC[p. T106S]SPAGGGAEPRKLSRTPKCARCR NHGV | GPRERCSPA, GPRERCSPAG | KIRP |
| DMXL 2 | c.7236C>A | p.D241 2E | GGGVKLVVKPRRQSENISAPPVLSE[p.D 2412E]EIDKHRRRFNMRMLVPGRPVK DATPP | EEIDKHRRRF | MM |
| DNAH 10 | c.5558G>T | p.C185 3F | GAPAGPAGTGKTETTKDLAKALGLL[p. C1853F]FVVTNCGEGMDYRAVGKIFSG LAQCG | KALGLLFVV, LAKALGLLF, AKALGLLLFV, LAKALGLLFV, FVVT NCGEGM, DLAKALGLLF, AKALGLLFVV | THCA |
| DNAH 10 | c.5663G>A | p.R188 8Q | DYRAVGKIFSGLAQCGAWGCFDEFN[p. R1888Q]QIDASVLSVISSAIQTIRNALI HQLT | QIDASVLSV, EFNQIDASV, DEFNQIDAS, NQIDASVLSV, DEF NQIDASV | UCEC |
| DNAH 14 | c.4099C>T | p.R136 7C | QDIGPPAVKMLISAEGEGLVLPKKI[p.R 1367C]CVRSAVEQMLVNVEKSMFDVL KKERY | KKICVRSAV, CVRSAVEQW, CVRSAVEQWL, LVLPKKICVR, L PKKICVRSA | UCEC |
| DNAH 3 | c.10099G> C | p.E336 7Q | LNLRIKYIIDHFTLSIYNNVCRSLF[p.E33 67Q]QKDKLLFSLLLTIGIMKQKKEITEEV KKERY | SLFQKDKLL, NVCRSLFQK, LFQKDKLLF, QKDKLLFSL, FQKDK LLFSL, SLFQKDKLLF | CESC |
| DNAH 5 | c.11465G>T | p.R382 2L | QKLEISAETEVQINSAREEYRPVAT[p.R3 822L]LGSILYFLITEMRLVNEMYQTSLR QF | VATLGSILY, TLGSILYFL, ATLGSILYF, RPVATLGSI, EEYRP VATL, PVATLGSILY, ATLGSILYFL, TLGSILYFLI, RPVATLG SIL, REEYRPVATL, VATLGSILYF | LUAD |
| DNAH 5 | c.2225G>A | p.R742 Q | LFRETECMAQMGLEVSPLATSLFQK[p. R742Q]QDRYKRNFSNMKMMLAEYQR VKSKIP | LFQKQDRYK, SLFQKQDRY, KQDRYKRNF, SLFQKQDRYK, TS LFQKQDRY, LFQKQDRYKR, QKQDRYKRNF | SKCM |

TABLE 8-continued

| gene | cDNA Change | Protein Change | Mutation Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| DNAH5 | c.2945G>A | p.R982H | ELLSHFNHQNMDALLKVTRNTLEAI[p.R982H]HKRIHSSHTINFRDSNSASNMKQNSL | NTLEAIHKR,AIHKRIHSSH,NTLEAIHKRI,HKRIHSSHTI | CRC |
| DNAH5 | c.5389C>G | p.Q1797E | TIELDKPVMAEGNVEVWLNSLLEES[p.Q1797E]ESSLHLVIRQAAANIQETGFQLTEFL | ESESSLHLV,LLEESESSL,ESSLHLVIR,ESESSLHL,SESSLHVI,SLLEESESSL,LEESESSLHL,ESESSLHLV | HNSC |
| DNAH5 | c.671G>A | p.R224Q | FLSSLEGFVNVLSGAQESLKEKVNL[p.R224Q]QKCDILELKTLKEPTDYLTLANNPET | LQKCDILEL,NLQKCDILEL,SLKEKVNLQK,LQKCDILELK | CRC |
| DNAH5 | c.9590G>A | p.R319Q | HVTPKSYLSFIQGYKFIYGEKHVEV[p.R3197Q]QTLANRMNTGLEKLKEASESVAALSK | EKHVEVQTL,HVEVQTLANR,GEKHVEVQTL,VEVQTLANRM | OV |
| DNAH5 | c.9706G>A | p.D323N | KEASESVAALSKELFAKEKELQVAN[p.D3236N]NKADMVLKEVTMKAQAAEKVKAEVQK | ANNKADMVLK,QVANNKADMV,LQVANNKADM,KELQVANNKA | SKCM |
| DNAH5 | c.8882G>A | p.R296Q | LCKGRDIPCSDDCSLMGTLGEAVTI[p.R2961Q]QTWNIAGLPSDSFSIDNGLIIMNARR | IQTWNIAGL,GEAVTIQTW,TIQTWNIAGL,EAVTIQTWNI | UCEC |
| DNAH7 | c.4639G>A | p.D154N | LESIFTGSEDIRAQLPQDSKRFEGI[p.D1547N]NIDFKELAYDAQKIPNVVQTTNKPGL | NIDFKELAY,RFEGINIDF,SKRFEGINI,RFEGINIDFK,INIDFKELAY,KRFEGINIDF | CRC |
| DNAH9 | c.8979C>G | p.S299R | KPPAIVNCTAIHWFHEWPQQALESV[p.S2993R]RLRFLQNTEGIEPTVKQSISKFMAFV | SVRLRFLQN,RLRFLQNTE,QALESVRLR,QQALESVRL,ALESVRLRF,LESVRLRFL,SVRLRFLQNT,RLRFLQNTEG,QALESVRLRF | LUAD |
| DNAH9 | c.691G>T | p.V231L | PNKPELALKPSSPLVTLEFNPKDSH[p.V231L]LLLGGCYNGQIACWDTRKGSLVAELS | NPKDSHLLL,SHLLLGGCY,LEFNPKDSHL | LUAD |
| DNAJC1 | c.578del A | p.K193fs | AVVWSIYLEKQLDELLSRKKREKKK[p.K193fs]RLAARVWMYQNSVLQKKMKDC* | RVWMYQNSV,RLAARVWMY,MYQNSVLQK,VWMYQNSVL,REKKKRLAA,KKRLAARVWM,KRLAARVWMY,WMYQNSVLQ,WMYQNSVLQK,KKRLAARVWM,RVWMYQNSVL,MYQNSVLQKK,KRLAARVWMY,YQNSVLQKKM,KKKRLAARVW,ARVWMYQNSV | STAD |
| DNAJC10 | c.239T>A | p.I80K | FKKLALKLHPDKNPNNPNAHGDFLK[p.I80K]KNRAYEVLKDEDLRKKYDKYGEKGLE | NAHGDFLKK,KNRAYEVLK,LKKNRAYEV,KKNRAYEVL,FLKKNRAYEV,GDFLKKNRAY,LKKNRAYEVL | MM |
| DNAJC12 | c.404G>A | p.R135K | DLMLEESDKTHTTKMENEECNEQRE[p.R135K]KKKEELASTAEKTEQKEPKPLEKSVS | EQREKKKEEL,KKKEELASTA | MM |
| DNAJC13 | c.3742G>A | p.E124 8K | TPRLQSNTRALYQYCPIPIINYPQL[p.E1248K]KNELFCNIYYLKQLCDTLRFPDWPIK | PIINYPQLK,KNELFCNIY,YPQLKNELF,LKNELFCNI,QLKNELFCNI,NYPQLKNELF,KNELFCNIYY,INYPQLKNEL,LKNELFCNIY | UCEC |
| DNAJC24 | c.181G>A | p.E61K | LMYHPDKQSTDVPAGTVEECVQKFI[p.E61K]KIDQAWKILGNEETKREYDLQRCEDD | KFIKIDQAW,FIKIDQAWK,IKIDQAWKI,FIKIDQAWKI,KFIKIDQAWK,QKFIKIDQAW,IKIDQAWKIL | CRC |
| DNASE1L1 | c.634G>A | p.D212N | CASLTKKRLDKLELRTEPGFHHVIA[p.D212N]NGEDTTVRASTHCTYDRVLHGERCR | VIANGEDTTV | CESC |

TABLE 8-continued

| gene | cDNA Change | Protein Change | Mutation Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| DNM2 | c.1134G>C | p.E378D | TLELSGGARINRIFHERFPFELVKM[p.E3 78D]DPFDEKDLRREISYAIKNIHGVRTGL F | LVKMDFDEK, PPFELVKMDF | LIHC |
| DNM2 | c.2371_2 372insC | p.P791 fs | QRRPVSSIHPGRPPAVRGTTPGPP[p. P791fs]PDSCSRGGSSLLLGAPNPIPAW TPERVCQQ* | LLLGAPNPI, CSRGGSSLL, SRGGSSLLL, NPIPAWTPE, IPAWT PERV, SLLLGAPNPI, LLGAPNPIPA, CSRGGSSLLL, NPIPAWT PER, LGAPNPIPAW | STAD |
| DNMB P | c.232A>C | p.T78P | SSFVEIVTIPSLKEGERLFVCICEF[p.T 78P]PSQELDNLPLHRGDLVILDGIPTAGW | FPSQELDNL | KIRC |
| DNMT 1 | c.1294G>A | p.E432K | LTCFSVYCKHGHLCPIDTGLIEKNI[p.E4 32K]KLFFSGSAKPIYDDDPSLEGGVNGK N | GLIEKNIKL, KLFFSGSAK, IEKNIKLFF, IKLFFSGSA, NIKLFFSGS A, GLIEKNIKLF | CRC |
| DNMT 1 | c.151G>A | p.E51K | RRLKDLERDSLTEKECVKEKLNLLH[p.E5 1K]KFLQTEIKNQLCDLETKLRKEELSEE | KLNLLHKFL, KEKLNLLHK, EKLNLLHKF, LLHKFLQTEI, KEKLN LLHKF | UCEC |
| DNMT 1 | c.2984G>A | p.R995Q | PEHYRKYSDYIKGSNLDAPEPYRIG[p.R9 95Q]QIKEIFCPKKSNGRPNETDIKIRVN K | QIKEIFCPK, RIGQIKEIF, GQIKEIFCPK, QIKEIFCPKK, APE PYRIGQI, YRIGQIKEIF | TGCT |
| DNMT 1 | c.4591G>C | p.E1531Q | RHNHWAGLYGRLEWDGFFSTTVTNP[p. E1531Q]QPMGKQGRVLHPEQHRVV | VTNPQPMGK, TTVTNPQPM, QPMGKQGRV, TVTNPQPM GK, QPMGKQGRVL, STTVTNPQPM | CRC |
| DNMT 3A | c.2207G>A | p.R736H | NDLSIVNPARKGLYEGTGRLFPEFY[p.R 736H]HLLHDARPKEGDDRPFFWLFEN VVAM | HLLHDARPK, FYHLLHDAR, FEFYHLLHD, EFYHLLHDAR, PEF YHLLHDA | LAML |
| DNMT 3A | c.2644C>T | p.R882C | DILWCTEMERVFGPVHYTDVSNMS[p. R882C]CLARQRLLGRSWSVPVIRHLFA PLKE | VSNMSCLAR, NMSCLARQR, DVSNMSCLA, YTDVSNMSCL, NMSCLARQRL, CLARQRLLGR, DVSNMSCLAR, SNMSCLAR QR | LAML |
| DNMT 3A | c.2645G>A | p.R882H | DILWCTEMERVFGPVHYTDVSNMS[p. R882H]HLARQRLLGRSWSVPVIRHLF APLKE | YTDVSNMSH, VSNMSHLAR, MSHLARQR, NMSHLARQR, DVSNMSHLA, YTDVSNMSHL, HLARQRLLGR, MSHLARQRL L, DVSNMSHLAR, SNMSHLARQR, NMSHLARQRL | LAML |
| DNMT 3B | c.274C>T | p.R92W | TQDLTGDGDGDGDGDSDTPVMPKLF[p. R92W]WETRTRSESPAVRTRNNNSV SSRERH | VMPKLFWET, KLFWETRTR, MPKLFWETR, TPVMPKLFW, V MPKLFWETR | CRC |
| DOCK 1 | c.2590G>A | p.E864K | SKMFTEFILNVPMGLLTIQKLYCLI[p.E8 64K]KIVHSDLFTQHDCREILLPMMTDQ LK | KLYCLIKIV, IQKLYCLIK, IKIVHSDLF, CLIKIVHSDL, TIQKLY CLIK, LIKIVHSDLF, IQKLYCLIKI | CRC |
| DOCK 10 | c.5489C>T | p.A183 0V | NENILVEQLYMCVEFLMKSERYELI[p.A 1830V]VDVNKPIIAVFEKQRDFKKLSDL YYD | LIVDVNKPI, ELIVDVNKP, WKSERYELIV, SERYELIVDV | CRC |
| DOCK 11 | c.505C>G | p.Q169 E | FEIDEDCEKDEDSSSLCSQKGGVIK[p.Q 169E]EGWLHKANVNSTITVTMKVFKR RYFY | VIKEGWLHKA, GVIKEGWLHK, KEGWLHKANV | TGCT |
| DOCK 3 | c.3547C>T | p.R118 3C | ELFSLLTQLFGPYPSILLEKVEQET[p.R1 183C]CETGISFVTSVTRLMERLLDYRDC MK | TWCETGISF, QETWCETGI, VEQETWCET, CETGISFVT, ETW CETGISF, CETGISFVTS | CRC |
| DOCK 5 | c.529G>A | p.E177K | IDHGNRMLGLDLVRDDNGNILDPD[p. E177K]KTSTIALFKAHEVASKRIEEKIQE EK | KTSTIALFK, ILDPDKTSTI, KTSTIALFKA, DPDKTSTIAL | CRC |
| DOCK 8 | c.3332 del T | p.L111 1fs | TLISMRLEFLRILCSHEHYLNLNLF[p.L1 11fs]L* | HYLNLNLFL | KICH |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| DOCK8 | c.531_532 insG | p.A177 fs | HKTLPKQTFESETLECSEPAAQAGP[p.A177fs]PPLKRAVRRVWERPRHCL* | AQAGPPPLK,RAVRRVWER,GPPPLKRAV,AAQAGPPPL,LK RAVRRVW,AAQAGPPPLK,AVRRVWERPR,RVWERPRHCL | KIRC |
| DOK5 | c.820C>T | p.R274 W | KMSERAASLSTMVPLPRSAYWQHIT[p.R274W]WQHSTGQLYRLQDVSSPLKH RTETF | SAYWQHITW,YWQHITWQH,WQHSTGQLY,WQHITWQH S,RSAYWQHITW,YWQHITWQHS,WQHSTGQLY,WQHIT WQHST,ITWQHSTGQL | CRC |
| DOK7 | c.1382G>A | p.G461 D | GQTSAGCPSGWLGTRRRGLVMEAPQ[p.G461D]DSEATLPGPAPGEPWEAGG PHAGPPP | APQDSEATL,MEAPQDSEA,MEAPQDSEAT | ACC |
| DOPE Y2 | c.3586G>A | p.E119 6K | KAGAKLSLVRVDSDKTQASESFSSD[p.E1196K]KEADLELQALTTSRLLKQORER QEAV | ASESFSSDK,KEADLELQA,QASESFSSDK,KEADLELQAL,SES FSSDKEA | BLCA |
| DOPE Y2 | c.6143A>C | p.Y204 8S | FEQKAMLLKRQAFAVFSGELDQYHL[p.Y2048S]SLPLIQERLTDNLRVGQTSIVA AQMF | SLPLIQERL,QYHLSLPLI,LSLPLIQER,DQYHLSLPL,GELDQYH LS,HLSLPLIQER,GELDQYHLSL,LDQYHLSLPL,DQYHLSLPLI, LSLPLIQERL | KIRC |
| DPCR1 | c.2302_2304de\|TTG | p.L768 de\| | NRERTANENTTPSPAQPTENGDRTP[p.L768de\|]ANEKTTPSLAEPTENGKRTPF ANEKTTS | TENGDRTPA | KIRC |
| DPEP1 | c.31G>T | p.V11L | MWSGWWLWPLL[p.V11L]LAVCTADFF RDEAERIMRDSPVIDGH | WLWPLLAVC,GWWLWPLLA,WWLWPLLAV,LLAVCTADF, SGWWLWPLL,LAVCTADFF,WPLLAVCTA,WLWPLLAVCT, WSGWWLWPLL,GWWLWPLLAV,LAVCTADFFR,LLAVCTA DFF | BRCA |
| DPP10 | c.547G>A | p.V183 I | TASYVIYNIHTREVWELNPPEVEDS[p.V183I]ILQYAAWGVQGQQLIYIFENNIYY QP | EVEDSILQY,ILQYAAWGV,VEDSILQYA,NPPEVEDSI,SILQY AAWGV,EVEDSILQYA,PEVEDSILQY,VEDSILQYAA | GBM |
| DPP6 | c.2271G>T | p.L757 F | TFTCGSALSPITDFKLYASAFSERY[p.L757F]FGLHGLDNRAYEMTKVAHRVSALE EQ | FSERYFGLH,AFSERYFGL,ASAFSERYF,ERYFGLHGL,SAFSE RYFGL,YASAFSERYF,SERYFGLHGL | LUAD |
| DPP8 | c.493G>A | p.G165 R | QATLDYGMYSREEELLRERKRIGTV[p.G165R]RIASYDYHQGSGTFLFQAGSGIY HVK | RKRRIGTVRI,IGTVRIASY,TVRIASYDY,KRIGTVRIA,GTVRIAS YDY,RERKRIGTVR,RIGTVRIASY,TVRIASYDYH,RKRIGTVRI A | CRC |
| DPY19 L1 | c.1134C>A | p.F378 L | ILKYLTSKIFGIADDAHIGNLLTSK[p.F378L]LFSYKDFDTLLYTCAAEFDFMEKETP | LTSKLFSYK,LLTSKLFSY,GNLLTSKLF,SKLFSYKDF,KLFSYK DFDT,LLTSKLFSYK,NLLTSKLFSY,IGNLLTSKLF | CRC |
| DPY19 L1 | c.745G>T | p.V249 L | MLLVTHILRATKLYRGSLIALCISN[p.V249L]LFFMLPWQFAQFVLLTQIASLFAVY V | LIALCISNL,CISNLFFML,IALCISNLF,LFFMLPWQF,ALCISNL FF,LCISNLFFM,SNLFFMLPW,SLIALCISNL,ALCISNLFFM,IA LCISNLFF,NLFFMLPWQF,LIALCISNLF,ISNLFFMLPW | KIRP |
| DPY19 L2 | c.628A>G | p.M21 0V | INAIKRPHLYPEVIIASWYCTFMGI[p.M210V]VNLFGLETKTCWNVTRIEPLNEVQ SC | CTFMGIVNL,CTFMGIVNLF,SWYCTFMGIV | PRAD |
| DQX1 | c.1514G>A | p.R505 H | ASCEFDCVDEMLTLAAMLTAAPGFT[p.R505H]HPPLSAEFEALRRALEHTGDH SSLI | APGFTHPPL,MLTAAPGFTH | GBM |
| DRD5 | c.825C>A | p.S275 R | RIAQVQIRRISSLERAAEHAQSCRS[p.S275R]RAACAPDTSLRASIKKETVKLTLS V | HAQSCRSRA,RSRAACAPD,AQSCRSRAA,RSRAACAPDT,R AACAPDTSL,AQSCRSRAAC | GBM |
| DSG4 | c.383G>T | p.R128 L | NPRTGEINITSVVDREITPLFLIYC[p.R128L]LALNSRGEDLERPLELRVKVMDIND N | FLIYCLALN,IYCLALNSR,TPLFLIYCL,FLIYCLALNS,ITPLFLIYC L,LIYCLALNSR,TPLFLIYCLA | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| DSP | c.478C>G | p.R160G | CDAYQKRLLQLQEQMRALVKAISVP[p. R160G]GVRRASSKGGGGYTCQSGSG WDEFTK | AISVPGVRR,KAISVPGVR,GVRRASSKG,YKAISVPGV,KAISV PGVRR,LYKAISVPGV | HNSC |
| DST | c.13228 G>T | p.A441 0S | TICGKSVERQNKLEEALLFSGQFTD[p.A 4410S]SLQALIDWLYRVEPQLAEDQPV HGDI | FTDSLQALI,SLQALIDWL,FSGQFTDSL,GQFTDSLQA,FTDSL QALID,SLQALIDWLY,GQFTDSLQAL,QFTDSLQALI | LUAD |
| DST | c.5300C>A | p.S176 7Y | ITLTRSLSVQDGLDEMLDWMGNVES[p. S1767Y]YLKEQGQVPLNSTALQDIISKN IMLE | WMGNVESYL,MGNVESYLK,YLKEQGQVPL,WMGNVESYL K,DWMGNVESYL,ESYLKEQGQV,LDWMGNVESY | UCEC |
| DSTN | c.301_302 insT | p.F101 fs | KDCRYALYDASFETKESRKEELMFF[p.F 101fs]FVGTRTSTSEK* | LMFFFVGTR,GIRTSTSEK,ELMFFFVGT,RKEELMFFF,EELM FFFVG,KEELMFFFV,LMFFFVGTRT,ELMFFFVGTR,SRKEEL MFFF,FFFVGTRTST,ELMFFFVGT,KEELMFFFVG | STAD |
| DUOX 2 | c.2640C>A | p.F880 L | SPEDKSRLMFTMYDLDENGFLSKDE[p. F880L]LFTMMRSFIEISNNCLSKAQLAE VVE | FLSKDELFT,GFLSKDELF,LFTMMRSFI,ELFTMMRSF,LSKDE LFTM,SKDELFTMM,DELFTMMRS,FLSKDELFTM,ELFTM MRSFI,NGFLSKDELF,LSKDELFTMM,DELFTMMRSF | CRC |
| DVL2 | c.1801 de|G | p.A601 fs | YGGGSASSQHSEGSRSSGSTRSDGG[p. A601fs]QGARGGEPRSGPPSPSPAVS LSPPAEGAAFGGVGKQVGLAMGALLH PEAQLGVPLISEPTQGSIPMDRPLAWPS PTTP* | ALLHPEAQL,SLSPPAEGA,GAAFGGVGK,GPPSPSPAV,SPP AEGAAF,EPTQGSIPM,IPMDRPLAW,RPLAWPSPT,VGKQV GLAM,KQVGLAMGA,PEAQLGVPL,AQLGVPLIS,GSIPMDR PL,LAWPSPTP,AEGAAFGGV,AMGALLHPEA,LLHPEAQL GV,AVAVSLSPPA,SLSPPAEGAA,KQVGLAMGAL,LISEPTQ GSI,STRSDGGQGA,RSGPPSPSPA,SPSPAVAVSL,HPEAQL GVPL,RPLAWPSPTT,LSPPAEGAAF,GVGKQVGLAM,SEPT QGSIPM,PEAQLGVPLI,AEGAAFGGVG | CRC |
| DVL2 | c.197T>G | p.V66G | GDFKSVLQRPAGAKYFFKSMDQDFG[p. V66G]GVKEEISDDNARLPCFNGRVVS WLVS | SMDQDFGGV,KSMDQDFGGV,SMDQDFGGVK | GBM |
| DYNC 2H1 | c.2649G>T | p.E883 D | KEWIVIGQVDMEALVEKHLFTVHDW[p. E883D]DKNFKALKIKGKEVERLPSAVK VDCL | HLFTVHDMDK,TVHDWDKNFK,HDWDKNFKAL | UCEC |
| DYRK1 B | c.1633 de|C | p.Q545 fs | DVPHKTHQAPASASSLPGTGAQLPP[p. Q545fs]SPDTLWPHHQPHHHPRS* | HHQPHHHPR,LVVPHHQPH,SPDTLVVPH,LPPSPDTLV,QL PPSPDTLV,AQLPPSPDTL,LPPSPDTLVV | STAD |
| DYRK4 | c.1402 de|A | p.K468 fs | TASRRQTFFDSKGFPKNITNNRGKK[p.K 468fs]DTQIPRTSRWC* | TQIPRTSRW,DTQIPRTSR,RGKKDTQIPR | STAD |
| DZIP3 | c.964A>C | p.M32 2L | NLKYPGENDQSFSGKKCLKEGCTGD[p. M322L]LIVRMLQCDVPGIVKILFEWRK DEYI | KEGCTGDLV,CLKEGCTGDL | LUAD |
| E2F7 | c.272T>G | p.I91S | PITPVKFVDRQQAEPWTPTANLKML[p. I91S]SSAASPDIRDREKKKGLFRPIENKD D | NLKMLSSAA,LKMLSSAAS,KMLSSAASP,MLSSAASPDI,LK MLSSAASP | TGCT |
| EAF2 | c.327de|A | p.V109 fs | CILIINHDTGECRLEKLSSNITVKK[p.V10 9fs]QELKEAVKFSIVKNNSNNKCGIQPG LPIL* | ITVKKQELK,IVKNNSNNK,KQELKEAVK,KKQELKEAV,QELK EAVKF,KEAVKFSIV,CGIQPGLPI,SIVKNNSNNK,ELKEAVKF SI,KQELKEAVKF,CGIQPGLPIL | STAD |
| EBAG 9 | c.559G>A | p.E187 K | EEDAAWQAEEVLRQQKLADEREKRAA[p. E187K]KQQRKKMEKEAQRLMKKEQN KIGVKL | RAAKQQRKK,KQQRKKMEK,RAAKQQRKKM | CRC |
| EBF1 | c.1058A>G | p.D353 G | SYKSKQFCKGTPGRFIYTALNEPTI[p.D3 53G]GYGFQRLQKVIPRHPGDPERLPKE VI | ALNEPTIGY,PTIGYGFQR,NEPTIGYGF,IGYGFQRLQK,GYG FQRLQKV,TALNEPTIGY,LNEPTIGYGF | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| EBPL | c.565C>G | p.L189V | YCWLYLPFFNGVWVLIPGLLLWQSW[p.L189V]VELKKMHQKETSSVKKFQ* | GLLLWQSWV, LLMQSWVEL, WQSWVELKK, LLLMQSWVE L, LLMQSWVELK, WQSWVELKM | KICH, KIRP, TGCT |
| EBPL | c.587A>C | p.Q196P | FFNGVWVLIPGLLLWQSWLELKKMH[p.Q196P]PKETSSVKKFQ* | KMHPKETSS, KMHPKETSSV | KICH |
| ECE2 | c.760G>A | p.D254N | DRGVSPCEDFYQFSCCGWIRNPLP[p.D254N]NGRSRWNTFNSLWDQNQAIL KHLLEN | NGRSRWNTF, NPLPNGRSRW | CESC |
| ECI2 | c.164A>G | p.K55R | HMNRTAMRASQKDFENSMNQVKLLK[p.K55R]RDPGNEVKLKLYALYKQATEGP CNMP | LLKRDPGNEV, SMNQVKLLKR | TGCT |
| ECM1 | c.796G>A | p.E266K | EIGYSRCCHCRSHTNRLECAKLVWE[p.E266K]KAMSRFCEAEFSVKTRPHWCCT RQGE | KAMSRFCEA, VWEKAMSRF, LVWEKAMSR, AKLVWEKAM, WEKAMSRFC, KLVWEKAMSR, LVWEKAMSRF, CAKLVWEK AM | BLCA |
| EDA | c.174G>C | p.L58F | RAGEGNSCLLFLGFGLSLALHLLT[p.L58F]FCCYLELRSELRRERGAESRLGGSGT RQGE | HLLTFCCYL, LTFCCYLEL, SLALHLLTF, TFCCYLELR, LHLLTFCC Y, LLTFCCYLEL, SLALHLLTFC, LTFCCYLELR, LSLALHLLTF, AL HLLTFCCY | HNSC |
| EDNRB | c.1349T>G | p.L450R | SRILKLTLYNQNDPNRCELLSFLLV[p.L450R]WDYIGINMASLNSCINPIALYLVSK R | LSFLLVWDY, LLVWDYIGI, SFLLVWDYI, WDYIGINMA, FLLV WDYIGI, LLSFLLVWDY, CELLSFLLVW, LVWDYIGINM | CRC |
| EEA1 | c.1709delA | p.N570fs | EREDLYAKIQAGEGETAVLNQLQEK[p.N570fs]TIHYRSK* | QLQEKTIHY, QLQEKTIHYR, NQLQEKTIHY | STAD |
| EEF1A1 | c.1294_1295AC>TT | p.T432L | GKPMCVESFSDYPPLGRFAVRDMRQ[p.T432L]LVAVGVIKAVDKKAAGAGKVT KSAQKA | QLVAVGVIK, AVRDMRQLV, FAVRDMRQL, RDMRQLVAV, RQLV AVGVI, QLVAVGVIKA, LVAVGVIKAV, AVRDMRQLVA, RQLVAVGVIK, FAVRDMRQLV | LIHC |
| EEF1A2 | c.1253A>C | p.Y418S | SLKSGDAAIVEMVPGKPMCVESFSQ[p.Y418S]SPPLGRFAVRDMRQTVAVGVIK NVEK | ESFSQSPPL, SPPLGRFAV, SQSPPLGRF, SFSQSPPLGR, VESF SQSPPL, FSQSPPLGRF, SQSPPLGRFA | BLCA, TGCT |
| EEF1B2 | c.127A>G | p.S43G | YLADKSYIEGTVPSQADVAVFEAVS[p.S43G]PPPADLCHALRWYNHIKSYEKEK AS | EAVSGPPPA, FEAVSGPPP, FEAVSGPPPA | KIRP, PRAD, SKCM |
| EEF2K | c.2017G>A | p.E673K | TDCDEGGEYDGMQDEPRYMMLAREA[p.E673K]KMLFTGGYGLEKDPQRSGDL YTQAAE | MMLAREAKM, MLAREAKML, YMMLAREAK, AKMLFTGGY, LAREAKMLF, REAKMLFTG, YMMLAREAKM, MMLAREAK ML, KMLFTGGYGL, MLAREAKMLF, RYMMLAREAK, EAKML FTGGY, REAKMLFTGG | BLCA |
| EFCAB4B | c.793G>C | p.E265Q | MEQQIKSEKEQPLLKDTERFQARSQ[p.E265Q]QLEQKLLCKEQELEQLTQKOKR LEGQ | RFQARSQQL, RSQQLEQKL, SQQLEQKLL, QARSQQLEQK, E RFQARSQQL, FQARSQQLEQ, RSQQLEQKLL | LUAD |
| EFCAB6 | c.1136G>A | p.R379K | NWKQFLTSFHEPQGLQVSSKGPLTK[p.R379K]KNSINSRNESHKENIITKLFRHTE DH | SSKGPLTKK, GPLTKKNSI, VSSKGPLTKK, LTKKNSINSR | BLCA, GBM, PRAD |
| EFCAB6 | c.3004G>A | p.E1002K | DQSKTNVISICKMQEVLEECGCSLT[p.E1002K]KGELTHLLNSWGVSRHDNAINY LDFL | SLTKGELTHL | HNSC |
| EGFR | c.1786C>T | p.P596S | CTGRGPDNCIQCAHYIDGPHCVKTC[p.P596S]SAGVMGENNTLVWKYADAGH VCHLCH | CVKTCSAGV, VKTCSAGVM, CVKTCSAGVM | GBM |
| EGFR | c.1787C>T | p.P596L | CTGRGPDNCIQCAHYIDGPHCVKTC[p.P596L]LAGVMGENNTLVWKYADAGH VCHLCH | CVKTCLAGV, GPHCVKTCL, VKTCLAGVM | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| EGFR | c.1793G>C | p.G598A | GRGPDNCIQCAHYIDGPHCVKTCPA[p.G598A]AVMGENNTLVWKYADAGHVCHLCHPN | CVKTCPAAV, VKTCPAAVM, AVMGENNTL, AVMGENNTLV, CVKTCPAAVM, AAVMGENNTL | GBM |
| EGFR | c.1793G>T | p.G598V | GRGPDNCIQCAHYIDGPHCVKTCPA[p.G598V]VVMGENNTLVWKYADAGHVCHLCHPN | CVKTCPAVV, VKTCPAVVM, VVMGENNTLV, CVKTCPAVVM | GBM |
| EGFR | c.185T>G | p.L62R | KLTQLGTFEDHFLSLQRMFNNCEVV[p.L62R]RGNLEITYVQRNYDLSFLKTIQEVAG | MFNNCEVVR, EVVRGNLEI, VRGNLEITY, RMFNNCEVVR, V VRGNLEITY, CEVVRGNLEI | GBM |
| EGFR | c.2125G>A | p.E709K | QERELVEPLTPSGEAPNQALLRILK[p.E709K]KTEFKKIKVLGSGAFGTVYKGLWIPE | RILKKTEFKK, ILKKTEFKK, QALLRILKK, LRILKKTEF, R ILKKTEFKK, NQALLRILKK, LLRILKKTEF | GBM |
| EGFR | c.2156G>C | p.G719A | PSGEAPNQALLRILKETEFKKIKVL[p.G719A]ASGAFGTVYKGLWIPEGEKVKIPV AI | ASGAFGTVY, VLASGAFGT, LASGAFGTV, KIKVLASGA, KVLA SGAFG, IKVLASGAF, KKIKVLASG, VLASGAFGTV, ASGAFGT VVK, KIKVLASGAF, LASGAFGTVY, KKIKVLASGA, TEFKKIKVL A | LUAD |
| EGFR | c.2235_2249de\|GGAAT TAAGAGA GC | p.ELRE A746de\| | GAFGTVYKGLWIPEGEKVKIPVAIK[p.ELREA746de\|]TSPKANKEILDEAYVMAS VDNPHVCRLLGICLTSTVQLIT | AIKTSPKANK, KVKIPVAIKT, KTSPKANKEI | LUAD |
| EGFR | c.2303G>T | p.S768I | AIKELREATSPKANKEILDEAYVMA[p.S768I]IVDNPHVCRLLGICLTSTVQLITQL M | MAIVDNPHV, VMAIVDNPH, DEAYVMAI, IL DEAYVMAI, VMAIVDNPHV, AIVDNPHVCR, YVMAIVDNPH, DEAYVMAIVD | LUAD |
| EGFR | c.2512C>A | p.L838M | YLLNWCVQIAKGMNYLEDRRLVHRD[p.L838M]MAARNVLVKTPQHVKITDFGL AKLLG | RLVHRDMAA, DMAARNVLV, MAARNVLVK, LVHRDMAAR, RDMAARNVL, RLVHRDMAAR, DMAARNVLVK, HRDMAA RNVL, RDMAARNVLV | KIRC |
| EGFR | c.2573T>G | p.L858R | LVHRDLAARNVLVKTPQHVKITDFG[p.L858R]RAKLLGAEEKEYHAEGGKVPIKW MAL | KITDFGRAK, HVKITDFGR, FGRAKLLGA, HVKITDFGRA, RAK LLGAEEK | LUAD |
| EGFR | c.2582T>A | p.L861Q | RDLAARNVLVKTPQHVKITDFGLAK[p.L861Q]QLGAEEKEYHAEGGKVPIKWMA LESI | LAKQLGAEEK, KQLGAEEKEY | LUSC |
| EGFR | c.323G>A | p.R108K | QEVAGYVLIALNTVERIPLENLQII[p.R108K]KGNMYYENSYALAVLSNYDANKTG LK | QIIKGNMYY, LQIIKGNMY, LQIIKGNMYY, KGNMYYENSY | GBM |
| EGFR | c.754C>T | p.R252C | SPSDCCHNQCAAGCTGPRESDCLVC[p.R252C]CKFRDEATCKDTCPPLMLYNPT TYQM | RESDCLVCC | GBM |
| EGFR | c.865G>A | p.A289T | CPPLMLYNPTTYQMDVNPEGKYSFG[p.A289T]TTCVKKCPRNYVVTDHGSCVR | YSFGTTCVK, TTCVKKCPR, GKYSFGTTC, YSFGTTCVKK, KYSF GTTCVK, GTTCVKKCPR, GKYSFGTTCV | GBM |
| EGFR | c.866C>A | p.A289D | CPPLMLYNPTTYQMDVNPEGKYSFG[p.A289D]DTCVKKCPRNYVVTDHGSCVR ACGAD | YSFGDTCVK, DTCVKKCPR, GKYSFGDTC, YSFGDTCVKK, KYS FGDTCVK, GKYSFGDTC | GBM |
| EGFR | c.866C>T | p.A289V | CPPLMLYNPTTYQMDVNPEGKYSFG[p.A289V]VTCVKKCPRNYVVTDHGSCVR ACGAD | YSFGVTCVK, KYSFGVTCV, VTCVKKCPR, GKYSFGVTC, YSFG VTCVKK, KYSFGVTCVK, GVTCVKKCPR, GKYSFGVTCV | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| EGFR | c.910C>T | p.H304Y | VNPEGKYSFGATCVKKCPRNYVVTD[p.H304Y]YGSCVRACGADSYEMEEDGVRKCKKC | VVTDYGSCV, YVVTDYGSCV, WTDYGSCVR, CPRNYVVTDY | GBM |
| EGR1 | c.27G>C | p.Q9H | MAAAKAEM[p.Q9H]HLMSPLQISDPFGSFPHSPTMDNYPK | AAKAEMHLM, AEMHLMSPL, MHLMSPLQI, MAAAKAEMHL, AAAKAEMHLM, KAEMHLMSPL, EMHLMSPLQI, AEMHLMSPLQ | MM |
| EGR1 | c.994del C | p.P332fs | TSYQSQLIKPSRMRKYPNRPSKTPP[p.P332fs]TNALJTLAQWSPVIAASPAPTSSPATSASTQARSPSSAASACATSAAAATTSPPTSAPTQAKSPSPATSVEESLPGAMNARGIPRSTCGRRTRKQTKVLWPLRPPPLSLPTRPRLLPLTRPRLLPLIHPRPPPHTHPLCPPPSPLPAPRPTHPLCTVASPPRRWPPRTPLFPLLSRPRSAASLPQLSPTPSAPPQGFRT* | LTLAQWSPV, TLAQWSPVI, AQWSPVIAA, KQTKVLWPL, VIAASPAPT, AMNARGIPR, RLLPLTRPR, RLLPLIHPR, ATSASTQAR, STCGRRTRK, CTVASPPRR, LWPLRPPPL, STQARSPSS, QARSPSSAA, RSPSSAASA, ASACATSAA, KSPSPATSV, RSTCGRRTR, RTRKQTKVL, QTKVLWPLR, PTRPRLLPL, RPRLLPLTR, LITRPRLLPL, LIHPRPPPH, SLPGAMNAR, ESLPGAMNA, SPVIAASPA, SPAPTSSPA, RPPPLSLPT, LPLTRPRLL, RPRLLPLIH, HPRPPPHTH, RPPPHTHPL, SPLPAPRPT, APRPTHPLC, RPTHPLCTV, SLPTRPRLL, SKTPPTNAL, TQARSPSSA, TQAKSPSPA, VEESLPGAM, LSLPTRPRL, CPPPSPLPA, ALTLAQWSPV, TLAQWSPVIA, VLWPLRPPPL, RLLPLTRPRL, GAMNARGIPR, RSTCGRRTRK, KTPPTNALTL, STQARSPSSA, ASACATSAAA, RGIPRSTCGR, CGRRTRKQTK, RTRKQTKVLW, KQTKVLWPLR, KVLWPLRPPP, LTRPRLLPLI, HTHPLCPPPS, ESLPGAMNAR, WSPVIAASPA, TTSPPTSAPT, RPSKTPPTNA, SPATSSPPAT, APTSSPATSA, SPATSASTQA, SPATSVEESL, LPGAMNARGI, WPLRPPPLSL, LPTRPRLLPL, HPLCPPPSPL, LPAPRPTHPL, APRPTHPLCT, RPTHPLCTVA, LTLAQWSPVI, AQWSPVIAAS, TQARSPSSAA, TQAKSPSPAT, AKSPSPATSV, RKQTKVLWPL, LSLPTRPRLL, EESLPGAMNA | STAD |
| EGR2 | c.1105G>A | p.E369K | SKTPVHERPYPCPAEGCDRRFSRSD[p.E369K]KLTRHIRIHTGHKPFQCRICMRNFSR | RRFSRSDKL | CLL |
| EGR2 | c.1169G>A | p.R390H | SRSDELTRHIRIHTGHKPFQCRICM[p.R390H]HNFSRSDHLTTHIRTHTGEKPFACDY | RICMHNFSR, HNFSRSDHL, FQCRICMHNF, CMHNFSRSDH, MHNFSRSDHL | CRC |
| EGR2 | c.1189C>A | p.H397N | RHIRIHTGHKPFPQCRICMRNFSRSD[p.H397N]NLTTHIRTHTGEKPFACDYCGRKFAR | RNFSRSDNL, RSDNLTTHI, MRNFSRSDNL, FSRSDNLTTH, SRSDNLTTHI | CLL |
| EHD3 | c.130G>A | p.E44K | QTVSEGLKKLYKSKLLPLEEHYRFH[p.E44K]KFHSPALEDADFDNKPMVLLVGQYST | HYRFHKFHS, RFHKFHSPA, FHKFHSPAL, EEHYRFHKF, YRFHKFHSP, RPHKFHSPAL, YRFHKFHSPA, LEEHYRFHKF, EEHYRFHKFH | CRC |
| EHHADH | c.2112G>T | p.Q704H | LQKYYRQNPDIPQLEPSDYLKKLLAS[p.Q704H]HGNPPLKEWQSLAGSPSSKL* | ASHGNPPLK, LASHGNPPL, KLASHGNPPL, LASHGNPPLK | LUAD |
| EIF1AX | c.26G>A | p.G9D | MPKNKGKG[p.G9D]DKNRRGKNENESEKRELVFKEDGQE | KGDKNRRGK | THCA |
| EIF2C1 | c.416G>A | p.R139Q | EVTIPGEGKDRIFKVSIKWLAIVSW[p.R139Q]QMLHEALVSGQIPVPLESVQALDVAM | WLAIVSWQM, WQMLHEALV, AIVSWQMLH, SWQMLHEAL, LAIVSWQML, WLAIVSWQML, IVSWQMLHEA, KWLAIVSWQM, SWQMLHEALV, VSWQMLHEAL, WQMLHEALVS | CRC |
| EIF3J | c.23C>G | p.A8G | MAAAAAA[p.A8G]GGDSDSWDADAFSVEDPVRKVGGGGT | AAAGGDSDSW | TGCT |
| EIF4G3 | c.23G>A | p.R8H | MNSQPQT[p.R8H]HSPFFQRPQIQPPRATIPNSSPSIRP | QTHSPFFQR, SQPQTHSPF, QPQTHSPFF, SQPQTHSPFF, NSQPQTHSPF | CLL |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ELAVL2 | c.789G>T | p.L263F | RLDNLLNMAYGVKRFSPMTIDGMTS[p.L263F]FAGINIPGHPGTGWCIFVVNLAPDAD | MTIDGMTSF, TIDGMTSFA, DGMTSFAGI, MTSFAGINI, MTIDGMTSFA, GMTSFAGINI, PMTIDGMTSF | LUAD |
| ELF3 | c.915del|C | p.F305fs | DILIHPELNEGLMKWENRHEGVFKF[p.F305fs]CAPRLWPNYGAKRKRTAT* | GVFKFCAPR, RLWPNYGAK, VFKFCAPRL, CAPRLWPNY, YG AKRKRTA, FKFCAPRLW, HEGVFKFCA, RLWPNYGAKR, VFK FCAPRLW, FCAPRLWPNY, EGVFKFCAPR, APRLWPNYGA, G VFKFCAPRL | CRC |
| ELF4 | c.1244C>T | p.S415L | KLTKAVSASSVPSNIHLGVAPVGSSG[p.S415L]LALTLQTIPLTTVLTNGPPASTTAPT | GLALTLQTI, GVAPVGSGL, APVGSGLAL, VGSGLALTL, GVAP VGSGLA, LGVAPVGSGL, SGLALTLQTI, LALTLQTIPL | HNSC |
| ELMOD2 | c.422C>T | p.T141M | RKRPYDSDNLQHEELLMKLWNLLMP[p.T141M]MKKLNARISKQWAEIGFQGDDPKTDF | KLWNLLMPM, LWNLLMPMK, MPMKKLNAR, LLMPMKKL NA, KLWNLLMPMK, LWNLLMPMKK, MKKLNARISK, LMP MKKLNAR, MPMKKLNARI, MKLWNLLMPM | CRC |
| EME1 | c.1708G>C | p.D570H | IGPELSRRIYLQMTTLQPHLSLDSA[p.D570H]H* | QPHLSLDSAH | LUSC |
| EMILIN1 | c.79C>G | p.R27G | APRTLWSCYLCCLLITAAGAASYPP[p.R27G]GGFSLYTGSSGALSPGGPQAQIAPRP | SYPPGGFSL, YPPGGFSLY, AASYPPGGF, SYPPGGFSLY, ASYP PGGFSL, GAASYPPGGF | BLCA |
| EML6 | c.2414A>G | p.K805R | FSADGKCLVSVGLDDFHSIVFWDWK[p.K805R]RGEKIATTRGHKDKIFVVKCNPHHVD | SIVFWDWKR, WDMKRGEKI, HSIVFWDWKR, VFWDWKRGEK | TGCT |
| EMR1 | c.1478G>A | p.R493H | EESESTETTGVAFVSFVGMESVLNE[p.R493H]HFFKDHQAPLTTSEIKLKMNSRVVGG | SVLNEHFFK, MESVLNEHF, ESVLNEHFK, HFFKDHQAPL, G MESVLNEHF, MESVLNEHFF, NEHFFKDHQA | LUAD |
| EMR1 | c.1892G>A | p.R631Q | SHVGIIISLVCLVLAIATFLLCRSI[p.R631Q]QNHNTYLHLHLCVCLLLAKTLFLAGI | SIQNHNTYL, RSIQNHNTY, IQNHNTYLH, QNHNTYLHL, RSI QNHNTYL, IQNHNTYLHL, CRSIQNHNTY | UCEC |
| EMR2 | c.224C>T | p.S75L | GFSSFSEIITTPMETCDDINECATL[p.S75L]LKVSCGKFSDCWNTEGSYDCVCSPGY | TLLKVSCGK, DINECATLL, LLKVSCGKF, NECATLLKV, ATLLKV SCGK, DINECATLLK, TLLKVSCGKF | CRC |
| ENAH | c.1541G>T | p.R514L | TPEPTRKPWERTNTMNGSKSPVISR[p.R514L]LDSPRKNQIVFDNRSYDSLHRPKSTP | VISRLDSPR, ISRLDSPRK, SKSPVISRL, VISRLDSPRK, GSKSPVISRL, PVISRLDSPR | LUAD |
| ENAM | c.1118G>A | p.R373H | PFYRNQQVQRGPRWNFFAWERKQVA[p.R373H]HPGNPVYHKAYPPTSRGNYPNYAGNP | QVAHPGNPV, VAHPGNPVY, KQVAHPGNPV, QVAHPGNP VY, FAWERKQVAH | CRC |
| ENOX2 | c.1066C>T | p.R356W | QFEQIVAVYHSASKQKAWDHFTKAQ[p.R356W]KNISVWCKQAEEIRNIHNDELMGIR | AQWKNISVW, KAQWKNISV, HFTKAQWKNI, QWKNISVW CK, KAQWKNISVW, AQWKNISVWC | CRC |
| ENPEP | c.866T>G | p.F289C | EESVDDKWTRTTFEKSVPMSTYLVC[p.F289C]CAVHQFDSVKRISNSGKPLTIYVQPE | STYLVCCAV, MSTYLVCCA, CAVHQFDSV, LVCCAVHQF, YLV CCAVHQF, MSTYLVCCAV, CAVHQFDSVK | KIRC |
| ENPP1 | c.2213G>A | p.G738E | YQDFRIPLSPVHKCSFYKNNTKVSY[p.G738E]EFLSPPQLNKNSSGIYSEALLTTNIV | NTKVSYEFL, YEFLSPPQL, SYEFLSPPQL, EFLSPPQLNK, KNN TKVSYEF, YEFLSPPQLN | LUAD |
| ENTPD2 | c.611del|G | p.G204fs | NFIKYGWVGRWFRPRKGTLGAMDLG[p.G204fs]VPLPRSLLRQPVQLRTEPARSSCISTASTTESTPTAGRGAFPPKCCCSGMWPAPSRPTASTPAGRGAFPPKCCCSGMCTSHHAPWPSGPRTSTAVPLGSSACQGA | TLGAMDLGV, SLLRQPVQL, WLGTLWPSL, TLMPSLPSS, STL WTFCGL, AVTPTSAEI, ASSAMAVTR, TLWTFCGLR, LWTFCG LRW, RSLLRQPVQ, LLRQPVQLR, AMAVTRSSR, RSSRGCWP A, SSRGCWPAP, RGCWPAPSR, AGRGAFPPK, HAPWPSGPR, STTESTPTA, ESTPTASSA, STPTASSAM, EIWFLGSSA, WPAP | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ENTPD7 | c.979G>A | p.E327K | VTPTSAEIWFLGSSASPPAPSPDALSMG SSSPQWLGTLWPSLPSSTLWTFCGLRW GCPWPCSSWRQPQ* | SRPTA,APSRPTAST,RPTASTPAG,FPPKKCCSGM,WPSGPRT ST,APSPDALSM,WPSLPSSTL,LPSSTLWTF,GAMDLGVPL,L GVPLPRSL,ARSSCISTA,MCTSHHAPW,SMGSSSPQW,CGL RWGCPW,TPTSAEIWF,SPQWLGTLW,CPWPCSSW,AEI WFLGSS,GTLGAMDLGV,FLGSSASPPA,SMGSSSPQWL,TL WPSLPSST,AMDLGVPLPR,SAMAVTRSSR,STLWTFCGLR, QWLGTLWPSL,LWPSLPSSTL,SLPSSTLWTF,RSLLRQPVQL, RTEPARSSCI,RSSCISTAST,SSRGCWPAPS,RTSTAVPGSA,S LLRQPVQLR,TASSAMAVTR,HHAPWPSGPR,STPTASSAM A,SAEIWFLGS,SSTLWTFCGL,WTFCGLRWGC,LPRSLLRQ PV,QPVQLRTEPA,TPTASSAMAV,WPAPSRPTAS,WPSGPR TSTA,VPGSACQGAV,SPPAPSPDAL,ASTPAGRGAF,ESTPT ASSAM,LSMGSSSPQW,LGAMDLGVPL,GMCTSHHAPW,C QGAVTPTSA,AEIWFLGSSA,SSSPQWLGTL,TPTSAEIWFL, WPSLPSSTLW,TESTPTASSA,LPSSTLWTFC | CRC |
| ENTPD7 | c.979G>A | p.E327K | HTEHVRVYTTFLGFGGNFARQRY[p. E327K]KDLVLNETLNKNRLLGQKTGLSP DNP | GNFARQRYK,RQRYKDLVL,FARQRYKDL,KDLVLNETL,GGN FARQRYK,RQRYKDLVLN,FARQRYKDLV,YKDLVLNETL | |
| EOMES | c.995de|G | p.G332fs | LNPTAHYNVFVEVVLADPNHWRFQG|p. G332fs]ANG* | HWRFQGANG | STAD |
| EP300 | c.3491G>A | p.C1164Y | YKYCSKLSEVPEQEIDPVMQSLGYC|p.C 1164Y]YGRKLEFSPQTLCCYGKQLCTIP RDA | SLGYCYGRK,YCYGRKLEF,VMQSLGYCY,QSLGYCYGR,LGY CYGRKL,QSLGYCYGRK,GYCYGRKLEF,PVMQSLGYCY,MQ SLGYCYGR | HNSC |
| EP300 | c.4195G>A | p.D1399N | FGMHVQEYGSDCPPPNQRRVVISYL|p. D1399N]NSVHFFRPKCLRTAVVHEILIG YLEY | YLNSVHFFR,NSVHFFRPK,VYISYLNSV,ISYLNSVHF,SYLNSV HFF,RVVISYLNS,YISYLNSVH,RVVISYLNSV,SYLNSVHFFR, YISYLNSVHF,ISYLNSVHFF,LNSVHFFRPK | CESC,HNSC, LUSC |
| EPB41L3 | c.2686G>T | p.A896S | SYSAGDSGDAAAQPAFTGIKGKEGS|p. A896S]SLTEGAKEGGEEVAKAVLEQE ETAA | GSSLTEGAK,IKGKEGSSL,KEGSSLTEGA | LUAD |
| EPG5 | c.1105G>A | p.D369N | KVFSYHRYQRVEMNENALVELKKLF|p. D369N]NAKSEHLHQTLALHSYTSVLSRL QVE | KLFNAKSEH,ELKKLFNAK,VELKKLFNA,KLFNAKSEHL | CRC |
| EPG5 | c.6866G>T | p.R2289L | MALSLLFMEVLMMMNNATIPTAEFL|p. R2289L]LGSIRTWIGQKMHGLVVLPLL TAACQ | LLGSIRTWI,TIPTAEFLL,FLLGSIRTW,FLLGSIRTWI,EFLLGSI RTW,ATIPTAEFLL,AEFLLGSIRT | LUAD |
| EPHA1 | c.332G>T | p.G111V | IYRGEFASRVHVELQFTVRDCKSFP|p.G 111V]VGAGPLGCKETFNLLYMESDQD VGIQ | FPVGAGPLG,TVRDCKSFPV,KSFPVGAGPL,FPVGAGPLGC | LUAD |
| EPHA1 | c.550G>A | p.A184T | LVSGSVKLNVERCSLGRLITRRGLYL|p.A 184T]TFHNPGACVALVSVRVFYQRCPE TLN | YLITFHNPGA,LITRRGLYLT,TRRGLYLIT,LITFHNPGACV,LITRR GLYLTF | GBM |
| EPHA10 | c.2604de|C | p.P868fs | ERPYWDMSGQDVIKAVEDGFRLPPP|p. P868fs]GTVLTFCTD* | RLPPPGTVL,GFRLPPPGTV,LPPPGTVLTF,FRLPPPGTVL | STAD |
| EPHA2 | c.1379de|C | p.P460fs | NQTEPPKVRLEGRSTTSLSVSWSIP|p.P 460fs]RRSRAECGSTRSLTARRETPTAT MCAAPRVSP* | ATMCAAPRV,LSVSWSIPR,SVSWSIPRR,GSTRSLTAR,RSRA ECGST,STRSLTARR,RSLTARRET,TARRETPTA,SWSIPRRSR, TATMCAAPR,EHPTATMCA,IPRRSRAEC,TPTATMCAA,AE CGSTRSL,RRETPTATM,RETPTATMC,SLSVSWSIPR,LSVS WSIPRR,SWSIPRRSRA,RSRAECGSTR,VSWSIPRRSR,PTAT | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| EPHA3 | c.2405C>G | p.T802R | AAYTTRGGKIPIRWTSPEAIAYRKF[p.T802R]RSASDVWSYGIVLWEVMSYGERPYWE | MCAAPR, ETPTATMCAA, TATMCAAPRV, RAECGSTRSL, AR RETPTATM, RETPTATMCA, ARCGSTRSLT RSASDVWSY, KFRSASDVW, IAYRKFRSA, AYRKFRSAS, EAIA YRKFR, RKFRSASDV, AIAYRKFRSA, KFRSASDVWS, IAYRKFR SAS, RKFRSASDVW, FRSASDVWSY | HNSC |
| EPHA6 | c.2854G>C | p.D952H | TTGGKIPIRWTAPEAIAYRKFSSASA[p.D952H]HAWSYGIVMWEVMSYGERPYW EMSNQ | SSASHAWSY, KFSSASHAW, ASHAWSYGI, HAWSYGIVM, Y RKFSSASH, RKFSSASHA, FSSASHAWSY, AYRKFSSASH, ASH AWSYGIV, SASHAWSYGI, RKFSSASHAW, SHAWSYGIVM, HAWSYGIVMW | HNSC |
| EPHB2 | c.1175G>A | p.R392H | SGRGACTRCGDNVQYAPRQLGLTEP[p.R392H]HIYISDLLAHTQYTFEIQAVNGV TDQ | GLTEPHIYI, RQLGLTEPH, LGLTEPHIY, RQLGLTEPHI, QLGLT EPHIY, HIYISDLLAH, TEPHIYISDL | CRC |
| EPHB6 | c.1010G>A | p.R337H | KACQACPRGLYKSSAGNAPCSPCPA[p.R337H]HSHAPNPAAPVCPCLEGFYRAS SDPP | HSHAPNPAA | LUAD |
| EPHB6 | c.160del G | p.G54fs | ALEEVLLDTTGETSEIGWLTYPPGG[p.G54fs]GTR* | LTYPPGGGTR | STAD |
| EPHX1 | c.394del C | p.P132fs | ILNRYPHFKTKIEGLDIHFIHVKPP[p.P132fs]SCPQAIPRSPC* | KPPSCPQAI, HVKPPSCPQA, CPQAIPRSPC | STAD |
| EPHX4 | c.845G>A | p.R282Q | TTEDLEAYIYFSQPGALSGPINHY[p.R282Q]QNIFSCLPLKHHMVTTPTLLMGE ND | HYQNIFSCL, GPINHYQNI, YQNIFSCLP, QNIFSCLPL, YQNIFS CLPL, QNIFSCLPLK, GPINHYQNIF, NHYQNIFSCL | UCEC |
| EPPK1 | c.6044del G | p.G2015fs | FQAMQKQLIEKAEALRLLEVQATG[p.G2015fs]VSSTHSTTTGSHMKQPTDGA VCTRTSMRSFPTRST* | STTTGSHWK, AVCTRTSMR, TSMRSFPTR, CTRTSMRSF, RTS MRSFPT, SMRSFPTRS, LEVQVATGV, VQVATGVSS, HSTTTG SHW, WKQPTDGAV, GAVCTRTSM, LLEVQVATGV, RTSMR SFPTR, HSTTTGSHWK, STHSTTTGSH, CTRTSMRSFP, SMRS FPTRST, VQVATGVSST, VCTRTSMRSF | STAD |
| EPPK1 | c.7132G>C | p.D2378H | HSHRVPVDVAYRRGYFDEEMNRVLA[p.D2378H]HPSDDTKGFFDPNTHENLTY LQLLQR | EEMNRVLAH, HPSDDTKGF, VLAHPSDDTK, HPSDDTKGFF, DEEMNRVLAH | ACC |
| EPRS | c.3451G>T | p.V1151L | MYPAYAKWVQSHRDLPIKLNQWCNV[p.V1151L]LRWEFKHPQPFLRTREFLW QEGHSAF | KLNQWCNVL, CNVLRWEFK, NQWCNVLRW, LNQWCNVLR, WCNVLRWEF, KLNQWCNVLR, QWCNVLRWEF, IKLNQW CNVL | LUAD |
| EPRS | c.4003C>A | p.L1335I | GITNALSEEDKEALIAKCNDYRRRL[p.L1335I]ISVNIRVRADLRDNYSPGWKFNH WEL | RLISVNIRV, RRRLISVNI, DYRRRLISV, RRRLISVNIR, RLISVNI RVR, NDYRRRLISV, YRRRLISVNI | TGCT |
| ERBB2 | c.2264T>C | p.L755S | AFGTVYKGIWIPDGENVKIPVAIKV[p.L755S]SRENTSPKANKEILDEAYVMAGV GSP | VSRENTSPK, IPVAIKVSR, KVSRENTSPK, VSRENTSPKA | BRCA |
| ERBB2 | c.2305G>T | p.D769Y | ENVKIPVAIKVLRENTSPKANKEIL[p.D769Y]YEAYVMAGVGSPYVSRLLGICLTSTV | ILYEAYVMA, YEAYVMAGV, NKEILYEAY, KEILYEAYV, EILYE AYVM, ILYEAYVMAG, ANKEILYEAY, EILYEAYVMA, KEILYEA YVM, SPKANKEILY, YEAYVMAGVG | BRCA |
| ERBB2 | c.2310_2311 insGCATA CGTGATG | p.774_775ins AYVM | AIKVLRENTSPKANKEILDEAYVMA[p.774_775insAYVM]YVMAGVGSPYVSRL LGICLTSTVQLVTQLMPYGCLLD | VMAYVMAG, YVMAYVMAG, DEAYVMAYV, EAYVMAYV, M, LDEAYVMAY, MAYVMAGVG, ILDEAYVMAY, YVMAYV MAGV, EAYVMAYVMA, DEAYVMAYVM | LUAD |
| ERBB2 | c.2326_2327insTCT | p.776G>VC | AIKVLRENTSPKANKEILDEAYVMA[p.776_776G>VC]VCVGSPYVSRLLGICLTS TVQLVTQLMP | AVCVGSPYV, MAVCVGSPY, EAYVMAVCV, YVMAVCVGS, D EAYVMAVC, ILDEAYVMAV, MAVCVGSPYV, VMAVCVGSP Y, DEAYVMAVCV | LUAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ERBB2 | c.2524G>A | p.V842I | LGSQDLLNWCMQIAKGMSYLEDVRL[p.V842I]IHRDLAARNVLVKSPNHVKITDFGLA | RLIHRDLAA, SYLEDVRLI, LIHRDLAAR, RLIHRDLAAR, YLEDVRLIHR, MSYLEDVRLI | CRC |
| ERBB2 | c.2748G>A | p.M916I | LESILRRRFTHQSDVWSYGVTWEL[p.M916I]ITFGAKPYDGIPAREIPDLLEKGERL | YGVTVWELI, VTVWELITF, LITFGAKPY, WELITFGAK, TVWELITFGA, SYGVTVWELI, ELITFGAKPY, GVTVWELITF, WELITFGAKP | HNSC |
| ERBB2 | c.929C>A | p.S310Y | PEGRYTFGASCVTACPYNYLSTDVG[p.S310Y]YCTLVCPLHNQEVTAEDGTQRCEKCS | YLSTDVGYC, STDVGYCTLV, YLSTDVGYCT, YNYLSTDVGY, LSTDVGYCTL, VGYCTLVCPL | LUAD |
| ERBB2 | c.929C>T | p.S310F | PEGRYTFGASCVTACPYNYLSTDVG[p.S310F]FCTLVCPLHNQEVTAEDGTQRCEKCS | STDVGFCTL, YLSTDVGFC, NYLSTDVGF, STDVGFCTLV, YLSTDVGFCT, YNYLSTDVGF, LSTDVGFCTL, VGFCTLVCPL | BLCA, BRCA, CESC, STAD |
| ERBB3 | c.273G>A | p.M91I | VLTGHNADLSFLQWIREVTGYVLVA[p.M91I]INEFSTLPLNLRVVRGTQVYDGKFA | YVLVAINEF, VAINEFSTL, INEFSTLPL, AINEFSTLPL, GYVLVAI NEF, EVTGYVLVAI | BLCA |
| ERBB3 | c.310G>A | p.V104M | WIREVTGYVLVAMNEFSTLPLNLR[p.V104M]MVRGTQVYDGKFAIFVMLNYNTNSSH | RMVRGTQVY, LPLPNLRMV, LRMVRGTQV, TLPLPNLRMV, NLRMVRGTQV, LRMVRGTQVY | CESC, CRC, STAD |
| ERBB3 | c.310G>T | p.V104L | WIREVTGYVLVAMNEFSTLPLNLR[p.V104L]LVRGTQVYDGKFAIFVMLNYNTNSSH | RLVRGTQVY, LPLPNLRLV, TLPLPNLRLV, NLRLVRGTQV, LRLVRGTQVY | BLCA |
| ERBB3 | c.889G>T | p.D297Y | LEPNPHTKYQYGGVCVASCPHNFVV[p.D297Y]YQTSCVRACPPDRMEVDKNGLKMCEP | FVVYQTSCV, VVVYQTSCVR, YQTSCVRAC, ASCPHNFVVY, FVVYQTSCVR | BLCA |
| ERC1 | c.2075A>G | p.K692R | DLSEKEASLLDLKEHASSLASSGLK[p.K692R]RDSRLKTLEIALEQKEECLKMESQL | GLKRDSRLK, SLASSGLKR, SSLASSGLKR, SGLKRDSRLK, LKRDSRLKTL | TGCT |
| ERCC2 | c.41A>G | p.Y14C | MKLNVDGLLVYFP[p.Y14C]CDYIYPEQFSYMRELKRTLDAKGHGV | LVYFPCDYI, VYFPCDYIY, LLVYFPCDY, CDYIYPEQF, FPCDYIYPE, LLVYFPCDYI, LVYFPCDYIY, GLLVYFPCDY | BLCA |
| ERCC2 | c.713A>G | p.N238S | LDPKIADLVSKELARKAVVVFDEAH[p.N238S]SIDNVCIDSMSVNLTRRTLDRCQGNL | VVFDEAHSI, EAHSIDNVCI | BLCA |
| ERCC2 | c.934G>A | p.D312N | RLVEGLREASAARETDAHLANPVLP[p.D312N]NEVLQEAVPGSIRTAEHFLGFLRRLL | NPVLPNEVL, LPNEVLQEA, VLPNEVLQEA, LANPVLPNEV, LPNEVLQEAV | ACC |
| ERCC6 | c.2338G>A | p.V780I | SLPDKNEQVLFCRLTDEQHKVYQNF[p.V780I]IDSKEVYRILNGEMQIFSGLIALRKI | FIDSKEVYR, NFIDSKEVY, YQNFIDSKEV, FIDSKEVYRI, KVYQNFIDSK, NFIDSKEVYR, QNFIDSKEVY | CRC |
| ERCC6 | c.1514G>A | p.R505Q | LVFSQSRQILNIIERLLKNRHFKTL[p.R505Q]QIDGTVTHLLEREKRINLFQQNKDYS | KTLQIDGTV, LQIDGTVTH, LQIDGTVTHL, KNRHFKTLQI | CRC |
| ERCC6L | c.1333C>A | p.L445I | LGDTSILDDLFKSHGNSPTQLPKKV[p.L445I]ISGPMEKAKQRPKDFWDIINEQNDES | KVISGPMEK, VISGPMEKAK, SPTQLPKKVI, LPKKVISGPM | UCEC |
| ERN2 | c.884C>A | p.T295K | TQDLGVPVMGVVTWHQDLGRLQPHL[p.T295K]KLARDTLHFLALRWGHIRLPASGPRD | GLRQLPHLK, KLARDTLFIF, RQLPHLKLA, QLPHLKLAR, HLKLARDTL, KLARDTLHFL, RQLPHLKLAR, LKLARDTLHF | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ERRFI1 | c.1261G>A | p.A421T | LLPERPPYLDKYEKFREAEETNGG[p.A421T[TQIQPLPADCGISSATEKPDSKTKMD | AEETNGGTQI | CRC |
| ESCO1 | c.899G>A | p.R300Q | TLPKSPQPSVPEQSDNELEQAGKSK[p.R300Q]QGSILQLCEEIAGEIESDNVEKKES | KSKQGSILQ, GKSKQGSIL, SKQGSILQL, KSKQGSIIQL | CRC |
| ESF1 | c.295de|A | p.T99fs | LSDSDNLSGEDSKALSQKKIKKKK[p.T99fs]PRLKKKSIQKI* | RLKKKSIQK, KIKKKKPRL, KKKKKPRLKK, KKKKKPRLKKK, KPRLKK KSI, LKKKSIQKI, RLKKKSIQKI, KIKKKKPRLK, KKKKKPRLKKK | STAD |
| ESPN | c.1286_1348de|CACCC CCACCCA CCACCCA GCTTCCCCC CGCCACCC CCGCCCCC AGGCACCC AACTGCCC C | p.PPPP PPSFPP PPPPP GTQLP P430de| | QSYMDMLNPELGLPRGTIGKPTPPP[p.PPPPPSFPPPPPGTQLPP430de|]G YPAPKPPVGPQAADIYMQTKNKLRHVE TEALKKELSSCDGHDGLRRQDSSRKPPA FSKQPSTGDYYRQLGRCPGETLAARPG MAHSE | IGKPTPPPGY, KPTPPPGYPA | PAAD |
| ESPNP | c.1880G>A | p.R627Q | EEEQRWKEEEARLASMPAWRWDLL[p.R627Q]QKKLEEE | AWRWDLLQK, AWRWDLLQKK, WRWDLLQKKL | GBM |
| ESPNP | c.191_198dele|ACGCGCG C | p.H64fs | PLYLACQEGHLEVTQYLVQECGADP[p.H64fs]RPPRHDPTARRGADGPQPGHR VVGELHRREPVGAGQRRRHRHALRGE PRPQQGAQLAAAARGDLG* | GQRRRHHA, RRRHRHALR, RPRRHDPTA, GPQPGHRVV, Q RRRHRHAL, RPQQGAQLA, AAAARGDL, GPQPGHRVVG, GE LHRREPV, GQRRRHHAL, LVQECGADPR, QPGHRVVGEL, E PRPQQGAQL, RPQQGAQLAA, LAAAARGDL, QQGAQLAA AA | PAAD |
| ESPNP | c.888_950dele|ACCCCCA CCAGCTT CCCCCCGC CACCCCG CACCCCAG CACCAAC TGCCCCA CCCCCACC | p.296_317PPP PSFPPP PPPPG TQLPPP PP>P | QSYMDMLNPELGLPWGTIGKPIPPP[p.296_317PPPPSFPPPPPPGTQLPPPP >P|SYPSPKPPVGPQAADIYMQTKNLR HVETEALKKEPSSCDGHDGLRRQDSSR KPRAFSKQPSTGDYYRQLGRCPGETLV ARPGMAHRE | IGKPIPPPSY | PAAD |
| ESRRA | c.655G>A | p.D219N | VNALVSHLLVVEPEKLYAMPDPAGP[p.D219N]NGHLPAVATLCDLFDREIWTIS WAK | GPNGHLPAV, MPDPAGPNGH | HNSC |
| ESYT1 | c.2446C>T | p.R816W | LQVNSLIQTQKSAELAAELAAALLSIYME[p.R816W]WAEDLPLRKGTKHLSPYATLTV GDSS | LLSIYMEWA, ALLSIYMEW, IYMEWAEDL, EWAEDLPLR, ME WAEDLPL, ALLSIYMEWA, YMEWAEDLPL, AALLSIYMEW | BRCA |
| ESYT3 | c.1721C>T | p.S574F | QILPYADLITLEQRFQLDHSGLDSLI[p.S574F]FMRLVLRFLQVEERELGSPYTGPEA L | SLIFMRLVI, FMRLVLRFL, LIFMRLVLR, IFMRLVLRF, DSLIFM RLV, HSGLDSLIF, SGLDSLIFM, GLDSLIFMR, SLIFMRLVLR, I FMRLVLRFL, SGLDSLIFMR, LIFMRLVLRF, HSGLDSLIFM | LUSC |
| ETFDH | c.841A>T | p.I281F | LYKKFDLRANCEPQTYGIGLKELWV[p.I281F]FDEKNWKPGRVDHTVGWPLDR HTYGG | WVFDEKNWK, IGLKELWVF | CLL |
| ETV6 | c.1105C>T | p.R369W | YVYQLLSDSRYENFIRWEDKESKIF[p.R369W]WIVDPNGLARLWGNHKQRTNM TYEKM | WIVDPNGLA, KESKIFWIV, IFWIVDPNGL | CRC |

TABLE 8-continued

| gene | cDNA Change | Protein Change | Mutation_Context_Sequence (SEQ ID NOS 81-3798, respectively in order of appearance) | Peptides (SEQ ID NOS 3799-33502, respectively, in order of appearance) | Exemplary Diseases |
|---|---|---|---|---|---|
| EXOC1 | c.1762C>T | p.R588C | QHNCGTPLPVSSEKDMIRQMMIKIF[p.R588C]CCIEPELNNLIALGDKIDSFNSLYML | MMIKIFCCI,RQMMIKIFC,QMMIKIFCCI,KIFCCIEPEL,RQMMIKIFCC | UCEC |
| EXOSC2 | c.32G>C | p.R11P | MAMEMRLPVA[p.R11P]PKPLSERLGRDTKKHLWPGDTITTD | EMRLPVAPK,APKPLSERL,MEMRLPVA,MEMRLPVAPK,MRLPVAPKPL | KIRP |
| EXOSC8 | c.480del|A | p.L160fs | CDLICLDYDGNILDACTFALLAALK[p.L160fs]MYSCLKLL* | KMYSCLKLL,ALKMYSCLK,ALLAALKMY,FALLAALKM,AALK MYSCL,LKMYSCLKL,LLAALKMYSC,ALKMYSCLKL,AALKM YSCLK,LAALKMYSCL,FALLAALKMY,LKMYSCLKLL | STAD |
| EZH2 | c.1529A>G | p.K510R | VDTPPRKKKRKHRLWAAHCRKIQLK[p.K510R]RDGSSNHVYNYQPCDHPRQPCDSSCP | RDGSSNHVY,LKRDGSSNH,KRDGSSNHVY | TGCT |
| EZH2 | c.1922A>T | p.Y641F | LAPSDVAGWGIFIKDPVQKNEFISE[p.Y641F]FCGEIISQDEADRRGKVYDKYMCSFL | FISEFCGEI,QKNEFISEF,SEFCGEIIS,FISEFCGEII,VQKNEFISEF | DLBCL |
| F10 | c.349G>A | p.E117K | TSPCQNQGKCKDGLGEYTCTCLEGF[p.E117K]KGKNCELFTRKLCSLDNGDCDQFCHE | KGKNCELFT,FKGKNCELF,YTCTCLEGFK,CTCLEGFKGK,GFKGKNCELF,KGKNCELFTR | UCEC |
| F5 | c.1277A>T | p.Q426L | DESFTKHTVNPNMKEDGILGPIIRA[p.Q426L]LVRDTLKIVFKNMASRPYSIYPHGVT | ILGPIIRAL,ALVRDTLKI,LVRDTLKIV,RALVRDTLK,IRALVRDTL,ILGPIIRALV,ALVRDTLKIV,IIRALVRDTL,RALVRDTLKI,LVRDTLKIVF | LIHC |
| F5 | c.3995T>C | p.L1332P | LSQTNLSPALGQOMPISPDLSHTTLS[p.L1332P]PDFSQTNLSPELSQTNLSPALGQMPL | TLSPDFSQT,SPDFSQTNL,SHTTLSPDF,LSHTTLSPDF | CLL |
| F8 | c.6806C>A | p.S2269Y | NPKEWLQVDFQKTMKVTGVTTQGVK[p.S2269Y]YLLTSMYVKEFLLSSSQDGHQWTLFF | YLLTSMYVK,KYLLTSMYV,GVKYLLTSM,GVTTQGVKY,VKYLLTSMY,TTQGVKYLL,KYLLTSMYVK,GVKYLLTSMY,QGVKYLLTSM,VKYLLTSMYV | CRC |
| FAM104B | c.223G>C | p.D75H | SSSRINIPERASGPEGNLNQIVTEP[p.D75H]HANFPQFLHEGLSKPVVINWFMSFG | HANFPQFLH,EPHANFPQF,IVTEPHANF,EPHANFPQFL,QIVTEPHANF,EPHANFPQF | TGCT |
| FAM105A | 0.376C>A | p.H126N | AREWKGETPRNKLMRKAYEELFWRH[p.H126N]NIKCVRQVRRDNYDALRSVLFQIFSQ | ELFWRHNIK,NIKCVRQVR,EELFWRHNI,FWRHNIKCVR,HNIKCVRQVR,NIKCVRQVRR,YEELFWRHNI | KIRC |
| FAM109A | c.466_474del|GGGGT GGC | p.GGG156del | LSRASFDYLRLVVRELEQQLAAVRG[p.GG156de]|MALPQPQPQSLPLPPSLPSALAPVPSLPSAPAPV | QLAAVRGMA,LAAVRGMAL,QQLAAVRGM,QLAAVRGM AL,EQQLAAVRGM,QQLAAVRGMA | ACC |
| FAM111B | c.807del|A | p.S269fs | KIYGKQSMVDEVSGKVLEMDISKKK[p.S269fs]HYNRKISIKKLNRMKVPLMKLITRV* | KLNRMKVPL,PLMKLITRV,RMKVPLMKL,ISKKKHYNR,SKK KHYNRK,KHYNRKISI,HYNRKISIK,YNRKISIKK,KISIKKLNR,SI KKLNRMK,LNRMKVPLM,ISIKKLNRM,MKVPLMKLI,KLNR MKVPLM,RMKVPLMKLI,ISIKKLNRMK,ISKKKHYNRK,KHY NRKISIK,HYNRKISIKK,KISIKKLNRM,SIKKLNRMKV,LNRM KVPLMK,KVPLMKLITR,DISKKKHYNR,KKHYNRKISI,KKLNR MKVPL,VPLMKLITRV | PRAD |
| FAM116A | c.1322del|T | p.L441fs | IKQLQKGVQQKRPSEAQSVILRRYF[p.L441fs]WN* | SVILRRYFW | STAD |
| FAM120B | c.1400C>A | p.P467H | DSEPRQEVPMYTGSEPRQEVPMYTG[p.P467H]HESRQEVPMYTGPESRQEVLIRTDPE | HESRQEVPM,VPMYTGHES,RQEVPMYTGH,HESRQEVPMY | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FAM126B | c.1145G>A | p.R382H | LSSQPIGTKPSSSSQRGSLRKVATG[p.R382H]HSAKDKETASAIKSSESPRDSVRRK Q | KVATGHSAK, ATGHSAKDK, RKVATGHSA | GBM |
| FAM127C | c.156C>A | p.F52L | IPFPETFDGDTDRLPEFIVQTSSYM[p.F52L]LVDENTFSNDALKVTFLITRLTGPAL | VQTSSYMLV, MLVDENTFS, YMLVDENTF, FIVQTSSYML, IV QTSSYMLV, SYMLVDENTF | LUAD |
| FAM35B | c.1933A>C | p.S645R | KGIDQEGKMVLLSLKLTPSEPCDPL[p.S645R]RSTLREPLDIRSSLKDSHTEEQEEL S | LRSTLREPL, EPCDPLRSTL | STAD |
| FAM35B | c.1942C>A | p.L648M | DQEGKMVLLSLKLTPSEPCDPLSST[p.L648M]MREPLDIRSSLKDSHTEEQEELS VLS | TMREPLDIR, LSSTMREPL, STMREPLDIR, EPCDPLSSTM | LUSC |
| FAM35B | c.2651G>A | p.R884H | GHCLPDGRTENTPGVETKGLNLKIP[p.R884H]HVIALENPRTRSLHRALEETPKG MPK | GLNLKIPHV, HVIALENPR, LKIPHVIAL, GLNLKIPHVI, NLKIPH VIAL, KGLNLKIPHV | CRC |
| FAM35B | c.720G>C | p.W240C | GYCKPTSSEGSFYITSENCMQHAHK[p.W240C]CHRDLCLLLLHAYRGLRLHFLVI MRD | MQHAHKCHR, CMQHAHKCHR | LUAD |
| FAM35B | c.855G>T | p.Q285H | LVIMRDIPELPHTELEALAVEETLS[p.Q285H]HLCSELQMLNNPEKIAEQISKDLA WL | TLSHLCSEL, HLCSELQML, SHLCSELQM, ETLSHLCSEL, LAVE ETLSHL, LSHLCSELQM | LUSC |
| FAM51A1 | c.351del|C | p.P117fs | LEADVNVEGLGTANETGVPIMAHPP[p.P117fs]LSTVTTHWSSGWTLCWALPKR ASNWTSRTSRQWAPPWTSCGS* | IMAHPPLST, MAHPPLSTV, WTLCWALPK, TSRTSRQWA, RT SRQWAPP, TLCWALPKR, SNWTSRTSR, VPIMAHPPL, THW SSGWTL, SGWTLCWAL, TSRQWAPPW, RQWAPPWTS, WS SGWTLCW, IMAHPPLSTV, GWTLCWALPK, WTLCWALPKR, ASNWTSRTSR, HWSSGWTLCW, RTSRQWAPPW, TTHWSS GWTL, WSSGWTLCWA, MAHPPLSTVT, SSGWTLCWAL, W ALPKRASNW, RQWAPPWTSC, PPLSTVTTHW RQRQQQQQR, RRRQQEPSW, RQRQQQQQRR | STAD |
| FAM55A | c.284A>G | p.Q95R | KEHQQQQRQQQQQQQQRQRQQQ QQ[p.Q95R]RRRQQEPSWPALLASMG ESSPAAQAH | | TGCT |
| FAM55B | c.472G>A | p.E158K | VCGGVPEPTGLDAACTKLQSLQRLF[p.E158K]KPTTPAPPLRPPDSLSRAPAEFPS AK | RLFKPTTPA, LQSLQRLFK, KPTTPAPPL, LQRLFKPTT, KLQSL QRLFK, LQRLFKPTTP, RLFKPTTPAP, FKPTTPAPPL | UCEC |
| FAM69B | c.495G>T | p.K165N | NDRPRQPAPGDGSKERMCGEELEDT[p.K165N]NDDPECGVEEEDAGLAGQPP GKLTRS | DTNDDPECGV | CRC |
| FAM70A | c.166G>A | p.E56K | DALQPGSTRVAKGMSQGVGEVTSTS[p.E56K]KYCSCVSSSRKLIHSGIQRIHRDS PQ | STSKYCSCV, GEVTSTSKY, SKYCSCVSS, GVGEVTSTSK, VGEV TSTSKY, TSTSKYCSCV, SKYCSCVSSS | CRC |
| FAM71B | c.1375G>A | p.D459N | SYSPQKKEPSKAETEERVSMVKTRD[p.D459N]NFKIYNEDVSFLSVNQNNYSRN PTQS | MVKTRDNFK, KTRDNFKIY, SMVKTRDNF, SMVKTRDNFK, MVKTRDNFKI, KTRDNFKIYN, VSMVKTRDNF, VKTRDNFKIY | CRC |
| FAM79A | c.2491G>A | p.A831T | QVFDAFTPRLQDSNKKVNQWALESF[p.A831T]TKMIPLLRESLHPMLLSIIITVAD NL | FTKMIPLLR, SFTKMIPLL, ESFTKMIPL, WALESFTKM, NQWA LESFTK, SFTKMIPLLR, ESFTKMIPLL, WALESFTKMI, LESFTK MIPL | BRCA |
| FAM81A | c.326G>A | p.R109H | KAALDKSAPCRRSVDHRKYLQKQLK[p.R109H]HFSQKYSRLPRGLPGRAAEPYL KRGS | KQLKHFSQK, YLQKQLKHF, KHFSQKYSR, QLKFIFSQKY, KYL QKQLKHF, KQLKHFSQKY, RKYLQKQLKH, KHFSQKYSRL | CRC |

TABLE 8-continued

| gene | cDNA Change | Protein Change | Mutation_Context_Sequence (SEQ ID NOS 81-3798, respectively in order of appearance) | Peptides (SEQ ID NOS 3799-33502, respectively, in order of appearance) | Exemplary Diseases |
|---|---|---|---|---|---|
| FAM184B | c.2350C>T | p.R784W | RALGRQASSQCPGDSKDHIIATEE[p.R784W]WGGPGQAGSPPGAAGQGSGEGCGLWE | EEWGGPGQA, EEWGGPGQAG, TEEWGPGQA | ACC |
| FAM186A | c.4667470_2de[TCCCTCCGCAGGCTCAGAATTGGAGATCCCTCTCA | p.IPPQAQELEIPL1556de| | LIPPQAQELGIPLTPQQVQALGIPL[p.IP PQAQELEIPL1556de||TPQQAQALGIP LTPQQAQELGIPLTPQQAQALGIPLTPQ QAQAQGIPLTPQQAQALGISLT | VQALGIPLIT, VQALGIPLTP | KIRC |
| FAM188B2 | c.152G>A | p.C51Y | PRKAKIRHPVASFFHLFFRVSAIIV[p.C51 Y]YLLCELLSSSFITCMVTILLLLSCDF | IIVYLLCEL, YLLCELLSS, QIIVYLLCEL, IIVYLL CELL, YLLCELLSSS | ACC, KIRP, TGCT |
| FAM193A | c.1284_1285insC | p.D428fs | NYRRRCACDDCSLSHILTCGIMDPP[p.D 428fs]RH* | LTCGIMDPPR | STAD |
| FAM193A | c.1284de|C | p.D428fs | NYRRRCACDDCSLSHILTCGIMDPP[p.D 428fs]SLMTSTFTSSHFKWILLTILLRGA RPVCHLQARGPAPALPSQFSSTPGSSSQ TVARHQLFVVMMKMLHHCQPNLLIFI H* | SLMTSTFTS, WILLLTIL, ILLRGARPV, VMMKMLHHC, MLH HCQPNL, GIMDPPSLM, FTSSHFKWI, LLTILLRGA, LQARGPA PA, ALPSQFSST, TVARHQLFV, STFTSSHFK, HQLFWMMK, MTSTFTSSH, GSSSQTVAR, TFTSSHFKW, SHFKWILL, KWIL LLTIL, QTVARHQLF, HCQPNLLIF, CQPNLLIFI, SSHFKWILL, V ARHQLFW, LTILLRGAR, QARGPAPAL, TSTFTSSFIF, LMTST FTSS, FKWILLLTI, RGARPVCHL, SQFSSTPGS, SQTVARHQL, ARHQLFWM, RHQLFWMM, QLFWMMKM, MKMLHHC QP, KMLHHCQPN, TPGSSSQTV, PPSLMTSTF, LLLTILLRGA, TVARHQLFVV, KMLHHCQPNL, MLHHCQPNLL, SLMTSTFT SS, HLQARGPAPA, LQARGPAPAL, QLFVVMMKML, TSTFTS SHFK, TFTSSHFKWI, HFKWILLLTI, KWILLLTILL, SQTVARHQ LF, SSHFKWILLL, GARPVCHLQA, VARHQLFVVM, RHQLFVV MMK, MTSTFTSSHF, WILLLTILLR, LTILLRGAR, FTSSHFKW IL, STPGSSSQTV, QTVARHQLFV, GPAPALPSQF, LMTSTFTS SH, HQLFVVMMKM, CGIMDPPSLM, STFTSSHFKW, FKWIL LLTIL, SQFSSTPGSS, ARHQLFVVMM, MKMLHHCQPN, HHC QPNLLIF, LPSQFSSTPG | STAD |
| FAM194B | c.404_421de e|AGGAGGAAGAGTATCTGG | p.EEEEYL135de| | IEEEEYLGKEGYLEEEEYLGKEEHL[p.EEE EYL135de||GKEGYLEKEDYIEEVDYLGK KAYLEEEEYLGKKSYLEEEKALE | LGKEEHLGK, EEHLGKEGY, HLGKEGYLEK, KEEHLGKEGY, EE HLGKEGYL | KIRC |
| FAM194B | c.415T>C | p.Y139H | EYLGKEGYLEEEEYLGKEEHLEEEE[p.Y1 39H]HLGKEGYLEKEDYIEEVDYLGKKAYL | EEHLGKEGY, HLGKEGYLEK, EEEHLGKEGY, EEHLEEEEHL, EE HLGKEGYL | TGCT |
| FAM210B | c.336G>T | p.L112F | QQLKKIFQEYGTVGVSLHIGISLIS[p.L11 2F]PGIFYMVSSGVDMPAILLKLGFKES | GISLISFGI, LISFGIFYM, ISFGIFYMV, SLISFGIFY, ISLISFGIF, SFGIFYMVV, HIGISLISF, ISLISFGIY, SLISFGIFYM, LISFGI FYMV, ISFGIFYMW, LHIGISLISF, GISLISFGIF | LUAD |
| FAM214B | c.124de|G | p.A42fs | GPSQPPVRQGALQGLLMGYSPAGG[p. A42fs]RHPPGSTRYPSFPLRLVPLSLIG p* | RYPSFPLRL, SFPLRLVPL, STRYPSFPL, RHPPGSTRY, MGYSP AGGR, YPSFPLRIV, SPAGGRHPP, RLVPLSLIG, FPLRLVPLS, S TRYPSFPLR, RYPSFPLRLV, GGRHPPGSTR, LMGYSPAGGR, S PAGGRHPPG, FPLRLVPLSL, MGYSPAGGRH, GRHPPGSTRY, GSTRYPSFPL, TRYPSFPLRL | STAD |
| FAM216A | c.106C>T | p.P36S | RGLGAAEMPGQGPGSDWTERSSSAE[p. P36S]SPAVAGTEGGGGSGAGYSCYQ NSKGS | RSSSAESPAV, AESPAVAGT, RSSSAESPAV | KIRP |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FAM21B | c.3691C>T | p.P1231S | DMDDIFSSGIQAKTTKPKSRSAQAA[p.P1231S]SEPRFEHKVSNIFDDPLNAFGGQ* | ASEPRFEHK,KSRSAQAAS,SAQAASEPR,AQAASEPRF,SEP RFEHKV,RSAQAASEPR,AASEPRFEHK,KSRSAQAASE,SAQ AASEPRF | TGCT |
| FAM22F | c.2070_2071delTT | p.P690fs | PGGRGPQGALQSPSAQKRGLSPSPS[p.P690fs]CQQVQEATSLWKPIC* | VQEATSLWK,EATSLWKPI,SPSPSCQQV,QQVQEATSL,QV QEATSLWK,CQQVQEATSL,QQVQEATSLW,QEATSLWKPI | KIRC |
| FAM22F | c.2071_2073delTCT | p.S691del | SPGGRGPQGALQSPSAQKRGLSPSP[p.S691del]PASKSKKRPLFGSPSPAEKTHPGPGLR | LSPSPPASK,RGLSPSPPA,GLSPSPPASK | KIRC,PRAD |
| FAM32A | c.26A>G | p.K9R | MEAYEQVQ[p.K9R]RGPLKLKGVAELG VTKRKKKKDKDK | VQRGPLKLK,YEQVQRGPL,QVQRGPLKLK,EQVQRGPLKL | TGCT |
| FAM40B | c.2218C>T | p.R740C | LQTKYLGRQWRKSNMKTMSAIYQKV[p.R740C]CHRMNDDWAYGNDIDARPWDFQAEEC | AIYQKVCHR,IYQKVCHRM,AIYQKVCHRM,CHRMNDDWAY,SAIYQKVCHR | STAD |
| FAM46B | c.1247_1248AC>GT | p.H416R | RPPGTDGWPAITVNYYVTPVQPLLA[p.H416R]RAYPTWLPCN* | LLARAYPTW,LARAYPTWL,RAYPTWLPC,VQPLLARAY,LLA RAYPTWL,PVQPLLARAY | TGCT |
| FAM47A | c.1114G>T | p.G372W | GSSLRSEPSETGVSRLRLAPPKTRR[p.G372W]WSSLHAEPSKTGVSHLSPEPPKTEVS | KTRRWSSLH,WSSLHAEPSK,KTRRWSSLHA,PPKTRRWSSL,RLAPPKTRRW | LUSC |
| FAM47A | c.2069G>T | p.R690L | EDKFFSQEKVWGRKFHTPSNSYTAQ[p.R690L]LVKMKYGAWYLKPKLWKKLRSDEPLI | NSYTAQLVK,YTAQLVKMK,SYTAQLVKM,YTAQLVKMKY,S NSYTAQLVK,LVKMKYGAWY,TPSNSYTAQL,NSYTAQLVK M,QLVKMKYGAW | LUAD |
| FAM47B | c.1701G>T | p.L567F | QRGRIRYGPWYFEPKLGKKLRSDEP[p.L567F]FIDKPVLEKPDEPDILDGLYGPIAF | KLRSDEPFI,KKLRSDEPF,EPFIDPKPV,RSDEPFIDPK,FIDPKP VLEK,EPFIDPKPVL,GKKLRSDEPF,KKLRSDEPFI | LUAD |
| FAM47B | c.489G>T | p.W163C | GKDMPPDLLLQVLKQLDPERKLEDA[p.W163C]CARCEAREKTTEVPTESGKYPCGESC | CARCEAREK,DACARCEAR,LEDACARCEA | LUAD |
| FAM47C | c.1162C>T | p.P388S | VSPLRQLPPEAGVSHLCPEPPKTRV[p.P388S]SPLRPETPKNGVSPLFPEPPKTRISN | KTRVSPLRP,RVSPLRPET,PPKTRVSPL,KTRVSPLRPE,EPPKT RVSPL | KIRC |
| FAM48B1 | c.1495A>G | p.I499V | ISSGNSFPPQQAGSPLKRPFSAAAA[p.I499V]VAAAAAAAAAAAAAAAAPALAA | FSAAAAVAA,SAAAAVAAA,RPFSAAAAV,FSAAAAVAAA,S AAAAVAAAA,RPFSAAAAVA | TGCT |
| FAM48B1 | c.1546P>C | p.A516P | RPFSAAAAIAAAAAAAAAAAAAAA[p.A516P]PAPALAAAAAPALAAAAPALAAA | AAAPAPAPAL,APAPAPPALAA | TGCT |
| FAM50A | c.950A>G | p.H317R | SDATVEKDESHAGKVVLRSVYEKNK[p.H317R]RIFPASRWEPYDPEKKWDKYTIR* | KNKRIFPAS,KRIFPASRW,SWYEKNKRIF,KNKRIFPASR,YEK NKRIFPA,NKRIFPASRW | CLL |
| FAM58BP | c.208G>A | p.A70T | LGMQSIPIATACTIYPKFCETILD[p.A70T]TFDPYLIAMSSIYLAGKVEEQPLWAH | ILDTFDPYL,TILDTFDPY,DTFDPYLIA,ETILDTFDPY,TILDTFD PYL,ILDTFDPYLI,FPCETILDTF,DTFDPYLIAM | BRCA |
| FAM5B | c.1204C>T | p.R402C | AGLKVLFKKTHRILRRLFNLCKRCH[p.R402C]CQPRFRLPKERSLSYWWNRIQSLLYC | CQPRFRLPK,RCHCQPRFR,KRCHCQPRF,RCHCQPRFRL,HC QPRFRLPK,CKRCFICQPRF | CRC |
| FAM5C | c.1274C>G | p.S425W | WLTRIQSFLYCNENGLLGSFSEETH[p.S425W]WCTCPNDQVVCTAFLPCTVGDASACL | GSFSEETHW | TGCT |
| FAM5C | c.1369C>G | p.R457G | QVVCTAFLPCTVGDASACLTCAPDN[p.R457G]GTRCGTCNTGYMLSQGLCKPEVAEST | GTRCGTCNT,GTRCGTCNTG,LTCAPDNGTR | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FAM70B | c.56C>T | p.S19L | MQPPVPGPLGLLDPAEGL[p.S19L]LRRKKTSLWFVGSLLLVSVLIVTVGL | LLDPAEGLL,LLRRKKTSL,GLLDPAEGLL,GLLRRKKTSL,LLRRKKTSLW,LRRKKTSLWF | STAD |
| FAM70B | c.829C>A | p.P277T | GFRLTPEPVPTCSSYPLPLQPCSRF[p.P277T]TVAPSSALASSEDLQPPSPSSSGSGL | LQPCSRFTV,FTVAPSSAL,TVAPSSALA,CSRFTVAPS,RFTVAPSSA,QPCSRFTVA,FTVAPSSALA,CSRFTVAPSS,LQPCSRFTVA,SRFTVAPSSA,RFTVAPSSAL | LUAD |
| FAM71B | c.1333C>G | p.H445D | PSAEVWNENKERREKKDRHPSRKSS[p.H445D]DHRKAGESHRRAGDKNQKASSHRSA | PSRKSSDHRK | CESC |
| FAM71B | c.1747C>A | p.L583M | VDIVAKMVEKQNIEAKVEKAQGGQE[p.L583M]MEMISGTMTSEKTEMIVFETKSI* | EKAQGGQEM,AQGGQEMEM,QEMEMISGT,MEMISGTMT,QEMEMISGTM,VEKAQGGQEM,KAQGGQEMEM,MEMISGTMTS | LUAD |
| FAM73A | c.68G>T | p.G23V | MSDCCSAPGISWEAGVGRPAVP[p.G23V]VLELQIRRGAMSEETVSESQFSLKTA | RPAVPVLEL,VGRPAVPVL | CESC |
| FAM75A6 | c.161C>T | p.P54L | FLTLVFALGFFFLLLPYLSYFHCDD[p.P54L]LPSPSPGKRKCPVGRRRPRGRMKNH | LSYFHCDDL,YLSYFHCDDL | LUAD |
| FAM75A6 | c.910C>A | p.R304S | ASSRWQETARTSCAFNSSVQQDPLS[p.R304S]SHPPETCQMEAGSLFLLSSDGQNVVG | VQQDPLSSH,SSHPPETCQM | LUAD |
| FAM75D1 | c.3793C>A | p.R1265S | NSQGISSGDMGTSQVVHVHLEDSGI[p.R1265S]SVAQKQEPRVPTCVLQKCQVTNFPPA | HLEDSGISV,SVAQKQEPR,LEDSGISVA,HLEDSGISVA,SVAQKQEPRV | LUAD |
| FAM75D5 | c.665T>C | p.L222P | PPQPVSPLDSKFPIDHSLPQQLPSP[p.L222P]PFPPHIQRAEPSLQPEASLSLNTVF | PQQLPSPPF,LPSPPFPPH,LPQQLPSPF,QQLPSPPFPP | THCA |
| FAM78A | c.575G>T | p.W192L | TWAVPVSESNVAKLTNIYRDQSFTT[p.W192L]LLVATNTSTNDMIILQTLHWRMQLSI | LLVATNTST,YRDQSFTTL,RDQSFTTLL,QSFTTLLVA,IYRDQSFTTL,YRDQSFTTLL,DQSFTTLLVA | KIRC |
| FAM83B | c.617G>A | p.R206Q | DESNFNHFLNMTEKQGCSVQRLRNI[p.R206Q]QVRTVKGQDYLSKTGAKFHGKMEQKF | VQRLRNIQV,RLRNIQVRT,RNIQVRTVK,RLRNIQVRTV,VQRLRNIQVR,QVRTVKGQDY | UCEC |
| FAM86A | c.421G>A | p.A141T | SGGSVVTLSESTAIISYGTTGLVTWD[p.A141T]TALYLAEWAIENPAVFTNRTVLELGS | LVTWDTALY,GLVTWDTAL,VTWDTALYL,VTWDTALYLA,GLVTWDTALY,LVTWDTALYL,DTALYLAEWA,TALYLAEWAI | TGCT |
| FAM86C2P | c.359G>A | p.C120Y | RASCSPLSYAGLGSDGKWNLVMTRN[p.C120Y]YFPTKSTWRWQC* | MTRNYFPTK,NYFPTKSTW,YFPTKSTWR,NLVMTRNYF,WNLVMTRNY,VMTRNYFPTK,YFPTKSTWRW,MTRNYFPTKS,KWNLVMTRNY,NYFPTKSTWR,LVMTRNYFPT,WNLVMTRNYF,RNYFPTKSTW | TGCT |
| FAM8A | c.1148C>T | p.S383L | KVQFERKHSKIHSIRSLASQPTELN[p.S383L]LEVLEQSQQSTSLTFGEGAESPGGQS | QPTELNLEV,SQPTELNLEV,LASQPTELNL,QPTELNLEVL | UCEC |
| FARP1 | c.896G>T | p.R299L | KRFLIKLRPDANSAYQDTLEFLMAS[p.R299L]LDFCKSFWKICVEHHAFFRLFEEPKP | FLMASLDFC,TLEFLMASL,LMASLDFCK,EFLMASLDF,ASLDFCKSF,FLMASLDFCK,SLDFCKSFWK,DTLEFLMASL,MASLDFCKSF,LEFLMASLDF,ASLDFCKSFW,LDFCKSFWKI | LUAD |
| FAS | c.781G>A | p.E261K | IAGVMTLSQVKGFVRKNGVNEAKID[p.E261K]KIKNDNVQDTAEQKVQLLRNWHQLHG | GVNEAKIDK | CESC |
| FASTKD1 | c.9_10insA | p.K3fs | MKK[p.K3fs]NTCFPRVIGYKYASSKSYLSILLESVSISTHQL* | YLSILLESV,IGYKYASSK,KYASSKSYL,SYLSILLES,CFPRVIGYK,ASSKSYLSI,SSKSYLSLI,YKYASSKSY,SVSISTHQL,TCFPRVIG | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FASTKD3 | c.1873C>G | p.Q625E | RFCSNSKHLLGKEAIKQRHLQLLGY[p.Q625E]EVVQIPYHEIGMLKSRRELVEYLQRK | Y,FPRVIGYKY,KKNTCFPRV,SKSYLSILL,LESVSISTFI,ILLESVS IST,VIGYKYASSK,TCFPRVIGYK,CFPRVIGYKY,SYLSILLESV, SSKSYLSILL,NTCFPRVIGY,GYKYASSKSY,ESVSISTHQL,FPR VIGYKYA,YASSKSYLSI,MKKNTCFPRV,KKNTCFPRVI,YKYA SSKSYL,ASSKSYLSIL,LSILLESVSI | BLCA |
| FAT1 | c.13076G>T | p.R4359L | TKVVDLDPCLSKKPLEEKPSQPYSA[p.R4359L]LESLSEVQSLSSPQSESCDDNGYHWD | HLQLLGYEV,LQLLGYEVV,LLGYEVVQI,GYEVVQIPY,YEW QIPYH,HLQLLGYEVV,QLLGYEVVQI,LGYEVVQIPY,EVVQIP YHEI,RHLQLLGYEV SALESLSEV,KPSQPYSAL,QPYSALESL,YSALESLSEV,SQPYS ALESL,LESLSEVQSL | LUAD |
| FAT3 | c.10720C>A | p.H3574N | PTAIPLEIFIVTMEDDFPGGVIGKI[p.H3574N]NATDQDMYDVLTFALKSEQKSLFKVN | KINATDQDM,KINATDQDMY,NATDQDMYDV,GKINATDQDM | LUAD |
| FAT3 | c.12475G>A | p.A4159T | GLRPVVVPNIQAGHSVVGKEELIGI[p.A4159T]TVVLFVIFILVVLFIVFRKKVFRKNY | ELIGITVVL,ITVVLFVIF,TVVLFVIFI,KEELIGITV,LIGITVLF,E LIGITVVLF,LIGITVLFV,IGITVVLFVI,ITVVLFVIFI,TVVLFVIFI L,ELIGITVVLF,KEELIGITVV,GITVVLFVIF,EELIGITVVL | UCEC |
| FAT3 | c.3797G>A | p.R1266H | VVQVLDENDNKPQFPEKVYQIKLPE[p.R1266H]HDRKKRGEPIYRAFAFDREGPNAEI | KVYQIKLPEH,QIKLPEHDRK | LUAD |
| FAT3 | c.5696G>T | p.G1899V | TDVNDNPPVFTQAVFETILLLPTYV[p.G1899V]VVEVLKVSATDPDSEVPPELTYSLME | ILLLPTYVV,LLLPTYVVV,YVVVEVLKV,LPTYVVVEV,TILLLPT YVV,ILLLPTYVVV,LLPTYVVVEV,PTYVVVEVLK,TYVVVEVL KV,LPTYVVVEVL | LUAD |
| FBRSL1 | c.2507C>T | p.A836V | GRSGAPAEREAEPRVKESRSPAKEE[p.A836V]VAKMPARASPPHSKAAPGDVKVKEER | EVAKMPARA,KEEVAKMPA,RSPAKEEVAK,SPAKEEVAKM, EEVAKMPARA | ACC |
| FBXL13 | c.306T>A | p.S102R | RIQQIIYCHKLTIILTKWRNTARHK[p.S102R]RKKKEDELILKHELQLKKWKNRLILK | RNTARHKRK,TARHKRKKK,KWRNTARHKR,RNTARHKRKK, RKKKEDELIL | CLL |
| FBXL14 | c.143T>G | p.V48G | RDKGRAAQVCTAWRDAAYHKSVWRG[p.V48G]GEAKLHLRRANPSLFPSLQARGIRRV | SVWRGGEAK,KSVWRGGEA,KSVWRGGEAK,GEAKLHLRR A | TGCT |
| FBXO18 | c.432G>T | p.M144I | KQPCTNDMAKSNSVGQDSCQDSEGD[p.M144I]IIFPAESSCALPQEGSAGPGSPGSAP | CQDSEGDII,SEGDIIFPA,IIFPAESSCA,CQDSEGDIIF | LUAD |
| FBXO21 | c.432del|T | p.F144fs | KRFFSEHVPCNGFSDIENLEGPEIF[p.F144fs]LRMNWCVS* | IFLRMNWCV,FLRMNWCVS,PEIFLRMNW,EIFLRMNWCV, LEGPEIFLRM,GPEIFLRMNW | STAD |
| FBXO24 | c.1657A>G | p.M553V | HLPASRWGTPEPSLGARAPQDPGG[p.M553V]VAQACEEYLSQIHSCQTLQDRTEKMK | GVAQACEEY,APQDPGGVA,GGVAQACEEY | HNSC |
| FBXO31 | c.1329_1330insG | p.G443fs | TPGEDGGEPGDAVAAAEQPAQCGQG[p.G443fs]AAVRAARGRELQE* | AQCGQGAAV,AVRAARGRE,AVRAARGREL,GQGAAVRAA, VRAARGREL,AVRAARGREL,QPAQCGQGAA | LUAD |
| FBXW7 | c.1268G>T | p.G423V | SDDNTLKVWSAVTGKCLRTLVGHTG[p.G423V]VVWSSQMRDNIIISGSTDRTLKVWNA | TLVGHTGVV,GVVWSSQMR,RTLVGHTGV,LVGHTGVVW, TGVVWSSQM,RTLVGHTGVV,TLVGHTGVVW,HTGVVWSSQM | UCEC |
| FBXW7 | c.1393C>T | p.R465C | DRTLKVWNAETGECIHTLYGHTSTV[p.R465C]CCMHLHEKRVVSGSRDATLRVWDIET | STVCCMHLH,GHTSTVCCM,TLYGHTSTVC,TVCCMHLHEK, HTSTVCCMHL,YGHTSTVCCM | CESC,CRC, STAD,UCEC, UCS |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FBXW7 | c.1394G>A | p.R465H | DRTLKVNNAETGECIHTLYGHTSTV[p.R465H]HCMHLHEKRVVSGSRDATLRVWDIET | STVHCMHLH, HCMHLHEKR, GHTSTVHCM, TVHCMHLHEK, HTSTVHCMHL, LYGHTSTVH, YGHTSTVHCM | CLL, CRC, UCEC, UCS |
| FBXW7 | c.1436G>A | p.R479Q | IHTLYGHTSTVRCMHLHEKRVVSGSG[p.R479Q]QDATLRVWDIETGQCLHVLMGHVAAV | SQDATLRVW | STAD, UCS |
| FBXW7 | c.1513C>G | p.R505G | DATLRVWDIETGQCLHVLMGHVAAV[p.R505G]GCVQYDGRRVVSGAYDFMVKVWDPET | VAAVGCVQY, HVAAVGCVQY | BLCA, CESC, HNSC, LUSC, UCS |
| FBXW7 | c.1513C>T | p.R505C | DATLRVWDIETGQCLHVLMGHVAAV[p.R505C]CCVQYDGRRVVSGAYDFMVKVWDPET | VAAVCCVQY, VLMGHVAAVC, HVAAVCCVQY, AVCCVQYDGR | CRC, UCEC |
| FBXW7 | c.1637C>T | p.S546L | FMVKVWDPETETCLHTLQGHTNRVY[p.S546L]LLQFDGIHVVSGSLDTSIRVWDVETG | LLQFDGIHV, VYLLQFDGI, TNRVYLLQF, YLLQFDGIH, YLLQFDGIHV, LLQFDGIHVV, RVYLLQFDGI, HTNRVYLLQF, LQGHTNRVYL | BLCA |
| FBXW7 | c.1745C>T | p.S582L | GSLDTSIRVWDVETGNCIHTLTGHQ[p.S582L]LLTSGMELKDNILVSGNADSTVKIWD | QLLTSGMEL, LLTSGMELK, HTLTGHQLL, IHTLTGHQL, GHQLLTSGM, QLLTSGMELK, IHTLTGHQLL, TGHQLLTSGM, HQLLTSGMEL | CRC |
| FBXW7 | c.2065C>T | p.R689W | ESGGSGGVVWRIRASNTKLVCAVGS[p.R689W]WNGTEETKLLVLDFDVDMK* | KLVCAVGSW, GSWNGTEETK, TKLVCAVGSW | CRC, UCEC, UCS |
| FBXW7 | c.41G>A | p.R14Q | MNQELLSVGSKRR[p.R14Q]QTGGSLRGNPSSSQVDEEQMNRVVEE | KRRQTGGSL, RQTGGSLRG, KRRQTGGSLR, SKRRQTGGSL | CRC |
| FBXW9 | c.893_894 insG | p.G298fs | YDKKVTIYDPRDRMETRDALMGWGG[p.G298fs]AFEGL* | GWGGAFEGL, ALMGWGGAF, DALMGWGGA, MGWGG AFEGL | STAD |
| FCAR | c.697G>A | p.V233M | SNALELVVTDSIHQDYTTQNLIRMA[p.V233M]MAGLVLVALLAILVENWHSTALNKE | RMAMAGLVL, MAMAGLVLV, AMAGLVLVA, LIRMAMAGL, TQNLIRMAM, IRMAMAGLV, MAGLVLVAL, NLIRMAMAGL, RMAMAGLVLV, MAMAGLVLVA, AMAGLVLVAL, LIRMAM AGLV, IRMAMAGLVL | HNSC |
| FCGBP | c.12055G>A | p.V4019M | VYYEPEQTVLIDNCRQQCTCHVGKV[p.V4019M]MVCQEHSCKPGQVCQPSGGILSCVTK | VMVCQEHSCK | UCS |
| FCGBP | c.3064G>T | p.A1022S | EALCGLCGNFNGPADDLALRGGGQ[p.A1022S]SANALAFGNSWQEETRPCGATEPGD | ALRGGGQSA, GQSANALAF, LALRGGGQSA, GGQSANALAF | LUAD |
| FCGBP | c.7478C>T | p.A2493V | RPDFMGTCVYVLAQTCCGTRPGLHRF[p.A2493V]VVLQENVAWGNGRVSVTRVITVQVAN | RPGLHRFVV, VVLQENVAW, GTRPGLHRFV, RPGLHRFVVL, FVVLQENVAW | PAAD |
| FCGR2A | c.665T>G | p.V222G | SSKPVTITVQVPSMGSSSPMGIIVA[p.V222G]GVIATAVAAIVAAVVALIYCRKKRIS | IVAGVIATA, PMGIIVAGV, SPMGIIVAG, IIVAGVIATA, IVAG VIATAV, GVIATAVAAI, SPMGIIVAGV | KIRP |
| FCGRT | c.118C>G | p.P40A | LFLLPGSLGAESHLSLLYHLTAVSS[p.P40A]AAPGTPAFWVSGWLGPQQYLSYNSLR | HLTAVSSAA, SSAAPGTPA, SAAPGTPAF, YHLTAVSSA, SSAAPGTPAF, YHLTAVSSAA, SAAPGTPAFW | THCA |
| FCRL2 | c.1513G>T | p.V505L | MQQPESSANIRTLLENKDSQVIYSS[p.V505L]LKKS* | SQVIYSSLK, QVIYSSLKK, SQVIYSSLKK, DSQVIYSSLK, KTAIYSSL | LUAD |
| FEM1A | c.1858C>A | p.L620M | AIMNALIEAGAHMDATNAFKKTAYE[p.L620M]MLDEKLLARGTMQPFNYVTLQCLAAR | TAYEMLDEK, AFKKTAYEM, FKKTAYEML, YEMLDEKLL, KTA YEMLDEK, EMLDEKLLAR, NAFKKTAYEM, YEMLDEKLLA | PRAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FER | c.1422del A | p.L474fs | SEKPLAEQDWYHGAIPRIEAQELLK[p.L474fs]NKETFWCERVMGNLVNMSFLYILMDRGDILSYNMLITCIDSRALGFQTFLNL* | CIDSRALGF,RVMGNLVNM,ILMDRGDIL,LVNMSFLYI,NM SFLYILM,LITCIDSRA,SYNMLITCI,RALGFQTFL,NLVNMSFL Y,MRGDILSY,SFLYIMDR,MLITCIDSR,ETFWCERVM,DIL SYNMLI,MGNLVNMSF,CERVMGNLV,VNMSFLYIL,RGDIL SYNM,SRALGFQTF,LGFQTFLNL,KETFWCERV,GDILSYNM L,LMDRGDILSY,NLVNMSFLYI,MLITCIDSRA,ALGFQTFLNL, MSFLYILMDR,VMGNLVNMSF,LYILMDRGDI,KNKETFWC ER,GNLVNMSFLY,NMLITCIDSR,DSRALGFQTF,QELLKNKE TF,KETFWCERVM,LVNMSFLYIL,VNMSFLYILM,LSYNMLIT CI,TCIDSRALGF,SRALGFQTFL,GDILSYNMLI | STAD |
| FERD3L | c.275C>A | p.P92H | CEVDQDGEEEEEERGRGVSLLGR[p.P92H]HKRKRVITYAQRQAANIRERKRMFNL | SLLGRHKRK,GVSLLGRHK,VSLLGRHKR,HKRKRVITY,VSLLG RFIKRK,RGVSLLGRH,SLLGRHKRKR,LGRHKRKRVI,RHKRK RVITY | LUAD |
| FEZ2 | c.149C>T | p.P50L | NCNASPEPGAEAEAGGADGFPA[p.P50L]LACSLEEKLSLCFRPSDPGAEPPRTA | ALACSLEEK,GGADGFPAL,ALACSLEEKL,FPALACSLEE | ACC |
| FEZF2 | c.244G>A | p.E82K | GSQGKLLNLCSPLPCMIPLQPLGY[p.E82K]KVPSKTLLSYSELWKSSLRAGGGGG | YKVPSKTLL,MIPLQPLGYK,KVPSKTLLSY,LGYKVPSKTL,IPL QPLGYKV | CESC |
| FGB | c.1015G>C | p.E339Q | NYCGLPGEYWLGNDKISQLTRMGPT[p.E339Q]QLLIEMEDWKGDKVKAHYGGFTVQNE | RMGPTQLLI,LTRMGPTQL,GPTQLLIEM,TRMGPTQLL,QLT RMGPTQL,LTRMGPTQLL,SQLTRMGPTQ | LUAD |
| FGF14 | c.686C>T | p.T229M | KPLEVAMYREPSLHDVGETVPKPGV[p.T229M]PSKSTSASAIMNGGKPVNKSKTT | VMPSKSTSA,MPSKSTSAS,GVMPSKSTSA,VPKPGVMPSK, MPSKSTSASA,GETVPKPGVM | GBM |
| FGF14 | c.707C>T | p.A236V | YREPSLHDVGETVPKPGVTPSKSTS[p.A236V]SAIMNGGKPVNKSKTT* | VTPSKSTSV,VSAIMNGGK,KSTSVSAIM,SKSTSVSAI,GVTPS KSTSV,SVSAIMNGGK,TPSKSTSVSA,SKSTSVSAIM | CRC |
| FGFR3 | c.1138G>A | p.G380R | VVLPAEEELVEADEAGSVYAGILSY[p.G380R]RVGFFLFILVVAAVTLCRLRSPPKKG | YAGILSYRV,ILSYRVGFF,RVGFFLFIL,SVYAGILSYR,GILSYRV GF,LSYRVGFFL,ILSYRVGFFL,RVGFFLFILV,SVYAGILSYR,VY AGILSYRV,LSYRVGFLF,STRVGFFLFI,AGILSYRVGF,GILSY RVGFF,YRVGFLFIL | BLCA |
| FGFR3 | c.1711_1712 insG | p.R571fs | QGGPLYVLVEYAAKGNLREFLRARR[p.R571fs]APCGPGLLLRHLQAARGAAHLQGPGVLCLPGGPGHGVLGLPEVHPQGPGCPQCAGDRGQRDEDRRLRAGPGRAQPRLLQEDDQRPAAREVDGA* | LLLRHLQAA,RARRAPGPG,LLRRHLQAAR,RLRAGPGRA,GP GHGVLGL,FLRARRAPG,LQAARGAAFI,REFLRARRA,ARRA PGPGL,RRAPGPGLL,RAPGPGLLL,RHLQAARGA,AHLQGP GVL,LQGPGVLCL,LQEDDQRPA,LPGGPGHGV,CLPGGPGH GV,GLLLRHLQA,LQAARGAAHL,LLQEDDQRPA,RARRAP GPGL,RLRAGPGRAQ,RAGPGRAQPR,LLLRHLQAAR,LPGG PGHGVL,RPAAREVDGA,FLRARRAPGP,REFLRARRAP,RRA PGPGLLI,RHLQAARGAA,HLQAARGAAH,AAHLQGPGVL, HLQGPGVLCL,LQEDDQRPAA | KIRC |
| FGFR3 | c.2147C>A | p.P716H | GGSPYPGIPVEELFKLLKEGHRMDK[p.P716H]HANCTHDLYMIMRECWHAAPSQRPTF | HANCTHDLY,KHANCTHDLY,RMDKHANCTH,HANCTHDL YM | KIRC |
| FGFR3 | c.2420G>C | p.*807S | SSGDDSVFAHDLLPPAPPSSGGSRT[p.*807S]SRATGPQQCEGSLAAHPAAGAQPLPGMRLSADGETATQSFGLCVCVCVCVCVCAHPRVPVCVRILPPGAEVPVVVSPLLCNGLLTGAAAPRGLCSGGTQCRM* | RILPPGAEV,RLSADGETA,CVCVCAHPR,GSRTSRATG,GSLA AHPAA,CVRILPPGA,LLTGAAAPR,LAAHPAAGA,ETATQSF GL,QSFGLCVCV,EVPWVSPLL,GPQQCEGSL,HPAAGAQPL, SPLLCNGLL,QQCEGSLAA,AGAQPLPGM,AQPLPGMRL,AE VPWVSPL,LPPGAEVPW,VPWVSPLLC,SLAAHPAAGA,TQS FGLCVCV,GLCVCVCV,LLCNGLLTGA,WVSPLLCNGL,ILP | MM |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FGFR3 | c.742C>T | p.R248C | RGNYTCVVENKFGSIRQTYTLDVLE[p.R248C]CSPHRPILQAGLPANQTAVLGSDVEF | PGAEVPW,ETATQSFGLC,CVCAHPRVPV,QPLPGMRLSA,H PRVPVCVRI,QQCEGSLAAH,ADGETATQSF,GETATQSFGL, AEVPWVSPLL,CEGSLAAFIPA,LPPGAEVPW DVLECSPHR,LECSPHRPI,LECSPHRPIL | BLCA |
| FGFR3 | c.746C>G | p.S249C | GNYTCVVENKFGSIRQTYTLDVLER[p.S249C]CPHRPILQAGLPANQTAVLGSDVEFH | DVLERCPHR,LERCPHRPI,CPHRPILQA,LERCPHRPIL | BLCA,LUSC |
| FGFR1 | c.1435_1436 de|CA | p.H479fs | LGPGPVAGPKLYPKLYTDIHTHTHT[p.H479fs]LSHTLTRGGQGPPAHPLSVLDGT VSAVGTGGPARQADWEDGGRSCRRR QGTHGEEEWPAPQAVCV* | SVLDGTVSA,VLDGTVSAV,HTHTHTLSH,HTLSHTLTR,HTH TLSHTL,RSCRRRQGT,DIHTHTHTL,GPPAHPLSV,PPAHPLS VL,WPAPQAVCV,GQGPPAHPL,EEWPAPQAV,EEEWPAP QA,SVLDGTVSAV,HTHTHTLSHT,HTHTLSHTLT,LTRGGQG PPA,RSCRRRQGTH,GPPAHPLSVL,HPLSVLDGTV,TDIHTH THTL,IHTHTHTLSH,RQGTHGEEEW,EEWPAPQAVC,EEEW PAPQAV,GEEEWPAPQA | BLCA |
| FGFRL1 | c.728G>T | p.R243L | KYTCRVSNRAGAINATYKVDVIQRT[p.R243L]LSKPVLTGTHPVNTTVDFGGTTSF QC | RTLSKPVLT,IQRTLSKPV,VIQRTLSKP,TLSKPVLTGT,RTLS KPVLTG,IQRTLSKPVL,YKVDVIQRTL | LUAD |
| FGFRL1 | c.820G>T | p.V274L | TGTHPVNTTVDFGGTTSFQCKVRSD[p.V274L]LKPVIQWLKRVEYGAEGRHNST IDVG | KVRSDLKPV,QCKVRSDLK,FQCKVRSDL,KVRSDLKPVI,DLK PVIQWLK,CKVRSDLKPV | LUAD |
| FGGY | c.412_413i nsG | p.G138fs | LDHRAVSQVNRINETKHSVLQYVGG[p.G138fs]GDVCGNAGPETSVAERELERD LLG* | SVAERELER,LQYVGGGDV,AERELERDL,VLQYVGGGDV,LQ YVGGGDVC,AERELERDLL | STAD |
| FHDC | c.298de|T | p.F100fs | PGLPPTTHMNGYSHLGKKKRMRSFF[p.F100fs]GKLFRRSKFEAKPTSGPWQPG RNITTKLIQRPLRSSLGSRKTPPSLPFLGE EEL* | RMRSFFGKL,RSFFGKLFR,KRMRSFFGK,SFFGKLFRR,KTPP SLPFL,KKRMRSFFG,FGKLFRRSK,LFRRSKFEA,RSKFEAKPT, TTKLIQRPL,IQRPLRSSL,PLRSSLGSR,GSRKTPPSL,TSGPWQ PGR,NITTKLIQR,GPWQPGRNI,LPFLGEEEL,MRSFFGKLF, GKLFRRSKF,RKTPPSLPF,KLFRRSKFEA,SLPFLGEEEL,RSFF GKLFRR,RMRSFFGKLF,KKRMRSFFGK,LFRRSKFEAK,RSKF EAKPTS,TTKLIQRPLR,IQRPLRSSLG,PLRSSLGSRK,GPWQP GRNIT,LIQRPLRSSL,KRMRSFFGKL,FGKLFRRSKF,SKFEAKP TSG,FEAKPTSGPW,SRKTPPSLPF,RKTPPSLPFL | STAD |
| FHL1 | c.760C>T | p.R254W | SGDVSKIiSLADSFLYGLIQVPNYSL[p.R254W]IEAMVLKKEFLPSCSSLYTDITVL R | YSLWIEAMV,SLWIEAMVL,LWIEAMVLK,WIEAMVLKK,IQ VPNYSLW,NYSLWIEAM,IQVPNYSLWI,SLWIEAMVLK,NYS LWIEAMV,YSLWIEAMVL,VPNYSLWIEA | CRC |
| FKLIP | c.552T>G | p.D184E | AKHCVKCNKAITSGGITYQDQPWHA[p.D184E]ECFVCVTCSKKLAGQRFTAVED QYYC | AECFVCVTC,QPWHAECFV,AECFVCVTCS | CLL |
| FIGNL1 | c.926de|A | p.K309fs | NGPKEDS5LPTFKTAKEQLWDQQK[p.K309fs]STTNLSVHQGLHMV* | SVHQGLHMV,LSVHQGLHM,DQQKSTTNL,QKSTTNLSV,S VHQGLHMVV,QQKSTTNLSV,TTNLSVHQGL,QKSTTNLSV H,NLSVHQGLHM | STAD |
| FILIP1 | c.1565T>A | p.I522K | LKDDLTKLKSFTVMLVDERKNMMEK[p.I522K]KKQERKVDGLNKNFKVEQK VMDVT | MMEKKKQEER | CLL |
| FKBPL | c.481G>C | p.E161Q | GPPEGWTELTMGVGPWREETWGELI[p.E161Q]QKCLESMCQGEEAELQLPGH SGPPVR | ETWGELIQK,LIQKCLESM,ELIQKCLESM | CESC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FKBPL | c.959G>T | p.R320L | AQAALGNLEKATADLKKVLAIDPKN[p. R320L]LAAQEELGKVVIQGKNQDAGLA QGLR | VLAIDPKNL, KNLAAQEEL, VLAIDPKNLA | LUAD |
| FLG | c.477del|A | p.K159fs | KGNKGRSKSPRETGGKRHESSSEKK[p.K 159fs]KEKDIHLLIEKKNMEKTIIQVKK RKTRLKILD* | KTMIITQVKK, LIEKKNMEK, TIITQVKKR, QVKKRKTRL, KKKEKD IHL, KEKDIHLLI, KKNMEKTII, MEKTIITQV, KKRKTRLKI, NME KTIITQV, LLIEKKNMEK, KTIITQVKKR, TIITQVKKRK, QVKKR KTRLK, ITQVKKRTR, KKKEKDIHLL, TQVKKRKTRL, KKRKTR LKIL | STAD |
| FLG | c.8657G>A | p.R2886H | ASTHADISRHSQAVQGQSEGSRRSR[p. R2886H]HQGSSVSQDSDSEGHSEDSE RWSGSA | GSRRSRHQG, RSRHQGSSV, RSRHQGSSVS, RRSRHQGSSV | GBM |
| FLG | c.9761C>A | p.P3254H | ERWSGSASRNHRGSVQEQSRHGSRH[p. P3254H]HRSHHEDRAGHGHSADRS RQSGTRHA | GSRHHRSHH, QSRHGSRHHR | LUAD |
| FLG2 | c.1716G>T | p.L572F | GSGSSQSSGYGYGSRETSGFGQHG[p. L572F]FGSGQSTGFGQYGSGSGQSSGF GQHG | FGSGQSTGF, GFGSGQSTGF | LUAD |
| FLG2 | c.4634G>T | p.G1545V | HTHGQSGSQHGESESIIHDRHRITH[p.G 1545V]VQTGDTTRHSYSGHEQTTQTG SRTTG | HVQTGDTTR | LUAD |
| FLG2 | c.5703_5704del|CA | p.H1901fs | RRSGHSESSDSEVHSGGSHTHSGHT[p. H1901fs]QPSQVSTWRVRIHSSQETPN YSWTDRRYH* | HSSQETPNY, TWRVRIHSS, RVRIHSSQE, QVSTWRVRI, TQP SQVSTW, SQETPNYSW, HTHSGHTQPS, RVRIHSSQET, IHSS QETPNY, ETPNYSWTDR, HTQPSQVSTW, SQVSTWRVRI, SS QETPNYSW, QPSQVSTWRV | GBM |
| FLI43860 | c.2549_2550insT | p.L850fs | SHTFQLMRALGAGQPTSHLVLTTLL[p.L 850fs]GLSAGATPAHRCQRQQPLPQGE DLPAFAGCHEHAARAAVCPGVQAGRA AV,VQAGRAGGL,RAGGLPQAL,AQRAPQAAG,LQHVTGGT GGLPQALPGPPHPDALCLGAEPAQRAP QAAGPGGGRAQPPKLQHVTGGTEEPA VHHGALA* | LVLTTLLGL, TLLGLSAGA, GLSAGATPA, ALCLGAEPA, AQPP KLQHV, ATPAHRCQR, AARAAVCPG, GGGRAQPPK, EPAVH HGAL, HRCQRQQPL, LSAGATPAH, PQGEDLPAF, HEHAARA E, LPQGEDLPA, HIVLITTLLGL, VLTTLLGLSA, AVCPGVQAGR, AARAAVCPGV, AGRAGGLPQA, RAQPPKLQHV, LSAGATPA HR, FAGCHEHAAR, TTLLGLSAGA, HVTGGTEEPA, LPQGEDL PAF, LPGPPHPDAL, AHRCQRQQPL, GLSAGATPAH, GRAGG LPQAL, LQHVTGGTEE, EEPAVHHGAL, LPAFAGCHEH, LPQA LPGPPH, HEHAARAAVC, AEPAQRAPQA, TEEPAVHHGA | PRAD |
| FLNA | c.3718G>A | p.V1240M | GTHTITYIPLCPGAYTVTIKYGGQP[p.V1 240M]MPNFPSKLQVEPAVDTSGVQCY GPGI | TIKYGGQPM, YGGQPMPNF, KYGGQPMNF, GQPMPNFP SK, QPMNFPSKL, MPNFPSKLQV, VTIKYGGQPM | GBM |
| FLNB | c.1586_1587insG | p.W529fs | LDGVYAFEYYPSTPGRYSIAITWGG[p. W529fs]TPHSKEPL* | ITWGGTPHSK, YSIAITWGGT, IAITWGGTPH | STAD |
| FLNB | c.1586delG | p.W529fs | FLDGVYAFEYYPSTPGRYSIAITWG[p.W 529fs]DTTFQRAPLKFKLALKRVCRKSVL GALGSMVGLSGGQRTSW* | VLGALGSMV, TTFQRAPLK, LALKRVCRK, TFQRAPLKF, FQR APLKFK, RAPLKFKLA, PLKFKLALK, KFKLALKRV, KLALKRVCR, RVCRKSVLG, TWGDTTFQR, MVGLSGGQR, DTTFQRAPL, A PLKFKLAL, AITWGDTTF, SVLGALGSM, KRVCRKSVL, LSGGQ RTSW, SVLGALGSMV, ALKRVCRKSV, KLALKRVCRK, ITWGD TTFQR, TFQRAPLKFK, IAITWGDTTF, TTFQRAPLKF, RVCRKS VLGA, DTTFQRAPLK, RAPLKFKLAL, LKRVCRKSVL, KSVLGAL GSM, FQRAPLKFKL, LKFKLALKRV, GLSGGQRTSW | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FLT3 | c.1800_1801 insTTCAG AGAATATG AATATGAT | p.600_ 601insF REYEYD | LQMVQVTGSSDNEYFYVDFREYEYD[p. 600_601insFREYEYD]FREYEYDLKWEF PRENLEFGKVLGSGAFGKVMNATAYGI SKTGVSI | YEYDFREYE,REYEYDFRE,REYEYDFREY,YEYDFREYEV,DFR EYEYDR,VDFREYEYDF,YDFREYEYDL | LAML |
| FLT3 | c.2503G>C | p.D835 H | RDLAARNVLVTHGKVVKICDFGLAR[p. D835H]HIMSDSNYVVRGNARLPVKW MAPESL | HIMSDSNYV,RHIMSDSNY,CDFGLARHI,HIMSDSNYVV,CD FGLARHIM,ARHIMSDSNY,RHIMSDSNY | LAML |
| FLT3 | c.2503G>T | p.D835 Y | RDLAARNVLVTHGKVVKICDFGLAR[p. D835Y]YIMSDSNYWRGNARLPVKW MAPESL | ICDFGLARY,YIMSDSNYV,RYIMSDSNY,CDFGLARYI,YIMS DSNYVV,KICDFGLARY,RYIMSDSNYV,CDFGLARYIM,ARYI MSDSNY | LAML |
| FLT3 | c.2505T>A | p.D835 E | RDLAARNVLVTHGKVVKICDFGLAR[p. D835E]EIMSDSNYVVRGNARLPVKW MAPESL | EIMSDSNYV,REIMSDSNY,CDFGLAREI,EIMSDSNYVV,CDF GLAREIM,AREIMSDSNY,REIMSDSNY | LAML |
| FMN2 | c.2252C>T | p.S751 F | CLEALRLEEKEVRHHRILEAKSIQT[p.S7 51F]FPTEEGGVLTLPPVDGLPGRPPCPP G | FPTEEGGVL,LEAKSIQTF,QTFPTEEGGV,ILEAKSIQTF,FPTE EGGVLT | BRCA |
| FMN2 | c.2974C>A | p.P992 T | GIPLPPPLPGAGIPPPPLPGAGIP[p.P9 92T]TPPPLPGAGIPPPPLPGAGIPPPP P | AGIPTPPPL | LUAD |
| FMNL1 | c.2779G>C | p.E927 Q | HFLDKAGSVSLLDSVLADVRSLQRGL[p.E 927Q]QLTQREFVRQDDCMVLKEFLRA NSPT | SLQRGLQLT,RSLQRGLQL,QLTQREFVR,LQRGLQLTQ,GLQ LTQREF,LQLTQREFV,GLQLTQREFV,RGLQLTQREF | CESC |
| FMO3 | c.1530C>A | p.F510 L | AILTQWDRSLKPMQTRVVGRLQKPC[p. F510L]LFFHWLKLFAIPILLIAVFLVLT* | CLFFHWLKL,RLQKPCLFF,LFFHWLKLF,LQKPCLFFH,RLQKP CLFFH,LQKPCLFFHW,CLFFHWLKLF,KPCLFFHWLK,GRLQ KPCLFF | CRC |
| FMOD | c.993C>A | p.S331 R | QKIPPVNTNLENLYLQGNRINEFSI[p.S3 31R]RSFCTVVDVVNFSKLQVLRLDGNE IK | FSIRSFCTV,SIRSFCTVV,RSFCTVVDV,INEFSIRSF,FSIRSFCT VV,RSFCTVVDVV,RINEFSIRSF,NEFSIRSFCT | KIRP |
| FN1 | c.868C>T | p.R290 C | RGEWKCERHTSVQTTSSGSGPFTDV[p. R290C]CAAVYQPQPHPQPPYGHCVT DSGVV | FTDVCAAVY,GPFTDVCAAV | UCEC |
| FNBP4 | c.172_177d e|ACCACC | p.TT58 de| | PEPDTEPDSTAAVPSQPAPSAATT[p.T T58de|]AVTAAAASDDSPSEDEQEAVQ EVPRVVQNPP | APSAATTTA,ATTTAVTAAA,APSAATTAV | PRAD |
| FNDC1 | c.1955G>A | p.R652 H | QGTSHRPSLPASLNDNDLVDSDEDE[p. R652H]HAVGSLHPKGAFAQPRPALSPS RQSP | HAVGSLHPK,DEHAVGSLH,DEDEHAVGSL | CRC |
| FNDC1 | c.3535_3537de|GAC | p.D118 Ode| | APGKSEPPSKRPLSSKSQQSVSAED[p.D 1180de|]EEEDAGFFKGGKEDLLSSSVP KWPSSST | AEDEEEDAGF | PAAD |
| FOLH1 | c.1501de|A | p.S501f s | NLTKELKSPDEGFEGKSLYESWTKK[p.S 501fs]VLPQSSVACPG* | KVLPQSSVA,YESWTKKVL,KKVLPQSSV,SLYESWTKKV,LYE SWTKKVL,KKVLPQSSVA | STAD |
| FOLH1 | c.1927G>T | p.A643 S | HPQEMKTYSVSFDSLFSAVKNFTEI[p.A 643S]SSKFSERLQDFDKSNPIVLRMMN DQL | KNFTEISSK,NFTEISSKF,EISSKFSER,ISSKFSERL,EISSKFSERL, KNFTEISKF | LUAD |
| FOXD4L4 | c.1215de|C | p.C405f s | GQFCSNSSSIRRTAPTAALPPRARC[p.C 405fs]GRAPVGLVGAAEVSGSGGGL* | RARCGRAPV,CGRAPVGLV,EVSGSGGGL,APVGLVGAA,RA RCGRAPVG,AEVSGSGGGL | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FOXK1 | c.1060C>T | p.R354W | SGIYAHITKHYPYRTADKGWQNSI[p.R354W]WHNLSLNRYFIKVPRSQEEPGKGSFW | WQNSIWHNL,NSIWHNLSL,WHNLSLNRY,SIWHNLSLNR,GWQNSIWHNL,IWHNLSLNRY,WHNLSLNRYF | CRC |
| FOXN3 | c.287de\|C | p.P96fs | NLLKSPGESVLRSVSPVQDLDDTP[p.P96fs]HPLPLTLTCPTMPGRTPTANPPTPSAASYLWPSRTLQPSACQ* | TMPGRTPTA,LTCPTMPGR,AASYLWPSR,SYLWPSRTL,DTPHPLPTL,SAASYLWPS,LPTLTCPTM,PPTPSAASY,TPSAASYLW,SAASYLWPSR,ASYLWPSRTL,TLTCPTMPGR,HPLPLTLTCPT,CPTMPGRTPT,WPSRTLQPSA,NPPTPSAASY | CRC,STAD |
| FOXQ1 | c.404C>T | p.S135L | RSKPYTRRPKPPYSYIALIAMAIRD[p.S135L]LAGGRLTLAEINEYLMGKFPFPRGSY | AIRDLAGGR,IAMAIRDLA,ALIAMAIRDL,LIAMAIRDLA,AIRDLAGGRL,MAIRDLAGGR,RDLAGGRLTL | BLCA |
| FOXRED1 | c.407G>T | p.R136L | SVGGICQQFSLPENIQLSLFSASFL[p.R136L]LNINEYLAVVDAPPLDLRFNPSGYLL | SLFSASFLL,FSASFLLNI,FLLNINEYL,LNINEYLAV,SFLLNINEY,LFSASFLLNI,LNINEYLAV,FLLNINEYLA,LNINEYLAV,ASFLLNINEY,LFSASFLLNI,SFLLNI,SFLLNINEYL,LSLFSASFLL,LNINEYLAVV | LUAD |
| FPGS | c.64A>G | p.I22V | MSRARSHLRAALFLAAASARG[p.I22V]VTTQVAARRGLSAWPVPQEPSMEYQD | SARGVTTQV,GVTTQVAAR,VTTQVAARR,LAAASARGV,FL AAASARGV,ASARGVTTQV,SARGVTTQVA | ACC |
| FPGT-TNNI3K | c.1364G>A | p.R455H | NVININHQGRDGHTGLHSACYHGHI[p.R455H]HLVQFLLDNGADMNLVACDPSRSSGE | CYHGHIHLV,HIHLVQFLL,ACYHGHIHL,HGHIHLVQF,GHIH LVQFL,YHGHIHLVQF,HSACYHGHIH,SACYHGHIHL,GHIHL VQFLL | CRC |
| FPR2 | c.161G>A | p.R54Q | PLVVLGVTFVLGVLGNGLVIWVAGF[p.R54Q]QMTRTVTTICYLNLALADFSFTATLP | FQMTRTVTT,QMTRTVTTI,WVAGFQMTR,VIWVAGFQM,AGPQMTRTV,FQMTRTVTTI,IWVAGFQMTR,LVIWVAGFQM | GBM |
| FRAS1 | c.1145G>T | p.C382F | FMSSNASEVKRIPEGEKWEDGPCKV[p.C382F]FECRGAQVTCYEPSCPPCPVGTLALE | WEDGPCKVF,FECRGAQVT,KVFECRGAQV,KWEDGPCKVF | LUAD |
| FRG1 | c.254_256de\|AAG | p.E86de\| | AIEMDKGTYIHALDNGLFTLGAPHK[p.E86de\|]VDEGPSPPEQFTAVKLSDSRIALKSGYG | FTLGAPHKV | PRAD |
| FRG1B | c.101T>C | p.I34T | RIALKSGYGKYLGINSDELVGHSDA[p.I34T]TGPREQWEPVFQNGKMALLASNSCFI | DELVGHSDAT | PRAD |
| FRG1B | c.110G>A | p.R37K | LKSGYGKYLGINSDELVGHSDAIGP[p.R37K]KEQWEPVFQNGKMALLASNSCFIRCN | GPKEQWEPV,DAIGPKEQW,VGHSDAIGPK | UCS |
| FRG1B | c.115C>A | p.Q39K | SGYGKYLGINSDELVGHSDAIGPRE[p.Q39K]KWEPVFQNGKMALLASNSCFIRCNEA | GPREKWEPV,DAIGPREKW,HSDAIGPREK,KWEPVFQNGK,GPREKWEPVF | CLL |
| FRG1B | c.125C>A | p.P42Q | GKYLGINSDELVGHSDAIGPREQWE[p.P42Q]QVFQNGKMALLASNSCFIRCNEAGDI | GPREQWEQV,EQVFQNGKM,GPREQWEQVF,WEQVFQNGKM,QVFQNGKMAL,REQWEQVFQN | PRAD |
| FRG1B | c.145A>G | p.M49V | SDELVGHSDAIGPREQWEPVFQNGK[p.M49V]VALLASNSCFIRCNEAGDIEAKSKTA | FQNGKVALL,FQNGKVALLA,VFQNGKVALL,VALLASNSCF,WEPVFQNGKV | TGCT |
| FRG1B | c.148G>C | p.A50P | DELVGHSDAIGPREQWEPVFQNGKM[p.A50P]PLLASNSCFIRCNEAGDIEAKSKTAG | FQNGKMPLL,VFQNGKMPL,MPLLASNSC,PLLASNSCF,FQ NGKMPLLA,VFQNGKMPLL,MPLLASNSCF | KIRP,PRAD,SKCM |
| FRG1B | c.155T>C | p.L52S | LVGHSDAIGPREQWEPVFQNGKMAL[p.L52S]SASNSCFIRCNEAGDIEAKSKTAGEE | SASNSCFIR,LSASNSCF,ALSASNSCF,FQNGKMALSA,ALSA SNSCFI,KMALSASNSC,LSASNSCFIR,MALSASNSCF | PRAD,UCS |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| FRG1B | c.157G>A | p.A53T | VGHSDAIGPREQWEPVFQNGKMALL[p. A53T]TSNSCFIRCNEAGDIEAKSKTA GEEE | LLTSNSCFI, LTSNSCFIR, ALLTSNSCFI, ALLTSNSCFI, FQNGK MALLT, KMALLTSNSC, LLTSNSCFIR, MALLTSNSCF | GBM, PRAD |
| FRG1B | c.163A>G | p.N55D | HSDAIGPREQWEPVFQNGKMALLAS[p. N55D]DSCFIRCNEAGDIEAKSKTAGEE EMI | LLASDSCFI, LASDSCFIR, ALLASDSCFI, ALLASDSCFI, LLASDS CFIR, MALLASDSCF | PRAD |
| FRG1B | c.175A>G | p.I59V | IGPREQWEPVFQNGKMALLASNSCF[p. I59V]VRCNEAGDIEAKSKTAGEEEMIK SLS | LLASNSCFV, LASNSCFVR, ALLASNSCFV, LLASNSCFVR | PRAD, SKCM |
| FRG1B | c.194G>A | p.G65E | WEPVFQNGKMALLASNSCFIRCNEA[p. G65E]EDIEAKSKTAGEEEMIKSLSHSLP SS | FIRCNEAEDI | UCS |
| FRG1B | c.29T>C | p.I10T | MAVKLSDSR[p.I10T]TALKSGYGKYLGI NSDELVGHSDAIG | LSDSRTALK, KLSDSRTAL, TALKSGYGK, RTALKSGYG, KLSDS RTALK, RTALKSGYGK, AVKLSDSRTA, TALKSGYGKY, VKLSD SRTAL | PRAD, UCS |
| FRG1B | c.31G>A | p.A11T | MAVKLSDSRI[p.A11T]TLKSGYGKYLGI NSDELVGHSDAIG | KLSDSRITL, ITLKSGYGK, LSDSRITLK, TLKSGYGKY, SRITLKSG Y, TLKSGYGKYL, KLSDSRITLK, RITLKSGYGK, ITLKSGYGKY, V KLSDSRITL | PRAD |
| FRG1B | c.39A>T | p.K13N | MAVKLSDSRIAL[p.K13N]NSGYGKYLG INSDELVGHSDAIGPRE | IALNSGYGK, SRIALNSGY, ALNSGYGKY, ALNSGYGKYL, RIAL NSGYGK, IALNSGYGKY, DSRIALNSGY | GBM, PRAD, UCS |
| FRG1B | c.59T>C | p.L20P | MAVKLSDSRIALKSGYGKY[p.L20P]PGI NSDELVGHSDAIGPREQWEPVFQ | YPGINSDEL, KYPGINSDEL, KSGYGKYPGI, YPGINSDELV | KIRP |
| FRG1B | c.95A>T | p.D32V | DSRIALKSGYGKYLGINSDELVGHS[p.D 32V]VAIGPREQWEPVFQNGKMALLAS NSC | ELVGHSVAI, VAIGPREQW, DELVGHSVA, NSDELVGHSV, DE LVGHSVAI | PRAD, UCS |
| FRG2B | c.424G>T | p.D142Y | ECSLSLNKKSRSSTPVHNSEIQETC[p.D1 42Y]YAHHRGRSRACTGRSKRHRSRALG VQ | NSEIQETCY, YAHHRGRSR, CYAHHRGR, SEIQETCYA, IQET CYAHH, ETCYAHHRGR, CYAHHRGRSR, YAHHRGRSRA, SEI QETCYAH | LUAD |
| FRMD4A | c.3014delC | p.P1005fs | CKATSAALPQSQRSSTPSSEIGATP[p.P1 005fs]QAAPTTS* | SEIGATPQA, SEIGATPQAA | STAD |
| FRMPD1 | c.3277G>C | p.E1093Q | APKYTEPLLSPRDEPRSDECGINPG[p.E 1093Q]QKIASIPTKEEPQGQLSLERDRE VTN | NPGQKIAS, GQKIASIP, GQKIASIPTK | LUAD |
| FRS2 | c.140T>C | p.L47S | KVINVDDGNELGSGIMELTDTELI[p.L 47S]SYTRKRDSVKWHYLCLRRYGYDSN LF | LITDTELISY, DTELISYTR, ELISYTRKR, ISYTRKRDSV, SYTRKRD SVK, ELITDTELISY | TGCT |
| FSHB | c.128C>A | p.T43N | CNSCELTNITIAIEKEBCRFCISIN[p.T 43N]NTWCAGYCYTRDLVKDPARPKIQKT QSGARIELQRNPPNADPNMKLFTI[p. | NTWCAGYCY, INNTWCAGY, FCISINNTW, RPCISINNTW, SI NNTWCAGY, NTWCAGYCYT | LUAD |
| FUBP1 | c.1288C>T | p.R430C | R430C]CGTPQQIDYARQLIEEKIGGPV NPLG | CGTPQQIDY, FTICGTPQQI | UCEC |
| FUT6 | c.418_419insA | p.S140fs | NPSAQLPRSPRROGQRMIWFSMESP[p. S140fs]KPLLAAESHGRIIQSHHVLPQ RLRHLHALRLAGAVRPACPPTAQPLG QDRAGGLGSVQLGAKLRQGALLPEPA GPSQGGRVRTLPQAPAPGNFIDGDAVP VQVLSGLRELLLAPRLHHREAVEERPGGL GRARGAGPQQKQLREVPATRRLHPRG RLPEPQGPGPVPAGAGGGPRPLPELLS | VLSGLRELL, FLQGLLETA, GLLETAGGI, NLIFLGPHL, HLSGGL IYI, FSMESPKPL, VLPQRLRFIL, ALRLAGAVV, GLGSVQLGA, P LPELLSLA, LLSLAGDAA, LLQLGTRFL, FLGPHLSGG, IWFSME SPK, RLRHLHALR, ASLLQLGTR, LSGGLIYLR, AWAARNLIF, RI LQSHHVL, VVRPACPPT, KLRQGALLP, RVRTLPQAP, GLRELL APR, RARGAGPQQ, ATRRLHPRG, RLHPRGRLP, GTRFLQGL L, AARNLIFLG, QSHHVLPQR, LLAPRLHHR, QLREVPATR, PA TRRLHPR, GWCGWAAR, ESPKPLLAA, DAAASLLQL, WAA | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| | | | LAGDAAASLLQLGTRFLQGLLETAGGIQ VPDTRHSGLVHLRGWCGAWAARNLIF LGPHLSGGLIYLRTRLPEASPA* | RNLIFL, RPACPPTAQ, VPVQVLSGL, APRLHHREA, HPRGRLP EP, GRPLPELL, RPLPELLSL, VPDTRHSGL, GPHLSGGLI, QRL RHIHAL, GAKLRQGAL, SLLQLGTRF, HLRGWCGAW, SMESP KPLL, MESPKPLLA, LQSHHVLPQ, LRHLHALRL, RHLHALRLA, HLHALRLAG, AKLRQGALL, RQGALLPEP, SQGGRVRTL, KQL REVPAT, REVPATRRL, LSLAGDAAA, LAGDAAASL, LETAGGI QV, TRHSGLVHL, RGWCGAWAA, GAWAARNLI, FSMESPKP LL, LLAAESHGRI, RLAGAVVRPA, GLRELLIAPRL, SLAGDAAAS L, SLLQLGTRFL, FLGPHLSGGL, RLRHLHALRL, HLHALRLAGA, VLSGLRELLA, LLSLAGDAAA, QLGTRFLQGL, LLETAGGIQV, HLRGWCGAWA, WIWFSMESPK, GLGSVQLGAK, HLSGGLI YLR, GAWAARNLIF, AWAARNLIFL, HGRILQSHHV, HVLPQR LRHL, ALRLAGAVVR, VVRPACPPTA, KLRQGALLPE, GGRVR TLPQA, RVRTLPQAPA, RTLPQAPAPG, RARGAGPQQK, ATR RLHPRGR, RLHPRGRLPE, RGWCGAWAAR, ELLAPRLHHR, QLREVPATRR, VPATRRLHPR, EAVEERPGGL, QVPDTRHSG L, LPQRLRHLHA, APGNHDGDAV, APRLHHREAV, GPQQKQ LREV, LPEPQGPGPV, PQRLRHLHQL, GPHLSGGLIY, MESPK PLLAA, LAAESHGRIL, GRILQSHHVL, HALRLAGAVV, RAGGL GSVQL, RQGALLPEPA, VQVLSGLREL, RELLAPRLHH, QQKQ LREVPA, REVPATRRLH, GQGPRPLPEL, GDAAASLLQL, ASLL QLGTRF, LQLGTRFLQG, RFLQGLLETA, IQVPDTRHSG, VHLR GWCGAW, RNLIFLGPFIL, AESHGRILQS, PELLSLAGDA, VPD TRHSGLV | |
| FYB | c.972de|G | p.G324 fs | NQEELASGTPARFPKAPSKLTVGG|p. G324fs|HGAKVRKRKRETRIQPPRNRS HCLPCLPWVHLHQNPTDHQMLT* | LTVGGHGA, GGHGAKVR, HGAKVRKRK, KVRKRKRE, RI QPPRNRS, RNRSHCLPC, TVGGHGAKV, PPRNRSHCL, HQNP TDHQM, IQPPRNRSH, SHCLPCLPW, LPCLPWVHL, LPWVH LHQN, CLPCLPWVHL, KLTVGGHGAK, KVRKRKRETR, RIQPP RNRSH, RNRSHCLPCL, ETRIQPPRNR, LTVGGHGAKV, QPPR NRSHCL, RSHCLPCLPW, LHQNPTDHQM, HQNPTDHQML, LPWVHLHQNP | STAD |
| FZD3 | c.1099G>A | p.D367 N | LTIILLAMNKIEGDNISGVCFVGLY|p.D3 67N|NVDALRYFVLAPLCLYVVGVSLLL A | NVDALRYFV, GLYNVDALR, LYNVDALRY, YNVDALRYF, GVC FVGLYNV, GLYNVDALRY, LYNVDALRYF, YNVDALRYFV | CRC |
| FZD6 | c.1247G>A | p.R416 Q | ISLNHVRQVIQHDGRNQEKLKKFMI|p. R416Q|QIGVFSGLYLVPLVTLLGCYVYE QVN | KLKKFMIQI, IQIGVFSG, KFMIQIGVF, QIGVFSGLY, KKFMI QIGV, FMIQIGVFSG, MIQIGVFSGL, KLKKFMIQIG, IQIGVFS GLY, KKFMIQIGVF | UCEC |
| GABR A3 | c.218G>A | p.R73H | LSPKHAPDIPDDSTDNITIFTRILD|p.R73 H|HLLDGYDNRLRPGLGDAVTEVKTDIY | ILDHLLDGY, IFTRILDHL, HLLDGYDNR, FTRILDHLL, HLLDGY DNRL, TIFTRILDHL, IFTRILDHL, RILDHLLDGY | UCEC |
| GABR A4 | c.1379G>A | p.R460 Q | PFSRANAAETISAARALPSASPTSI|p.R460 Q|QTGYMPRKASVGSASTRHVFGSR LQR | SIQTGYMPR, IQTGYMPRK, SPTSIQTGY, SIQTGYMPRK, TSI QTGYMPR, ASPTSIQTGY, SPTSIQTGYM, IQTGYMPRKA | CRC, UCEC |
| GABR A5 | c.377G>A | p.S126 N | RQSWKDERLRFKGPMQRLPLNNLLA|p. S126N|NKIWTPDTFFHNGKKSIAHNM TTPNK | NKIWTPDTF, ANKIWTPDTF, NKIWTPDTFF | CRC |
| GABR A5 | c.670C>A | p.Q224 K | SEVVYVWTNGSTKSVVVAEDGSRLN|p. Q224K|KYHLMGQTVGTENISTSTGEYT IMTA | KYHLMGQTV, GSRLNKYHL, SRLNKYHLM, GSRLNKYHLM, A EDGSRLNKY, NKYHLMGQTV | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GABRA6 | c.940G>A | p.V314I | SARHSLPKVSYATAMDWFIAVCFAF[p.V314I]IFSALIEFAAVNYFTNLQTQKAKRKA | FIAVCFAFI, FAFIFSALI, FIFSALIEF, IAVCFAFIF, CFAFIFSAL, FIFSALIEFA, WFIAVCFAFI, CFAFIFSALI, AFIFSALIEF, FIAVCFAFIF, VCFAFIFSAL | GBM |
| GABRB1 | c.1246C>T | p.R416C | KATMYSYDSASIQYRKPLSSREAYG[p.R416C]CALDRHGVPSKGRIRRRASQLKVKIP | SSREAYGCA, EAYGCALDR, SREAYGCAL, SSREAYGCAL | PRAD |
| GABRB3 | c.1498G>A | p.D500N | RSLPHKKTHLRRRSSQLKIKIPDLT[p.D500N]NVNAIDRWSRIVFPFTFSLFNLIVYWL | LTNVNAIDR, IKIPDLTNV, KIKIPDLTNV, KIPDLTNVNA, DLTNVNAIDR, NVNAIDRWSR, IPDLTNVNAI | CRC |
| GABRD | c.1236delG | p.Q412fs | GSYSRVSGVETGETKKEGAARSGGGQG[p.Q412fs]ASVPGSGGPSTQTPLTFTPALCSLRRLRPSMSSTCGRHTPCEHRTQATLACPGARRQLPRNFLGERALGLPSLPRVSKWDDSRPRKTRGSLGLPEL* | FLGERALGL, RLRPSMSST, ATLACPGAR, ALGLPSPLR, RVSKWDDSR, TFTPALCSL, AARSGGQGA, RSGGQGASV, SLRRLRPSM, RQLPRNFLG, RALGLPSPL, KWDDSRPRK, KTRGSLGLP, FTPALCSLR, ALCSLRRLR, TLACPGARR, QTPLTFTPA, TPLTFTPAL, RPRKTRGSL, PSTQTPLTF, CEHRTQATL, TQATLACPG, ARRQLPRNF, RRQLPRNFL, RNFLGERAL, GERALGLPS, RKTRGSLGL, RGSLGLPEL, ALGLPSPLR, ATLACPGAR, RALGLPSPLR, CSLRRLRPSM, SLRRLRPSMS, RLRPSMSSTG, RTQATLACPG, KTRGSLGLPE, TFTPALCSLR, QTPLTFTPAL, LTFTPALCS L, TPALCSLRRL, LPRNFLGERA, RPRKTRGSLG, GSGPSTQTPL, GPSTQTPLTF, TQTPLTFTPA, TQATLACPGA, LACPGARRQL, GARRQLPRNF, RQLPRNFLGE, ERALGLPSPL, TRGSLGLPEL, LPSPLRVSKW, CEHRTQATLA, GERALGLPSP | STAD |
| GABRG1 | c.613G>A | p.E205K | LRLTINAECYLQLHNPMDEHSCPL[p.E205K]KFSSYGYPKNEIEYKWKKPSVEVADP | KFSSYGYPK, PLKFSSYGY, DEHSCPLKF, HSCPLKFSSY, CPLKFSSYGY, MDEHSCPLKF | SKCM |
| GABRR2 | c.1103C>T | p.A368V | VSYVKAVDIYLWVSFVFVFLSVLEY[p.A368V]VAVNYLTTVQERKERKLRKFPCMCG | VFLSVLEYV, FLSVLEYVA, VAVNYLTTV, VLEYVAVNY, LEYVAVNYL, VNYL, FVFLSVLEYV, FLSVLEYVAV, VLEYVAVNYL, YVAVNYLTTV, SVLEYVAVNY, LEYVAVNYLT | PRAD |
| GADL1 | c.1054C>A | p.L352I | VAWNPHKMLMAGIQCCALLVKDKSD[p.L352I]ILKKCYSAKASYLFQQDKFYDVSYDT | KSDILKKCY, ILKKCYSAK, ILKKCYSAKA, LVKDKSDILK, DILKKCYSAK | LUAD |
| GAL3ST3 | c.811G>T | p.A271S | ESLVLLRRLLAWDLDDVLYAKLNAR[p.A271S]SASSRLAAIPAALARAARTWNALDAG | SASSRLAAI, KLNARSASS, RSASSRLAA, NARSASSRL, YAKLNARSA, VLYAKLNARS, KLNARSASSR, NARSASSRLA, RSASSRLAAI, LNARSASSRL, ARSASSRLAA | LUAD |
| GALNT13 | c.1072G>T | p.G358C | LEIVTCSHVGHVFRKATPYTFPGGT[p.G358C]CHVINKNNRLAEVWMDEFKDFFYII | GGTCHVINK, YTFPGGTCH, FPGGTCHVI, YTFPGGTCHV, TFPGGTCHVI | LUSC |
| GALNT14 | c.702T>A | p.D234E | VNRDWLQPLLHRVKEDYTRVVCPVI[p.D234E]EIINLDTFTYIESASELRGGFDWSLH | RVVCPVIEI, IEIINLDTF, CPVIEIINL, EIINLDTFTY, RVVCPVIEII | LUAD |
| GALNTL1 | c.950_951insG | p.W317fs | GIFVIDKSWFNHLGKYDAQMDIWGG[p.W317fs]REF* | AQMDIWGGR, MDIWGGREF, DAQMDIWGGR, QMDIWGGREF | STAD |
| GALNTL2 | c.1183G>A | p.E395K | AMDRHYFQNTGAYDSLMSLRGGENL[p.E395K]KLSFKAWLCGGSVEILPCSRVGHIYQ | SLRGGENLK, GGENLKLSF, NLKLSFKAW, LKLSFKAWL, SLRG GENLKL, MSLRGGENLK, NLKLSFKAWL, RGGENLKLSF, GEN LKLSFKA | UCEC |
| GALNTL5 | c.133G>A | p.A45T | TALLFIYLHHNHVSSWQKKSQEPLS[p.A45T]TWSPGKKVHQQIIYGSEQIPKPHVIV | LSTWSPGKK, KSQEPLSTW, KKSQEPLSTW | LIHC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GALNTL5 | c.785G>T | p.R262I | LEPLLHAIAKDPKMVVCPLIDVIDD[p.R262I]TLEYKPSPLVRGTFDWNLQFKWDNV | VIDDITLEY,PLIDVIDDI,VIDDITLEYK,DVIDDITLEY,ITLEYKPSPL,CPLIDVIDDI | CRC |
| GALNTL6 | c.1694_1696delAGA | p.K567del | WGYRKDRTLFHPVSNSCMDCNPAEK[p.K567del]IFMARCDPLSETQQWIFEHINMTVLEKF | NPAEKIFMA,CMDCNPAEKI,NPAEKIFMAR,MDCNPAEKIF | BRCA |
| GARS | c.124C>G | p.P42A | LLLLPPRLLARPSLLLRRSLSAASC[p.P42A]APISLPAAASRSSMDGAGAEEVLAPL | RSLSAASCA,LSAASCAPI,APISLPAAA,AASCAPISL,SLSAASCAPI,SAASCAPISL | ACC |
| GART | c.2420delA | p.K807fs | IESMQINGSVLKNGSLTNHFSFEKK[p.K807fs]RPEWLS* | FEKKRPEWL,FSFEKKRPEW | OV |
| GAS2L2 | c.566A>C | p.D189A | AAPTLVQLEEEIEEEVRRELALPPP[p.D189A]APSPPAPPRRQPCHFRNLDQMVQSLV | RELALPPPA,LPPPAPSPPA,RELALPPPAP | TGCT |
| GAS6 | c.449delG | p.G150fs | CDRKGTQACQDLMGNFFCLCKAGWG[p.G150fs]AGSATKMSTNAARRTGAASRSATTSRVASTVPATAASSSPLMAGPAKT* | TTSRVASTV,ATAASSSPL,KMSTNAARR,GWGAGSATK,ATKMSTNAA,ARRTGAASR,RTGAASRSA,ASRSATTSR,RSATTSRVA,STVPATAAS,NAARRTGAA,WGAGSATKM,SRVASTVPA,TAASSSPLM,ATTSRVASTV,RVASTVPATA,ATKMSTNAAR,AASRSATTSR,SSPLMAGPAK,AGWGAGSATK,STNAARRTGA,AARRTGAASR,RTGAASRSAT,ASRSATTSRV,TSRVASTVPA,ATAASSSPLM,SRVASTVPAT | STAD |
| GAS8 | c.937C>A | p.R313S | EEMSEMQKQLANYERDKQILLCTKA[p.R313S]SLKVREKELKDLQMEHEVLEQRFTKV | ILLCTKASL,LLCTKASLK,KASLKVREK,CTKASLKVR,SLKVREKEL,LLCTKASLKV,ILLCTKASLKV,SLKVREKELK,KQILLCTKAS | LUAD |
| GATA3 | c.1002_1003insG | p.N334fs | ARRAGTSCANCQTTTTLWRRNANG[p.N334fs]GPCLQCLWALLQASQY* | CLQCLWALL,WALLQASQY,RNANGGPCL,LWALLQASQY,RRNANGGPCL,LQCLWALLQA | BRCA |
| GATA3 | c.1200_1201insA | p.H400fs | CKKVHDSLEDFPKNSSFNPAALSRH[p.H400fs]NVLPEPHLALQPLQPHADHAHADAPAIQPVLWTTPPLQHGHRHGLEPCSMLTGPPARVPAVPFDLHFCRSSIMKPKRDGYMFLKAESKIMFATLQRSSLWCLCSNH* | VLPEPHLAL,ALQPLQPHA,AIQPVLWTT,MLTGPPARV,FLKAESKIM,IMFATLQRS,YMFLKAESK,KIMFATLQR,SMLTGPPAR,HFCRSSIMK,MFLKAESKI,CSMLTGPPA,RSSIMKPKR,IMKPKRDGY,KAESKIMFA,VPFDLHFCR,AALSRHNVL,EPHLALQPL,GPPARVPAV,KPKRDGYMF,FATLQRSSL,DLHFCRSSI,LHFCRSSIM,ESKIMFATL,LALQPLQPH,LQPHADHAH,HAHADAPAI,LQHGHRHGL,RHGLEPCSM,PARVPAVPF,PAVPFDLHF,LKAESKIMF,ATLQRSSLW,LQRSSLWCL,AESKIMFAT,ADAPAIQPV,APAIQPVLW,SMLTGPPAR V,YMFLKAESKI,LQRSSLWCL,CSMLTGPPAR,LHFCRSSIMK,FCRSSIMKPK,IMKPKRDGYM,YMFLKAESK,SIMKPKRDGY,TTPPLQHGHR,AVPFDLHFCR,HADAPAIQPV,NPAALSRHNV,QPVLWTTPPL,KPKRDGYMFL,DLHFCRSSIM,MFATLQRSSL,FLKAESKIMF,RHNVLPEPHL,HLALQPLQPH,ADAPAIQPVL,HRHGLEPCSM,ARVPAVPFDL,VPAVPFDLHF,FDLHFCRSSI,MKPKRDGYMF,MFLKAESKIM,AESKIMFATL,IMFATLQRSS,FATLQRSSLW,LQRSSLWCLC,PPARVPAVPF,PEPHLALQPL | BRCA |
| GATA3 | c.1222_1223insC | p.S408fs | EDFPKNSSFNPAALSRHMSSLSHIS[p.S408fs]ALQPLQPHADHAHADAPAIQPVLWTTPPLQHGHRHGLEPCSMLTGPPARVPAVPFDLHFCRSSIMKPKRDGYMFLKAESKIMFATLQRSSLWCLCSNH* | ALQPLQPHA,AIQPVLWTT,MLTGPPARV,FLKAESKIM,IMFATLQRS,YMFLKAESK,KIMFATLQR,SMLTGPPAR,HFCRSSIMK,MFLKAESKI,MSSLSHISA,SSLSHISAL,CSMLTGPPA,RSSIMKPKR,MKPKRDGY,KAESKIMFA,VPFDLHFCR,GPPAR,SIMKPKR,MKPKRDGY,KAESKIMFA,VPFDLHFCR,GPPAR,VPAV,KPKRDGYMF,FATLQRSSL,DLHFCRSSI,LHFCRSSIM,ESKIMFATL,SHISALQPL,SALQPLQPH,LQPHADHAH,HAHADAPAI,LQHGHRHGL,RHGLEPCSM,PARVPAVPF,PAVPF | BRCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| | | | | DLHF,LKAESKIMF,ATLQRSSLW,LQRSSLWCL,AESKIMFAT, ADAPAIQPV,APAIQPVLW,SMLTGPPAR,YMFLKAESKI,T LQRSSLWCL,HMSSLSHISA,CSMLTGPPAR,LHFCRSSIMK,F CRSSIMKPK,IMKPKRDGYM,GYMFLKAESK,SIMKPKRDGY, TTPPLQHGHR,AVPPDLHFCR,MSSLSHISAL,HADAPAIQPV, QPVLWTTPPL,KPKRDGYMFL,DLHFCRSSIM,MFATLQRSS L,FLKAESKIMF,LSHISALQPL,ADAPAIQPVL,HRHGLEPCSM, ARVPAVPFDL,VPAVPFDLHF,FDLHFCRSSI,MKPKRDGYM F,MFLKAESKIM,AESKIMFATL,IMFATLQRSS,FATLQRSSL W,LQRSSLWCLC,PPARVPAVPF | |
| GATA 3 | c.1223_122 4insT | p.S408f s | EDFPKNSSFNPAALSRHMSSLSHIS[p.S 408fs]ALQPLQPHADHAHADAPAIQPV LWTTPPLQHGHRHGLEPCSMLTGPPA RVPAVPFDLHFCRSSIMKPKRDGYMFL KAESKIMFATLQRSSLWCLCSNH* | ALQPLQPPIA,AIQPVLWTT,MLTGPPARV,FLKAESKIM,IMF ATLQRS,YMFLKAESK,KIMFATLQR,SMLTGPPAR,HFCRSSI MK,MFLKAESKI,MSSLSHISA,SSLSHISAL,CSMLTGPPA,RS SIMKPKR,IMKPKRDGY,KAESKIMFA,VPFDLHFCR,GPPAR VPAV,KPKRDGYMF,FATLQRSSL,DLHFCRSSI,LHFCRSSIM, ESKIMFATL,SHISALQPL,SALQPLQPH,LQPHADHAH,HAH ADAPAI,LQHGHRHGL,RHGLEPCSM,PARVPAVPF,PAVPFDLH F,LKAESKIMF,ATLQRSSLW,LQRSSLWCL,AESKIMFAT, ADAPAIQPV,APAIQPVLW,SMLTGPPARV,YMFLKAESKI,T LQRSSLWCL,HMSSLSHISA,CSMLTGPPAR,LHFCRSSIMK,F CRSSIMKPK,IMKPKRDGYM,GYMFLKAESK,SIMKPKRDGY, TTPPLQHGHR,AVPPDLHFCR,MSSLSHISAL,HADAPAIQPV, QPVLWTTPPL,KPKRDGYMFL,DLHFCRSSIM,MFATLQRSS L,FLKAESKIMF,LSHISALQPL,ADAPAIQPVL,HRHGLEPCSM, ARVPAVPFDL,VPAVPFDLHF,FDLHFCRSSI,MKPKRDGYM F,MFLKAESKIM,AESKIMFATL,IMFATLQRSS,FATLQRSSL W,LQRSSLWCLC,PPARVPAVPF | BRCA |
| GATA 3 | c.1290_129 1insT | p.S430f s | ISPFSHSSHMLTTPTPMHPPSSLSF[p.S4 30fs|WTTPPLQHGHRHGLEPCSMLTG PPARVPAVPFDLHFCRSSIMKPKRDGY MFLKAESKIMFATLQRSSLWCLCSNH* | MLTGPPARV,FLKAESKIM,IMFATLQRS,YMFLKAESK,KIMF ATLQR,SMLTGPPAR,HFCRSSIMK,MFLKAESKI,LSFWTTPP L,CSMLTGPPA,RSSIMKPKR,IMKPKRDGY,KAESKIMFA,VP FDLHFCR,GPPARVPAV,KPKRDGYMF,FATLQRSSL,DLHFC RSSI,LHFCRSSIM,ESKIMFATL,LQHGHRHGL,RHGLEPCSM, PARVPAVPF,PAVPFDLHF,LKAESKIMF,ATLQRSSLW,LQR SSLWCL,AESKIMFAT,HPPSSLSFW,SLSFWTTPPL,SMLTGP PARV,YMFLKAESKI,TLQRSSLWCL,CSMLTGPPAR,MHPPS SLSFW,LHFCRSSIM,FCRSSIMKPK,IMKPKRDGYM,GYMF LKAESK,SIMKPKRDGY,TTPPLQHGHR,AVPPDLHFCR,KPK RDGYMFL,DLHFCRSSIM,MFATLQRSSL,FLKAESKIMF,HR HGLEPCSM,ARVPAVPFDL,VPAVPFDLHF,FDLHFCRSSI,M KPKRDGYMF,MFLKAESKIM,AESKIMFATL,IMFATLQRSS, FATLQRSSLW,LQRSSLWCLC,PPARVPAVPF | BRCA |
| GATA 3 | c.1301_130 2insC | p.H434 fs | FSHSSHMLTTPTPMHPPSSLSFGPH[p. H434fs]PPLQHGHRHGLEPCSMLTGPP ARVPAVPFDLHFCRSSIMKPKRDGYMF LKAESKIMFATLQRSSLWCLCSNH* | MLTGPPARV,FLKAESKIM,IMFATLQRS,YMFLKAESK,KIMF ATLQR,SMLTGPPAR,HFCRSSIMK,MFLKAESKI,CSMLTGP PA,RSSIMKPKR,IMKPKRDGY,KAESKIMFA,VPFDLFIFCR,G PPARVPAV,KPKRDGYMF,FATLQRSSL,DLHFCRSSI,LHFCR SSIM,ESKIMFATL,LSFGPHPPL,LQHGHRHGL,RHGLEPCS M,PARVPAVPF,PAVPFDLFIF,LKAESKIMF,ATLQRSSLW,L QRSSLWCL,AESKIMFAT,SLSFGPHPPL,SMLTGPPARV,YM FLKAESKI,TLQRSSLWCL,CSMLTGPPAR,LHFCRSSIMK,FCR | BRCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GATA 3 | c.1304_130 5insC | p.H435 fs | HSSHMLTPTPMHPPSSLSFGPHHP[p. H435fs]LQHGHRHGLEPCSMLTGPPAR VPAVPFDLHFCRSSIMKPKRDGYMFLK AESKIMFATLQRSSLWCLCSNH* | SSIMKPK,IMKPKRDGYM,GYMFLKAESK,SIMKPKRDGY,A VPPDLHFCR,KPKRDGYMFL,DLHFCRSSIM,MFATLQRSSL, FLKAESKIMF,HRHGLEPCSM,ARVPAVPFDL,VPAVPFDLHF, FDLHFCRSSI,MKPKRDGYMF,MFLKAESKIM,AESKIMFAT L,IMFATLQRSS,FATLQRSSLW,LQRSSLWCLC,PPARVPAVPF MLTGPPARV,FLKAESKIM,IMFATLQRS,YMFLKAESK,KIMF ATLQR,SMLTGPPAR,HFCRSSIMK,MFLKAESKI,CSMLTGP PA,RSSIMKPKR,IMKPKRDGY,KAESKIMFA,VPFDLHFCR,L SFGPFIHPL,GPPARVPAV,KPKRDGYMF,FATLQRSSL,DLHF CRSSI,LHFCRSSIM,ESKIMFATL,LQHGHRHGL,RHGLEPCS M,PARVPAVPF,PAVPPDLHF,LKAESKIMF,ATLQRSSLW,L QRSSLWCL,HPLQHGHRH,AESKIMFAT,SLSFGPHHPL,SML TGPPARV,YMFLKAESKI,LQRSSLWCL,CSMLTGPPAR, LHFCRSSIMK,FCRSSIMKPK,IMKPKRDGYM,GYMFLKAESK,SI MKPKRDGY,AVPPDLHFCR,KPKRDGYMFL,DLHFCRSSIM, MFATLQRSSL,FLKAESKIMF,HRHGLEPCSM,ARVPAVPFDL, VPAVPFDLHF,FDLFIPCRSSI,MKPKRDGYMF,MFLKAESKI M,AESKIMFATL,IMFATLQRSS,FATLQRSSLW,LQRSSLWC LC,PPARVPAVPF | BRCA |
| GATA 3 | c.1329G>T | p.M44 3I | TTPTPMHPPSSLSFGPHHPSSMVTA[p. M443I]IG* | HPSSMVTAI | LUAD |
| GATA 3 | c.983_984 insCTGGAG G | p.L328f s | RRLSAARRAGTSCANCQTTTTLWR[p. L328fs]LEEECQWGPCLQCLWALLQAS QY* | CLQCLWALL,QWGPCLQCL,TTTTTLWRL,WALLQASQY,EE CQWGPCL,QWGPCLQCLW,LWALLQASQY,QTTTTLWRL, CQWGPCLQCL,LQCLWALLQA | BRCA |
| GBP7 | c.1292_129 3insG | p.G431 fs | QAELKRLSELLTESISRGTFFVPGG[p.G4 31fs]AQYLLRSKKED* | FVPGGAQYL,AQYLLRSK,GAQYLLRSK,FFVPGGAQY,VPG GAQYLL,FVPGGAQYLL,GAQYLLRSKK,FFVPGGAQYL,TFFV PGGAQY | STAD |
| GCDH | c.1167deIG | p.L389f s | VSLLKRNNCGKALDIARQARDMLGG[p. L389fs]MGFLTSIT* | MLGGMGFLT,RDMLGGMGF,GGMGFLTSI,RQARDMLGG M,RDMLGGMGFL | STAD |
| GCDH | c.244C>T | p.R82C | EEQLTTDEILIRDTFRTYCQERLMP[p.R8 2C]CILLANRNEVFHREIISEMGELGVLG | RLMPCILLA,MPCILLANR,QERLMPCIL,LMPCILLANR,CQE RLMPCIL,QERLMPCILL | LUAD |
| GDAP 1 | c.919A>G | p.T307 A | RVLKRKTFNKVLGHVNNILISAVLP[p.T3 07A]AAFRVAKKRAPKVLGTTLVVGLLA GV | ILISAVLPA,LISAVLPAA,AVLPAAFRV,VLPAAFRVA,SAVLPA AFR,LPAAFRVAK,ISAVLPAAF,ILISAVLPAAF,VLPAAFRVAK,I SAVLPAAFR,AVLPAAFRVA,SAVLPAAFRV,LISAVLPAAF | BRCA |
| GDF5 | c.315_316i nsA | p.E105f s | GQTGGLTQPKDEPKKLPPRPCGPE[p. E105fs]TQARTPSPNKAGYSPDCDPKRT ASRRQGTPKSRICPQLLPAEEGQGARA PTRAQGAVSPTPHHTPRVHALAVQDA VRC* | RICPQLLPA,ASRRQGTPK,QARTPSPNK,RTASRRQGT,KSRI CPQLL,HTPRVHALA,SPTPHHTPR,HALAVQDAV,APTRAQ GAV,TPRVHALAV,RQGTPKSRI,RAQGAVSPT,AQGAVSPTP,HHTPRVHAL,TPSPNKAGY,AEEGQGARA,LLPAEEGQGA, TQARTPSPNK,TASRRQGTPK,QARTPSPNKA,AGYSPDCDP K,ASRRQGTPKS,KSRICPQLLP,RVHALAVQDA,RTPSPNKA GY,HALAVQDAVR,HTPRVHALAV,TPKSRICPQL,SPTPHHT PRV,SRICPQLLPA,AQGAVSPTPH | TGCT |
| GDPD 5 | c.1779_178 0insC | p.G593 fs | SVCSDNSYDTYANSTATPVPGRGGG[p. G593fs]QPHQDPHRAEWALAEDMSV PPVPDTEAGEPRRAGGSVSELGVLWER APQPPCGLQPLVSRSLS* | GPRGGGQPH,EPRRAGGSV,QPPCGLQPL,HQDPHRAEW, AEWALAEDM,WALAEDMSV,AEDMSVPPV,RAGGSVSEL, WERAPQPPC,LQPLVSRSL,SELGVLWER,DPHRAEWAL,AL AEDMSVPP,GLQPLVSRSL,RAEWALAEDM,RRAGGSVSEL, AEWALAEDMS,SELGVLWERA,QPPCGLQPLV | KIRP |
| GEM | c.803G>T | p.R268 L | RDSKEKNERRLAYQKRKESMPRKAR[p. R268L]LFWGKIVAQNNKNMAFKLKSKS | RLFWGKIVA,SMPRKARLF,RKARLFWGK,KARLFWGKI,LF WGKIVAK,MPRKARLFW,ESMPRKARL,RLFWGKIVAK,SM | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GEN1 | c.1526C>T | p.S509L | VMSFQSHMTLKPTCEIFHKQNSKLN[p. S509L]LGISPDPTLPQESISASLNSLLLPK N | PRKARLFW,KARLFWGKIV,MPRKARLFWG,KESMPRKARL, RKARLFWGKI HKQNSKLNL,SKLNLGISP,LGISPDPTL,KQNSKLNLGI,FHKQ NSKLNL | UCEC |
| GFM1 | c.49_50ins C | p.A17fs | MRLLGAAVAALGRGRAP[p.A17fs]RL PRLAEEAG* | RLPRLAEEA,ALGRGRAPR,RGRAPRLPR,APRLPRLAE,AALG RGRAPR,RGRAPRLPRL | KICH |
| GFRAL | c.922C>A | p.Q308 K | LGTVLQVQCTCRTITQSEESLCKIF[p.Q3 08K]KHMLHRKSCFNYPTLSNVKGMAL YTR | KIFKHMLHR,IFKHMLHRK,SLCKIFKHM,SLCKIFKHML,KIFK HMLHRK,KHMLHRKSCF | LUAD |
| GGA2 | c.188C>T | p.A63V | MSEQDWSAIQNFCEQVNTDPNGPTH[p. A63V]VPWLLAHKIQSPQEKEALYALT VLEM | HVPWLLAHK,HVPWLLAH,VPWLLAHKI,GPTHVPWLL,N TDPNGPTHV,HVPWLLAHKI,DPNGPTHVPW | UCEC |
| GIGYF 2 | c.680G>A | p.R227 H | PNFEEGGPTSVGRKHEFIRSESENW[p. R227H]HIFREEQNGEDEDGGWRLAGS RRDGE | ESENWHIFR,SESENWHIF,RSESENWHIF | UCEC |
| GIMA P7 | c.827de T | p.V276 fs | LLKLKYDEKIKNIREEAERNIFKDV[p.V27 6fs]LIGFGRCFQKYGIGFCRNVSFILPNL L* | NVSFILPNL,IGFGRCFQK,IFKDVLIGF,CFQKYGIGF,IGFCRN VSF,GFGRCFQKY,VLIGFGRCF,VSFILPNLL,LIGFGRCFQK,K YGIGFCRNV,IGFGRCFQKY,FQKYGIGFCR,NVSFILPNLL,NI FKDVLIGF,AERNIFKDVL,RCFQKYGIGF,GIGFCRNVSF,IGFC RNVSFI,RNVSFILPNL | STAD |
| GIMA P8 | c.1630G>T | p.A544 S | SCCEKGDTFFVLVFQLGRFTEEDKT[p.A 544S]SVAKLEAIFGADFTKYAIMLFTRK ED | KTSVAKLEA,FTEEDKTSV,SVAKLEAIF,KTSVAKLEAI,TSVAK LEIAF,EEDKTSVAKL | KIRP |
| GIPC3 | c.679de G | p.G227 fs | SRSSKCPVEAKVTSGRETLRLRSGG[p.G 227fs]LPQWRKRPVSLRRRHLGRLMTC WKATWAFGTPSWRPPWWRRPRQR APRSLHAV* | RLMTCWKAT,RAPRSLHAV,SLRRRFILGR,TCWKATWAF,T WAFGTPSW,RLRSGGLPQ,QWRKRPVSL,RKRPVSLRR,RRR HLGRLM,LGRLMTCWK,CWKATWAFG,SWRPPWWR,RP RRARAPR,RQRAPRSLH,WAFGTPSWR,RPPWWRPR,MT CWKATWA,LPQWRKRPV,TLRLRSGGL,LRSGGLPQW,LMT CWKATW,RRQRAPRSL,TPSWRPPWW,LMTCWKATWA, GLPQWRKRPV,SLRRRHLGRL,HLGRLMTCWK,RSGGLPQ WRK,VSLRRRHLGR,RLMTCWKATW,MTCWKATWAF,RLR SGGLPQW,QWRKRPVSLR,RKRPVSLRRR,SWRPPWWRRP, WWRRPRRQRA,RQRAPRSLHA,TWAFGTPSWR,TPSWRP PWWR,REPPWWRRPR,ETLRLRSGGL,LPQWRKRPVS,RPV SLRRRHL,LPRRRHLGRL,RPRRRHLGR,RPRRHLGRLM,R HLGRLMTCW,ATWAFGTPSW,FGTPSWRPPW | STAD |
| GIT2 | c.368G>T | p.R123 L | KVHPNKAEFITRAKYQMLAFVHRLPC[p. R123L]LDDDSVTAKDLSKQLHSSVRTG NLET | CLDDDSVTA,LPCLDDDSV,RLPCLDDDS,LAFVHRLPCL | LUAD |
| GJA1 | c.932de C | p.A311 fs | YKLVTGDRNNSSCRNVNKQASEQNW[p. A311fs]VITVQNKIEWGRREAPSLTP MHSLLISPMITRILKN* | SLTPMHSLL,LISPMITRI,KQASEQNWV,LLISPMITR,SPMIT RILK,QASEQNWVI,WVITVQNKI,REAPSLTPM,SEQNWVIT V,WGRREAPSL,MHSLLISPM,IEWGRREAP,KQASEQNWVI, SLTPMHSLLI,LLISPMITRI,LISPMITRIL,SLLISPMITR,ISPMI TRILK,NVVITVQNKI,TVQNKIEWGR,APSLTPMHSL,RREA PSLTPM,REAPSLTPMI,PMHSLLISPM,MHSLLISPMI,IEW GRREAPS | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GJB3 | c.479G>A | p.R160H | LIFKLIEFLFLYLLHTLWHGFNMP[p.R16 0H]HLVQCANVAPCPNIVDCYIARPTEK K | NMPHLVQCA,HLVQCANVA,MPHLVQCAN,LWHGFNMP HL,MPHLVQCANV | GBM |
| GJB4 | c.64C>A | p.R22S | MNWAFLQGLLSGVNKYSTVLS[p.R22S] SIWLSVVFIFRVLVYVVAAEEVWDDE | VLSSIWLSV,SIWLSVVFI,LSSIWLSVV,KYSTVLSSI,SSIWLSV VF,STVLSSIWL,NKYSTVLSS,YSTVLSSIW,TVLSSIWLSV,VLS SIWLSVV,KYSTVLSSIW,SIWLSVVFIF,SSIWLSVVFI,LSSIWL SVVF,NKYSTVLSSI,YSTVLSSIWL | LUAD |
| GLB1L2 | c.1221C>G | p.I407M | KMPYEPLTPVLYLSLMDALKYLGEP[p.I 407M]MKSEKPINMENLPVNGGNGQS FGYIL | ALKYLGEPM,EPMKSEKPI,MKSEKPINM,ALKYLGEPMK,DA LKYLGEPM | LUAD |
| GLI1 | c.815del|G | p.W272fs | QEQLVHHINSEHIHGERKEFVCHWG[p. W272fs]AAPGS* | KEFVCHWGA,KEFVCHWGAA | STAD |
| GLI3 | c.2993C>T | p.P998L | VHAPRRCSDGGAHGYGRRHLQPHDA[p. p.P998L]LGHGVRRASDPVRTGSEGLAL PRVPR | ALGHGVRRA,DALGHGVRR,RHLQPHDAL,RRHLQPHDAL | ACC |
| GLI3 | c.3098del|C | p.P1033fs | PVRTGSEGLALPRVPRFSSLSSCNP[p.P1 033fs]RRWPRPRRSAVSCFRITRGPRAA SPETSTRPPVLPASPRTSPWSP* | AVSCFRITR,SSLSSCNPR,SLSSCNPRR,SCNPRRWPR,RWPR PRRSA,RRSAVSCFR,RSAVSCFRI,CFRITRGPR,ITRGPRAAS, STRPPVLPA,NPRRWPRPR,WPRPRRSAV,CLRIIFIYK,GP RAASPET,LPASPRTSP,FSSLSSCNPR,SSLSSCNPRR,SSCNP RRWPR,SAVSCFRITR,RWPRPRRSAV,CFRITRGPRA,ITRGP RAASP,RAASPETSTR,STRPPVLPAS,CNPRRWPRPR,SCFRI TRGPR,WPRPRRSAVS,RPRRSAVSCF,SPETSTRPPV,LPASP RTSPW,RWPRPRRSA,RRSAVSCFRI,FRITRGPRAA | STAD |
| GLIPR1L2 | c.276del|A | p.G92fs | IPRGSNLRFMTWDVALSRTARAWGK[p. G92fs]NVCLRIIFIYKMYKWSILNFMVL VKICGSALKMNLLQVLLSEVGMQRRKC TILKMAVALETVLIIFSLFGTTLTKLVVLLL HVQKLDILYMQQFSYATMRQEEH* | HVQKLDILY,SILNFMVLV,ALKMNLLQV,KMNLLQVLL,LLQ VLLSEV,KMAVALETV,LIIFSLFGT,TLTKLMLL,KLVVLLLHV, VLLHVQKL,YMQQFSYAT,VLVKICGSA,CLRIIFIYK,IIFIYKM YK,KMYKWSIL,ILNFMVLVK,SLFGTTLTK,VVLLLHVQK,IL YMAQFSY,QQFSYATMR,IFIYKMYKW,IYKMYKWSI,MYK WSILNF,KWSILNFMV,TVLIIFSLF,IFSLFGTTL,LYMQQFSYA, TARAWGKNV,MQRRKCTIL,QRRKCTILK,RIIFIYKMY,LLSE VGMQR,CTILKMAVA,ETVLIIFSL,LVKICGSAL,YKMYKWSIL, GMQRRKCTI,VQKLDILYM,MQQFSYATM,RAWGKNVCL, KNVCLRIIF,LRIIFIYKM,YKWSILNFM,WSILNFMVL,KICGSA LKM,LKMNLLQVL,LQVLLSEVG,RRKCTILKM,KLMAVALET, MAVALETVL,VALETVLII,ALETVLIIF,LHVQKLDIL,LDILYMQ QF,FIYKMYKWS,YKWSILNFMV,MQQFSYATM,ILNFMVL VKI,NLLQVLLSEV,KMAVALETVL,VLIIFSLFGT,IIFSLFGTTL, SLFGTTLTKL,TLTKLVVLL,ALKMNLLQVL,ILYMQQFSYA,YMQQFSYATM, VLVKICGSAL,ALKMNLLQVL,RIIFIYKMYK,KMYKWSILNF,S ILNFMVLVK,LVKICGSALK,MQRRKCTILK,FSLFGTTLTK,RA WGKNVCLR,LVLLLFIVQK,MQQFSYATMR,AWGKNVCLR I,IYKMYKWSIL,MYKWSILNFM,KWSILNFMVL,VALETVLIIF, ETVLIIFSLF,LYMQQFSYAT,RTARAWGKNV,CLRIIFIYKM,D ILYMQQFSY,CTILKMAVAL,MAVALETVLI,VGMQRRKCTI, GMQRRKCTIL,LQVLLSEVGM,ARAWGKNVCL,GKNVCLRII F,LRIIFIYKMY,IIFIYKMYKW,VKICGSALKM,LKMNLLQVLL, QRRKCTILKM,KLDILYMQQF,LHVQKLDILY,LETVLIIFSL,HV QKLDILYM,KLDILYMQQF,QQFSYATMRQ | STAD |

315
316

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GLOD4 | c.667_668insC | p.Q223fs | KLELQGVKGGVDHAAAFGRIAFSCP[p.Q223fs]PERVARLRRLDEKGEPEDSDSPGEPGHPRESNSTGGHSGRP* | IAFSCPPER,NSTGGHSGR,HPRESNSTG,RESNSTGGH,CPPERVARL,RIAFSCPPER,VARLRRLDEK,FSCPPERVAR,IAFSCPPERV | LUAD |
| GLRA3 | c.1360C>A | p.L454I | DTISRACFPLAFLIFNIFYWVIYKI[p.L454I]IRHEDIHQQQD* | FYWVIYKII,IFYWVIYKI,IYKIIRHEDI,FYWVIYKIIR | CRC |
| GLRA3 | c.396C>A | p.F132L | AYSEYPDDSLLDLDPSMLDSIWKPDL[p.F132L]LFANEKGANFHEVTTDNKLLRIFKNG | LLFANEKGA,SIWKPDLLF,IWKPDLLFA,DSIWKPDLL,SIWKPDLLFA,LFANEKGANF | CRC |
| GLT8D2 | c.533C>T | p.A178V | IYLDDDVIVQGDIQELYDTTLALGH[p.A178V]VAAFSDDCDLPSAQDINRLVGLQNTY | TLALGHVAA,DTTLALGHV,TTLALGHVA,LALGHVAAF,DTTLALGHVA,TTLALGHVAAF | GBM |
| GLTSCR2 | c.1166A>G | p.Q389R | RHQELFRLRGIKAQVALRLAELARR[p.Q389R]RRRRQARRRAEAADKPRRLGRLKYQAP | RRRRQARR,ELARRRRR,RLAELARRR,LARRRRRQA,RRRRRRQARR,RLAELARRR | ACC |
| GLYR1 | c.1139_1140insG | p.G380fs | CYVDMSTVDADTVTELAQVIVSRGG[p.G380fs]ALSGSPRLRESAAV* | SPRLRESAA,GALSGSPRL,RGGALSGSPR,QVIVSRGGAL,SPRLRESAAV | STAD |
| GNA13 | c.598A>G | p.R200G | KYFLDNLDKLGEPDYIPSQQDILLA[p.R200G]GRPTKGIHEYDFEIKNVPFKMVDVGG | ILLAGRPTK,SQQDILLAG,LLAGRPTKGI | BLCA |
| GNAO1 | c.848C>A | p.P283Q | KWFTDTSIILFLNKKDIFEEKIKKS[p.P283Q]LTICFPEYTGPSAFTEAVAVIQAQY | KIKKSQLTI,QLTICFPEY,KKSQLTICF,KIKKSQLTIC,SQLTICFPEY,IKKSQLTICF,FEEKIKKSQL | LUAD |
| GNAS | c.2530C>T | p.R844C | QYFLDKIDVIKQADYVPSDQDLLRC[p.R844C]CVLTSGIFETKFQVDKVNFHMFDVGG | CCVLTSGIF,RCCVLTSGIF | LIHC |
| GNAS | c.2531G>A | p.R844H | QYFLDKIDVIKQADYVPSDQDLLRC[p.R844H]HVLTSGIFETKFQVDKVNFHMFDVGG | LLRCHVLTS,CHVLTSGIF,RCHVLTSGIF | PAAD |
| GNB1 | c.239T>C | p.I80T | LAKIYAMHWGTDSRLLVSASQDGKL[p.I80T]TIWDSYTTNKVHAIPLRSSWVMTCAY | LTIWDSYTT,SQDGKLTIW,GKLTIWDSY,TIWDSYTTNK,ASQDGKLTIW | CLL |
| GNG12 | c.202delA | p.T68fs | CEEHARSDPLLIGIPTSENPFKDKK[p.T68fs]LASSYSGIEKQLLASSQQRKL* | KLASSYSGI,ASSYSGIEK,LLASSQQRK,KDKKLASS,KKLASSYSG,KQLLASSQQ,IEKQLLASS,LLASSQQRKL,QLLASSQQRK,LASSYSGIEK,SYSGIEKQLL,FKDKKLASSY,KKLASSYSGI,SSYSGIEKQL,SENPFKDKKL | STAD |
| GNPNAT1 | c.162delT | p.F54fs | AISPTHPGCEGLVLRPLCTADLNRGF[p.F54fs]LRYWVS* | RGFLRYWVS,DLNRGFLRY,TADLNRGFLR,CTADLNRGFL,ADLNRGFLRY | STAD |
| GNPTAB | c.3566G>A | p.R1189Q | VKAVLRDFYESMFPIPSQFELPREY[p.R1189Q]QNRFLHMHELQEWRAYRDKLKFWTHC | EYQNRFLHM,LPREYQNRF,REYQNRFLH,YQNRFLHMH,LPREYQNRFL,REYQNRFLHM,SQFELPREYQ | UCEC |
| GOLGA4 | c.4608G>T | p.Q1536H | KKESNLETELKSQTARIMELEDHIT[p.Q1536H]HKTIEIESLNEVLKNYNQQKDIEHKE | MELEDHITH,HKTIEIESL,LEDHITHKTI | CRC |
| GOLGA5 | c.1474C>A | p.L492I | ELEELRHEKEMQREEIQKLMQIHQ[p.L492I]IRSELQDMEAQQVNEAESAREQLQDL | KLMGQIHQI,KLMGQIHQIR,HQIRSELQDM,QKLMQIHQI,GQIHQIRSEL | KIRC |
| GOT2 | c.1063C>T | p.R355W | ILNTPDLRKQWLQEVKVMADRIIGM[p.R355W]WTQLVSNLKKEGSTHNWQHITDQIGM | RIIGMWTQL,IIGMWTQLV,WTQLVSNLK,MWTQLVSNL,MADRIIGMW,RIIGMWTQLV,GMWTQLVSNL,MWTQLVSNLK,WTQLVSNLKK,VMADRIIGMW | PRAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GP2 | c.122C>T | p.S41L | LALVSCILTQASAVQRGYGNPIEAS[p.S41L]LYGLDLDCGAPGTPEAHVCFDPCQNY | NPIEASLYG, YGNPIEASLY, NPIEASLYGL, IEASLYGLDL | CRC |
| GPAT CH4 | c.629_630i nsA | p.K210fs | FLARLKGQDPGAPQLQSESKPPKKK[p.K210fs]EKEKEAERGGRSYSI* | EAERGGRSY, KEAERGGRSY, AERGGRSYSI | PRAD |
| GPAT CH4 | c.629del A | p.K210fs | AFLARLKGQDPGAPQLQSESKPPKK[p.K210fs]RKRKGGRKRKRKLQHLKGM QMRSTQNMLSRTSEKARRRKGDIKKER SQMKERVQLKGMRRRTLQEQVGLGN* | MQMRSTQNM, QMRSTQNML, MLSRTSEKA, NMLSRTSEK, QMKERVQLK, RSTQNMLS, RVQLKGMR, KRRKGGRK, KGGRKRRKK, RRKKLQHLK, LSRTSEKAR, RTSEKARRR, KARR RKGDI, RRRKGDIKK, KGMRRRTLQ, GMRRRTLQE, HLKGM MQMR, LKGMRRRTL, KKLQHLKGM, QHLKGMMQM, GM MQMRSTQ, SQMKERVQL, KERVQLKGM, RTLQEQVGL, M QMRSTQNML, MMQMRSTQNM, SQMKERVQLK, RTSEKA RRRK, KKRRKGGRK, KRKGGRKRRK, RRKKLQHLK, QMRS TQNMLS, QNMLSRTSEK, LSRTSEKARR, KARRRKGDIK, RSQ MKERVQL, RVQLKGMRRR, MLSRTSEKAR, QLKGMRRRTL, LQHLKGMMQM, RKRRKKLQHL, RKKLQHLKGM, KKLQHLK GMM, MKERVQLKGM, KERSQMKERV | STAD |
| GPC5 | c.1040G>T | p.R347 L | LVNDAVLQAHLNGQKLLEQVNRICG[p.R347L]LPVRTPTQSPRCSFDQSKEKHG MKTT | EQVNRICGL, QVNRICGLPV, VNRICGLPVR, LEQVNRICGL | LUSC |
| GPC6 | c.640G>A | p.A214 T | CVSKYTDQLKPFGDVPRKLKIQVTR[p.A214T]TFIAARTFVQGLTVGREVANRVS KVS | VTRTFIAAR, RTFIAARTF, KIQVTRTFI, QVTRTFIAA, TFIAART FV, LKIQVTRTF, IQVTRTFIA, RTFIAARTFV, KLKIQVTRTF, KI QVTRTFIA, VTRTFIAART, QVTRTFIAAR, LKIQVTRTFI, IQVT RTFIAA, TRTFIAARTF | CRC |
| GPLD 1 | c.2150G>A | p.R717 Q | TRMYALTSDAQPLLLSTFSGDRRFS[p.R717Q]QFGGVLHLSDLDDDGLDEIIMAA PLR | SQFGGVLHL, SGDRRFSQF, RRFSQFGGV, RRFSQFGGVL, FSG DRRFSQF, RRFSQFGGVL, FSQFGGVLHL, SQFGGVLHLS | CRC |
| GPM6 A | c.149C>T | p.A50V | IPYASLIATILLYAGVALFCGCGHE[p.A50V]VLSGTVNILQTYFEMARTAGDTLDV F | VLSGTVNIL, EVLSGTVNI, ALFCGCGFIEV, EVLSGTVNIL, HEV LSGTVNI | KIRC |
| GPNM B | c.522C>G | p.I174 M | GQSHNHVFPDGKPFPHHPGWRRWNF[p.I174M]MYVFHTLGQYFQKLGRCSV RVSVNTA | FMVYFHTLG, RRWNFMVYF, NEMYVFHTL, GWRRWNFMY, RWNFMVYFH, MVYFHTLGQY, GWRRWNFMYV, RWNFM YVFHT, HPGWRRWNFM, WNFMVYFHTL, WRRWNFMVYF, FMVYFHTLGQ | LUAD |
| GPR1 0 | c.910del C | p.C3fs | MECL[p.C3fs]LFPGISAPGCKIAT* | LLFPGISQP, MECLLFPGI, LLFPGISQPG, MECLLFPGIS | TGCT |
| GPR1 10 | c.1327A>G | p.R443 G | TALPLNPSRKFIDWKGIPVNKSQLK[p.R443G]GGYSYQIKMCPQNTSIPIRGRVLI GS | KGGYSYQIK, SQLKGGYSY, LKGGYSYQI, GGYSYQIKM, QLKG GYSYQI, VNKSQLKGGY, KSQLKGGYSY, SQLKGGYSYQ, KGG YSYQIKM | CLL |
| GPR1 12 | c.3848C>A | p.S128 3Y | KDQMTISLGKPTPRTMEVTEMSPSKN[p.S1283Y]YFISYSRGTPSLEMTDTGFPETT KIS | KNYFISYSR, MSPSKNYFI, PSKNYFISY, EMSPSKNYF, TEMSP SKNY, VTEMSPSKNY, EMSPSKNYFI, SPSKNYFISY, TEMSPSK NYF | UCEC |
| GPR1 23 | c.1889T>C | p.L630 P | PRTPHCVGKKVPQPVGAADLAPDTS[p.L630P]PCRKEGSSASRSCRPGPHLTRR EED | DLAPDTSPCR | CLL |
| GPR1 25 | c.338G>A | p.R113 Q | LSNNKISELKNGSFSGLSLLERLDL[p.R113Q]QNNLISSIDPGAFWGLSSLKRLDLT N | LQNNLISSI, LERLDLQNNL | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GPR137B | c.718G>T | p.G240C | KISKMSLANIYLESKGSSVCQVTAI[p.G240C]CVTVILLYTSRACVNLFILSFSQNKS | QVTAICVTV,ICVTVILLY,TAICVTVIL,CQVTAICVTVIL,CQVTAICVT,CQVTAIC VTV,AICVTVILLY,SVCQVTAICV,QVTAICVTVI,TAICVTVILL | LUAD |
| GPR156 | c.2262C>A | p.F754L | PVPSGCASLSSQHSYFDTESSSSDE[p.F754L]LFCRCHRPYCEICFQSSSDSDSGTS | SSSDELFCR,LFCRCHRPY,TESSSDEL,SSSSDELFCR,ELFCR CHRPY,TESSSDELF | CRC |
| GPR158 | c.1696G>A | p.D566N | LIGWTSSVCQNLEKQISLIGGQKTS[p.D566N]NHLIFNMCLIDRWDYMTAVAEF LFLL | KTSNHLIFN,TSNHLIFNM,GQGKTSNHL,GKTSNHLIF,KTSN HLIFNM,GQGKTSNHLI,QGKTSNHLIF | CRC |
| GPR158 | c.2284C>A | p.P762T | NPHLQKKRCSKKGLGRSIMRRITEI[p.P762T]TETVSRQCSKEDKEGADHGTAKGT AL | RITEITETV,RRITEITETV | LUAD |
| GPR161 | c.1550del G | p.G517 fs | AEAKINLFGEEALPGVLVTARTVPG[p.G517fs]AASGAAEAAELL* | TARTVPGAA,VTARTVPGA,TVPGAASGA,VPGAASGAA,LV TARTVPGA,RTVPGAASGA,VTARTVPGAA,TVPGAASGAA | STAD |
| GPR21 | c.647G>A | p.R216H | FTLFIVMMLYAPAALIVCFTYFNIF[p.R216H]HICQQHTKDISERQARFSSQSGET GE | FTYFNIFHI,TYFNIFHIC,CFTYFNIFHI,IFHICQQHTK,FTYFNI FHIC | CRC |
| GPR6 | c.106_165del e\|GCGGCG GCGGCGGC CACACAG CAGGGGG GCCGGACA CGGCGAA TGGGGACC CCCTGCT | p.AAAA ATAAG GPDTG EWGPP A36del\| | AAMNASAASLNDSQVVVAAEGAAA[p. AAAATAAGGPDTGEWGPPA36de\| LGAGGGANGSLELSSQLSAGPPGLLLP AVNPMDVLLCVSGTVIAGENALVVALI ASTPALRTPMFVLVGSLATADLLAGCGL ILH | VAAEGAAAL,AEGAAALGA,VVAAEGAAAL,AEGAAALGAG | PAAD |
| GPR98 | c.12424C>T | p.R414 2W | RFTIQLISIDEVEISPVKGSASIII[p. R4142W]WGDKRASGEVGIAPSSRHLIGEPSA SIIIW | ASIIIWGDK,SIIIWGDKR,KGSASIIIW,SASIIIWGDK,VKGSA SIIIW | CRC, UCEC |
| GPR98 | c.12919G>T | p.G430 7W | QRVNITIIRSSGDFGHVRLWYKTMS[p. G4307W]WTAEAGLDFVPAAGELLPEA GEMRKS | WTAEAGLDF,KTMSWTAEA,RLWYKTMSW,WYKTMSWT A,MSWTAEAGL,TMSWTAEAGL,WTAEAGLDFV,RLWYKT MSWT,SWTAEAGLDF,VRLWYKTMSW,LWYKTMSWTA,Y KTMSWTAEA | LUAD |
| GPR98 | c.18455A>T | p.Y615 2F | AYRHFWMLVLFVIFNSLQGLYVFMV[p. Y6152F]FFILHNQMCCPMKASYTVEM NGHGPP | YVFMVFFIL,QGLYVFMVF,LYVFMVFFI,VFFILHNQM,GLYV FMVF,GLYVFMVFFI,LQGLYVFMVF,QGLYVFMVFF,LYVF MVFFIL,MVFFILHNQM | CLL |
| GPRA SP1 | c.2117C>T | p.S706 L | KEPCMYPAGGSWKSRPEEEEDIVN[p. S706L]LWFWSRKYTKPEAIIGSWLWAT EESN | IVNLWFWSR,VNLWFWSRK,NLWFWSRKY,EEEDIVNLW,E EDIVNLWF,EEEEDIVNL,IVNLWFWSRK,LWFWSRKYTK,V NLWFWSRKY,DIVNLWFWSR,EEEDIVNLWF,EEDIVNLWF W | HNSC |
| GPRC 5A | c.88G>A | p.V30I | VPDGCRNGLKSKYYRLCDKAEAWGI[p. V30I]ILETVATAGVVTSVAFMLTLPILVC K | IILETVATA,AWGIILETV,EAWGIILET,KAEAWGIIL,AEAWGI ILE,ILETVATAGV,GIILETVATA,EAWGIILETV,AEAWGIILET | CRC |
| GPRIN 1 | c.693_716d e\|GAAGGA GGATCCTG GGTCTTTG AG | p.231_ 239RKE DPGSL R>R | KEDLGSLGKVDPLCSSKTYTVSPRK[p.23 1_239RKEDPGSLR>R]VDPVSSDKVDP VFPRKEEPRYSGKEHPVSSEKVAPTSAE KVDLVLSGKR | TVSPRKVDPV,KTYTVSPRKV | KIRC |
| GPRIN 2 | c.1337G>A | p.R446 H | APASEDSLSVEGRRGPLRAVMQSLR[p. R446H]HPSCCGCSGAAPE* | MQSLRHPSC | ACC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GPRIN2 | c.298A>C | p.T100P | ARASGPKARPSAGGHWMSSTVGNVS[p.T100P]PMGGSDLCRLRAPSAAAMQRSHSDLV | STVGNVSPM, SSTVGNVSPM | CESC |
| GPRIN2 | c.721G>A | p.V241M | KAAEQLATTTCHALPPAALLCGMRE[p.V241M]MRAGGCCHALPATGILAFPKLVASVS | ALLCGMREM, LLCGMREMR, REMRAGGCC, AALLCGMREM, REMRAGGCCH, MRAGGCCHAL | ACC |
| GPRIN3 | c.1898delG | p.R633fs | PSDPMGDSSPGSGKKTPSRSVKASP[p.R633fs]PGPAASASSSRSKS* | ASASSSRSK, RSVKASPPG, KASPPGPAA, SPPGPAASA, AASASSSRSK, SVKASPPGPA, VKASPPGPAA | HNSC |
| GPT2 | c.29G>C | p.R10P | MQRAAALVR[p.R10P]PGCGPRTPSSWGRSQSSAAAEASAVL | LVRPGCGPR, RPGCGPRTPS, MQRAAALVRP | TGCT |
| GRAMD2 | c.369C>G | p.I123M | DFLLQGRLYISPNWLCFHASLFGKD[p.I123M]MKVVIPVVSVQMIKKHKMARLLPNGL | SLFGKDMKV, ASLFGKDMK, HASLFGKDM, KDMKVVIPV, SLFGKDMKV, HASLFGKDMK, FHASLFGKDM, KDMKVVIPVV, MKVVIPVVSV | CESC |
| GRAP | c.207G>T | p.E69D | GYVPKNFIDIQPPKWFHEGLSRHQA[p.E69D]DNLLMGKEVGFFIIRASQSSPGDFSI | QADNLLMGK, SRHQADNLL, RHQADNLLM, HQADNLLMG, GLSRHQADNL, HQADNLLMGK, SRHQADNLLM | CRC |
| GRB14 | c.898G>A | p.A300T | RHLQFFSEFGNSDIVVSLAGKKKHG[p.A300T]TPTNYGFCFKPNKAGGPRDLKMLCAE | KKHGTPTNY, HGTPTNYGF, TPTNYGFCF, GTPTNYGFCF, KKHGTPTNY, KHGTPTNYGF | BRCA |
| GRB7 | c.716G>T | p.R239L | ISHEDLIQNFLNAGSFPEIQGFLQL[p.R239L]LGSGRKLWKRFFCFLRRSGLYYSTKG | LGSGRKLWK, EIQGFLQLL, LLGSGRKLW, LLGSGRKLWK, LQLLGSGRKL, QLLGSGRKLW, PEIQGFLQLL | LUAD |
| GREB1 | c.1031C>A | p.S344Y | ESPSAPDGGCPQGGGNRAKYESAGM[p.S344Y]YCVPQVGLVGPASVTFPVVASGEPVS | AGMYCVPQV, MYCVPQVGL, AKYESAGMY, YESAGMYCV, GMYCVPQVG, GMYCVPQVGL, KYESAGMYCV, MYCVPQVGLV, RAKYESAGMY, YESAGMYCVP | KIRC |
| GRHL1 | c.1822G>T | p.G608W | LVNMDDNIVKHYSNEDTFQLQIEEA[p.G608W]WGSYKLTLTEI* | AWGSYKLTL, QIEEAWGSY, FQLQIEEAW, ERAWGSYKL, QIEEAWGSYK, TFQLQIEEAW, LQIEEAWGSY, IEEAWGSYKL, EEAWGSYKLT | LUAD |
| GRIA1 | c.652C>T | p.R218C | EGYRMLFQDLEKKERLVVVDCESE[p.R218C]CLNAILGQIIKLEKNGIGYHYILANL | CLNAILGQI, CESECLNAI, CLNQILGQII, CESECLNAIL | CRC |
| GRIA2 | c.2534G>A | p.R845Q | LVGGLGLAMLVALIEFCYKSRAEAK[p.R845Q]QMKVAKNAQNINPSSSQNSQNFATYK | KSRAEAKQM, AEAKQMKVA, KQMKVAKNA, KSRAEAKQM, K, YKSRAEQKQM, KQMKVAKNAQ | CRC |
| GRID1 | c.1864G>A | p.E622K | PRPSASATLHSAIWIVYGAFVQQGG[p.E622K]KSSVNSMAMRIVMGSWWLFTLIVCSS | GAFVQQGGK, KSSVNSMAM, VQQGGKSSV, GGKSSVNSM, FVQQGKSSV, KSSVNSMAMR, GKSSVNSMAM | DLBCL |
| GRID1 | c.2048G>T | p.R683L | VSRMDNPIRTFQDLSKQVEMSYGTV[p.R683L]LDSAVYEYFRAKGTNPLEQDSTFAEL | VLDSAVYEY, VEMSYGTVL, LDSAVYEYF, VLDSAVYEYF, TVLDSAVYEY, MSYGTVLDSA | LUAD |
| GRID2 | c.1947delG | p.T649fs | YTTLATRMMMGAWWLFALIVISSYT[p.T649fs]QTSLLSSLLHALKVPSSLSRTFPSKQKSLMAQS* | SLLSSLLHAL, LLSSLLHAL, TQTSLLSSL, LSSLLHALK, SLSRTFPSK, SSYTQTSLL, SSLSRTFPS, KQKSLMAQS, QTSLLSSLL, HALK, VPSSL, VPSSLSRTF, FPSKQKSLM, ISSYTQTSL, SLLSSLLHAL, VLSSYTQTSL, YTQTSLLSSL, TQTSLLSSLL, LLSSLLHALK, ALKV, PSSLSR, SSLSRTFPSK, KVPSSLSRTF, LSRTFPSKQK, RTFPSKQKSL, FPSKQKSLMA, ISSYTQTSLL, LHALKVPSSL | HNSC |
| GRIK1 | c.1103G>A | p.R368Q | VSSLQCHRHKPWRLGPRFMNLIKEA[p.R368Q]QWDGLTGHITFNKTNGLRKDFDLDII | AQWDGLTGH, KEAQWDGLT, AQMDGLTGHI, LIKEAQWD, GL, FMNLIKEAQM, KEAQWDGLTG | LUAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| GRIN2B | c.1556G>A | p.R519Q | WNGMIGEVVMKRAYMAVGSLTINEE[p.R519Q]QSEVVDFSVPFIETGISVMVSRSNGT | TINEEQSEV, EEQSEVVDF, LTINEEQSEV, TINEEQSEVV, EQS EVVDFSV, NEEQSEVVDF | OV |
| GRK4 | c.64_65insA | p.K22fs | MELENIVANSLLLKARQGGYGKK[p.K22fs]KWS* | RQGGYGKKK | STAD |
| GRM3 | c.2046C>A | p.F682L | SALLTKTNCIARIFDGVKNGAQRPK[p.F682L]LISPSSQVFICLGLLIVQIVMVSVWL | KLISPSSQV, LISPSSQVF, LISPSSQVFI, KLISPSSQVF, AQRPKL ISPS, VKNGAQRPKL | HNSC |
| GRM3 | c.547C>T | p.R183C | ANLLRLFQIPQISYASTSAKLSDKS[p.R183C]CYDYFARTVPPDFYQAKAMAEILR FF | LSDKSCYDY, KSCYDYFAR, AKLSDKSCY, LSDKSCYDYF, KLSD KSCYDY, SAKLSDKSCY | GBM |
| GRM5 | c.2685_2686insC | p.P895fs | SSGETLRYKDRRLAQHKSEIECFTP[p.P895fs]QREYGEWWESNNEQFQWKIRH VGPE* | WWESNNEQF, EIECFTPQR, SEIECFTPQ, REYGEWWES, EQ FQWKIRH, FQWKIRHVG, TPQREYGEW, ESNNEQFQW, EW WESNNEQF, EQFQWKIRHV, IECFTPQREY, WESNNEQFQ W, FQWKIRHVGP, REYGEWWESN, GEWWESNNEQ, TPQR EYGEWW | LUAD |
| GRM6 | c.1089G>T | p.E363D | GFDQYFMTRSLENNRRNIWFAEFWE[p.E363D]DNFNCKLTSSGTQSDDSTRKCT GEER | WEDNFNCKL, EFWEDNFNCK, AEFWEDNFNC | UCEC |
| GRM6 | c.2152_2153insG | p.A718fs | SPTSQLVITFSLTSLQVVGMIAWLG[p.A718fs]GPAPTQRD* | MIAWLGGPA, GMIAWLGGPA | KIRC |
| GRM7 | c.2036G>A | p.R679Q | VCSFRRVFLGLGMCISYAALLTKTN[p.R679Q]QIYRIFEQGKKSVTAPRLISPTSQL A | ALLTKTNQI, LTKTNQIYR, KTNQIYRIF, LLTKTNQIY, QIYRIFE QGK, LTKTNQIYRI, KTNQIYRIFE, ALLTKTNQIY, LLTKTNQIY R, TKTNQIYRIF | CRC |
| GRM8 | c.2554C>T | p.R852C | SVSLGMLYMPKVYIIIFHPEQNVQK[p.R852C]CKRSFKAVVTAATMQSKLIQKGN DRP | VQKCKRSFK, KCKRSFKAV, CKRSFKAVV, NVQKCKRSFK, VQ KCKRSFKA, KCKRSFKAVV | LIHC |
| GTF2E1 | c.575G>T | p.R192L | AMPKKDARTLLARFNEQIEPIYALL[p.R192L]LETEDVNLAYEILEPETEIPALKQ S | ALLLETEDV, IEPIYALLL, LETEDVNLA, LLLETEDVNL, LETEDV NLAY, EPIYALLLET | LUAD |
| GTF3A | c.918G>T | p.K306N | HAGCGKTFAMKQSLTRHAVVHDPDK[p.K306N]NKMKLKVKKSREKRSLASHLS GYIPP | VVFIDDPDKNK, KNKMKLKVK, AVVHDPDKNK, KNKMKLKVK K | CRC |
| GTF3C1 | c.2299delA | p.S767fs | KEGPSCSGGDSQLSASRSESGRMKK[p.S767fs]VIIKWA* | RMKKVIIKW, SGRMKKVII, RMKKVIIKWA, SGRMKKVIIK | STAD |
| GTF3C4 | c.1685delA | p.E562fs | LIDLVRMKILKDKHIPQFLQEALEK[p.E562fs]RLKAVESPIFGVLSPSS* | AVESPIFGV, ALEKRLKAV, RLKAVESPI, SPIFGVLSF, LKAVESP IF, VESPIFGVL, FLQEALEKRL, KAVESPIFGV, RLKAVESPIF, EA LEKRLKAV, KRLKAVESPI, VESPIFGVLS, QEALEKRLKA | STAD |
| GUCY2C | c.1645G>T | p.G549C | NFTEKQKIELNKLLQIDYYNLTKFY[p.G549C]CTVKLDTMIFGVIEYCERGSLREVL N | NLTKFYCTV, LIKFYCTVK, TKFYCTVKL, FYCTVKLDTM, LITKF YCTVKL, YNLTKFYCTV, CTVKLDTMIF | BRCA |
| GUSB | c.1498T>C | p.C500R | PSRPVTFVSNSNYAADKGAPYVDVI[p.C500R]RLNSYYSWYHDYGHLELIQLQLA TQF | RLNSYYSWY, IRLNSYYSW, VIRLNSYYS, DVIRLNSYY, APYVD VIRL, VDVIRLNSY, YVDVIRLNSY, RLNSYYSWYH, DVIRLNSY YS, VDVIRLNSYY, VIRLNSYYSW, IRLNSYYSWY | KIRC |
| GUSB | c.1501T>G | p.L501V | SRPVTFVSNSNVAADKGAPYVDVIC[p.L501V]VNSYYSWYHDYGHLELIQLAT QFE | CVNSYYSWY, DVICVNSYY, VDVICVNSY, VDVICVNSYY, APYV DVICV, VVDVICVNSY, CVNSYYSWYH, DVICVNSYYS, VDVIC VNSYY, CVNSYYSWY | KIRC |
| GXYLT1 | c.667_668insT | p.L223fs | SQRLFLPLILKEVDSLLIYVDTDILFF[p.L223fs]FTTS* | YVDTDILFF, YVDTDILFFT, LVVDTDILFF | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| H1FO | c.642_643i nsA | p.A214 fs | PGAATEKARKQGGAAKDTRAQSGEA[p.A2W 14fs]KEGAPQARQGHAGTFQCWW AQQEGKGQRQQEQPRRC* | APQARQGHA,ARQGHAGTF,GHAGTFQCW,HAGTFQCWW, EAKEGAPQAR,QARQGHAGTF,GEAKEGAPQA,RQGHA GTFQC | BLCA |
| H2AF V | c.374A>G | p.Q125 R | LIKATIAGGGVIPHIHKSLIGKKGQ[p.Q1 25R]RKTA* | SLIGKKGQR,KSLIGKKGQR | TGCT |
| H2AFV 2 | c.432de lG | p.K144f s | GKSETILSPPPEKRGRKATSGKKGG[p.K 144fs]RNPRLPNHGRPKSPNQRTAIKKE LQIPPLKMGQGMDSPFCLLRALFWDRS CP* | GMDSPFCLL,RLPNHGRPK,LLRALFWDR,SPFCLLRAL,MGQ GMDSPF,KKELQIPPL,KSPNQRTAIK,GMDSPFCLLR,KMGQ GMDSPF,SGKKGGRNPR,GGRNPRLPNH,HGRPKSPNQR,R TAIKKELQI,CLLRALFWDR,RPKSPNQRTA,IPPLKMGQGM, SPFCLLRALF,NQRTAIKKEL,IKKELQIPPL,KELQIPPLKM,GQ GMDSPFCL | STAD |
| H3F3C | c.392G>T | p.R131 L | DTNLCAIHAKRVTIMPKDIQLARRI[p.R 131L]LGERA* | LARRILGER,QLARRILGER,KDIQLARRIL | LUAD |
| HAO1 | c.514C>T | p.R172 C | AEKMGYKAIFVTVDTPYLGNRLDDV[p. R172C]CNRFKLPPQLRMKNFETSTLSFS PEE | RLDDVCNRF,RLDDVCNRFK | CRC |
| HAO2 | c.34C>A | p.H12N | MSLVCLTDFQA[p.H12N]NAREQLSKS TRDFIEGGADDSITRDD | CLTDFQANA,FQANAREQL,QANAREQLSK,CLTDFQANAR | LUAD |
| HARS 2 | c.503G>A | p.R168 H | NKVKKMKRYHVGKVWRESPTIVQG[p. R168H]HYREFCQCDFDIAGQFDPMI PDAECL | IVQGHYREF,PTIVQGHYR,SPTIVQGHY,HYREFCQCDF,TIV QGHYREF,RESPTIVQGH | CRC |
| HAUS 6 | c.1588de lA | p.S530f s | ENSPLSDVAKNTESSAFGGSLPAKK[p.S 530fs]VIHFKKSKIIW* | KVIHFKKSK,PAKKVIHFK,AKKVIHFK,LPAKKVIHF,IHFKKS KII,SLPAKKVIHF,PAKKVIHFK,KVIHFKKSKI,IHFKKSKIIW | STAD |
| HBB | c.126C>A | p.F42L | GKVNDEVGGEALGRLLVVYPWTQR[p. F42L]LFESFGDLSTPDAVMGNPKVKA HGKK | VVYPWTQRL,RLFESFGDL,VYPWTQRLF,WTQRLFESF,RLF ESFGDLS,VVYPWTQRLF,PWTQRLFESF,LVVYPWTQRL,YP WTQRLFES | CRC |
| HBB | c.257T>G | p.F86C | VKAHGKKVLGAFSDGLAHLDNLKGT[p. F86C]CATLSELHCDKLHVDPENFRLLG NVL | NLKGTCATL,KGTCATLSEL | KIRC |
| HCN1 | c.1496G>T | p.G499 V | PLFANADPNFVTAMLSKLRFEVFQP[p. G499V]VDYIIREGAVGKKMYFIQHGVA GVIT | VFQPVDYII,EVFQPVDYI,LRFEVFQPVDYI,FEVFQPV,FEVFQPVDY,KLRFE VFQPV,RPEVFQPVDY,VFQPVDYIIR,EVFQPVDYII,FEVFQP VDYI | LUSC |
| HCN1 | c.1976G>T | p.R659 L | QAIAPINYPQMTTLNSTSSTTTPTS[p.R 659L]LMRTQSPPVYTATSLSHSNLHSPS PS | LMRTQSPPV,TTTPTSLMR,STTTPTSLM,SSTTPTSL,SLMR TQSPPV,STTTPTSLMR,LMRTQSPPVY,SSTTPTSLM | LUSC |
| HCN1 | c.2140G>T | p.A714 S | QPSAILSPCSYTTAVCSPPVQSPLA[p.A7 14S]SRTFHYASPTASQLSLMQQQPQQ QVQ | ASRTFHYAS,PLASRTFHY,LASRTFHYA,VQSPLASRT,PLASR TFHYA,ASRTFHYASP,VQSPLASRTF,SPLASRTFHY | LUSC |
| HCN1 | c.692C>A | p.P231 Q | IILDPKVIKMNYLKSWFVVDFISSI[p.P23 1Q]QVDYIFLIVEKGMDSEVYKTARALRI | FISSIQVDY,QVDYIFLIV,IQVDYIFLI,SSIQVDYIF,VVDFISSIQ V,FISSIQVDYI,SIQVDYIFLI,IQVDYIFLIV,SSIQVDYIFL,ISSIQ VDYIF | LUAD |
| HCN1 | c.976C>A | p.P326 T | LIGMLLLCHWDGCLQFLVPLLQDF[p. P326T]TPDCWVSLNEMVNDSWGKQY SYALFK | FTPDCWVSL,FLVPLLQDFT | LUSC |
| HCN4 | c.1574G>A | p.R525 H | IVGATCYAMFIGHATALIQSLDSSR[p.R 525H]HQYQEKYKQVEQYMSFHKLPPD TRQR | SLDSSRHQY,SSRHQYEBK,RHQYQEKYK,IQSLDSSRH,SRH QYQEKY,QSLDSSRHQY,SSRHQYQEKY,HQYQEKYKQV | CRC |
| HCRT R2 | c.26_27ins C | p.S9fs | MSGTKLEDSPP[p.S9fs]LSQLVICFGAE * | DSPPLSQLV,SPPLSQLVI,TKLEDSPPL,LEDSPPLSQL | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| HCRT R2 | c.26del C | p.S9fs | MSGTKLEDS[p.S9fs]LVATGHLLRS* | LVATGHLLR, SPIVATGHL, LEDSPLVAT, GTKLEDSPLV, SPLV ATGHLL | STAD |
| HCRT R2 | c.298G>T | p.D100 Y | VCVAVWKNHHMRTVTNYFIVNLSLA[p. D100Y]YVLVTITCLPATLVVDITETWFF GQS | FIVNLSLAY, IVNLSLAYV, NLSLAYVLV, SLAYVLVTI, YVLVTIT CL, VNLSLAYVL, FIVNLSLAVV, SLAYVLVTIT, YFIVNLSLAY, AY VLVTITCL, IVNLSLAYVL, LSLAYVLVTI | HNSC |
| HDAC 4 | c.2703del C | p.P901f s | PDEVGTGPGVGFNVNMAFTGGLDPP[p. P901fs]WETLSTWRPSERWSCRSPAS LPRMWCWCHQASMPWRATPPLLGAT TSPPDASGT* | GLDPPWETL, RMWCWCHQA, HQASMPWRA, ASLPRMW CW, RWSCRSPAS, RSPASLPRM, PWRATPPLL, LSTWRPSER, RPSERWSCR, MPWRATPPL, WSCRSPASL, WCWCHQASM, WHQASMPW, FTGGLDPPW, PPWETLSTW, SPASLPRM W, RMWCWCHQAS, SMPWRATPPL, RWSCRSPASL, MWC WCHQASM, CWCHQASMPW, SCRSPASLPR, TLSTWRPSER, MPWRATPPLL, SERWSCRSPA, CRSPASLPRM, HQASMPW RAT, WETLSTWRPS, DPPWETLSTW | STAD |
| HDAC 5 | c.3130G>A | p.A104 4T | CVSALLLSVELQPLDEAVLQQKPNIN[p.A 1044T]TVATLEKVIEIQSKHWSCVQKFA AGL | QQKPNINTV, NTVATLEKV, KPNINTVAT, LQQKPNINTV, NI NTVATLEK, NTVATLEKVI, KPNINTVATL, QQKPNINTVA | CRC |
| HDLB P | c.1507C>T | p.R503 C | SNLIRIEGDPQGVQQAKRELLELAS[p.R 503C]CMENERTKDLIIEQRFHRTIIGQK GE | LASCMENER, RELLELASC, LELASCMEN, ELASCMENER, REL LELASCM | TGCT |
| HDLB P | c.2240del G | p.G747 fs | EKQTKSFTVDIRAKPEYHKFLIGKG[p.G7 47fs]AAKFARCATALEHVSSSLRLRTRTR T* | ALEHVSSSL, HVSSSLRLR, SSSLRLRTR, SLRLRTRTR, LIGKGA AKF, AKFARCATA, KFARCATAL, AAKFARCATA, FLIGKGAAKF, KFLIGKGAAK, KGAAKFARCA, AAKFARCATA, SSLRLRTRTR, VSSSLRLRTR, TALEHVSSSL, SLRLRTRTRT, FARCATALEH, HKFLIGKGAA, A KFARCATAL, LEHVSSSLRL | STAD |
| HEAT R7B2 | c.3325G>A | p.E110 9K | TVVVNLLQKPLPFDRDTKTLMKALA[p. E1109K]KKPASSGKLLQALIDKLETELED DIA | KTLMKALAK, TLMKALAKK, WKALAKKPA, KTLMKALAKK, L AKKPASSGK, AKKPASSGKL | BLCA |
| HECA | c.998_999i nsG | p.R333f s | MAGGHVPRNAHFDYSPAGLAVHRGG[p. R333fs]TLRHPRAVPSAAGPLRTPHS HPQA* | AVHRGGTLR, RGTLRHPR, GTLRHPRAV, RTPHSHPQA, HP RAVPSAA, LAVHRGGTL, GLAVHRGGTL, RGGTLRHPRA, LA VHRGGTLR, HPRAVPSAAG, RAVPSAAGPL, LRHPRAVPSA, S AAGPLRTPH | STAD |
| HECT D2 | c.55C>G | p.P19A | MSEAVRVPSPATPLVVAA[p.P19A]AA PEERKGKESEREKLPPIVSAGAGA | ATPLVVAAA, AAAAPEERK, TPLVVAAAA, VAAAAPEERK, AT PLVVAAAA | ACC |
| HECW 1 | c.547G>T | p.A183 S | ICFKYYHGVSGALRATTPSVTVKNS[p.A 183S]SAPIFKSIGADETVQGQGSRRLISF S | KNSSAPIFK, TVKNSSAPI, SSAPIFKSI, VKNSSAPIF, VTVKNSS API, NSSAPIFKSI, TVKNSSAPIF | LUAD |
| HERC 1 | c.6989G>A | p.R233 0H | PVLAVIGGVDAGLRVGGRCVHKQTG[p. R2330H]HHATLLGVVKEGSTSAKVQW DEAEIT | HKQTGHHAT, KQTGHHATL, HKQTGHHATL, KQTGHHATLL | GBM |
| HERC 2 | c.986C>T | p.S329 F | SQMLSAILLLLQLWDSGAQETDNER[p. S329F]FAQGTSAPLLPLLQRFQSIICRKD AP | FAQGTSAPL, AQETDNERF, ERFAQGTSA, RFAQGTSAPL, GA QETDNERF, NERFAQGTSA, FAQGTSAPLL | CESC |
| HES3 | c.286C>A | p.P96T | SCLPGVSQLLRRGDEVGSGLRCPLV[p.P 96T]TESAAGSTMDSAGLGQEAPALFRP CT | TESAAGSTM, CPLVTESAA, VTESAAGSTM | ACC |
| HEXD C | c.1444A>C | p.T482 P | CRSWRLPCSWLSTRMPWRSGWRKTC[p. T482P]PPACSGCKLCCRTSARCLPPR CHPPA | GWRKTCPPA | KIRC,LUSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| HGF | c.1400C>A | p.S467Y | NPDDAHGPWCYTGNPLIPWDYCPI[p.S467Y]YRCEGDTTPTIVNLDHPVISCAKTKQ | IPWDYCPIY, LIPWDYCPIY, IPWDYCPIYR | CRC |
| HGF | c.2057T>C | p.M686T | AEKIGSSGPCEGDYGGPLVCEQHKMR[p.M686T]TVLGVIVPGRGCAIPNRPGIFVRVAY | KMRTVLGVI, EQHKMRTVL, HKMRTVLGV, CEQHKMRTV, K MRTVLGVIV, VLGVIVPGR, CEQHKMRTVL, HKMRTVLGVI | LUAD |
| HGF | c.686G>C | p.G229A | PQCSEVECMTCNGESYRGLMDHTES[p.G229A]AKICQRWDHQTPHRHKFLPERYPDKG | GLMDHTESA, LMDHTESAK, LMDHTESAKI, GLMDHTESAK, HTESAKICQR, TESAKICQRW | CESC |
| HHIPL1 | c.2075T>C | p.V692A | APRDGEVRLVRPAGLSSGSGRVEVF[p.V692A]AGGRWGTVCDDSWNISGAAVVCRQLG | VEVFAGGRW, EVFAGGRWGT | ACC |
| HIF3A | c.214G>A | p.A72T | VSAHLDKASIMRLTISYLRMHRLCA[p.A72T]TGEWNQVGAGGEPLDACYLKALEGFV | RMHRLCATG, LRMHRLCAT, HRLCATGEW, YLRMHRLCAT, MHRLCATGEW | CESC |
| HIP1 | c.2819G>T | p.R940L | AQLVAASKVKADKDSPNLAQLQQAS[p.R940L]LGVNQATAGVVASTISGKSQIEETDN | QLQQASLGV, LAQLQQASL, LQQASLGVN, AQLQQASLGV, NLAQLQQASL, QQASLGVNQA | LUAD |
| HIPK4 | c.839G>A | p.R280H | PDAANPWQLKSSADYLAETKVRPLE[p.R280H]HRKYMLKSLDQIETVNGGSVASRLTF | KVRPLEHRK, LEHRKYMLK, RPLEHRKYM, HRKYMLKSL, KVR PLEHRKY, ETKVRPLEHR, RPLEHRKYML, EHRKYMLKSL | CRC |
| HIST1 H1B | c.564G>C | p.K188N | AAAGVKKVAKSPKKAKAAAKPKKAT[p.K188N]NSPAKPKAVKPKAAKPKAAKPKAAKP | ATNSPAKPK, KKATNSPAK, KATNSPAKPK, ATNSPAKPKA, K PKKATNSPA | CESC |
| HIST1 H1C | c.194C>T | p.A65V | VSELITKAVAASKERSGVSLAALKK[p.A65V]VLAAAGYDVEKNNSRIKLGLKSLVSK | ALKKVLAAA, VLAAAGYDV, AALKKVLAA, KKVLAAAGY, KVL AAAGYDV, SLAALKKVLA, LAALKKVLAA, LKKVLAAAGY | DLBCL |
| HIST1 H1D | c.243C>G | p.I81M | SGVSLAALKKALMAGVDVEKNNSR[p.I81M]MKLGLKSLVSKGTLVQTKGTGASGSF | RMKLGLKSL, NSRMKLGLK, MKLGLKSLV, RMKLGLKSLV, YD VEKNNSRM, SRMKLGLKSL | BLCA |
| HIST1 H1E | c.398G>C | p.G133A | NKKAASGEAKPKAKKAGAAKAKKPA[p.G133A]AAAKKPKKATGAATPKKSAKKTPKKA | AAAAKKPKK, AAKAKKPAA, AKKPAAAAK, KAKKPAAAAK, A AKAKKPAAA, AKAKKPAAAA | DLBCL |
| HIST1 H1E | c.74G>C | p.R25P | MSETAPAPAAPAAPAPAPAEKTPVKKKA[p.R25P]PKSAGAAKRKASGPPVSELITKAVA | KTPVKKKAPK, KAPKSAGAAK, KKAPKSAGAA | LUAD |
| HIST1 H2AL | c.89G>C | p.R30P | GKQGGKARAKAKTRSSRAGLQPPVG[p.R30P]PVHRLLRKGNYAERVGAGAPVYLAAV | GLQPPVGPV, FPVGPVHRL, LQPPVGPVH, QPPVGPVHRL, F PVGPVHRLL | CESC |
| HIST1 H2BF | c.229G>A | p.E77K | DTGISSKAMGIMNSFVNDIFERIAG[p.E77K]KASRLAHYNKRSTITSREIQTAVRLL | RIAGKASRL, GKASRLAHY, DIFERIAGK, RIAGKASRLA, KASR LAHYNK, AGKASRLAHY, DIFERIAGKA | HNSC |
| HIST1 H2BJ | c.38A>G | p.K13R | MPEPAKSAPAPK[p.K13R]RGSKKAVTKAQKKDGKKRKRSRKESY | RGSKKAVTK, APAPKRGSK, SAPAPKRGSK, APKRGSKKAV | TGCT |
| HIST1 H3B | c.142G>T | p.A48S | TKAARKSAPATGGVKKPHRYRPGTV[p.A48S]SLREIRRYQKSTELLIRKLPFQRLVR | RYRPGTVSL, SLREIRRYQ, VSLREIRRY, TVSLREIRR, HRYRPG TVS, SLREIRRYQK, GTVSLREIRR, RYRPGTVSLR, TVSLREIRR Y, RPGTVSLREI, HRYRPGTVSL | DLBCL |
| HIST1 H3B | c.220G>A | p.E74K | LREIRRYQKSTELLIRKLPFQRLVR[p.E74K]KIAQDFKTDLRFQSSAVMALQRACEA | LVRKIAQDF, FQRLVRKIA, KLPFQRLVRK, LVRKIAQDFK, LPF QRLVRKI, RLVRKIAQDF | LUSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| HIST1 H3C | c.110A>T | p.K37 M | TGGKAPRKQLATKAARKSAPATGGV[p. K37M]MKPHRYRPGTVALREIRRYQKS TELL | GVMKPHRYR,VMKPHRYRP,KSAPATGGVM,VMKPHRYRP G | HNSC |
| HIST1 H4C | c.203G>C | p.R68P | GVKRISGLIYEETRGVLKVFLENVI[p.R68 P]PDAVTYTEHAKRKTVTAMDVVYALK R | FLENVIPDA,VIPDAVTYT,NVIPDAVTY,LENVIPDAV,FLENV IPDAV,NVIPDAVTY,IPDAVTYTEH,LENVIPDAVT | HNSC |
| HIST2 H2AC | c.89G>C | p.R30P | GKQGGKARAKAKSRSSRAGLQPPVG[p. R30P]PVHRLLRKGNYAERVGAGAPVY MAAV | GLQPPVGPV,FPVGPVHRL,LQPPVGPVH,QPPVGPVHRL,F PVGPVHRL | CESC |
| HIST2 H2BE | c.161G>A | p.G54D | KRKRSRKESYSIYVYKVLKQVHPDT[p.G 54D]DISSKAMGIMNSFVNDIFERIAGE AS | KQVHPDTDI | LUSC |
| HIVEP 3 | c.1601de lC | p.P534f s | LSSHSEKTKPEQSLLSLQHPPSTAP[p.P5 34fs]LCLS* | LQHPPSTAPL,HPPSTAPLCL | STAD |
| HIVEP 3 | c.1660de lC | p.H554 fs | PSTAPPVPLLRSHSMPSAACTISTP[p.H 554fs]TTPSEVATPSMTISPTPKP* | SMTISPTPK,STPTTPSEV,EVATPSMTI,TPSMTISPT,TPSEV ATPS,SEVATPSMT,PSMTISPTPK,TPSEVATPSM,SEVATPS MTI | STAD |
| HLA-A | c.233A>G | p.Q78R | DDTQFVRFDSDAASQRMEPRAPWIE[p. Q78R]REGPEYWDQETRNVKAQSQTD RVDLG | WIEREGPEY,IEREGPEYW,PWIEREGPEY | BLCA, PRAD |
| HLA-C | c.312C>A | p.N104 K | EGPEYWDRNTQIYKAQAQTDRESLR[p. N104K]KLRGYYNQSEAGSHTLQSMYG CDVGP | QTDRESLRK,SLRKLRGYY,KLRGYYNQS,SLRKLRGYYN,KLR GYYNQSE,RESLRKLRGY,ESLRKLRGYY | CESC |
| HLA-DMA | c.250G>A | p.E84K | LSEAYDEDQLFFDFSQNTRVPRLP[p.E 84K]KFADWAQEQGDAPAILFDKEFCE WMI | RLPKFADWA,NTRVPRLPK,RVPRLPKFA,TRVPRLPKF | CRC |
| HLA-DMA | c.706_707i nsG | p.A236 fs | YTAIAYWVPRNALPSDLLENVLCGV[p. A236fs]GLWPGCAGHHRGHCSHHLLP EALLR* | HLLPEALLR,RGHCSHHLL,SHHLLPEAL,LENVLCGVGL,HHR GHCSHHL,CSHHLLPEAL | LUAD |
| HLA-DPB1 | c.340_341i nsA | p.G114 fs | NSQKDILEEKRAVPDRMCRHNYELG[p. G114fs]EAHDPAAPSPA* | ELGEAHDPA,HNYELGEAH,RHNYELGEAH,YELGEAHDPA | CESC |
| HLA-DQB2 | c.740G>A | p.R247 H | AQSKMLSGIGGFVLGLIFLGLGLII[p.R2 47H]HHRGQKGPRGPPPAGNISAMIQS GER | LIIHHRGQK,GLIIHHRGQK | PRAD |
| HLA-DQB2 | c.748G>A | p.G250 S | KMLSGIGGFVLGLIFLGLGLIIRHR[p.G2 50S]SQKGPRGPPPAGNISAMIQSGERA QA | LIIRHRSQK,RHRSQKGPR,GLIIRHRSQK | PRAD |
| HLCS | c.1084G>A | p.E362 K | LPPSSNIVQTPEDFNLLKSSNFRRY[p.E3 62K]KVLREILTTLGLSCDMKQVPALITPL Y | KSSNFRRYK,RYKVLREIL,SSNFRRYKV,NPRRYKVLR,SNFRR YKVL,RRYKVLREI,KVLREILTTL,KSSNFRRYKV,SSNFRRYKVL, SNFRRYKVLR,RYKVLREILT,FRRYKVLREI,RRYKVLREIL | CRC |
| HLX | c.34T>A | p.S12T | MFAAGLAPFVA[p.S12T]TNFSLWSAAY CSSAGPGGCSFPLDPA | ATNFSLWSA,PFYATNFSL,FYATNFSLW,LAPFYATNF,TNFS LWSAA,GLAPFYATNF,PFYATNFSLW,ATNFSLWSAA,TNFS LWSAAY,YATNFSLWSA,APFYATNFSL | HNSC |
| HLX | c.693C>G | p.N231 K | GRPAGVHLSGLQPSAGQFFASLDPI[p. N231K]KEASAILSPLNSNPRNSVQHQF QDTF | KEASAILSP,DPIKEASAI,QFFASLDPIK,KEASAILSPL,DPIKEA SAIL | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| HMCN1 | c.398C>A | p.S133Y | RELYVQGGDCPEMSIGAIKIALEI[p.S133Y]YLPGSFIYVFTDARSKDYRLTHEVLQ | YLPGSFIYV, IYLPGSFIY, AIKIALEIY, EIYLPGSFI, LEIYLPGSF, IK IALEIYL, YLPGSFIYVF, IYLPGSFIYV, AIKIALEIYL, GAIKIALEIY, EIYLPGSFIY, ALEIYLPGSF, LEIYLPGSFI | UCEC |
| HMG20A | c.744G>C | p.E248D | EEFLNHSKAREAELRQLRKSNMEFE[p.E248D]DRNAALQKHVESMRTAVEKLEVDVIQ | MEPEDRNAA, MEPEDRNAAL | CRC |
| HNF1B | c.1250C>T | p.T417M | GHNLLSPDGKMISVSGGGLPVSTL[p.T417M]MNIHSLSHNPQQSQNLIMTPLSGVM | GLPPVSTLM, STLMNIHSL, LMNIHSLSH, MNIHSLSHH, PPVS TLMNI, LMNIHSLSH, LMNIHSLSHH, GGLPPVSTLM, LPPVS TLMNI | GBM |
| HNF1B | c.906C>G | p.N302K | GVSPSKAHGLGSNLVTEVRVYNWFA[p.N302K]KRRKEEAFRQKLAMDAYSSNQTHSLN | RVYNWFAKR, VYNWFAKRR, FAKRREEA, AKRRKEEAF, RV YNWFAKRR, EVRVYNWFAK, WFAKRRKEEA, FAKRRKEEAF | KIRC |
| HOOK1 | c.1083de\|A | p.L361fs | QVKTLQEFTNMMYMHNTVSLEEELKK[p.L361fs]QMQHVHN* | LEEELKKQM, LKKQMQHVH, EELKKQMQHV | STAD |
| HOXA5 | c.31G>T | p.G11C | MSSYFVNSFC[p.G11C]CRYPNGPDYQLHNYGDHSSVSEQFRD | FVNSFCCRY, CRYPNGPDY, YFVNSFCCR, YPNGPDYQ, SYFVNSFCCR | LUAD |
| HOXD10 | c.452A>G | p.Y151C | AEVPSYQRLVPESCPVENPEVPVPG[p.Y151C]CFRLSQTYATGKTQEYNNSPEGSSTV | CFRLSQTYA, EVPVPGCFR, VPVPGCFRL, GCFRLSQTY, EVPV PGCFRL, NPEVPVPGCF | HNSC |
| HOXD8 | c.201G>C | p.Q67H | GRHAAAAALQLYGNSAAGFPHAPP[p.Q67H]HAHAHPHPSPPPSGTGCGGREGRGQE | FPHAPPHAH, AGFPHAPPH, AGFPHAPPHA, FPHAPPHAHA | KIRP |
| HOXD8 | c.364de\|C | p.P122fs | GSPAAAYQAAPPPPHPPPPPPPP[p.P122fs]RAAGLPVTGSPRSFTDTITYRDSRFLRPSKRPSWYNILTVNRPVVILARTQTT* | FTDTITYRD, RSFTDTITY, KRPSWYNIL, ITYRDSRFL, TYRDSR FLR, DSRFLRPSK, SFTDTITYR, DTITYRDSR, WYNILTVNR, NIL TVNRPV, TVNRPVVIL, SPRSFTDTI, RPSKRPSWY, SKRPSWY NI, RSFTDTITYR, ITYRDSRFLR, RDSRFLRPSK, RFLRPSKRPS, VNRPVVILAR, DSRFLRPSKR, SWYNILTVNR, TVNRPVVILA, L PVTGSPRSF, SPRSFTDTIT, RPSWYNILTV, FLRPSKRPSW, SK RPSWYNIL, YNILTVNRPV | STAD |
| HPD | c.852_853de\|AG | p.R284fs | GGAGVQHIALKTEDIITAIRHLRER[p.R284fs]PGVLICSLHVLSLHVLQTTAGEAEDGDQGEGEH* | GVLICSLHV, VLICSLHVL, SLHVLQTTA, VLQTTAGEA, HLRER PGVL, RPGVLICSL, RERRPGVLIC, HLRERPGVLI, RHLRERPGVL, RERRPGVLICS | UCEC |
| HPS3 | c.1403C>T | p.S468L | NHIILLTKAEPEAIPERRQSPKRLL[p.S468L]LRKDTSVKIKIPPVAEAGWNLYIVNT | LLLRKDTSV, LLLRKDTSVK, RQSPKRLLL, RLLLRKDTSV, LLRKD TSVKI, LLLRKDTSVK, RQSPKRLLLR, QSPKRLLLRK, RRSQPKR LLL | CRC |
| HPS3 | c.2436G>C | p.K812N | VACLPDVVLQELFFKLTSQYIWRLS[p.K812N]NRQPPDTTPLRTSEDLINACSHYGLI | QYIWRLSNR, SQYIWRLSN, SQYIWRLSNR, NRQPPDTTPL | HNSC |
| HPSE2 | c.174G>T | p.K58N | LHLSLSSQAGDRRPLPVDRAAGLKE[p.K58N]NTLILLDVSTKNPVRTVNENFLSLQL | GLKENTLIL, LKENTLILL, GLKENTLILL, RAAGLKENTL, KENTLI LLDV | CRC |
| HRAS | c.181C>A | p.Q61K | IEDSYRKQVVIDGETCLLDILDTAG[p.Q61K]KEEYSAMRDQYMRTGEGFLCVFAINN | LDTAGKEEY, AGKEEYSAM, ILDTAGKEEY, DTAGKEEYSA | THCA |
| HRAS | c.182A>G | p.Q61R | IEDSYRKQWIDGETCLLDILDTAG[p.Q61R]REEYSAMRDQYMRTGEGFLCVFAINN | LDTAGREEY, AGREEYSAM, ILDTAGREEY, AGREEYSAMR, D TAGREEYSA | THCA |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| HRAS | c.34G>A | p.G12S | MTEYKLVVVGA[p.G12S]SGVGKSALTIQLIQNHFVDEYDPTIE | LVVVGASGV, KLVVVGASGV, YKLVVVGASG | HNSC |
| HRAS | c.35G>A | p.G12D | MTEYKLVVVGA[p.G12D]DGVGKSALTIQLIQNHFVDEYDPTIE | LVVVGADGV, VVGADGVGK, KLVVVGADGV, VVVGADGVGK | BLCA, HNSC |
| HRAS | c.35G>C | p.G12A | MTEYKLVVVGA[p.G12A]AGVGKSALTIQLIQNHFVDEYDPTIE | LVVVGAAGV, VVGAAGVGK, YKLVVVGAAG, KLVVVGAAGV, VVVGAAGVGK, GAAGVGKSAL | HNSC |
| HRAS | c.38G>T | p.G13V | MTEYKLVVVGAG[p.G13V]VVGKSALTIQLIQNHFVDEYDPTIED | KLVVVGAGV, VVVGAGVGK, KLVVVGAGVV, VVVGAGVVG, K, YKLVVVGAGV | HNSC |
| HRC | c.1317_1318insC | p.P439fs | PHHHHRVPREEDEEVSAELGHQAP[p.P439fs]QPQAKPPR* | HQAPQPQAK, AELGHQAPQ | KIRC |
| HRCT1 | c.275A>C | p.H92P | LGIFHHHRPGHVSHVPNVGLHHHH[p.H92P]PPRHTPHHLHHHHPRHHPR | GLHHHPPR, PPRHTPHHL, VGLHHHPPR, HPPRHTPHHL, HHHPPRHTPH | BLCA |
| HRNR | c.1de|A | p.M1fs | [p.M1fs]CLNSYKASSLSSMFSTNMPPSMGSMIR* | NMPPSMGSM, SYKASSLSS, KASSLSSMF, MPPSMGSMI, LN SYKASSL, YKASSLSSM, LSSMFSTNM, FSTNMPPSM, SMFST NMPP, SLSSMFSTNM, CLNSYKASSL, SMFSTNMPPS, NMP PSMGSMI, SYKASSLSSM, KASSLSSMFS, YKASSLSSMF, MFS TNMPPSM, NMPPSMGSM | OV |
| HRNR | c.7615G>A | p.G2539S | QHGSGSSQSSGYGRQSGSGSQSPGH[p.G2539S]SQRGSSGRQSPSYGRHGSGSGRSSSS | HSQRGSGSR | CESC |
| HRSP12 | c.359G>A | p.R120Q | IYKQYFKSNFPARAAYQVAALPKGS[p.R120Q]QIEIEAVAIQGPLTTASL* | SQIEIEAVA, LPKGSQIEI, AALPKGSQI, SQIEIEAVAI, ALPKGSQIEI | CRC |
| HS3ST1 | c.859G>A | p.E287K | RDRCLHESKGRAHPQVDPKLLNKLH[p.E287K]KYFHEPNKKFFELVGRTFDWH* | KLLNKLHKY, HKYFHEPNK, LLNKLHKYF, KLLNKLHKYF, KYFH EPNKKF, LHKYFHEPNK | CRC |
| HS3ST3A1 | c.1195G>T | p.G399W | EIDREVVRRLREFYRPFNLKFYQMT[p.G399W]WHDFGWDG* | FYQMTWFIDF, NLKFYQMTW, LKFYQMTWFI, YQMTWFIDF G, QMTWHDFGW, FNLKFYQMT, KFYQMTWHDF, YQMT WHDFGW | LUAD |
| HSD17B1 | c.937G>A | p.G313S | VPAKARAGAEAGGGAGPGAEDEAGR[p.G313S]SAVGDPELGDPPAPQ* | AEDEAGRSA, RSAVGDPEL, AEDEAGRSAV, GRSAVGDPEL | ACC |
| HSD17B6 | c.627C>G | p.F209L | EAFSDILRREIQHFGVKISIVEPGY[p.F209L]LRTGMTNMTQSLERMKQSWKEAPKHI | YLRTGMTNM, SIVEPGYLR, YLRTGMTNMT, ISIVEPGYLR, G YLRTGMTNM, VEPGYLRTGM | LUAD |
| HSF4 | c.505C>T | p.R169W | QALRGVQESTEARLRELRQQNEILW[p.R169W]WEVVTLRQSHGQQHRVIGKLIQCLFG | ILWWEVVTL, RQQNEILWW, LWWEVVTLR, NEILWWEVV, WEVVTLRQS, QQNEILWWEV, ILWWEVVTLR, EILWWEVV TL, WEVVTLRQSH, NEILWWEVVT | TGCT |
| HSPA13 | c.253G>T | p.V85L | DENGHISIPSMVSFTDNDVYVGYES[p.V85L]LELADSNPQNTIYDAKRFGIKIFTAE | DVVVGYESL, YVGYESLELA, VVVGYESLEL | LUAD |
| HSPA4L | c.1447C>T | p.R483C | RIGSFFIQNVFPQSDGDSSKVKVKV[p.R483C]CVNIHGIFSVASASVIEKQNLEGDHS | KVKVKVCVN, KVKVCVNIH, VCVNIHGIF, CVNIHGIFSV, SSK VKVKVCV, KVKVKVCVNI, KVKVCVNIHG, VKVCVNIHGI, KV CVNIHGIF | UCEC |
| HSPBAP1 | c.845G>T | p.R282L | HYVESIDPVTVSINSWIELEEDHLA[p.R282L]LVEEAITRMLVCALKTAENPQNTRAW | HLALVEEAI, LEEDHLAIV, ALVEEAITRM, IELEEDHLQL | LUAD |
| HTR2A | c.656C>T | p.S219L | LKIIAWTISVGISMPIPVFGLQDD[p.S219L]LKVFKEGSCLLADDNFVLIGSFVSFF | LQDDLKVFK, GLQDDLKVF, PVFGLQDDLK, GLQDDLKVFK, I PVFGLQDDL, FGLQDDLKVF, LKVFKEGSCL | UCEC |
| HTR3B | c.706C>T | p.R236C | SVSSTYSILQSSAGGFAAIQFNVVM[p.R236C]CRHPLVYVVSLLIPSIFLMLVDLGS | VVMCRHPLV, IQFNVVMCR, VMCRHPLVV, MCRHPLVYV, N VVMCRHPL, VMCRHPLVVV, VMCRHPLVY, QIQFNVVMC | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| HTR5A | c.454C>T | p.R152C | ASIWNVTAIALDRYWSITRHMEYTL[p.R152C]CTRKCVSNVMIALTWALSAVIS LAPL | R,NVVMCRHPLV,AQIQFNVVMC,IQFNVVMCRH,FNVVM CRHPL CTRKCVSNV,HMEYTLCTR,YTLCTRKCV,RHMEYTLCT,HME YTLCTRK,CTRKCVSNVM,MEYTLCTRKC | CRC |
| HTR5A | c.894G>T | p.W298C | DTWREQKEQRAALMVGILIGVFVLC[p.W298C]CIPFFLTELISPLCSCDIPAIWKSI F | VLCCIPFFL,CIPFFLTEL,VFVLCCIPF,FVLCCIPFF,FVLCCIPFF L,CIPFFLTELI,VFVLCCIPFF,GVFVLCCIPF | LUAD |
| HTRA3 | c.1208A>G | p.Q403R | DFPEVSSGIVVQEVAPNSPSCQRGGI[p.Q403R]RDGDIIVKVNGRPLVDSSELQEA VLT | GIRDGDIIVK | GBM |
| HYAL4 | c.664G>A | p.D222N | AFMKETIKLGIKSRPKGLWGYYLYP[p.D222N]NCHNYNVYAPNYSGSCPEDEVL RNNE | YLYPNCHNY,YPNCHNYNV,GLWGYYLYPN,YLYPNCHNYN, YYLYPNCHNY,LYPNCHNYNV,YPNCHNYNV | TGCT |
| HYDIN | c.1352G>A | p.R451Q | NPLEAKLYQQTIYCDILGREIRLPL[p.R451Q]QIKGEGMGPKIHFNFELLDIGKVFT G | EIRLPLQIK,REIRLPLQI,QIKGEGMGPK,LPLQIKGEGM | CRC |
| HYDIN | c.2816G>A | p.R939Q | PELNLGAHFSLDTHYFHFKLLINKGR[p.R939Q]QIQQLFWMNDSFRPQAKLSKKG RVKK | RQIQQLFWM,KLINKGRQI,KGRQIQQLF,KGRQIQQLFW,F KLINKGRQI,NKGRQIQQLF,RQIQQLFWMN | CRC |
| HYDIN | c.3559C>T | p.R1187C | VHYPNLSFETKELDFGCILNDTELI[p.R1187C]YVTITNCSPLVVKFRWFFLVNDE EN | LNDTELICY,TELICYVTI,ILNDTELICY,DTELICYVTI,TELI CYVTIT | CRC |
| HYOU1 | c.472C>T | p.R158C | TVHFQISSQLQFSPEEVLGMVLNYS[p.R158C]CSLAEDFAEQPIKDAVITVPVFFN QA | MVLNYSCSL,VLNYSCSLA,YSCSLAEDF,GMVLNYSCSL,MVL NYSCSLA,NYSCSLAEDF | CRC |
| IARS2 | c.2494C>T | p.R832C | YCEKENDPKRRSCQTALVEILDVIV[p.R832C]CSFAPILPHLAEEVFQHIPYIKEPKS | VIVCSFAPI,CSFAPILPH,ILDVIVCSF,ILDVIVCSFA,VIVCSFA PIL,DVIVCSFAPI,EIlDVIVCSF,CSFAPILPHL | SKCM |
| IBA57 | c.390C>A | p.S130R | RTLYDVILYGLQEHSEVSGFLLECD[p.S130R]RSVQGALQKHLALYRIRRKVTVEP HP | FLLECDRSV,RSVQGALQK,LECDRSVQGA | ACC |
| IBTK | c.3638de1A | p.K1213fs | PVNAWASSLHSVSSKSFRDFLLEEK[p.K1213fs]SLLLAIVQAIMSKKFLLKELKILR HQKLSDALPMVPQDQKATIFQIYHF* | FLLEEKSLL,LLEEKSLLL,SLLLAIVQA,LLLAIVQAI,AIMSKKFLL, FLLKELKIL,KLSDALPMV,LLAIVQAIM,AIVQAIMSK,IVQAI MSKK,IMSKKFLLK,KFLLKELKI,ATIFQIYHF,ELKILRHQK,LLK ELKILR,VPQDQKATI,VQAIMSKKF,SKKFLLKEL,LKILRHQKL, RHQKLSDAL,QKLSDALPM,QKATIFQIY,EEKSLLLAI,LEEKS LLLA,FLLEEKSLLL,SLLLAIVQAI,LLLAIVQAIM,LLEEKSLLLA, AIVQAIMSKK,AIMSKKFLLK,LAIVQAIMSK,IVQAIMSKKF,K ATIFQIYHF,KSLLLAIVQA,MSKKFLLKEL,DQKATIFQIY,VPQ DQKATIF,ELKILRHQKL,HQKLSDALPM,RDFLLEEKSL,LEEK SLLLAI,VQAIMSKKFL,KKFLLKELKI,LRHQKLSDAL,EEKSLLL AIV,LPMVPQDQKA | STAD |
| IDE | c.110de1A | p.K37fs | ALPSTPRSVLGARLPPPERLCGFQK[p.K37fs]RLTAK* | GFQKRLTQK,CGFQKRLTQK | STAD |
| IDH1 | c.394C>G | p.R132G | VFREAIICKNIPRLVSGWVKPIIIG[p.R132G]GHAYGDQYRATDFWPGPGKVEIT YT | PIIIGGFIAY,GGHAYGDQY,KPIIIGGHAY,IGGHAYGDQY | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| IDH1 | c.394C>T | p.R132C | VFREAIICKNIPRLVSGWVKPIIIG[p.R13 2C]CHAYGDYRATDFVVPGPGKVEITY T | PIIIGCHAY, GCHAYGDQY, KPIIIGCHAY, IGCHAYGDQY | LAML,LIHC, MM,SKCM |
| IDH1 | c.395G>A | p.R132H | VFREAIICKNIPRLVSGWVKPIIIG[p.R13 2H]HHAYGDYRATDFVVPGPGKVEIT YT | PIIIGHHAY, GHHAYGDQY, KPIIIGHHAY, IGHHAYGDQY | GBM,LAML, PRAD |
| IDH2 | c.419G>A | p.R140Q | TITPDEARVEEFKLKMWKSPNGTI[p.R 140Q]QNILGGTVFREPIICKNIPRLVPG WT | IQNILGGTV, QNILGGTVF, SPNGTIQNI, TIQNILGGTV, SPNG TIQNIL, IQNILGGTV | LAML |
| IDH2 | c.515G>A | p.R172K | VFREPIICKNIPRLVPGWTKPITIG[p.R17 2K]KHAHGDYKATDFVADRAGTFKM VFT | WTKPITIGK, KHAHGDQYK, GKHAHGDQY, IGKHAHGDQY | LAML |
| IDUA | c.1120A>C | p.T374P | DNAFLSYHPHPPAQR TLTARFQVNN[p. T374P]PRPPHVQLLRKPVLTAMGLLAL LDEE | NPRPPHVQL, FQVNNPRPP, TARFQVNNPR, QVNNPRPPH V, NPRPPHVQLL, FQVNNPRPPH | ACC |
| IDUA | c.99T>G | p.H33Q | AALLALLASLLAAPPVAPAEAPHLV[p. H 33Q]QVDAARALWPLRRFWRSTGFCPP LPH | HLVQVDAAR, VQVDAARAL, AEAPHLVQV, HLVQVDAARA, APHLVQVDAA, VQVDAARALW | KIRP |
| IER5 | c.580C>G | p.R194G | SRAARRPCGCPLGGEDPPGTPAATP[p. R194G]GAACCCAPQPAEDEPPAPPAV CPRKR | TPAATPGAA, TPAATPGAAC | KIRP |
| IFNA10 | c.236T>C | p.V79A | KDRHDFPRIPQEEFDGNPQFQKAQAIS[p. V79A]ALHEMIQQTFNLFSTEDSSAAW EQSL | ALHEMIQQT, AISALHEMI, KAQAISALH, QAISALHEM, QKA QAISAL, FQKAQAISAL, QAISALHEMI, AQAISALHEM, ALHE MIQQTF | GBM, LUSC |
| IFNA10 | c.238C>T | p.L80F | DRHDFPRIPQEEFDGNQFQKAQAISV[p. L80F]FHEMIQQTFNLFSTEDSSAAWEQ SLL | KAQAISVFH, QAISVFHEM, QKAQAISVF, AQAISVFHEM, VF HEMIQQTF, QAISVFHEMI, FQKAQAISVF | GBM |
| IFT140 | c.1990G>A | p.E664K | VDEGLKNYVPVNHFWDQSEPRLFVC[p. E664K]KAVQETPRSQPQSANGQPQD GRAGPA | QSEPRLFVCK, EPRLFVCKAV, SEPRLFVCKA | HNSC |
| IFT172 | c.2509G>A | p.A837T | YERAGDLFEKIHNPQKALECYRKGN[p. A837T]TFMKAVELARLAFPVEVKLEE AWGD | CYRKGNTFM, KGNTFMKAV, NTFMKAVEL, CYRKGNTFMK, TFMKAVELAR, NTFMKAVELA, LECYRKGNTF, RKGNTFMK AV | STAD |
| IFT172 | c.2831C>T | p.A944V | AQHYASLQEYEIAEELYTKGDRTKD[p.A 944V]VIDMYTQAGRWEQAHKLAMKC MRPED | RTKDVIDMY, DVIDMYTQA, RTKDVIDMYT | CRC |
| IGF2BP2 | c.556A>T | p.T186S | SSPSPPQRAQRGDHSSREQHAPGG[p. T186S]SSQARQIDFPLRILVPTQFVGAII GK | SSQARQIDF, GSSQARQIDF | CLL |
| IGF2R | c.3942_3943insG | p.T1314fs | HKVAGLLTQKLTYENGLLKMNFTGG[p. T1314fs]GHLP* | KMNFTGGGH, MNFTGGGHL, KMNFTGGGHL, LKMNFTGG GH | STAD |
| IGHMBP2 | c.1843C>A | p.R615S | FLAEDRRINVAVTRARRHVAVICDS[p.R 615S]STVNNHAFLKTLVEYFTQHGEVR TAF | AVICDSSTV, STVNNHAFL, SSTVNNHAF, STVNNHAFLK, DSS TVNNHAF | LUAD |
| IGJ | c.230G>A | p.R77Q | KCARITSRIIRSSEDPNEDIVERNI[p.R77 Q]QIIVPLNNRENISDPTSPLRTRFVYH | QIIVPLNNR, DIVERNIQI, VERNIQIIV, RNIQIIVPL | CRC |
| IK | c.268_269dele|GA | p.E90fs | DPAARRKKKSYYAKLRQQEIERER[p.E 90fs]ASREVPGSCQGTERMSEQRL* | EIERERASR, REVPGSCQG, TERMSEQRL, RQQEIERERA, IER ERASREV, REVPGSCQGT | UCEC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| IKZF3 | c.485T>G | p.L162R | KRSHTGERPFQCNQCGASFTQKGNL[p. L162R]RRHIKLHTGEKPFKCHL CNYAC QRRD | KGNLRRHIK, SFTQKGNLR, FTQKGNLRR, ASFTQKGNLR, KG NLRRHIKL, SFTQKGNLRR, NLRRHIKLHT, TQKGNLRRHI | CLL |
| IL17B | c.100C>T | p.R34W | FLLTISIFLGLGQPRSPKSKRKGQG[p.R3 4W]WPGPLAPGPHQVPLDLVSRMKPY ARM | GQGWPGPLA, RKGQGWPGPL, WPGPLAPGPH | BRCA |
| IL17RA | c.2409_241 0insC | p.Q803fs | PYEEEQRQSVQSDQGYISRSSPQPP[p. Q803fs]RGTHGNGGRGRGAGPREA GPATLSRGPGEPEEPPAAAAFPPAAEEL GLGHDGVRVRGAQCMRAAPQGPPRS | GLGHDGVRV, RAAPQGPPR, RGRGAGPR, RVRGAQCMR, GPREAGPAT, VRVRGAQCM, EEPPAAAAF, REAGPATLS, ISR SSPQPPR, GVRVRGAQCM, RVRGAQCMRA, GPREAGPATL, APQGPPRSQL, AAFPPAAEEL, EELGLGHDGV | CRC |
| IL17RA | c.1091_109 2insG | p.L364fs | KEASSTPSWGIVLAPLSLAFLVLGG[p.L3 64fs]NMDAQTVQTQNWKSRWSDCA MASSSRLSILSQVK* | RLSILSQVK, QTVQTQNWK, KSRWSDCAM, MASSSRLSI, AQ TVQTQNW, CAMASSSRL, ASSSRLSIL, SRLSILSQV, FLVLGG NMDA, AMASSSRLSI, KSRWSDCAMA, SSRLSILSQV, TVQT QNWKSR, MASSSRLSIL, LAFLVLGGNM, VQTQNWKSRW, WKSRWSDCAM, DAQTVQTQNW | CLL |
| IL1R2 | c.149T>G | p.F50C | DDWGLDTMRAIQVFEDEPARIKCPL[p. F50C]CEHFLKFNYSTAHSAGLTLTIWYW TRQ | RIKCPLCEH, IKCPLCEHF, CEHFLKFNY, RIKCPLCEHF, CPLCE HFLKF, CEHFLKFNYS | KIRC |
| IL1RAPL2 | c.1940C>T | p.T647M | KHEIPATTLPVPSLGNHHTYCNLPL[p.T 647M]MLLNGQLPLNNTLKDTQEFHRN SSLL | MLLNGQLPL, YCNLPLML, HTYCNLPLM, LMLLNGQLPL, H TYCNLPLML, TYCNLPLML, LPLMLLNGQL, HHTYCNLPLM | CRC |
| IL2 | c.308G>T | p.R103M | CLEEELKPLEEVLNLAQSKNFHLRP[p.R1 03M]MDLISNINVIVLELKGSETTMCEY A | RPMDLISNI, NFHLRPMDL, SKNFHLRPM, QSKNFHLRPM, K NFHLRPMDL, MDLISNINVI | LUAD |
| IL25 | c.502_503d el|TG | p.C168fs | HGEKGTHKGYCLERRLYRVSLACVC[p.C 168fs]AAPCDGLAGPAGGWSLFGKPG ARCTTTCHEGPGCPDAWPL* | AGGWSLFGK, SLFGKPGAR, GPAGGWSLF, HEGPGCPDA, SL ACVCAAPC, RVSLACVCAA, WSLFGKPGAR, GPGCPDAWPL, LAGPAGGWSL, HEGPGCPDAW | KIRP |
| IL3 | c.268G>A | p.A90T | DILMENNLRRPNLEAFNRAVKSLQN[p. A90T]TSAIESILKNLLPCLPLATAAPTRH P | TSAIESILK, KSLQNTSAI, NTSAIESIL, LQNTSAIESI, NTSAI ESILK, AVKSLQNTSA, VKSLQNTSAI | CRC |
| IL32 | c.643C>A | p.P215T | LWKQFQSFCCSLSELFMSSFQSYGA[p. P215T]TRGDKEELTPQKCCSEPQSSK* | SYGATRGDK, SFQSYGATR, SSFQSYGAT, FQSYGATRG, SSF QSYGATR, QSYGATRGDK | LUAD |
| IL32 | c.653_654i nsG | p.D218fs | QFQSFCCSLSELFMSSFQSYGAPRG[p.D 218fs]EQGGADTPEVL* | APRGEQGGA | SKCM |
| IL5RA | c.139C>A | p.L47I | LLPDEKISLLPPVNFTIKVTGLAQV[p.L47 I]ILQWKPNPDQEQRNVNLEYQVKINA P | GLAQVILQW, GLAQVILQWK, IKVTGLAQVI, TGLAQVILQW | CRC |
| IL6ST | c.647C>A | p.P216H | FVNIEVWVEAENALGKVTSDHINFD[p. P216H]HVYVKPNPPHNLSVINSEELSS ILK | TSDHINFDH, HINFDHVYK, DHINFDHVY, TSDHINFDHV, HI NFDHVYKV, SDHINFDHVY | MM |
| IL7R | c.161C>T | p.S54L | DLEDAELDDYSFSCYSQLEVNGSQH[p.S 54L]LLTCAFEDPDVNITNLEFEICGALVE NGSQHLL | EVNGSQHLL, SQHLLTCAF, LEVNGSQHL, GSQHLLTCAF, LEV NGSQHLL | LUSC |
| ILF3 | c.1450G>A | p.E484K | VKVLQDMGLPTGAEGRDSSKGEDSA[p. E484K]KETEAKPAVVAPAPVVEAVSTP SAAF | SSKGEDSAK, KETEAKPAV, KETEAKPAVV, GEDSAKETEA | BLCA |
| INADL | c.4018C>G | p.P1340A | KLVFIRNEDAVNQMAVTPFPVPSSS[p. P1340A]ASSIEDQSGTEPISSEEDGSVE VGIK | FPVPSSSAS, VPSSSASSI, TPFPVPSSSA, FPVPVPSSSASS | LUSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| INF2 | c.1581del C | p.S527fs | PLLPGMGWGPPPPPPLLPCTCSPP[p. S527fs]WREAWRRSSWPRWTMAWA QHGSPAIGG* | SWPRWTMAW, AWRRSSWPR, RSSWPRWTM, SSWPRWT MA, WPRWTMAWA, WAQHGSPAI, REAWRRSSW, WRRSS WPRW, AWAQHGSPA, AQHGSPAIG, LPCTCSPPW, AWRRS SWPRW, SSWPRWTMAW, RSSWPRWTMA, MAWAQHGS PA, CSSPWREAWR, EAWRRSSWPR, WTMAWAQHGS, WP RWTMAWAQ, LLPCTCSPPW, WREAWRRSSW, RRSSWPR WTM, AWAQHGSPAI | STAD |
| ING1 | c.658G>T | p.A220 S | DECYERFSRETDGAQKRRMLHCVQR[p. A220S]SLIRSQELGDEKIQIVSQMVELV ENR | MLHCVQRSL, RSLIRSQEL, RMLHCVQRS, RMLHCVQRSL, M LHCVQRSLI, RSLIRSQELG | LUAD |
| INMT | c.167G>T | p.G56V | PSPEAEMLKFNLECLHKTFGPGGLQ[p. G56V]VDTLIDIGSGPTIYQVLAACDSFQ DI | LQVDTLIDI, GLQVDTLIDI, KTFGPGGLQV | LUAD |
| INMT | c.635C>T | p.S212 F | LKPGGHLIVTTVTLRLPSYMVGKREF[p.S 212F]FCVALEKEEVQAVLDAGFDIEQL LH | EFFCVALEK, YMVGKREFF, GKREFFCVA, KREFFCVAL, REFF CVAL, MVGKREFFC, MVGKREFFCV, SYMVGKREFF, GKR EFFCVAL, REFFCVALEK | SKCM |
| INPP5 D | c.1568G>A | p.R523 Q | SFMFNGTSLGFVNSHLTSGSEKKLR[p.R 523Q]QNQNYMNILRFLALGDKKLSPF NITH | RQNQNYMNI, KLRQNQNYM, KKLRQNQNY, KLRQNQNYM N, RQNQNYMNIL, KKLRQNQNYM | CRC |
| INPP5 K | c.787C>T | p.R263 C | EGRLLFPPTYKFDRNSNDYDTSEKK[p.R 263C]CKPAWTDRILWRLKRQPCAGPD TPIP | KCKPAWTDR, SEKKCKPAW | CRC |
| INPPL 1 | c.1478C>T | p.T493 M | VFGTQENSVGDREWLDLLRGGLKEL[p. T493M]MDLDYRPIAMQSLWNIKVAVL VKPEH | LMDLDYRPI, LKELMLDLY, ELMDLDYRPI, GLKELMLDLY, LL RGGLKELM, MDLDYRPIAM | HNSC |
| INPPL 1 | c.2921del C | p.A974 fs | APREEPLTPRLKPEGAPEPEGVAAP[p.A 974fs]HPRTASITLPTTSLKGSRTSCCPRS HPRLPGPLSHLHPPRTKWPLQCLLHSLGT TGTLVWERGVLQMRSLEAHCPLQTFHL HHCRTQPSSCPPAWILYQGQWSGAVV GLRPVAHHLPRPIQGLHCPQQAPHQPAL SWGKWPVGMTGPARCCRWPRR* | RLPGPLSHL, SLGTTGTLV, YQGQWSGAV, ALSWGKWPV, VL QMRSLEA, GLRPVAHHL, HLPRPIQGL, ITLPTTSLK, LSHLPPR TK, TTGTLVWER, QTFHLHHCR, HQPALSWGK, MTGPARCC R, AWILYQGQW, SWGKWPVGM, RTASITLPT, GSRTSCCPR, RTSCCPRSH, RSHPRLPGP, RTKWPLQCL, RSLEAHCPL, RPVA HHLPR, PARCCRWPR, SCPPAWILY, EGVAAPHPR, SCCPRS HPR, WSGAVVGLR, APHPRTASI, HPRTASITL, HPRLPGPLS, L PPRTKWPL, CPQAPHQPA, APHQPALSW, WPVGMTGPA, L QMRSLEAH, EAHCPLQTF, SHLPPRTKW, TKWPLQCLL, LLHS LGTTG, HSLGTTGTL, LGTTGTLVW, RGVLQMRSL, TQPSSCCP PA, SSCPPAWIL, ILYQGQWSG, GQWSGAVVG, VAHHLPRPI, GLHCPQAPH, PQAPHQPAL, EPEGVAAPH, CPLQTFHLH, Q PSSCPPAW, QPALSWGKW, LEAHCPLQT, SSCPPAWILY, HL PPRTKWPL, ILYQGQWSGA, YQGQWSGAVV, GQWSGAVV GL, LLHSLGTTGT, SITLPTTSLK, TSCCPRSHPR, GTTGTLVWE R, RTASITLPTT, KGSRTSCCPR, RSHPRLPGPL, RTKWPLQCLL, RTQPSSCPPA, PARCCRWPRR, LQTFHLHHCR, QWSGAVV GLR, HSLGTTGTLV, APHPRTASIT, CPRSHPRLPG, HPRLPGP LSH, WPLQCLLHSL, CPQAPHQPAL, LEAHCPLQTF, LVWERG VLQM, ASITLPTTSL, LSHLPPRTKW, LHSLGTTGTL, SLGTTGT LVW, LQMRSLEAHC, MRSLEAHCPL, QPSSCPPAW, HQPA LSWGKW, LSWGKWPVGM, WERGVLQMRS, QPSSCPPAWI | STAD |
| INPPL 1 | c.3460del C | p.P115 4fs | SEVDVAPAGPARSALLPGPLLELQPP[p.P 1154fs]GDCPRTMAGPSASLHPASGRA | TMAGPSASL, SLHPASGRA, ASLHPASGR, RASRKTWQR, RT MAGPSAS, ASRKTWQRR, KTWQRRLRA, WQRRLRACR, RL | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| INTS12 | c.1A>G | p.M1V | SRKTWQRRLRACRAGGPAGWARQA* | RACRAGG, RACRAGGPA, HPASGRASR, CPRTMAGPS, GPSASLHPA, SGRASRKTW, RTMAGPSASL, RASRKTWQRR, ASRKTWQRRL, KTWQRRLRAC, RLRACRAGGP, ELQPPGDCPR, SASLHPASGR, TWQRRLRACR, CPRTMAGPSA, WQRRLRACRA, TMAGPSASLH, ASGRASRKTW | MM |
| INTS4 | c.1378T>G | p.M1V | [p.M1V]VAATVNLELDPIFLKALGFLHSKSKD | VAATVNLEL | TGCT |
| INTS4 | c.1378T>G | p.S460A | MRKISNNITLREDQLDTVLAVLEDS[p.S460A]ARDIREALHELLCCTNVSTKEGIHLA | VLAVLEDSA, SARDIREAL, SARDIREALH, DSARDIREAL | UCEC |
| INTS7 | c.2818C>T | p.R940C | GIVWKTGPRTTIFVKSLEDPYSQQI[p.R940C]CLQQQAQQPLQQQQQRNAYTRF* | DPYSQQICL, QQICLQQQQA | UCEC |
| INTS7 | c.317G>T | p.R106I | LCVLKVTQQSEKHLEKILNVDEFVK[p.R106I]IIFSVIHSNDPVARAITLRMLGSLAS | FVKIIFSVI, EFVKIIFSV, DEFVKIIFS, ILNVDEFVKI, EFVKIIFSVI, DEFVKIIFSV | CESC |
| INVS | c.2396G>A | p.R799K | WKPSRRHDTEPKAKCAPQKRRTQEL[p.R799K]KGGRCSPAGSSRPGSARGEAVHAGQN | PQKRRTQELK, ELKGGRCSPA | STAD |
| INVS | c.2444del G | p.R815fs | KRRTQELRGGRCSPAGSSRPGSARG[p.R815fs]RRSMLGRILPTIVHQETK* | SMLGRILPT, MLGRILPTI, SARGRRSML, RGRRSMLGR, RSMLGRILP, GSARGRRSM, RRSMLGRIL, SMLGRILPTI, MLGRILPTIV, ILPTIVHQET, SSRPGSARGR, SARGRRSMLG, RGRRSMLGRI, RSMLGRILPT | STAD |
| IPO11 | c.2532del T | p.S844fs | ERYPVVMSTYLGVMGRVLLQNTSFF[p.S844fs]LHYLMRWPINLIRRWTSFWEI* | LLQNTSFFL, YLMRWPINL, LMRWPINLI, TSFFLHYLM, SFFLHYLMR, FFLHYLMRW, RRWTSFWEI, LQNTSFFLH, QNTSFFLHY, NTSFFLHYL, LHYLMRWPI, NLIRRWTSF, LIRRWTSFW, WPINLIRRW, NTSFFLHYLM, VLLQNTSFFL, FLHYLMRWPI, YLMRWPINLI, TSFFLHYLMR, SFFLHYLMRW, HYLMRWPINL, RWPINLIRRW, LMRWPINLIR, LQNTSFFLHY, INLIRRWTSF, NLIRRWTSFW, IRRWTSFWEI | CRC |
| IRAK3 | c.800G>A | p.R267Q | PYMRNGTLFDRLQCVGDTAPLPWHI[p.R267Q]QIGILIGISKAIHYLHNVQPCSVICG | IQIGILIGI, APLPWHIQI, WHIQIGILI, LPWHIQIGI, QIGILIGIS K, TAPLPWHIQI, LPWHIQIGIL | CRC |
| IREB2 | c.1256G>A | p.R419Q | HLEHTGFSKAKLESMETYLKAVKLF[p.R419Q]QNDQNSSGEPEYSQVIQINLNSIVPS | FQNDQNSSG | MM |
| IRF4 | c.368A>G | p.K123R | RCALNKSNDFEELVERSQLDISDPY[p.K123R]RVYRIVPEGAKKGAKQLTLEDPQMSM | ISDPYRVYR, RVYRIVPEG, DISDPYRVY, DPYRVYRIV, QLDISDPYRV, RVYRIVPEGA, SQLDISDPYR, DISDPYRVYR, LDISDPYRVY | STAD |
| IRS4 | c.1771_1772insG | p.G591fs | GHGSGGGQGPGDGHGSGGGKNSGG G[p.G591fs]QRLRKWERIRW* | GQRLRKWER, RLRKWERIR, RLRKWERIRW, GKNSGGGQRL | PAAD |
| IRS4 | c.63_65del GGC | p.21_22AA>A | MASCSFTRDQATRRLRGAAAAAAA[p.21_22AA>A]LAAVVTTPLLSSGTPTALIGTGSSCPGA | RGAAAAAAAL | ACC |
| IRX3 | c.1265T>C | p.L422P | LVSAPLGKFPAWTNRPFPGPPPGPR[p.L422P]PHPLSLLGSAPPHLLGLPGAAGHPAA | PPGPRPHPL, GPRPHPLSL, GPRPHPLSLL | |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| IRX6 | c.1274C>T | p.A425V | CDESSCCIPKAFGNPKFALQGLPLNC[p.A425V]VPCPRRSEPVVQCQYPSGAEAG* | PLNCVPCPR, ALQGLPLNCV, VPCPRRSEPV | STAD |
| ISX | c.256C>T | p.R86C | AASGSGLEKPPKDQPQEGRKSKRRV[p.R86C]CTTFTTEQLHELEKLFHFTHYPDVHI | KSKRRVCTT, CTTFTTEQL, SKRRVCTTF, RRVCTTFTT, KSKRRVCTTF | SKCM |
| ISX | c.5G>T | p.C2F | M[p.C2F]FAEVGPALCRGMERNSLGCCEAPKKL | MFAEVGPAL | LUSC |
| ITGA10 | c.2006G>A | p.R669Q | PIVHLTPSLEVTPQAISWQRDCRR[p.R669Q]QGQEAVCLTAALCFQVTSRTPGRWDH | CRRQGQEAV, RQGQEAVCL, RRQGQEAVCL, ROGQEAVCLT | HNSC |
| ITGA4 | c.2018C>T | p.T673M | YLAVGSMKTLMLNVSLFNAGDDAYE[p.T673M]MTLHVKLPVGLYFIKILELEEKQINC | MTLHVKLPV, DAYEMTLHV, YEMTLHVKL, NAGDDAYEM, A YEMTLHVKL, DAYEMTLHVK, EMTLHVKLPV, FNAGDDAYE M, YEMTLHVKLP | CRC |
| ITGA4 | c.2700C>A | p.F900L | GIVRFLSKTDKRLLYCIKADPHCLN[p.F900L]LLCNFGKMESGKEASVHIQLEGRPSI | HCLNLLCNF, CLNLLCNFGK, IKADPHCLNL | CRC |
| ITGA5 | c.143C>A | p.A48D | PPLLPLLLLLLPPPPRVGGFNLDAE[p.A48D]DPAVLSGPPGSFFGFSVEFYRPGTDG | NLDAEDPAV | KICH |
| ITGA8 | c.1846G>T | p.G616C | TEFRDKLSPINISLNYSLDESTFKE[p.G616C]CLEVKPILNYYRENIVSEQAHILVDC | STFKECLEV, TFKECLEVK, KECLEVKPI, DESTFKECL, CLEVKPI LNY, STFKECLEVK, ESTFKECLEV, KECLEVKPIL | LUAD |
| ITGAX | c.2054G>A | p.R685H | KRSKNLLGSRDLQSSVTLDLALDPG[p.R685H]HLSPRATFQETKNRSLSRVRVLGLKA | GHLSPRATF | LUSC |
| ITGAX | c.848G>A | p.R283H | TDGKKEGDSLDYKDVIPMADAAGII[p.R283H]HYAIGVGLAFQNRNSWKELNDIASKP | GIIHYAIGV, DAAGIIHYA, ADAAGIIHY, IHYAIGVGL, MADAA GIIHY, IIHYAIGVGL, HYAIGVGLAF, DAAGIIHYAI, IHYAIGVG LA | LUAD |
| ITGB1 | c.1132C>A | p.L378I | PKSAVGTLSANSNVIQLIIDAYNSI[p.L378I]ISSEVILENGKLSEGVTISYKSYCKN | LIIDAYNSI, QLIIDAYNS, AYNSISSEVI, DAYNSISSEV | STAD |
| ITGB1 | c.472G>A | p.D158N | LKFKRAEDYPIDLYYIMDLSYSMKD[p.D158N]NLENVKSLGTDLMNEMRRITSDFRIG | SMKDNLENV, LSYSMKDNL, YSMKDNLENV, SMKDNLENVK | HNSC |
| ITGB8 | c.21_22insT | p.A7fs | MCGSALAFF[p.A7fs]YRCICLPAKRPARSRLVPLGSLGVFTCSWTGPR* | CGSALAFFY, ALAFFYRCI, LVPLGSLGV, GSALAFFYR, FTCSWT GPR, FYRCICLPA, RSRLVPLGS, CLPAKRPAR, RPARSRLVP, VPLGSLGVF, PARSRLVPL, AKRPARSRL, SRLVPLGSL, SLGVF TCSW, RLVPLGSLGV, FYRCICLPA, CGSALAFFY, FYRCICLP AK, RSRLVPLGSL, MCGSALAFFY, VFTCSWTGPR, RPARSRL VPL, LAFFYRCICL, GSLGVFTCSW, SALAFFYRCI | STAD |
| ITIH1 | c.760G>T | p.G254W | KGHVLFRPTVSQQQSCPTCSTSLLN[p.G254W]WHFKVTYDVSRDKICDLLVANNHFAH | SLLNWHFKV, TSLLNWHFK, STSLLNWHF, LNWHFKVTY, ST SLLNWHFK, CSTSLLNWHF, LLNWHFKVTY, TSLLNWHFKV | LUAD |
| ITIH2 | c.2524C>G | p.L842V | TLDKEMSFSVLLHRVWKKHPVNVDF[p.L842V]VGIYIPPTNKFSPKAHGLIGQFMQEP | VNVDFVGIY, NVDFVGIYI, HPVNVDFVG, VGIYIPPTNK, PVN VDFVGIY, HPVNVDFVGI | LUAD |
| ITK | c.586G>A | p.E196K | PEETVVIALYDYQTNDPQELALRRN[p.E196K]KEYCLLDSSEIHWWRVQDRNGHEGYV | LALRRNKEY, RRNKEYCLL, KEYCLLDSS, ALRRNKEYCL, ELAL RRNKEY | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ITK | c.86G>T | p.R29L | FILLEQLIKKSQQKRRTSPSNFKV[p.R29L]LFFVLTKASLAYFEDRHGKKRTLKGS | SNFKVLFFV, VLFFVLTKA, KVLFFVLTK, NFKVLFFVLT, SPSNFK VLF, KVLFFVLTKA, TSPSNFKVLF, RTSPSNFKVL, SPSNFKVLF F, SNFKVLFFVL, LFFVLTKASL | LUAD |
| ITM2C | c.499G>A | p.E167K | ADIIHDFQRGLTAYHDISLDKCYVI[p.E167K]KLNTTIVLPRNFWELLMNVKRGT YL | YVIKLNTTI, VIKLNTTIV, SLDKCYVIK, IKLNTTIVL, SLDKCYVIK L, YVIKLNTTIV, SLDKCYVIK, CYVIKLNTTI | UCEC |
| ITPR1 | c.4707G>T | p.M15 69I | CGLERDKFDNKTVTFEEHIKEEHNM[p.M1569I]CHYLCFIVLVKVKDSTEYTGPE SYVA | NMCHYLCFI, HNMCHYLCF, KEEHNMCHY, CHYLCFIVL, EEH NMCHYL, NMCHYLCFIV, HNMCHYLCFI, IKEEHNMCHY, KE EHNMCHYL, MCHYLCFIVL | TGCT |
| ITPR2 | c.1073C>A | p.P358Q | RDGVPPTSKKKRQAGEKIMYTLVSV[p.P358Q]QHGNDIASLFELDATTLQRADC LVPR | IMYTLVSVQ, VQHGNDIAS, IMYTLVSVQH, VQHGNDIASL, QHGNDIASLF | LUAD |
| IWS1 | c.2404de\|A | p.S802fs | FQATSKKGISRLDKQMRKFTDIRKK[p.S802fs]ADLHTQ* | RKFTDIRKKA | STAD |
| JAG1 | c.1384G>A | p.A462T | DCLPGWMGQNCDININDCLGQCQND[p.A462T]TSCRDLVNGYRCICPPGYAG DHCERD | TSCRDLVNGY, CQNDTSCRDL | CRC |
| JAK1 | c.928G>A | p.V310I | IFETSMLLISSENEMMWFHSNDGGN[p.V310I]ILYYEVMVTGNLGIQWRHKPNV VSVE | SNDGGNILY, NILYYEVMV, ILYYEVMVT, HSNDGGNIL, GNIL YYEVM, HSNDGGNILY, SNDGGNILYY, FHSNDGGNIL | CRC |
| JAKMIP2 | c.848G>T | p.R283I | MSSPKREIPGRAGDGSEHCSSPDLR[p.R283I]INQKRIAELNATIRKLEDRNTLLG DE | INQKRIAEL, RINQKRIAEL, SSPDLRINQK | UCEC |
| JARID2 | c.1180_1181insG | p.G394fs | VNHTISGKTESSNAKTRKQVLSLGG[p.G394fs]GVQVHWARRQWPQGQWQVE PKVMH* | GQWQVEPKV, QWPQGQWQV, GVQVHWARR, RQWPQGQWQ, WQVEPKVMH, VLSLGGGVQV, RQWPQGQWQV, KQVLSLGGGV, LSLGGGVQVH, SLGGGVQVHW, VQVHWAR RQW, ARRQWPQGQW, GQWQVEPKVM | STAD |
| JARID2 | c.1266de\|G | p.V422fs | TGPAVNGLKVSGRLNPKSCTKEVGG[p.V422fs]GSCGRACSCGRGCGTPRGDW KRHTRRRSRSRPPRR* | CGRACSCGR, KRHTRRRSR, HTRRRSRSR, RRSRSRPPR, RSRS RPPRR, EVGGGSCGR, KRHTRRRSRP, HTRRRSRSRP, RRRSRSRPPR | STAD |
| JHDM1D | c.289de\|A | p.R97fs | HHAVFDIDLYHCPNCAVLHGSSLMKK[p.R97fs]GGTGTDMTTQKLMMVPNQCK LELELSLRNYALESSQVPMK* | MMVPNQCKL, MTTQKLMMV, LMMVPNQCK, VPNQCKLE L, ELSLRNYAL, KKGGTGTDM, TDMTTQKLM, NQCKLELEL, C KLELELSL, ALESSQVPM, LELSLRNYA, GTDMTTQKLM, LM MVPNQCKL, SLMKKGGTGT, KLMMVPNQCK, ALESSQVPM K, GTGTDMTTQK, YALESSQVPM, MKKGGTGTDM, TDMTT QKLMM, LELELSLRNY, LELSLRNYAL, RNYALESSQV | STAD |
| JHDM1D | c.938G>A | p.R313H | TSVWYHVLWGEKIFYLIKPTDENLA[p.R313H]HYESWSSSVTQSEVFFGDKVDKC YKC | PTDENLQHY, AHYESWSSS, DENLQHYES, KPTDENLAHY, AH YESWSSSV, DENLAHYESW | GBM |
| JMJD1C | c.3592C>A | p.R1198S | SHSVTTFRNDCRSPTHLTVSSTNTL[p.R1198S]SSMPALHRAPVFHPPIHHSLERK EGS | LSSMPALHR, SSMPALHRA, NTLSSMPAL, SSTNTLSSM, TLS SMPALHR, STNTLSSMPA, VSSTNTLSSM | LUAD |
| JMJD4 | c.32C>T | p.A11V | MRAGPEPQAL[p.A11V]VGQKRGALRL LVPRLVLTVSAPAEVR | LVGQKRGAL, LVGQKRGALR | ACC |
| JMY | c.2429_2464de\|CACCA CCACCTCCC CCACCTCCT | p.PPPPP PPPPPP PP811de\| | LNNNLEPCSVTINPLPSLPPTPPP[p.PPPPPPPPPPP811de\|]LPVAKDSGPETLE KDLPRKEGNEKRIPKSASAPSAHLFDSS QLVSARKKLRKTAEGLQRRR | SPLPPTPPPL, LPPTPPLPV | PAAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| JPH1 | CCCCCTCCC CCAC c.1183G>A | p.A395 T | ARTKVEIANSRTAHARAKADAADQA[p. A395T]TLAARQECDIARAVARELSPDFY QPG | DAADQATLA, TLAARQECDI, DAADQATLAA, KADAADQAT L | GBM |
| JPH3 | c.1299G>C | p.Q433 H | EARIARITAKEFSPSFQHRENGLEY[p.Q4 33H]HRPKRQTSCDDIEVLSTGTPLQQE SP | NGLEYHRPKR, YHRPKRQTSC | CESC |
| JSRP1 | c.275T>C | p.V92A | EKEPAARGTPGTGKERLKAGASPRS[p. V92A]APARKKAQTAPPLQPPPPPALS EEL | KAGASPRSA, SPRSAPARK, RSAPARKKA, ASPRSAPARK/GA SPRSAPAR, APARKKAQTA, LKAGASPRSA | KIRP |
| JUP | c.1880C>T | p.S627 L | RVAAGVLCELAQDKEAADAIDAEGA[p. S627L]LAPLMELLHSRNEGTATYAAAV LFRI | ALAPLMELL, AEGALAPLM, GALAPLMEL, DAIDAEGAL, DAI DAEGALA, DAEGALAPL | CESC |
| KAL1 | c.907G>A | p.V303I | SKHFRSSKDPSAPPAPANLRLANST[p.V 303I]INSDGSVTVTIVWDLPEEPDIPVH HY | STINSDGSV, NLRLANSTI, TINSDGSVTV, NSTINSDGSV, ANL RLANSTI | CRC |
| KANK 3 | c.1076G>A | p.R359 H | VEADAMVTEALLGLPAAAERELELL[p. R359H]HASLEHQRGVSELLRGRLRELEE ARE | AERELELH, RELELLHAS, LLHASLEHQR, AERELELLHA, RELE LLHASL, LELLHASLEH | ACC |
| KANK 4 | c.757T>C | p.S253 P | VQEGAEPPEGVVKVPNHLPLPGPPF[p. S253P]PFQNVLVVLEDKEDEHNAREAE VLFT | PLPGPPPF, PFQNVLVVL, FPFQNVLVV, GPPFPFQNV, LPLP GPPPF, GPPFPFQNVL, FPFQNVLVVL, PFPFQNVLV | KIRC |
| KANSL 3 | c.1127G>A | p.G376 E | IGWNTGALVACHVSVMEYVTAVVCL[p. G376E]EPLLTVDGPRGDVDDPLLDM KTPVL | AVVCLEFPL, CLEFPLLTV, VTAVVCLEF, LEFPLLTVD, YVTAVV CLEF, TAVVCLEFPL | TGCT |
| KBTB D13 | c.242C>T | p.A81V | GGFRATLQVLRGDRPALAAEDELLQ[p. A81V]VVECAAFLQAPALARFLEHNLTS DNC | QVVECAAFL, LQVVECAAF, AEDELLQVV, LLQVVECAAF, LQ VVECAAFL, DELLQVVECA | ACC |
| KBTB D6 | c.1325_132 6insG | p.G442 fs | LADRLLCREGMDVAYLNGYIYILGG[p.G 442fs]ARPYYWS* | YILGGARPY, IIGGARPYY, YIYILGGAR, ILGGARPYYW, IYILG GARPY, YILGGARPYY, GYIYILGGAR | STAD |
| KBTB D8 | c.1645G>A | p.V549I | YLKLVLFQNKLHLFVRATQVTVEEH[p.V 549I]IFRTSRKNSLYQYDDIADQWMKV YET | VTVEEHIFR, TQVTVEEHI, IFRTSRKNSL, QVTVEEHIFR, TQVT VEEHIF | CRC |
| KCNA 1 | c.1126G>T | p.G376 C | EAESHFSSIPDAFWWAVVSMTTVGY[p. G376C]CDMYPVTIGGKIVGSLCAIAGV LTIA | TTVGYCDMY, VGYCDMYPV, MTTVGYCDMY, TVGYCDMY PV, GYCDMYPVTI, SMTVGYCDM | LUAD |
| KCNA 3 | c.1244C>T | p.A415 V | TLKASMRELGLLIFFLFIGVILFSS[p.A41 5V]VYFAEADDPTSGFSSIPDAFWWA VV | ILFSSVVYF, GVILFSSVV, VILFSSVVY, SSVVYFAEA, FIGVILFS SV, ILFSSVVYFA, FSSVVYFAEA, VILFSSVVYF, GVILFSSVVY | CRC |
| KCNB 2 | c.692G>A | p.R231 H | STIALSLNTLPELQETDEFGQLNDN[p.R 231H]HQLAHVEAVCIAWFTMEYLLRFL SSP | HQLAHVEAV, QLNDNHQLA, GQLNDNHQL, GQLNDNHQL A, HQLAHVEAVC, DEFGQLNDNH | BRCA |
| KCNC 1 | c.1363delA | p.K455f s | VPVIVNNFGMVYSLAMAKQKLPKKK[p. K455fs]RSIFRGHRSWDLPIIVNLS* | KQKLPKKKR, RSWDLPIIV, LPKKKRSIF, SIFRGFIRSW, GHRS WDLPI, WDLPIIVNL, IFRGHRSWDL, KKRSIFRGHR, RGHRS WDLPI, LPKKKRSIFR, RSIFRGHRSW, GHRSWDLPII | STAD |
| KCND 3 | c.1313C>T | p.S438 L | NQRADKRRAQKKARLARIRVAKTGS[p.S4 38L]LNAYLHSKRNGLLNERALELTGTP EEE | SLNAYLHSK, KTGSLNAYL, LNAYLHSKR, IRVAKTGSL, AKTGS LNAY, GSLNAYLHSK, KTGSLNAYLH, SLNAYLHSKR, RIRVAK TGSL, RVAKTGSLNA, VAKTGSLNAY, AKTGSLNAYL | CRC, UCEC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KCNH2 | c.446G>C | p.G149A | MFILNFEVVMEKDMVGSPAHDTNHR[p.G149A]APPTSWLAPGRAKTFRLKLP ALLALT | RAPPTSWLA,NHRAPPTSW,HRAPPTSWL | STAD |
| KCNH8 | c.1365G>A | p.M455I | SSLTSVGFGNVSANTDAEKIFSICT[p.M455I]ILIGALMHALVFGNVTAIIQRMYS EK | KIFSICTIL,ILIGALMHA,SICTILIGA,IFSICTILI,CTILIGALM, IFSICTI,KIFSICTILI,FSICTILIGA,ILIGALMHAL,SICTILI-GAL,AEKIFSICTI,EKIFSICTIL | LUAD |
| KCNJ10 | c.305del|C | p.P102fs | GTWFLFGVVWLVAVAHGDLLELDP[p.P102fs]RPTTPVWYRCTHSLEPSSSPL NPKPPLAMASATSVRNVHWPLCFLLPS WCSPPSWKSSSQVPSWRRLPGPRSGL RPFVSASMQLWPPTMASPAS* | LAMASATSV,SMQLWPPTM,MQLWPPTMA,SLEPSSSPL, NVHWPLCFL,RLPGPRSGL,AMASATSVR,SSSQVPSWR,SS QVPSWRR,VWYRCTHSL,RNVHWPLCF,VHWPLCFLL,SVR NVHWPL,SWCSPPSWK,SWRRLPGPR,SGLRPFVSA,PTTPP VWYR,DRPPTTPPV,SPLNPKPPL,KPPLAMASA,VPSWRRLP G,GPRSGLRPF,WPPTMASPA,FLLPSWCSP,KSSSQVPSW,S QVPSWRRI,LRPFVSASM,FVSASMQLW,ASMQLWPPT,W PLCFLLPS,LPSWCSPPS,LELDPRPTT,FLLPSWCSPP,SMQL WPPTMA,PLAMASATSV,LLPSWCSPPS,GLRPFVSASM,LA MASATSVR,PSWCSPPSWK,KSSSQVPSWR,SSSQVPSWRR, PFVSASMALW,HSLEPSSSPL,SVRNVHWPLC,SWKSSSQV PS,SWRRLPGPRS,RSGLRPFVSA,ASMQLWPPTM,RPTTPP VWYR,MASATSVRNV,TSVRNVHWPL,NVHWPLCFLL,GPR SGLRPFV,RPFVSASMQL,SATSVRNVHW,VRNVHWPLCF,R NVHWPLCFL,WKSSSQVPSW,SQVPSWRRLP,RRLPGPRSG L,MQLWPPTMAS,WPLCFLLPSW,LPSWCSPPSW,DPRPTT PPVW | STAD |
| KCNJ3 | c.1290G>T | p.L430F | KITGRED[p.L430F]FGDLPMKLQRISSVPGNSEEKLVSK T | YSFGDLPMK,AYSFGDLPM,SFGDLPMKL,TTSEKAYSF,KAY SFGDLPM,AYSFGDLPMK,YSFGDLPMKL,STTSEKAYSF,SEK AYSFGDL | LUAD |
| KCNK17 | c.61A>G | p.S21G | MYRPRARAAPEGRVRGCAVP[p.S21G]GTVLLLLAYLAYLALGTGVFWTLEGR | GTVLLLLAY,RVRGCAVPG,CAVPGTVLL,VPGTVLLLL,RVRG CAVPGT,PGTVLLLLAY,RGCAVPGTVL,CAVPGTVLLL,VPGT VLLLLA | ACC |
| KCNK18 | c.68G>T | p.G23V | MEVSGHPQARRCCPEALGKLFP[p.G23V]VLCFLCFLVTYALVGAVVFSAIEDGQ | ALGKLFPVL,KLFPVLCFL,VLCFLCFLV,EALGKLFPV,GKLFPV LCF,FPVLCFLCF,KLFPVLCFLC,LFPVLCFLCF,FPVLCFLCFL,L GKLFPVLCF,GKLFPVLCFL,PEALGKLFPV | LUAD |
| KCNK2 | c.17C>G | p.S6W | MLPSA[p.S6W]WRERPGYRAGVAAPD LLDPKSAAQNS | AWRERPGYR,SAWRERPGY,MLPSAWRER,SAWRERPGYR, AWRERPGYRA,PSAWRERPGY | BLCA |
| KCNK2 | c.497G>T | p.R166L | HWDLGSSFFFAGTVITTIGFGNISP[p.R166L]LTEGGKIFCIIYALLGIPLFGFLLAG | IGFGNISPL,SPLTEGGKIF | LUAD |
| KCNMB2 | c.453T>G | p.N151K | KLLLYHTEETIKINQKCSYIPKCGK[p.N151K]KFEESMSLVNVVMENFRKYQHFSC YS | CGKKFEESM,KKFEESMSL,CSYIPKCGKK,SYIPKCGKKF,KKF EESMSLV | STAD |
| KCNS2 | c.631G>A | p.D211N | SRVFSILSILVVMGSIITMCLNSLP[p.D211N]NFQIPDSQGNPGEDPRFEIVEHFGI A | MCLNSLPNF,CLNSLPNFQI,TMCLNSLPNF | UCEC |
| KCTD20 | c.942del|A | p.L314fs | KLYRFFKYIENRDVAKTVLKERGLK[p.L314fs]TFALELKVTLPVKKLREGLAAGLK SSIIMVNAPSSRCHGKRKKGRVAMWIS SVFEANPSRIW* | KTFALELKV,RVAMWISSV,GLKTFALEL,KLREGLAAG,KVTL PVKKK,IMYNAPSSR,SVFEANPSR,VAMWISSVF,ELKVTLPV K,KSSIIMYNA,SSRCHGKRK,KRKKGRVAM,KGRVAMWIS, GLKSSIIMY,LKERGLKTF,FALELKVTL,LELKVTLPV,KKLREGL AA,LAAGLKSS,AGLKSSIIM,RKKGRVAMW,MWISSVFEA,F | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KCTD21 | c.17C>T | p.T6M | MSDPI[p.T6M]MLNVGGKLYTTSLATLTSFPDSMLGA | EANPSRIW, KERGLKTFA, ALELKVTLPV, KLREGLAAGL, GLA AGLKSSI, AWWISSVFEA, IMYNAPSSRC, SVFEANPSRI, GLKT FALELK, IMYNAPSSR, TFALELKVTL, RVAMWISSVF, VFEAN PSRIW, RGLKTFALEL, SSRCHGKRKK, KGRVAMWISS, AGLK SSIIMY, VTLPVKKKLR, VLKERGLKTF, KERGLKTFAL, LAAGLK SSII, AAGLKSSIIM, GKRKKGRVAM, RKKGRVAMWI, GRVA MWISSV, REGLAAGLKS MSDPIMLNV, MLNVGGKLY, IMLNVGGKL, IMLNVGGKLY | STAD |
| KDELC1 | c.1339C>A | p.L447I | LKWAKDHDEEAKKIAKAGQEFARNNI[p.L447I]IMGDDIFCYYFKLFQEYANLQVSEPQ | IMGDDIFCY, GQEFARNNI, QEFARNNIM, IMGDDIFCYY, NI MGDDIFCY, GQEFARNNIM, RNNIMGDDIF | CRC |
| KDM1B | c.1083C>A | p.F361L | HLSNLEYACGSNLHQVSARSWDHNE[p.F361L]LFAQFAGDHTLLTPGYSVIIEKLAEG | RSWDHNELF, ARSWDHNEL, DHNELFAQF, NELFAQFAG, S ARSWDHNEL, RSWDHNELFA, ARSWDHNELF, WDHNELFA QF | UCEC |
| KDM3B | c.3946del C | p.P1316fs | SLRDLLHSGPGKLPQTPLDTGIPFP[p.P1316fs]RSSLHPQQE* | FPPRSSLHPQ, IPPPRSSIH, TGIPFPRSSL | STAD |
| KDM5A | c.1267C>T | p.P423S | VSSIEEDVIVEYGADISSKDFGSGF[p.P423S]SVKDGRRKILPEEEEYALSGWNLNNM | SVKDGRRKI, DFGSGFSV, KDFGSGFSV, SSKDFGSGFS, KDF GSGFSVK, SVKDGRRKIL | TGCT |
| KEAP1 | c.1408C>T | p.R470C | PERDEWHLVAPMLTRRIGVGVAVLN[p.R470C]CLLYAVGGFDGTNRLNSAECYYPERN | VAVLNCLLY, AVLNCLLYA, VLNCLLYAV, CLLYAVGGF, GVAV LNCLLY, AVLNCLLYAV | LUSC |
| KEAP1 | c.1438G>T | p.G480W | PMLTRRIGVGVAVLNRLLYAVGGFD[p.G480W]WTNRLNSAECYYPERNEWRMITAMNT | LYAVGGFDW, AVGGFDWTNR, LLYAVGGFDW, FDWTNRL NSA | LUSC |
| KEAP1 | c.1807G>T | p.G603W | LDSVECYDPDTDTWSEVTRMTSGRS[p.G603W]WVGVAVTMEPCRKQIDQQNCTC* | RMTSGRSWV, SWVGVAVTM, SGRSWVGVA, TRMTSGRS W, GRSWVGVAV, RSWVGVAVT, MTSGRSWVGV, SGRSWV GVAV, RSWVGVAVTM, VTRMTSGRSW, RMTSGRSWVG | LUAD |
| KEAP1 | c.431C>T | p.S144F | GMEVVSIEGIHPKVMERLIEFAYTA[p.S144F]FISMGEKCVLHVMNGAVMYQIDSVVR | FISMGEKCV, TAFISMGEK, FAYTAFISM, YTAFISMGE, LIEFA YTAF, IEFAYTAFI, RLIEFAYTAF, LIEFAYTAFI, FISMGEKCVL, Y TAFISMGEK, IEFAYTAFIS, EFAYTAFISM | LUAD |
| KEAP1 | c.463G>T | p.V155F | PKVMERLIEFAYTASISMGEKCVLH[p.V155F]FMNGAVMYQIDSVVRACSDFLVQQLD | VLHFMNGAV, FMNGAVMYQ, HFMNGAVMY, CVLHFMN GA, MGEKCVLHF, GEKCVLHFM, LHFMNGAVM, CVLHFMN GAV, FMNGAVMYQI, SMGEKCVLHF, LHFMNGAVMY, VLH FMNGAVM | LUSC |
| KEAP1 | c.779G>T | p.R260L | DDLNVRCESEVFHACINWVKYDCEQ[p.R260L]LRFYVQALLRAVRCHSLTPNFLQMQL | QLRFYVQAL, KYDCEQLRF, LRFYVQALL, QLRFYVQALL, KYD CEQLRFY, WVKYDCEQLR, EQLRFYVQAL, VKYDCEQLRF, CE QLRFYVQA | LUAD |
| KEL | c.1231G>A | p.V411M | RKLSQKLRELTEQPPMPARPWWKC[p.V411M]MEETGTFFEPTLAALFVREAFGPSTR | CMEETGTFF, KCMEETGTF, MKCMEETGTF, KCMEETGTFF | GBM |
| KHDRBS2 | c.608C>T | p.S203L | LNGSEDSGRGRGIRGRGAI[p.S203L]LRGRGGAIPPPPPGRGVLTPRGSTV | RIAPTAPLR, APLRGRGGA, PLRGRGGAI, IRIAPTAPL, GIRIAP TAPL, APLRGRGGAI | LUAD |
| KIAA0020 | c.188A>G | p.K63R | RKVAKEGGPKVTSRNFEKSITKLGK[p.K63R]RGVKQFKNKQQGDKSPKNKFQPANKF | KSITKLGKR, ITKLGKRGV, RGVKQFKNK, LGKRGVKQF, ITKLG KRGVK, LGKRGVKQFK, KLGKRGVKQF | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KIAA0 182 | c.359_360i nsC | p.T120f s | STPKRVPMGPIIVPPGGHSVPSTPP[p.T 120fs]RGDHRSNQNREWCLEE* | HSVPSTPPR,RSNQNREWCL | STAD |
| KIAA0 195 | c.2706de|C | p.I902f s | GLETGWNCHISLTPNGDMPGSEIPP[p.I 902fs]PAPATQAPCMMT* | APATQAPCM,SEIPPPAPA,APATQAPCMM,SEIPPPAPAT, MPGSEIPPPA | STAD |
| KIAA0 240 | c.2683de|A | p.K895f s | PMNHDQPHLVPNHIWSAEGNISKK[p. K895fs]QNALAEH* | ISKKQNALA,NISKKQNAL,KKQNALAEH | STAD |
| KIAA0 528 | c.542G>A | p.R181 Q | YRAVIIHGFVEELVVNEDPEYQWID[p.R 181Q]QIRTPRASNEARQRLISLMSGEL QRK | EYQWIDQIR,WIDQIRTPR,PEYQWIDQI,QWIDQIRTPR,YQ WIDQIRTP,DPEYQWIDQI | CRC |
| KIAA0 556 | c.3244C>T | p.R108 2W | SHSITIDFTHPCHVALIRIWNYNKS[p.R1 082W]IHSFRGVKDITMLLDTQCIFEG EIA | WIHSFRGVK,YNKSWIHSF,KSWIHSFRG,NKSWIHSFR,RIW NYNKSW,WNYNKSWI,NYNKSWIHS,RIWNYNKSWI,KS WIHSFRGV,SWIHSFRGVK,YNKSWIHSFR,IRIWNYNKSW | CRC |
| KIAA0 556 | c.988C>A | p.L330I | FPDQERMCSRPGSRRERPLSATRKT[p.L 330I]ICEAEYPEEDASAVLQAIQVENAA LQ | ATRKTICEA,RKTICEAEY,RPLSATRKTI,TRKTICEAEY | UCEC |
| KIAA0 586 | c.4775de|C | p.A159 2fs | PRWESSATLRFTDAPCQDVSDAAVS[p. A1592fs]DLEDCSQSLSLSTMQEDMES SGADTF* | DVSDAAVSDL,SDLEDCSQSL | STAD |
| KIAA0 907 | c.1337A>C | p.Q446 P | GQSPMGGPFIPAAPVKTALPAGPQP[p. Q446P]PPQPQPPLPSQPQAQKRFTE ELPDE | QPPPQPQPPL | BLCA |
| KIAA0 907 | c.1546_154 7de|AG | p.R516f s | TGFSSQNEIEGAGSKPASSSGKERE[p.R 516fs]GQAVDASTSLSSDWNKNRVR* | TSLSSDWNK,LSSDWNKNR,QAVDASTSL,STSLSSDWNK, SLSSDWNKNR,KEREGQAVDA,REGQAVDAST,GQAVDAST SL,DASTSLSSDW | GBM |
| KIAA1 109 | c.14039T>C | p.L468 0P | SMSLHGNHMTLLACFHGPNFRSKSWA[p. L4680P]PFHLEEPNIAFWTEAQKIWE DGSSDH | RSKSWAPPH,KSWAPFHLE,FRSKSWAPF,SKSWAPPHL,NF RSKSWAPF,RSKSWAPFHL,APFHLEEPNI | CLL |
| KIAA1 109 | c.14810C>A | p.S493 7Y | ITYTTVDWRDFMCNTWHLEPTLRLI[p. S4937Y]YWTGRKIDPVGVDYILQKLGF HHART | RLIYWTGRK,LEPTLRLIY,LIYWTGRKI,EPTLRLIYW,HLEPTL RLIY,RLIYWTGRKI,TLRLIYWTGR | CRC |
| KIAA1 109 | c.4763de|A | p.E158 8fs | ANSLLDRGMQLSGSTNTPYTPLEK[p.E 1588fs]NSLITQMMKH* | NSLITQMMK,EKNSLITQM,KNSLITQMM,TPLEKNSLI,KNS LITQMMK,LEKNSLITQM,EKNSLITQMM | STAD |
| KIAA1 147 | c.446C>T | p.A149 V | YFRKGPPFGLACFANMPVESELERG[p. A149V]VRMKSVGILSPSYTLLYRYMHFL ENQ | GVRMKSVGI,SELERGVRM,VRMKSVGIL,VESELERGV,GVR MKSVGIL,LERGVRMKSV | UCEC |
| KIAA1 211 | c.3608C>A | p.P120 3Q | SVTVELSDSAPPAPLVKEVTKRFST[p.P1 203Q]QDAAPVSTEPAWLALAKRKAKA WSDC | FSTQDAAPV,KRFSTQDAA,VTKRFSTQDA | LUAD |
| KIAA1 211 | c.924de|T | p.R308f s | ERAPREEQQRSLEAPGWEDAERRER[p. R308fs]RSASAWRRRRSEGVCRPRPKR RRGGGWRRTPGWRSGGGRRRRKEDA RRSSKGRRRRRLRDGKSWNSRRRRCRG RPRRWRRLGRAGGARRRRIWGKRRRR ARRTWRTGGGSVSF* | RSASAWRRR,SASAWRRRR,KRRRGGGWR,GWRRTPGWR, GWRSGGGRR,RSGGGRRRR,SGGGRRRRK,RSSKGRRRR,S SKGRRRRR,KGRRRRRLR,RRRRLRDGK,KSWNSRRRR,RRR CRGRPR,RGRPRRWR,RWRRLGRAG,LGRAGGARR,RAG GARRRR,GARRRRIWG,ARRRRIWGK,RRRRIWGKR,RIWG KRRRR,RRRARRTWR,RARRTWRTG,DGKSWNSRR,RPRR WRRLG,RERRSASAW,RLRDGKSW,RRRAARTW,WRTG GGSSV,TGGGSSVSF,AERRERRSA,RTGGGSSVSF,RERRSAS AWR,RSASAWRRRR,AWRRRSEGV,KRRRGGGWRR,RSG GGRRRRK,RSSKGRRRR,SSKGRRRRL,KGRRRRRLRD,RR RRRLRDGK,RLRDGKSWNS,KSWNSRRRRC,NSRRRRCRGR, | CESC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KIAA1211 | c.926_927insG | p.E309fs | RAPREEQQRSLEAPGWEDAERREREE[p.E309fs]GARAPGGGGGAKASAGPGPSGGEAAAGGGRQAGGAEAAGGGGRKMRGGAQKAGGGGG* | RRRRCRGRPR,RRRCRGRPRR,RCRGRPRRW,RGRPRRWRRL,RPRRWRRLGR,RWRRLGRAGG,LGRAGGARRR,RAGGARRRI,GARRRIWGK,RIWGKRRRA,RRPRARRTWR,RARRTWRTGG,TWRTGGGSV,DARRSSKGRR,DGKSWNSRR,R,SWNSRRRCR,RPRPKRRRG,RPKRRRGGGW,ERRERRSASA,RRERRSASAW,RRRLRDGKSW | CESC |
| KIAA1429 | c.413C>T | p.S138F | LRGWYNCLTLAIYGSVDRVISHDRD[p.S138F]FPPPPPPPPQPQPSLKRNPKHAD | RKMRGGAQK,KMRGGAQKA,REREGARAP,RQAGGAEAA,ABRREREGA,RAPGGGGGAK,KMRGGAQKAG,REREGARAPG,RQAGGAEAAG,RKMRGGAQKA | HNSC |
| KIAA1429 | c.4576G>A | p.D1526N | VLSAPESLQNLFNNRTAYVLADVMD[p.D1526N]NQLKSMWFTPFQAEEIDTDLDLVKVD | RVISHDRDF | HNSC |
| KIAA1549 | c.3816G>T | p.L1272F | DGERLSAVKSSDLINKMDLQRAAIIF[p.L1272F]FGYRIQGVIAQPVDRVKRPSPESQSN | VMDNQLKSM,MDNQLKSMW,VLADVMDNQL,DVMDNQLKSM,VMDNQLKSMW,MDNQLKSMWF | LUAD |
| KIAA1751 | c.189G>C | p.L63F | LQEAEDDVDPGHSSSVKELDTDADK[p.L63F]FKKKTAEDRTQAFHLRQNLSALDKMH | RAAIIFGYR,LQRAAIIFG,QRAAIIFGY,AAIIFGYRI,FGYRIQGVI,IIFGYRIQGV,RAAIIFGYRI,FGYRIQGVI,LQRAAIIFGY,MDLQRAAIIF | LUSC |
| KIAA1751 | c.291G>C | p.K97N | TQAFHLRQNLSALDKMHEEQELFTE[p.K97N]NMRGELRACRQRRDLIDKQQEAVAAE | KFKKKTAEDR,KELDTDADKF | KIRC |
| KIAA1755 | c.324A>C | p.Q108H | CLRDEVVHLAPLNPLLLRQGDFYLL[p.Q108H]HVEPQEEQSVCIMIKCLSLDLCTVDK | EQELFTENM,EEQELFTEN,FTENMRGELR,NMRGELRACR,EEQELFTENM,TENMRGELRA | LUAD |
| KIAA1804 | c.1420G>A | p.V474M | AALQQKSQEELLKRREQQLAEREID[p.V474M]MLERELNILIFQLNQEKPKVKKRKGK | RQGDFYLHV,LLRQGDFYLH,RQGDFYLHVE | CRC |
| KIAA1804 | c.1429C>T | p.R477W | QQKSQEELLKRREQQLAEREIDVLE[p.R477W]WELNILIFQLNQEKPKVKKRKGKFKR | MLERELNIL,REIDMLERE,QLAEREIDML,MLERELNILI,QQLAEREIDM,REIDMLEREL,IDMLERELNI | CRC |
| KIAA1967 | c.1243delC | p.P415fs | TGIDLSGCTKWWRFAEFQYLQPGPP[p.P415fs]GGFRQWWCTCRMSGPSCLLWRSGRPCASRKLQRQLPQPRRHKGKRSLLNRHLMPWSKQQTLLDGTQKLQRPPHSRKRTLISQRPLHPP* | EWELNILIF,EIDVLEWEL,DVLEWELNI,LEWELNILI,WELNILIF,VLEWELNILI,ABREIDVLEW,REIDVLEWEL,LEWELNILIF,WELNILIFQL | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KIAA2022 | c.1034G>T | p.C345F | NVRDKTLLMQEDAQFNFFPSVFTT[p.C345F]FPKRESKSGALKQSSDFSQFKVPDVS | SVFTTPKR,TTFPKRESK,PSVFTTPK,FPPSVFTTF,FTTFPK RESK,NFFPSVFTF,FPSVFTTFPK | LUSC |
| KIAA2026 | c.1720C>T | p.R574C | PAKMILDNHDISVEMGVKSNYEIRI[p.R574C]CRPCEIKKTDCCKENLEKPRSPGEVT | RICRPCEIK,ICRPCEIKK,SNVEIRICR,YEIRICRPC,RICRPCEIK, KSNYEIRICR,EIRICRPCEI | UCEC |
| KIAA2026 | c.2069deA | p.K690fs | LEQSLQSHKKLKLTKMRAKKKKKKK[p.K690fs]RN* | RAKKKKKKR | STAD |
| KIDINS220 | c.2552A>G | p.N851S | SNINGHDYMRNIVHLPVFLNSRGLS[p.N851S]SARKFLVTSATNGDVPCSDTTGIQED | FLNSRGLSS,GLSSARKFL,SARKFLVTS,NSRGLSSAR,LSSARKFLV, RGLSSARKF,FLNSRGLSSA,GLSSARKFLV,NSRGLSSARK,RGLSSARKFL,SARKFLVTSA,SRGLSSARKF | TGCT |
| KIF13A | c.3345deA | p.K1115fs | LNCVREBWSDALIKRREYLDEQIKK[p.K1115fs]SAIKQRKQRTMWSGKPSLWSSG* | TMWSGKPSL,KQRTMWSGK,MWSGKPSLW,KQRKQRTM W,RTMWSGKPS,SAIKQRKQR,IKQRKQRTM,YLDEQIKKSA, TMWSGKPSLW,KSAIKQRKQR,AIKQRKQRTM,KQRKQRT MWS,RKQRTMWSGK,KQRTMWSGKP,RTMWSGKPSL,QI KKSAIKQR,IKQRKQRTMW | STAD |
| KIF14 | c.1793G>A | p.R598Q | VFTLVMTQTKTEFVEGEEHDHRITS[p.R598Q]QINLIDLAGSERCSTAHTNGDRLKEG | RITSQINLI,SQINLIDLA,HRITSQINL,HRITSQINLI,SQINLIDL AG | CRC |
| KIF15 | c.754G>C | p.E252Q | TSMNRESSRSHAVFTITIESMEKSN[p.E252Q]QIVNIRTSLLNLVDLAGSERQKDTHA | SMEKSNQIV,KSNQIVNIR,ESMEKSNQI,QIVNIRTSLL,ESM EKSNQIV,IESMEKSNQI,MEKSNQIVNI,NQIVNIRTSL | LUAD |
| KIF16B | c.434G>A | p.R145Q | GLIPRICEGLFSRINETTRWDEASF[p.R145Q]QTEVSYLEIYNERVRDLLRRKSSKTF | SFQTEVSYL,ASFQTEVSY,DEASFQTEV,QTEVSYLEIY,FQTE VSYLEI,EASFQTEVSY,ASFQTEVSYL,DEASFQTEVS | CRC |
| KIF18A | c.49C>T | p.R17C | MSVTEEDLCHHMKVVV[p.R17C]CVRPENTKEKAAGFHKVVHVVDKHLI | HMKVVVCVR,VVCVRPENTK,CVRPENTKEK,HHMKVVVCV R | CRC |
| KIF1B | c.3958C>T | p.R1320W | TVTIIHEKGSELHWKDVRELVVGRI[p.R1320W]WNKPEVDEAAVDAILSLNIISAKYLK | LVVGRIWNK,RELVVGRIW | BRCA |
| KIF20B | c.160G>A | p.E54K | NFDGIKLDLSHEFSLVAPNTEANSF[p.E54K]SKDYLQVCLRIRPFTQSEKELESEG | KSKDYLQVC,FKSKDYLQV,NTEANSFKSK,SFKSKDYLQV,KS KDYLQVCL,EANSFKSDY | UCEC |
| KIF20B | c.2971G>A | p.E991K | NEIETATRSITNNVSQIKLMHTKID[p.E991K]KLRTLDSVSQISNIDLLNLRDLSNGS | LMHTKIDKL,KLMHTKIDK,KLRTLDSVS,TKIDKLRTL,KLMHT KIDKL,HTKIDKLRTL,LMHTKIDKLR | CRC |
| KIF23 | c.1048G>A | p.E350K | KEQITISQLSLVDLAGSERTNRTRA[p.E350K]KGNRLREAGNINQSLMTLRTCMDVLR | RTNRTRAKG,RTRAKGNRL,RTRAKGNLR,RAKGNRLREA | BLCA |
| KIF25 | c.449G>A | p.R150Q | SPGEGGLLPRCLDMIFNSIGSFQAK[p.R150Q]QYVFKSNDRNSMDIQCEVDALLERQK | FQAKQYVFK,SFQAKQYVF,IGSFQAKQY,SFQAKQYVF,KQ YVFKSNDR,SIGSFQAKQY,GSFQAKQYVF | UCEC |
| KIF25 | c.7T>A | p.W3R | MT[p.W3R]RTSGQLQREKQARPGSGAVLAFPDDK | MIRTSGQLQ,RTSGQLQREK,MTRTSGQLQR | PRAD |
| KIF26B | c.3194deC | p.S1065fs | SLQSSRESLNSCGFVEGKPRPMGSP[p.S1065fs]GWASPACPRPRSTSHPALLPRDAKSTPRRGSCRLPPHCLPRARIPAWRLGSPCCSPRCVRPLE* | RLPPHCLPR,TSHPALLPR,RSTSHPALL,RGSCRLPPH,RARIP AWRL,STPRRGSCR,KPRPMGSPG,RPMGSPGWA,CPRPRS TSH,RPRSTSHPA,HPALLPRDA,TPRRGSCRL,LPRARIPAW,I PAWRLGSP,SPRCVRPRL,LPPHCLPRA,RLPHCLPRA,STSH PALLPR,RPRSTSHPAL,KSTPRRGSCR,RARIPAWLG,WAS PACPRPR,LPRARIPAWR,RLGSPCCSPR,KPRPMGSPGW,R | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KIF26B | c.3337G>A | p.V1113M | RCKVYTQKGVLPSPAPLPPSSKDSG[p.V1113M]MASRESLLQPEVRTPPVGMSPQVLKK | PMGSPGWAS, SPACPRPRST, IPAWRLGSPC, MGSPGWASPA | BRCA |
| KIF26B | c.3341C>T | p.A1114V | CKVYTQKGVLPSPAPLPPSSKDSGV[p.A1114V]VSRESLLQPEVRTPPVGMSPQVLKKS | GMASRESLL, SGMASRESL, SSKDSGMASR, LPPSSKDSGM, SGMASRESLL | CRC |
| KIF26B | c.6097G>A | p.A2033T | SKEAMCFNAKLKILEHRQQRIAEVR[p.A2033T]TKYEWLMKELEATKQYLMLDPNKWLS | SSKDSGVVSR | LIHC |
| KIF26B | c.6097G>A | p.A2033T | | RTKYEWLMK, RIAEVRTKY, EVRTKYEWL, AEVRTKYEW, QQRIAEVRTK, RTKYEWLMKE, RQQRIAEVRT, QRIAEVRTKY, AEVRTKYEWL, TKYEWLMKEL, IAEVRTKYEW | |
| KIF27 | c.2775G>T | p.K925N | LDACNLKRRKGSFGSIDHLQKLDEQ[p.K925N]JNKWLDEEVEKVLNQRQELEELEADLK | KLDEQNKWL, EQNKWLDEEV, LQKLLDEQNKW | UCEC |
| KIF9 | c.1438G>A | p.G480R | ISAIQKAGLVDVDGHLVGEPEGQNF[p.G480R]RLGVAPFSTKPGKKAKSKKTFKEPLS | NFRLGVAPF, GQNFRLGVA, RLGVAPFSTK, QNFRLGVAPF, GEPEGQNFRL | LUAD |
| KIF9 | c.1781G>A | p.R594Q | IRPDTPPSKPVAFEEFKNEQGSEIN[p.R594Q]QIFKENKSILNERRKRASETTQHINA | GSEINQIFK, QGSEINQIF, EQGSEINQIF, NQIFKENKSI, NEQGSEINQI | UCEC |
| KIRREL | c.1003delC | p.P335fs | VDPKPTTTDIGSDVTLTCVWVGNPP[p.P335fs]SLLSPGPKRTQIWS* | VWVGNPPSL, SPGPKRTQI, CVWVGNPPSL, SPGPKRTQIW | STAD |
| KIRREL | c.1810G>T | p.G604C | VDLKQDLRCDTIDTREEYEMKDPTN[p.G604C]CYYNVRAHEDRPSSRAVLYADYRAPG | EMKDPTNCY, PTNCYYNVR, MKDPTNCYY, YEMKDPTNC, DPTNCYYN, EMKDPTNCY, YEMKDPTNCY | LUAD |
| KIRREL2 | c.1947delC | p.V649fs | PPSPLGPPGTPTFYDFNPHLGMVPP[p.V649fs]ADFTEPGQAISPHPTLELSPATSNPHPLGPQIWPPGLPSHMLPSPHLATRVSRLTCDIFPMEESWDLQLAIMDCSDF* | HMLPSPHLA, RLTCDIFPM, HLATRVSRL, ATRVSRLTC, LPSPHLATR, ESWDLQLAI, HPTLELSPA, NPHPLGPQI, SPHLATRVS, FPMEESWDL, LAIMDCSDF, LGMVPPADF, GQAISPHPT, QAISPHPTL, SHMLPSPHL, VSRLTCDIF, MEESWDLQL, EPGQAISPH, EESWDLQLA, DIFPMEESW, AISPHPTLEL, HLATRVSRLT, IFPMEESWDL, MLPSPHLATR, ESWDLQLAIM, NPHLGMVPPA, SPATSNPHPL, WPPGLPPSHM, LPSPHLATR, QLAIMDCSDF, HLGMVPPADF, ADFTEPGQAI, GQAISPHPTL, HMLPSPFILAT, RVSRLTCDIF, SRLTCDIFPM, EESWDLQLAI, HPTLELSPAT, NPHPLGPQIW, FPMEESWDLQ, MEESWDLQLA | STAD |
| KIT | c.1669T>G | p.W557G | VAGMMCIIVMLITYKLQKPMYEVQ[p.W557G]GKVVEEINGNNYVIIDPTQLPYDHKW | PMYEVQGKV, VQGKVVEEI, EVQGKVVEEI, KPMYEVQGKV | TGCT |
| KIT | c.2446G>C | p.D816H | RDLAARNILLTHGRITKICDFGLAR[p.D816H]HIKNDSNYVVKGNARLPVKWMAPESI | HIKNDSNYV, RHIKNDSNY, CDFGLARHI, HIKNDSNYVV, ARHIKNDSNY, RHIKNDSNYV | TGCT |
| KIT | c.2446G>T | p.D816Y | RDLAARNILLTHGRITKICDFGLAR[p.D816Y]YIKNDSNYVVKGNARLPVKWMAPESI | ICDFGLARY, YIKNDSNYVV, RYIKNDSNY, DFGLARYIK, CDFGLARYI, YIKNDSNYV, KICDFGLARY, RYIKNDSNYV, ARYIKNDSNY | TGCT |
| KIT | c.2447A>T | p.D816V | RDLAARNILLTHGRITKICDFGLAR[p.D816V]VIKNDSNYVVKGNARLPVKWMAPESI | VIKNDSNYVV, RVIKNDSNY, CDFGLARVI, RVIKNDSNYV, VIKNDSNYV, ARVIKNDSNY | LAML, TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KIT | c.2464A>T | p.N822Y | NILLTHGRITKICDFGLARDIKNDS[p.N822Y]YVVVKGNARLPVKWMAPESIFNCVYT | KNDSYYVVK,SYYVVKGNA,RDIKNDSYY,YVVVKGNAR,DIKNDSYYV,IKNDSYYVV,YVVVKGNARL,LARDIKNDSY,SYYVVKGNAR,DIKNDSYYVI,DSYYVVKGNA | TGCT |
| KIT | c.2466T>G | p.N822K | NILLTHGRITKICDFGLARDIKNDS[p.N822K]YVVVKGNARLPVKWMAPESIFNCVYT | KNDSKYYVK,RDIKNDSKY,IKNDSKYVV,KYVVKGNARL,LARDIKNDSK | TGCT |
| KLC2 | c.1703de|C | p.T568fs | SFGKLRDALRSSEMLVKKLQGGTP[p.T568fs]RSPLTPG* | TPRSPLTPG,LQGGTPRSPL | STAD |
| KLF3 | c.312de|A | p.I1104fs | SLKFPSSHRRASPGLSMPSSSSPPIK[p.I1104fs]NTHPLLQACSPSACRCPCHQ* | LLQACSPSA,QACSPSACR,PPIKNTHPL,SPSACRCPC,LQACSPSAC,SPPIKNTHPL | STAD |
| KLF3 | c.671_672insC | p.S224fs | GIEPQRTDYYPEEMSPPLMNSVSPP[p.S224fs]ASIVARESPFGHRAAWEETFTCGIPGYSKEAEDTQM* | LMNSVSPPA,SVSPPASIV,TFTCGIPGY,NSVSPPASI,FTCGIPGYS,SPFGHRAAW,SIVARESPP,RESPFGHRA,HRAAWEETF,SKEAEDTQM,WEETFTCGI,PLMNSVSPPA,FTCGIPGYSK,VARESPFGHR,EITFTCGIPGY,NSVSPPASIV,ASIVARESPF,LMNSVSPPAS,MNSVSPPASI,RESPFGHRAA,GHRAAWEETF,YSKEAEDTQM | STAD |
| KLF4 | c.1300A>C | p.K434Q | GRRSWPRKRTATHTCDYAGCGKTYT[p.K434Q]QSSHLKAHLRTHTGEKPYHCDWDGCG | KTYTQSSHL,TQSSHLKAH,KTYTQSSHLK,QSSHLKAHLR,GKTYTQSSHL,TQSSHLKAHL | BRCA |
| KLF5 | c.1255G>C | p.E419Q | LRTHTGEKPYKCTWEGCDWRFARSD[p.E419Q]QLTRHYRKHTGAKPFQCCGVCNRSFSR | RSDQLTRHY,FARSDQLTR,DQLTRHYRK,WRFARSDQL,RSDQLTRHY,ARSDQLTRHY | LUAD,LUSC |
| KLF5 | c.353C>T | p.S118L | EKYLTPQLPPVPIIPEHKKYRRDSA[p.S118L]LVVDQFFTDTEGLPYSINMNVFLPDI | KYRRDSALV,SALVVDQFF,KKYRRDSAL,YRRDSALVV,KYRRDSALV,SALVVDQFF,KKYRRDSAL,KKYRRDSALV,RDSALVVDQF | BLCA |
| KLHDC2 | c.962G>C | p.W321S | DAWTYCISKNEWIQFNHPYTEKPRL[p.W321S]SHTACASDEGEVIVFGGCANNLLVHH | KPRLSHTAC,KPRLSHTACA,TEKPRLSHTA | TGCT |
| KLHDC7A | c.1903G>A | p.E635K | DRWDFAPPLPSDTFALAHTATVRAK[p.E635K]KIFVTGGSLRFLLFRFSAQEQRWWAG | HTATVRAKK,TVRAKKIFV,RAKKIFVTG,KIFVTGGSL,KIFVTGGSLR,TVRAKKIFVT,RAKKIFVTGG,HTATVRAKKI,KKIFVTGGSL | SKCM |
| KLHL13 | c.637G>A | p.E213K | FLISGVTLDNCVEVGRIANTYNLTE[p.E213K]MDKYVNSFVLKNFPALLSTGEFLKLP | NLTEMDKYV,EMDKYVNSF,ANTYNLTEM,TEMDKYVNS,MDKYVNSFV,NTYNLTEMDK,TEMDKYVNSF,IANTYNLTEM,MDKYVNSFVL | UCEC |
| KLHL14 | c.693de|C | p.P231fs | KYLVEDVLLLNFEEMRALLDSLPPP[p.P231fs]WSRSWRSSRCPCCGWSTTARPACSMRLTS* | WSRSWRSSR,SWRSSRCPC,TARPACSMR,DSLPPWSR,TTARPACSM,RPACSMRLT,LLDSLPPPW,LPPPWSRSW,TTARPACSMR,RSWRSSRCPC,SWRSSRCPCC,SSRCPCCGWS,STTARPACSM,TARPACSMRL,RPACSMRLTS,ALLDSLPPPW,SLPPPWSRSW,RSSRCPCCGW | STAD |
| KLHL15 | c.554A>G | p.D185G | DNFVPLMSRPDFLSYLSFEKLMSYL[p.D185G]CNDHLSRFPEIELYEAVQSWLRHDRR | MSYLGNDHL,LMSYLGNDH,LGNDHLSRF,FEKLMSYLG,LMSYLGNDHL,YLGNDHLSRF,SYLGNDHLSR | BLCA |
| KLHL28 | c.97G>A | p.E33K | YMLANLTHLHSEQLLQGLNLLRQHH[p.E33K]KLCDIILRVGDVKIHAHKVVLASVSP | KLCDIILRV,LNLLRQHHK,NLLRQHHKL,RQHHKLCDI,GLNLLRQHHK,RQHHKLCDII | UCEC |
| KLHL5 | c.976C>T | p.R326C | QLSQVVEACCKFLMKQLHPSNCLGI[p.R326C]CSFADAQGCTDLHKVAHNYTMEHFME | SNCLGICSF | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KLK2 | c.169C>A | p.P57T | EKHSQPMQVAVVSHGWAHCGGVLVH[p.P57T|TQWVLTAAHCLKKNSQVWL GRHNLFE | VLVHTQWVL, GVLVHTQWV, HTQWVLTAA, TQWVLTAAH, VHTQWVLTAA | CRC |
| KLK2 | c.481G>A | p.E161K | VKVLGLPTQEPALGTTCYASGWGSI[p.E161K]KPEEFLRPRSLQCVSLHLLSNDMCAR | YASGWGSIK, SIKPEEFLR, GSIKPEEFLR, GWGSIKPEEF | CESC |
| KLK6 | c.359G>A | p.R120H | QSSVVRAVIHPDYDAASHDQDIMLL[p.R120H]HLARPAKLSELIQPLPLERDCSANTT | MLLHLARPA, LLHLARPAK, DIMLLHLAR, IMLLHLARPA, LLH LARPAK, MLLHLARPAK, HDQDIMLLHL | GBM |
| KPNA4 | c.86G>A | p.R29Q | NEKLDNQRLKNFKNKGRDLETMRRQ[p.R29Q]QNEVVVELRKNKRDEHLLKRRN VPHE | QQNEVVVEL, TMRRQQNEV, RRQQNEVVV, RQQNEVVVE, TMRRQQNEVV, ETMRRQQNEV, MRRQQNEVVV, RQQNE VVVEL | CRC |
| KPRP | c.1659_1660insC | p.E553fs | YCGPSSYNQGQESGAGCGPGDVFPE[p.E553fs]PEGSGWPWRPRQCLCWSER GSKECLFLKER* | GSKECLFLK, WPWRPRQCL, RPRQCLCWS, SERGSKECL, FPE PEGSGW, EPEGSGWPW, CLCWSERGSK, RGSKECLFLK, EGS GWPWRPR, SERGSKECLF | HNSC |
| KRAS | c.176C>G | p.A59G | PTIEDSYRKQVVIDGETCLLDILDT[p.A59G]GQEEYSAMRDQYMRTGEGFLCVFAI | LDTGGQEEY, GGQEEYSAM, ILDTGGQEEY | MM |
| KRAS | c.180_181TC>AA | p.Q61K | IEDSYRKQVVIDGETCLLDILDTAG[p.Q61K]KEEYSAMRDQYMRTGEGFLCVFAINNT | LDTAGKEEY, AGKEEYSAM, LDTAGKEEY, DTAGKEEYSA | CRC, THCA |
| KRAS | c.182A>G | p.Q61R | IEDSYRKQVVIDGETCLLDILDTAG[p.Q61R]REEYSAMRDQYMRTGEGFLCVFAINN | LDTAGREEY, AGREEYSAM, ILDTAGREEY, AGREEYSAMR, D TAGREEYSA | MM, TGCT |
| KRAS | c.182A>T | p.Q61L | IEDSYRKQVVIDGETCLLDILDTAG[p.Q61L]LEEYSAMRDQYMRTGEGFLCVFAIN | LDTAGLEEY, AGLEEYSAM, ILDTAGLEEY, LLDILDTAGL, DTA GLEEYSA | CRC, LUAD, TGCT |
| KRAS | c.183A>C | p.Q61H | IEDSYRKQVVIDGETCLLDILDTAG[p.Q61H]HEEYSAMRDQYMRTGEGFLCVFAINN | LDTAGHEEY, AGHEEYSAM, ILDTAGHEEY, DTAGHEEYSA | LUAD, PAAD, STAD |
| KRAS | c.183A>T | p.Q61H | IEDSYRKQVVIDGETCLLDILDTAG[p.Q61H]HEEYSAMRDQYMRTGEGFLCVFAINN | LDTAGHEEY, AGHEEYSAM, ILDTAGHEEY, DTAGHEEYSA | MM, TGCT |
| KRAS | c.34G>A | p.G12S | MTEYKLVVVGA[p.G12S]SGVGKSALTIQLIQNHFVDEYDPTIE | LVVVGASGV, KLVVVGASGV, YKLVVVGASG | CRC, STAD |
| KRAS | c.34G>C | p.G12R | MTEYKLVVVGA[p.G12R]RGVGKSALTIQLIQNHFVDEYDPTIE | ARGVGKSAL, KLVVVGARGV, VVVGARGVGK, EYKLVVVGA R, GARGVGKSAL, RGVGKSALTI | MM, PAAD, TGCT |
| KRAS | c.34G>T | p.G12C | MTEYKLVVVGA[p.G12C]CGVGKSALTIQLIQNHFVDEYDPTIE | LVVVGACGV, VVVGACGVGK, KLVVVGACGV, VVVGACGVGK | CRC, LUAD |
| KRAS | c.35G>A | p.G12D | MTEYKLVVVGA[p.G12D]DGVGKSALTIQLIQNHFVDEYDPTIE | LVVVGADGV, VVVGADGVGK, KLVVVGADGV, VVVGADGVGK | CESC, CRC, GBM, KIRP, LAML, LUAD, MM, PAAD, STAD, UCEC, UCS |
| KRAS | c.35G>C | p.G12A | MTEYKLVVVGA[p.G12A]AGVGKSALTIQLIQNHFVDEYDPTIE | LVVVGAAGV, VVVGAAGVGK, YKLVVVGAA, KLVVVGAAGV, VVVGAAGVGK, KLVVVGAAG, GAAGVGKSAL | CRC, LUAD, MM, TGCT, UCEC |
| KRAS | c.35G>T | p.G12V | MTEYKLVVVGA[p.G12V]VGVGKSALTIQLIQNHFVDEYDPTIE | LVVVGAVGV, VVVGAVGVGK, YKLVVVGAV, KLVVVGAVGV, VVVGAVGVGK, GAVGVGKSAL | BRCA, CESC, CRC, LUAD, |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KRAS | c.37G>T | p.G13C | MTEYKLVVVGAG[p.G13C]CVGKSALTI QLIQNHFVDEYDPTIED | VVGAGCVGK, KLVVVGAGCV, VVVGAGCVGK | OV,PAAD,TGCT, UCEC,UCS LUAD |
| KRAS | c.38G>A | p.G13D | MTEYKLVVVGAG[p.G13D]DVGKSALT IQLIQNHFVDEYDPTIED | VVGAGDVGK, KLVVVGAGDV, VVVGAGDVGK | CESC,CLL, CRC,DLBCL, LUAD,MM, STAD,UCEC |
| KRAS | c.436G>A | p.A146 T | PSRTVDTKQAQDLARSYGIPFIETS[p.A1 46T]TKTRQRVEDAFYTLVREIRQYRLKK L | ETSTKTRQR, GIPFIETSTK, ETSTKTRQRV | CRC,MM,TGCT |
| KRBA 1 | c.2515A>G | p.R839 G | DRLATALAGLAQEVATMRTQVNRLG[p. R839G]GRPQGPGPMGQASWMWTL PRGPRWAH | RTQVNRLGG, TQVNRLGGR, RTQVNRLGGR | TGCT |
| KRT2 | c.896T>G | p.L299 W | KRTAAENDFVTLKKDVDNAYMIKVE[p. L299W]MQSKVDLLNQEIEFLKVLYDAE ISQI | YMIKVEWQS, MIKVEWQSK, IKVEWQSKV, VEWQSKVDL, N AYMIKVEW, MIKVEWQSKV, YMIKVEWQSK, VEWQSKVDL L | KIRC |
| KRT4 | c.462_463i nsC | p.F154f s | RGNKSISMSVAGSRQGACFGGAGGF[p. F154fs]RHWLWWWIWGLLQW* | WLWWWIWGL, GGFRHWWLM, GFRHWWLWW, FRHW WLWW, RHWWLWWWI, HWWLWWWIW, LWWWIW GLL, WWIWGLLQW, CFGGAGGFR, GGAGGFRHW, WLWW WIWGLL, AGGFRHWWLW, GFRHWWLWWW, RHWWLW WWIW, WWLMWWIWGL, WWWIWGLLQW, FGGAGGFR HW | KIRC |
| KRT6B | c.590T>C | p.L197 P | NKFASFIDKVRFLEQQNKVLDTKWT[p. L197P]PLQEQGTKTVRQNLEPLFEQYIN NLR | VLDTKWTPL, KVLDTKWTPL | CRC |
| KRT8 | c.175T>G | p.S59A | TQKSYKVSTSGPRAFSRSYTSGPG[p.S 59A]ARISSSSFSRVGSSNFRGGLGGGY GG | RSYTSGPGA, GARISSSSF, SYTSGPGAR, YTSGPGARI, RSYTS GPGAR, SYTSGPGAR, GARISSSSFS | ACC,KIRP, LIHC |
| KRTAP 1-1 | c.346A>G | p.I116V | CGTGCGIGGGIGYGQEGSSGAVSTR[p.I 116V]VRWCRPDCRVEGTCLPPCCVS CTPP | VSTRVRWCR, STRVRWCRP, RVRWCRPDC, GAVSTRVRW, AVSTRVRWCR, STRVRWCRPD, RVRWCRPDCR, SGAVSTR VRW | TGCT |
| KRTAP 27-1 | c.372G>T | p.M12 4I | ACQSESSSAGLACVSQPCQSESTQQ[p. M124I]IGFVAQSCQPASLKGNSCPPKT SKSK | CQSESTQQI, ESTQQIGFV, SESTQQIGF, QSESTQQIGF, QQI GFVAQSC, SESTQQIGFV | LUAD |
| KRTAP 4-11 | c.144C>G | p.S48R | TCCRPSCCETTCCRTTYCRPSCCVS[p.S4 8R]RCCRPQCCQSVCCQPTCCRPRCCIS S | VSRCCRPQC | GBM,PRAD |
| KRTAP 4-5 | c.220A>T | p.S74C | VCYQPTCCHPSCCISSCCRPYCCES[p.S7 4C]CCRPCCCQTTCCRTTCCRTTCCCP S | CESCCCRPC | KIRP |
| KRTAP 4-5 | c.272G>T | p.C91F | CRPYCCESSCCRPCCQTTCCRTT[p.C 91F]FRTTCCPSCCVSSCCRPQCCQSV CC | TCCRTTCFR, TTCCRTTCFR | LUAD |
| KRTAP 4-8 | c.188C>G | p.T63S | TCYRPSYSVSCCCRPSCCVSSCCRPQCCQSVCCQP[p.T 63S]SCCCRPSCCVSSCCKPQCCQSVCCQ PT | SVCCQPSCCR | TGCT |
| KRTAP 4-9 | c.53A>T | p.D18V | MVSSCCGSVCSDQGCGQ[p.D18V]VLC QETCCRPSCCETTCCRTTCCRPS | CSDQGCGQV, SDQGCGQVL, QVLCQETCCR | PRAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| KRTAP 5-1 | c.578C>A | p.S193Y | GSCGGSKGGCGSCGGCKGGCGSCGG[p.S193Y]YKGGCGSCGGCGSCGCGVPV CCCSCS | GGCGSCGGY, KGGCGSCGGY | LUAD |
| KSR2 | c.1664C>T | p.T555M | FNLPASHYYKKQQFIFPDVVPVPE[p.T555M]MPTRAPQVILHPVTSNPILEGNP LLQ | MPTRAPQVI, FPDVVPVPEM, MPTRAPQVIL, PEMPTRAPQ V | HNSC |
| L1CAM | c.1894C>A | p.R632S | LVVGSPGVPRLVLSDLHLLTQSQV[p.R632S]SVSWSPAEDHNAPIEKYDIEFEDK EM | LLTQSQVSV, QVSVSWSPA, TQSQVSVSW, SQVSVSWSP, HL LTQSQVSV, SQVSVSWSPA, LTQSQVSVSW | LUAD |
| L1CAM | c.557C>T | p.T186M | PPSAEPLRIYWMNSKILHIKQDERV[p.T186M]MMGQNGNLYFANVLTSDNHS DYICHA | MMGQNGNLY, VMMGQNGNL, HIKQDERVM, IKQDERVM M, VMMGQNGNLY, MMGQNGNLYF, RVMMGQNGNL, LH IKQDERVM | CRC |
| L2HGDH | c.1321_1323del | p.P441del | VEDFVFDAGVGDIGNRILHVRNAPS[p.P441del]|AATSSIAISGMIADEVQQRFEL * | HVRNAPSAA, SAATSSIAI, APSAATSSI, LHVRNAPSA, IL HVRNAPSA, HVRNAPSAAT, NAPSAATSSI, APSAATSSIA, LHVRN APSAA | TGCT |
| L3MBTL4 | c.485G>T | p.W162L | HPVGWCEKTKHELHIPKGYRKDKFV[p.W162L]LMDYLKACKLQNAPKKLFRNR SPNGP | VLMDYLKAC, LMDYLKACK, KFVLMDYIK, KDKFVLMDY, YR KDKFVLM, LMDYLKACKL, VLMDYLKACK, KGYRKDKFVL, RK DKFVLMDY | LUAD |
| LACTB | c.13A>C | p.M5L | MYRL[p.M5L]LSAVTARAAAPGGLASS CGRRGVHQR | LLSAVTARA, RLLSAVTAR, YRLLSAVTA, RLLSAVTARA, LLSA VTARAA, MYRLLSAVTA, LSAVTARAAA | ACC |
| LALBA | c.121G>A | p.A41T | AILAKQFTKCELSQLLKDIDGYGGI[p.A41T]TLPELICTMFHTSGYDTQAIVENNES CGRRGVHQR | TLPELICTM, IDGYGGITL, GYGGITLPEL, TLPELICTMF, ITLPE LICTM | CRC |
| LAMA1 | c.3088G>T | p.D1030Y | NTCDPETGECVCPPHTGGVKCEECE[p.D1030Y]YGHWGYDAEVGCQACNCSL VGSTHHR | GVKCEECEY, CEYGHWGYDA, EECEYGHWGY | LUAD |
| LAMA4 | c.1673C>T | p.A558V | SLSTSADSLTTPRLTLSELDDIIKN[p.A558V]VSGIYAEIDGAKSELQVKLSNLSNLS | ELDDIIKNV, NVSGIYAEI, IIKNVSGIY, DIIKNVSGI, IKNVSGIY A, IIKNVSGIYA, DIIKNVSGIY, KNVSGIYAEI, SELDDIIKNV | CRC |
| LAMA4 | c.1915G>A | p.E639K | NGLVQKALDASNVYENIVNVVSEAN[p.E639K]KTAEFALNTTDRIYDAVSGIDTQ IIY | VNVVSEANK, YVVSEANKTA, EANKTAEFA, SEANKTAEF, IVNY VSEANK, EANKTAEFAL, VSEANKTAEF, SEANKTAEFA | BLCA |
| LAMA4 | c.3879G>A | p.M1293I | PNGLLFYYASGSDVFSISLDNGTVI[p.M1293I]IDVKGIKVQSVDKQYNDGLSHFV ISS | SLDNGTVII, VIIDVKGIK, TVIIDVKGI, VIIDVKGIKV, TVIIDVK GIK, ISLDNGTVII | LUSC |
| LAMA5 | c.6668T>G | p.L2223R | SSMAWARLHRLNASIADLQSQLRSP[p.L2223R]RGPRHETAQQLEVLEQQSTSL GQDAR | QLRSPRGPR, LQSQLRSPR, SPRGPRHET, SQLRSPRGPR, QL RSPRGPRH, DLQSQLRSPR, SPRGPRHETA | KIRP |
| LAMB4 | c.1762G>T | p.G588W | GLAPLGSETFGQSPAVHVVLGEPVP[p.G588W]WNPVTWTGPGFARVLPGAGL RFAVNN | GEPVPWNPV, VVLGEPVPW, HVVLGEPVPW, EPVPWNPVT W | LUAD |
| LAMB4 | c.3715G>T | p.G1239W | EADFKDLRGNVSEIERILKHPVFPS[p.G1239W]WKFLKVKDYHDSVRRQIMQLN EQLKA | VFPSWKFLK, KHPVFPSWK, FPSWKFLKV, HPVFPSWKF, LKH PVFPSW, WKFLKVKDY, PVFPSWKFLK, KHPVFPSWKF, VFPS WKFLKV, SWKFLKVKDY, HPVFPSWKFL, ILKHPVFPSW | LUAD |
| LAMC3 | c.521_522CC>AG | p.P174Q | KRSRADGPWEPYQFYSASCQKTYGR[p.P174Q]QEGQYLRPGEDERVAFCTSEFS DISPL | TYGRQEGQY, YGRQEGQYL, KTYGRQEGQY, TYGRQEGQYL, RQEGQYLRPG | TGCT |
| LARP1 | c.668_669insC | p.A223fs | PRHIPANRGELKGSESATYVPVAPP[p.A223fs]HPSLATRDQTGACLARPG* | APPHPSLAT, SLATRDQTGA, ATYVPVAPPH, ATRDQTGACL, VPVAPPHPSL | STAD |
| LARP4B | c.487del|A | p.T163fs | PENSETGGNESQPDSQEDPREVLKK[p.T163fs]HWNSAYLGRTLLVTCILYHRWI | CILYHRWIV, VLKKHWNSA, YLGRTLLVT, ILYHRWIVT, VTSM CQSQR, AYLGRTLLV, RTLLVTCIL, LYHRWIVTS, SAYLGRTLL, | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| LARS | c.554_555insC | p.P185fs | VTSMCQSQRWLTSTTSRSSALMWT* | RWLTSTTSR, STTSRSSAL, TTSRSSALM, LKKHWNSAY, TLLIV TCILY, HWNSAYLGR, LVTCILYHR, YHRWIVTSM, KKHWNSA YL, NSAYLGRTL, SMCQSQRWL, CQSQRWLTS, SQRWLTSTT, TSRSSQLMW, TSMCQSQRW, SAYLGRTLLV, RTLLVTCILY, L YHRWIVTSM, STTSRSSALM, VLKKHWNSA, LLVTCILYHR, I VTSMCQSQR, EVLKKHWNSA, NSAYLGRTLL, LKKHWNSAY L, WNSAYLGRTL, CQSQRWLTST, SQRWLTSTS, REVLKKH WNS, TTSRSSALMW | KIRC |
| LAT2 | | p.P185fs | MKSLGLSDEEIVKFSEAEHWLDYFP[p.P 185fs]ATGYSGFKKQNGFEGRLASFLHHH * | ATGYSGFKK, RLASFLHHH, GFEGRLASF, FPATGYSGF, LDYF PATGY, FEGRLASFL, WLDYFPATGY, YFPATGYSGF, NGFEG RLASF, AEHWLDYFPA, FKKNGFEGRL | GBM |
| LBX1 | c.53T>G | p.L18W | MSSGTELLWPGAALLVL[p.L18W]WG VAASLCVRCSRPGAKRSEKIYQQR | AALLVLWGV, VLMWGVAASL, LVLWGVAA, GAALLVLWGV, ALLVLWGVAA, LVLWGVAASL, WPGAALLVLW | GBM |
| LCP1 | c.526C>T | p.R176W | SPADRDQIAQQLGLTNAQVITWFQN[p. R176W]WRAKLKRDLEEMKADVESAK KLGPSG | VITWFQNWR, QVITWFQNW, WFQNWRAKL, TWFQNWR AK, ITWFQNWRA, ITWFQNWRAK, QVITWFQNWR, TWFQ NWRAKL, WFQNWRAKLK, NWRAKLKRDL, AQVITWFQNW | CRC |
| LHCGR | c.1334_1335insC | p.P445fs | SDALVIFQLYEKIKVPVDWNRVNKP[p.P 445fs]AIPQTGRQYEEA* | RVNKPAIPQT | KIRC |
| LILRA1 | c.47T>A | p.L16Q | MKQRFSALQLLKLLL[p.L16Q]QLQPPL PRALREALCPEPCNCVPDGA | QLLKLLLQL, LLLQLQPPL, QLQPPLPRA, KLLLQLQPPL, QLQP PLPRAL, LQLLKLLLQL, LQLQPPLPRA | TGCT |
| LILRB1 | c.1228C>T | p.H410Y | SPVTSAHSGTYRCYGSLSSNPYLLS[p.H4 10Y]YPSDSLELMVSGAAETLSPPQNKS DS | SSNPYLLSY, LLSYPSDSL, SYPSDSLEL, YPSDSLELM, NPYLLSY PS, LSSNPYLLSY, YLLSYPSDSL, SYPSDSLELM, LSYPSDSLEL, Y PSDSLELMV | BLCA |
| LILRB5 | c.1417_1419delCTC | p.L479del | GLGRHLGVVIGILVAVILLLLLLLL[p.L479 de|]FLILRHRRQGKHWTSTQRKADFQH PAGA | ILLLLLLLF | BLCA |
| LIM2 | c.1792T>C | p.S598P | TKDRQAEEDRQMDTERVLSPGPQA[p. S598P]PPPPPRSLPLTLPRCRLLHLKPP RM* | APPPPPRSL, PPPPPRSLPL | PRAD |
| LIMK2 | c.448T>A | p.S150T | IMAFAHQPTFSRISRPFSAGIMFFS[p.S1 50T]TTLFVVLALAIVTGVTVSFLGRRFG D | GIMFFSTTL, MFFSTTLFV, FFSTTLFVV, IMFFSTTLF, FSTTLFV VL, STTLFVVLA, TTLFVVLAL, IMFFSTTLFV, MFFSTTLFVV, GI MFFSTTLF, FFSTTLFVVL, FSAGIMFFST, FSTTLFVVLA, STTLF VVLAL, TTLFVVLALA, AGIMFFSTTL | LUAD |
| LIN9 | c.608G>A | p.R203H | TTVQVKEVNRMHISPNNRNAIHPGD[p. R203H]HILEINGTPVRTLRVEEVEDAIS QTS | NAIHPGDHI, HPGDHILEI, AIHPGDHIL, HILEINGTPV | GBM |
| LIN9 | c.547C>T | p.R183W | FCVCLKESFPNLKTRKLTRVEWGKI[p.R 183W]WRLMGKPRRCSSAFFEERSAL KQKR | RVEWGKIWR, IWRLMGKPR, VEWGKIWRL, WGKIWRLMG K, KIWRLMGKPR, IWRLMGKPRR, VEWGKIWRLM | UCEC |
| LINGO2 | c.691G>A | p.E231K | QKRQKIRLLQQRKVADVSQFKDLPD[p. E231K]KIPLPLVIGTKVTARLRGVHDGL FTG | SQFKDLPDK, LPDKIPLPL, KDLPDKIPL, VSQFKDLPDK, SQFK DLPDKI, FKDLPDKIPL, LPDKIPLPLV | CESC |
| LIPJ | c.1228C>A | p.P410T | PDTIRERSFKDFHSTALSFYFTCKK[p.P4 10T]TKIREKKLQHLLVDEGQTVQLECSA D | KTKIREKKL, FTCKKTKIR, FYFTCKKTKI, SFYFTCKKTK, TCKKT KIREK, YFTCKKTKIR | HNSC |
| LIPJ | c.707C>A | p.P236Q | GSKLCPLQIFDKICLNLFMMFGYD[p.P 236Q]QKNLNMSRLDVYFSHNPAGTSV QNML | FMMFGYDQK, DQKNLNMSR, MMFGYDQKN, MMFGYDQ KNL, LFMMFGYDQK, FGYDQKNLNM | LUAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| LLGL2 | c.2864_2865insG | p.P955fs | PRCLVDSAETKNHRPGNGAGPKKAP[p.P955fs]EPSQELRDSE* | KKAPEPSQEL | BLCA |
| LMLN | c.595G>T | p.G199C | PVIVPEHLQQCRVYRGGKWPHGAV[p.G199C]CVPDQEGISDADFVLYVGALATERCS | GKWPHGAVC, GKWPHGAVCV | LUSC |
| LMX1B | c.844_846del|CAG | p.Q285del| | RHQQQQEQQNSQRLGQGEPGPGQL[p.Q285de|]QEVLSSRMEGMMASYTPLAPPQQQIVAM | LQEVLSSRM, GLQEVLSSRM | THCA |
| LOC100132247 | c.1594A>C | p.T532P | ADDNLKTPSERQLTALPPSADDNIK[p.T532P]PPAERLRGPLPPSADDNLKTPSERQL | DNIKPPAER, NIKPPAERLR, PPAERLRGPL | LIHC |
| LOC151174 | c.268C>T | p.P90S | AEGIAMLLGTAGPSRLPAAPDASQA[p.P90S]SLRSPWALSVAAALCSPVSCHPCGRH | SLRSPWALS, APDASQASL, SQASLRSPW, ASLRSPWAL, SLRSPWALSV, SQASLRSPWA, ASQASLRSPW | CESC |
| LOC401296 | c.430C>A | p.L144M | CVLAPGSGSRPTPHIYYSVPAARTC[p.L144M]MGAPGSLSPCHLCVHICAHTYSGTPV | AARTCMGAPG, RTCMGAPGSL, VPAARTCMGA, YSVPAAR TCM | TGCT |
| LOC554223 | c.438_458del|GCGGGCGCCGTGGATGGAGCA | p.RAPWMEQ147del| | LSVGDVDDTQCVRLDSDATSPRMEP[p.RAPWMEQ147de|]EGPEYWEEETGTAKAKAQFYRVNLRTLSGYYNQSEA* | RMEPEGPEY, RMEPEGPEYW | PRAD |
| LOC649330 | c.278G>A | p.G93E | AGEDGRMIASQVVDINLAAEPKVNR[p.G93E]ENAGVKRSAAEMYGSSFDLDYGFQRD | KVNRENAGV, VNRENAGVK, KVNRENAGVK, RENAGVKRSA | SKCM |
| LPHN2 | c.2716T>A | p.F906I | EFIFLIGIDKTKYAIACPIFAGLLH[p.F906I]IFFLAAFAWMCLEGVQLYLMLVEVFE | GLLHIFFLA,LLHIFFLAA,HIFFLAAFA,IFAGLLHIF,IFFLAAFAW,LHIFFLAAF,FAGLLHIFF,GLLHIFFLAA,IFAGLLHIFF,IFFLAAFAWM,CPIFAGLLHI,LLHIFFLAAF,PIFAGLLHIF,HIFFLAAFAW | TGCT |
| LPHN3 | c.2220G>T | p.E740D | FPENMGHGSTIQLSANTLKQNGRNG[p.E740D]DIRVAFVLYNNLGPYLSTENASMKLG | DIRVAFVLY,KQNGRNGDI,RNGDIRVAF,GDIRVAFVL,GRNGDIRVAF,GDIRVAFVLY | LUAD |
| LPHN3 | c.2477G>A | p.R826H | VFTVKHIKQSENFNPNCSFWSYSK[p.R826H]HTMTGYWSTQGCRLLTTNKTHTTCSC | YSKHTMTGY,CSFWSYSKH,HTMTGYWST,FWSYSKHTM,SKHTMTGYW,SFWSYSKHTM,SYSKHTMTGY,WSYSKHTMTG,YSKHTMTGYW | PRAD |
| LPHN3 | c.3548G>A | p.R1183Q | SGSRTPCRYSTCGSQSRIRRMWNDTV[p.R1183Q]QKQSESSFITGDINSSASLNREGLLN | RMWNDTVQK,VQKQSESSF,TVQKQSESSF,RMWNDTVQ,KQ,VQKQSESSFI | CRC |
| LPIN1 | c.2921C>T | p.S974L | SDTFSNFTFWREPLPPFENQDIHSA[p.S974L]LA* | FENQDIHSAL | BLCA |
| LPPR2 | c.556G>T | p.A186S | TDQGACAGSPSLVAAARRAFPCKDA[p.A186S]SLCAYAVTYTAMVTLVFRVKGSRLV | SLCAYAVTY,DASLCAYAV,CKDASLCAY,SLCAYAVTYT,RAFPCKDASL,ASLCAYAVTY,FPCKDASLCA,KDASLCAYAV | ACC |
| LPPR4 | c.1579C>A | p.R527S | LKIQPGAVPGCNNSMPGGPRVSIQS[p.R527S]SPGSSQLVHIPEETQENISTSPKSSS | RVSIQSSPG,IQSSPGSSQ,QSSPGSSQLV,IQSSPGSSQL,SPGSSQLVHI | LUAD |
| LRBA | c.6307G>A | p.E2103K | VSLSTPAQLVAPSVVKGTLSVTSS[p.E2103K]KLYFEVDEEDPNFKKIDPKILAYTEG | LSVTSSKLY,TLSVTSSKL,GTLSVTSSK,TSSKLYFEV,SVTSSKLYF,VTSSKLYFEV,KGTLSVTSSK,TLSVTSSKLY,LSVTSSKLYF | UCEC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| LRCH2 | c.2150A>G | p.D717G | SIHVSPAVPKLSMAKCRRNVENFL[p.D717G]GACKKLGVSQERLCLPHHILEERGLV | FLGACKKLGV | KIRC |
| LRFN5 | c.396C>A | p.N132K | NSNRLTKITNDMFSGLSNLHHLILN[p.N132K]KNQLTLISSTAFDDVFALELDLSYN | ILNKNQLTL, NLHHLILNK, ILNKNQLTLI, SNLHHLILNK, LILNKNQLTL | LUAD |
| LRIG1 | c.70C>G | p.L24V | MARPVRGGLGAPRRSPCLLLLWL[p.L24V]VLLRLEPVTAAAGPRAPCAAACTCAG | LLLLWLVLL, LLMLVLLRL, LVLLRLEPV, LLLWLVLLR, LLLWLV LLRL, WLVLLRLEPV, SPCLLLLWLV | ACC |
| LRIG1 | c.76C>G | p.L26V | MARPVRGGLGAPRRSPCLLLLWLL[p.L26V]VRLEPVTAAAGPRAPCAAACTCAGDS | LLLLWLLLV, LLMLLLVRL, LLLVRLEPV, VRLEPVTAA, CLLLLW LLLV, LLLWLLLVRL, WLLLVRLEPV | ACC |
| LRP1 | c.3172C>A | p.P1058T | TCDGDNDCGDYSDETHANCTNQATR[p.P1058T]TPGGCHTDEFQCRLDGLCIPLRWRCD | ATRTPGGCH, ATRTPGGCHT, TPGGCHTDEF | KIRP, PRAD |
| LRP1 | c.4462_4463insG | p.G1488fs | GSGHMEVLRGHEFLSHPFAVTLYGG[p.G1488fs]GGLLD* | TLYGGGGLL | STAD |
| LRP1 | c.4462delG | p.G1488fs | GSGHMEVLRGHEFLSHPFAVTLYGG[p.G1488fs]RSTGLTGEQTHWLRPTSGPATMSPWYRGPTPSPLTCRCTTPPASPWLPIPVRPMGARAPAPTCVSSTTTGPCPAPAPTS* | WLRPTSGPA, PVRPMGARA, FAVTLYGGR, PATMSPWYR, TTPPASPWL, TTGPCPAPA, RPTSGPATM, PPASPWLPI, RPM GARAPA, YRGPTPSPL, CTTPPASPW, WLPIPVRPM, GPATM SPWY, TLYGGRSTGL, GLTGEQTHWL, TMSPWYRGPT, WYR GPTPSPL, HWLRPTSGPA, GARAPAPTCV, SGPATMSPWY, P FAVTLYGGR, LTGEQTHWLR, CTTPPASPWL, TTTGPCPAPA, SPWYRGPTPS, TPPASPWLPI, LPIPVRPMGA, IPVRPMGAR A, RPMGARAPAP, APAPTCVSST, WLRPTSGPAT, LRPTSGP ATM, TSGPATMSPW, RCTTPPASPW, GEQTHWLRPT | STAD |
| LRP10 | c.15_17delCCT | p.L11del | MLLATLLLL[p.L11del]GGALAHPDRIIFPNHACEDPPAVLLEVQ | TLLLLLGGA | PRAD |
| LRP11 | c.275C>G | p.P92R | QQERPQEELELELRAGGGPQEDCPG[p.P92R]RGSGGYSAMPDAIIRTKDSLAAGASF | RGSGGYSAM, CPGRGSGGY, GRGSGGYSAM | ACC |
| LRP12 | c.928G>T | p.G310C | CTWLIDTGDHRKVILRFTDFKLDGT[p.G310C]CYGDYVKIYDGLEENPHKLLRVLTAF | GTCYGDYVK, KLDGTCYGDY, TDFKLDGTCY, TCYGDYVKIY | TGCT |
| LRP1B | c.10687G>T | p.G3563C | FDCADGSDERNCETSCSKDQFRCSN[p.G3563C]CQCIPAKWKCDGHEDCKYGEDEKSCE | CSNCQCIPAK | LUAD |
| LRP1B | c.4174C>T | p.L1392F | SLRTTLIAGAMEHPRAIALDPRYGI[p.L1392F]FFWTDWDANFPRIESASMSGAGRKTI | RYGIFFWTD, ALDPRYGIF, YGIFFWTDW, DPRYGIFFW, GIFF WTDWDA, IALDPRYGIF, RYGIFFWTDW, FFWTDWDANF, A LDPRYGIFF | UCS |
| LRP2 | c.12117G>C | p.M4039I | FGTCPCPHCRNTKGSYECVCADGFTS[p.M4039I]ISDRPGKRCAAEGSSPLLLLPDNVRI | TSISDRPGK, DGFTSISDR, SISDRPGKR, FTSISDRPGK, TSISDRPGKR | LUAD |
| LRP2 | c.1547C>T | p.A516V | IDMVNLDGSYRVTLITENLGHPRGI[p.A516V]VVDPTVGYLFFSDWESLSGEPKLERA | IVVDPTVGY, LGHPRGIVV, VVDPTVGYLF, IVVDPTVGYL, GI VVDPTVGY, HPRGIWVDPT | LUSC |
| LRP2 | c.2210C>T | p.S737L | IFSSQVAIRGIPFTLSTQEDVMVPV[p.S737L]LGNPSFFVGIDFDAQDSTIFFSDMSK | VLGNPSFFV, VPVLGNPSF, QEDVMVPVL, VPVLGNPSFF, M VPVLGNPSF, TQEDVMVPVL | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| LRP2 | c.7295G>T | p.R2432I | NHSPPFQTINVERTVMSLDYDSVSD[p.R2432I]IYFTQNLASGVGQISYATLSSGIHT | SVSDIIYFT, IIYFTQNLA, DIIYFTANL, LDYDSVSDI, YDSVSDII, DSVSDIIYFT, DIIYFTQNLA, LDYDSVSDII, YDSVSDIIYF, SDIYFTQNL | UCEC |
| LRP2 | c.9127C>T | p.R3043C | CGDYSDERGCLYQTCQQNQFTCQNG[p.R3043C]CCISKTFVCDEDNDCGDGSDELMHLC | CQNGCCISK | CRC |
| LRP5 | c.4825T>C | p.S1609P | LSAEDSCPPSPATERSYFHLFPPPP[p.S1609P]PPCTDSS* | HLFPPPPPPC | PRAD |
| LRP6 | c.2024G>A | p.R675Q | NNNNVAIPLTGVKEASALDFDVTDN[p.R675Q]QIYWTDISLKTISRAFMNGSALEHVV | FDVTDNQIY, QIYWTDISL, NQIYWTDISL, QIYWTDISLK | CRC |
| LRRC16A | c.679G>A | p.D227N | LDHRDLIPIIAALEYNQWFTKLSSK[p.D227N]NLKLSTDVCEQILRVVSRSNRLEELV | KLSSKNLKL, FTKLSSKNLK, TKLSSKNLKL | BLCA |
| LRRC16B | c.2359C>T | p.R787W | AVDKELQVILESMVSLLTQELCPVAM[p.R787W]WVAEGHNKMLSNVAERVTVPRNFIRG | ELCPVAMVV, WVAEGHNKM, QELCPVAMW, AMWVAEGHNK, MWVAEGHNKM, ELCPVAMWVA, WVAEGHNKML, QELCPVAMWV | PRAD |
| LRRC18 | c.652C>T | p.R218W | RRLENLYVVEEKDLCAACLRKCQNA[p.R218W]WDNLNRIKNMATTTPRKTIFPNLISP | NAWDNLNRI, CLRKCQNAW, RKCQNAWDNL | CRC |
| LRRC31 | c.68A>C | p.K23T | RKKTSSEGETKPQTSTVNKFLR[p.K23T]ASNAESRKEDNDLKTSDSQPSDWIQK | FLRASNAES, RASNAESRK, STVNKFLRA, FLRASNAESR | CRC |
| LRRC37A2 | c.305C>G | p.T102S | ELEQPHTQQGPEKLAGNAIYTKPSF[p.T102S]SQEHKAAVSVLTPFSKGAPSTSSPAK | FSQEHKAAV, SQEHKAAVSV | PRAD |
| LRRC37A3 | c.1217C>A | p.A406D | ETPGQPPEHHEVTVSPPGHHQTHHL[p.A406D]DSPSVSVKPPDVQLTIAAEPSAEVGT | HLDSPSVSV, HLDSPSVSVK, QTHHLDSPSV, HQTHHLDSPS | CESC |
| LRRC4 | c.1674del | p.D558fs | KEPAKEWKVLKKKEPPKELRQDPP[p.D558fs]SSRCWAGAW* | SSRCWAGAW, ELRQDPPSSR, RQDPPSSRCW | STAD |
| LRRC7 | c.4166G>A | p.R1389H | VPPDTITKKAGSHIQTLMGSQSLQH[p.R1389H]HSREQQPYEGNINKVTIQQFQSPLPI | HSREQQPYE, SQSLQHHSR, HHSREQQPY, LMGSQSLQHH, QHHSREQQPY | CRC |
| LRRCC1 | c.17C>T | p.A6V | MEAAA[p.A6V]VVVAAEAEVENEDGDSSCGDVCFMDK | VVVAAEAEV, EAAAVVVAA, MEAAAVVVA, AVVVAAEAEV, MEAAAVVVAA | TGCT |
| LRRIQ1 | c.2375G>T | p.W792L | RKRPVKCPANMTPALDKLEILRCGP[p.W792L]LDTLQQVTTVTFQDLPGCVLSTLAEC | LEILRCGPL, GPLDTLQQV, ILRCGPLDTL | LUAD |
| LRRIQ3 | c.732_733insA | p.K244fs | LIVQRWIRGFLVRKNLSPVFFHKKK[p.K244fs]TAGKNY* | KKKTAGKNY, FFHKKKTAGK, HKKKTAGKNY | PRAD |
| LRRT M4 | c.728C>A | p.S243Y | SKINFAHFPRLFNLRSIYLQWNRIR[p.S243Y]YISQGLTWTWSSLHNLDLSGNDIQGI | LQWNRIRYI, RIRYISQGL, YISQGLTWT, RYISQGLTW, YLQWNRIRY, LQWNRIRYI, IYLQWNRIRY, YISQGLTWTW, RIRYISQGLT, LQWNRIRYIS, NRIRYISQGL, IRYISQGLTW | LUAD |
| LRTM2 | c.416C>T | p.S139L | DLTNLTELQLRNNSIRTLDRDLLRH[p.S139L]LPLLRHLDLSINGLAQLPPGLFDGLL | LLRHLPLLR, LPLLRHLDL, DLLRHLPLL, RDLLRHLPLL, RHLPLLRHL, DLLRHLPLLR, LPLLRHLDLS, INGLAQLPPG, RDLLRHLPL, LRHLPLLRHL | BLCA |
| LRTM2 | c.526C>G | p.L176V | GLAQLPPGLFDGLLALRSLSRSNR[p.L176V]VQNLDRLTFEPLANLQLLQVGDNPWE | SLSLRSNRV, VQNLDRLTF, LRSNRVQNL, SLRSNRVQNL, RS NRVQNLDR, RVQNLDRLTF, RSLSLRSNRV | CESC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| LSG1 | c.1550G>T | p.R517L | ITPREDEDPHRPPTSEELLTAYGYM[p.R517L]LGFMTAHGQPDQPRSARYILKDYVSG | LLTAYGYML,TAYGYML,AYGYMLGFM,GYMLGFMTA,YMLGFMTAH,LTAYGYMLGF,YMLGFMTAHG,TAYGYMLGFM,YGYMLGFMTA | LUSC |
| LTA4H | c.319T>C | p.F107L | YKGSPMEISLPIALSKNQEIVIEIS[p.F107L]LETSPKSSALQWLTPEQTSGKEHPYL | EISLETSPK,QEIVIEISL,LETSPKSSA,NQEIVIEISL,LETSPKSSAL | KIRC |
| LTB4R | c.217T>C | p.F73L | QKRSVTALMVLNLALADLAVLLTAP[p.F73L]LFLHFLAQGTWSFGLAGRCLCHYVCG | VLLTAPLFL,LTAPLFLFL,TAPLFLHFL,LAVLLTAPL,TAPLFLHFL,AVLLTAPLF,LTAPLFLHFL,DLAVLLTAPL,LLTAPLFLHF,TAPLFLHFLA,LAVLLTAPLF | TGCT |
| LUC7L3 | c.442T>A | p.S148T | GKNEEKIQVLTDKIDVLLQQIEELG[p.S148T]TEGKVEEAQGMMKLVEQLKEERELLR | IEELGTEGKV | TGCT |
| LUM | c.929G>T | p.R310L | QLEKFDIKSFCKILGPLSYSKIKHL[p.R310L]LLDGNRISETSLPPDMYECLRVANEV | SYSKIKHLL,YSKIKHLLL,SYSKIKHLLL,LSYSKIKHLL | LUSC |
| LUM | c.988C>T | p.R330C | KIKHLRLDGNRISETSLPPDMYECL[p.R330C]CVANEVTLN* | DMYECLCVA,YECLCVANEV | GBM |
| LY9 | c.205A>C | p.I69L | RASGKDSAPTVVSGILGGSVTLPLN[p.I69L]LSVDTEIENVIWIGPKNALAFARPKE | VTLPLNLSV,SVTLPLNLSV | BRCA |
| LYPD4 | c.191C>A | p.T64K | AVAFHNWKWLLMRNMVCKLQEGCEE[p.T64K]KLVFIETGTARGVVGFKGCSSSSSYP | EEKLVFIET,KLQEGCEEKL,KLVFIETGTA,QEGCEEKLVF,CEEKLVFIET | TGCT |
| LYST | c.2130G>T | p.Q710H | DLLWKWDALKAYQNFVEEDRLHSI[p.Q710H]HIANHICNLIQKGNIVVQWKLYNYIF | HIANHICNL,HSIFHIANHI,EEDRLHSIH,HIANHICNL,RLHSIHIANH,FEEDRLHSIH,IHIANHICNL,EEDRLHSIHI | KIRC |
| LZTS1 | c.1294_1341de\|AGGACCCAGGACCGCCCTGCGCACCAAGGGCTGGAGCTG | p.RTQDLEGALRTKGLEL432de\| | AKASEILGLKAQLKDTRGKLEGLEL[p.RTQDLEGALRTKGLEL432de\|]EVCENELQRKKNEAELLREKVNLLEQELQELRAQAALARDMGPPTFPEDVPALQRELRLRAELREERQGHDQ | KLEGLELEV,GKLEGLELEV | PAAD |
| LZTS2 | c.298de\|C | p.P100fs | VPPRKAVPVTSFTYINEDFRTESPP[p.P100fs]AQAVMLRMPESSGHTMPTSAAHHQSSLSLESWRRTWRS* | SSLSLESWR,HTMPTSAAH,SWRRTWRRS,ESWRRTWRR,ESSGHTMPT,SPPAQAVML,MPESSGHTM,AAHHQSSSL,TESPPAQAV,HHQSSLSL,SSSLSLESWR,SLESWRRTW,RMPESSGHTM,SSSLSLESWR,SSLSLESWR,MLRMPESSGH,HTMPTSAAHH,SLESWRRTWR,SAAHHQSSSL,TESPPAQAVM,AHQSSSLSL,HQSSLSLES,QSSSLSLESW,LSLESWRRTW,MPTSAAHHQS | CRC |
| MAEL | c.1033C>T | p.R345C | EAHVPLQDYEASNSVTPKMVLDAG[p.R345C]CYQKLRVGSSGFSHFNSSNEEQRSNT | VLDAGCYQK,MVLDAGCY,DAGCYQKLR,VLDAGCYQKL,VVLDAGCYQK,KMVLDAGCY | CRC |
| MAF | c.158de\|G | p.G53fs | MKFEVKKEPVETDRIISQCGRLIAG[p.G53fs]ARCPPP* | CGRLIAGAR,SQCGRLIAGA,RLIAGARCPP | CLL |
| MAGEC1 | c.1826T>A | p.L609H | PQGEDSLSPHYFPQSPPQGEDSMSP[p.L609H]HYFPQSPLQGEEFQSSLQSPVSICSS | GEDSMSPHY,SMSPHYFPQ,SMSPHYFPQS,QGEDSMSPHY,SPHYFPQSPL,GEDSMSPHYF | CLL |
| MAGEC1 | c.714_716de\|CCC | p.P239de\| | FQSSPERTQSTFEGFAQSPLQIPVS[p.P239de\|]SSSSTLLSLFQSFERTQSTFEGFAQSS | IPVSSSSST,VSSSSSTLL,IPVSSSSSTL | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MAGEE1 | c.1138G>A | p.V380M | SVLPIPGEGLSTVSPPTASDGSDTS[p.V380M]MPPTPGEGASTLVQPTAPDGPGSSVL | ASDGSDTSM, SMPPTPGEGA, TASDGSDTSM | CRC |
| MAGEE2 | c.133del|C | p.Q45fs | GDGRGRBIQATNASGSPTSMLVVDAP[p.Q45fs]SALRRQSTLSVSTLPRPFRTRMTWRS* | MLVVDAPSA, LVVDAPSAL, TLSVSTLPR, VVDAPSALR, VSTLPRPFR, TLPRPFRTR, PFRTRMTWR, SALRRQSTL, LPRPFRTRM, RPFRTRMTW, LRRQSTLSV, RQSTLSVST, QSTLSVSTL, SVSTLPRPF, SMLVVDAPSA, MLVVDAPSAL, ALRRQSTLSV, RQSTLSVSTL, STLSVSTLPR, LVVDAPSALR, VVDAPSALRR, SVSTLPRPFR, STLPRPFRT, RPFRTRMTWR, APSALRRQST, LPRPFRTRMT, LSVSTLPRPF, RRQSTLSVST | STAD |
| MAGI1 | c.3467G>T | p.G1156V | KGFGFSLRGGREYNMDLYVLRLAED[p.G1156V]VPAERCGKMRIGDEILEINGETTKNM | YVLRLAEDV, VPAERCGKM, RLAEDVPAER | LUAD |
| MAGI1 | c.3592C>T | p.R1198C | INGETTKNMKHSRAIELIKNGGRRV[p.R1198C]CLFLKRGDGSVPEYDPSSDRHGPATG | GGRRVCLFL, GRRVCLFLK, GGRRVCLFLK, IKNGGRRVCL, KNGGRRVCLF | CRC |
| MAGI2 | c.1348C>A | p.L450M | LSTTLKKSNMGFGFTIIGGDEPDEF[p.L450M]MQVKSVIPDGPAAQDGKMETGDVIVY | EFMQVKSVI, MQVKSVIPD, DEFMQVKSV, MQVKSVIPDG, DEFMQVKSVI | UCEC |
| MAGI2 | c.3130C>A | p.P1044T | PSSEKQSPMAQQSPLAQQSPLAQPS[p.P1044T]TATPNSPIAQPAPPQPLQLQGHENSY | STATPNSPI, STATPNSPIA, SPLAQPSTAT, QQSPLAQPST | LUAD |
| MAML2 | c.1771C>A | p.Q591K | QANQOMPSVLPSQNKPSLLHYTQQQ[p.Q591K]KQQQQQQQQQQQQQQQQQQQQQQQQ | LLHYTQQQK, SLLHYTQQQI | KIRP |
| MAMLD1 | c.1715A>T | p.Q572L | YLQQPTPTQASSATASSTATATLQL[p.Q572L]LQQQQQQQQPDHSSFLLQQMMQQPQ | STATATLQLL | TGCT, UCS |
| MAMSTR | c.484_485insC | p.P162fs | QPHPRMKPSPLTPCPPGVPSPSPPP[p.P162fs]TQVGTSDP* | SPSPPPTQV | STAD |
| MAN1C1 | c.1291_1292insG | p.G431fs | MEAKNMYYEALEAIETYLLNVSPGG[p.G431fs]ADLHCRVARGDSGPDGAPGLFLRGHDRPWRRGCQGRKEGPLPRARSPDHQDVSRVIRPLRHQTWA* | LLNVSPGGA, RGHDRPWRR, VSRVIRPLR, DGAPGLFLR, DVSRVIRPL, GPDGAPGL, LFLRGHDRPW, QGRKEGPLPR, RARSPDHDRPW, YLLNVSPGGA, LFLRGHDRPW, FLRGHQDV, VSRVIRPLRH, FLRGHDRPWR, DVSRVIRPLR, VIRPLRHQTWLTPPAVPPV, SLTPPAVPPV | STAD |
| MAP1A | c.6187del|C | p.P2063fs | GPTVPPRPEPGPSMEPSLTPPAVPP[p.P2063fs]VLLS* | LTPPAVPPV, SLTPPAVPPV | STAD |
| MAP1B | c.6138G>T | p.E2046D | EGYSYETSTKTTRTPDTSTYCYETA[p.E2046D]DKIIRTPQASTYSYETSDLCYTAEKK | ETADKITRT, STYCYETADK, TYCYETADKI | CRC |
| MAP1S | c.1232C>G | p.S411C | EKMGVGRLDMVLHPPSAGAERTLA[p.S411C]CVCALLVWHPAGPGEKVVRVLFPGCT | RTLACVCAL, LACVCALL, AERTLACVC, RTLACVCALL, TLACVCALLV, LACVCALLVW, AERTLACVCA | ACC |
| MAP2 | c.1590G>T | p.K530N | QAVTDSAMTSKTLEKAMTEPSALIE[p.K530N]NSSIQELFEMRVDDKDKIEGVGAATS | SALIENSSI, IENSSIQEL, IENSSIQELF | CRC |
| MAP2 | c.4414_4415insA | p.K1472fs | EPSTVSRDEVRRKAVYKKAELAKK[p.K1472fs]NRSSGPLSLQEIHFKTCYQIY* | SLQEIHFKT, LSLQEIHFK, KNRSSGPLS, HFKTCYQIY, KKNRSSGPL, NRSSGPLSL, QEIHFKTCY, IHFKTCYQI, KNRSSGPLSL, IHFKTCYQIY, EIHFKTCYQI, AKKNRSSGPL, LQEIHFKTCY | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MAP2K1 | c.171G>C | p.K57N | ALQKKLEELELDEQQRKRLEAFLTQ[p.K57N]NQKVGELKDDDFEKISELGAGNGGVV | TQNQKVGEL, TQNQKVGELK, EAFLTQNQKV | CLL |
| MAP2K1 | c.171G>T | p.K57N | ALQKKLEELELDEQQRKRLEAFLTQ[p.K57N]NQKVGELKDDDFEKISELGAGNGGVV | TQNQKVGEL, TQNQKVGELK, EAFLTQNQKV | LUAD |
| MAP2K4 | c.370C>T | p.P124S | IHLEIKPAIRNQIIRELQVLHECNS[p.P124S]SYIVGFYGAFYSDGEISICMEHMDGG | NSSYIVGFY, SYIVGFYGA, VLHECNSSY, HECNSSYIV, CNSSYIVGF, CNSSYIVGFY, VLHECNSSYI, SYIVGFYGAF, SSYIVGFYGA, QVLHECNSSY | SKCM |
| MAP2K4 | c.551C>T | p.S184L | PYIVQPYGALFREGDCWICMELMST[p.S184L]LFDKFYKYVYSVLDDVIPEEILGKIT | MSTLFDKFY, STLFDKFYK, TLFDKFYKY, ELMSTLFDK, LMSTLFDKF, ICMELMSTL, CMELMSTLF, LMSTLFDKFY, STLFDKFYKY, LFDKFYKYV, TLFDKFYKYV, WICMELMSTL, MSTLFDKFYK, ICMELMSTLF, ELMSTLFDKF | BRCA |
| MAP2K4 | c.752G>T | p.S251I | IHRDIKPSNILLDRSGNIKLCDFGI[p.S251I]TGQLVDSIAKTRDAGCRPYMAPERID | IIGQLVDSI, IKLCDFGII, GIIGQLVDSI | BRCA |
| MAP2K4 | c.783_784dele\|AA | p.T261fs | DRSGNIKLCDFGISGQLVDSIAKTR[p.T261fs]CWL* | SIAKTRCWL | BRCA |
| MAP2K4 | c.860G>A | p.R287H | RDAGCRPYMAPERIDPSASRQGYDV[p.R287H]HSDVWSLGITLYELATGRPYPKWNS | DVHSDVWSL, RQGYDVHSDV, QGYDVHSDVW, YDVHSDVWSL | CRC |
| MAP2K5 | c.1334A>G | p.Q445R | VQFNDGNAAVVSMWVCRALEERRSQ[p.Q445R]RGPP* | RALEERRSQR | KIRC |
| MAP3K1 | c.2281_2284de\|ATAG | p.I761fs | LNCILGNQTESNNWQELLGRLCLID[p.I761fs]CCWNFLLNFLILILSVLMFHKLSLLKSGIRSCCPS* | LIDCCWNFL, FLLNFILIL, FILILSVLM, VLMFHKLSL, LMFHKLSLL, KLSLLKSGI, ILSVLMFHK, MFHKLSLLK, CLIDCCWNF, CW NFLLNFI, NFLLNFIL, ILILSVLMF, CCWNFLLNF, WNFLLNFIL, LSVLMFHKL, CLIDCCWNFL, LIDCCWNFLL, FLLNFILILS, LLN FILILSV, ILSVLMFHKL, VLMFHKLSLL, LILSVLMFHK, LMFHK LSLLK, CWNFLLNFIL, NFLLNFLIL, NFILILSVLM, SVLMFFIKL SL, LNFILILSVL, FILILSVLMF, HKLSLLKSGI | BRCA |
| MAP3K1 | c.4036_4038de\|GTT | p.V1346de\| | LFIEWMAGGSVAHLLSKYGAFKESV[p.V1346de\|]INYTEQLLRGLSYLHENQIIHRDVKGAN | SVINYTEQL, AFKESVINY, SVINYTEQLL, KYGAFKESVI, GAFKESVINY, ESVINYTEQL | BRCA |
| MAP3K1 | c.4150_4151insT | p.L1384fs | LHENQIIHRDVKGANLLIDSTGQRL[p.L1384fs]KNCRFWSCSQVGIKRNWCRRVSGTTTGDNCIYGT* | WSCSQVGIK, RLKNCRFWS, GIKRNWCR, VGIKRNWCR, GQRLKNCRF, CRFWSCSQV, SQVGIKRNW, LIDSTGQRLK, RFWSCSQVGI, RLKNCRFWSC, GIKRNWCRRV, GTTTGDNCIY, STGQRLKNCR, QVGIKRNWCR, GQRLKNCRFW | BRCA |
| MAP3K1 | c.953_954insA | p.L318fs | DGFSPYSPEETNRRVNKVMRARLYL[p.L318fs]TAADRA* | VMRARLYLT, RLYLTAADR, RARLYLTAA, MRARLYLTA, VMR ARLYLTA, RLYLTAADRA, KVMRARLYLT, RARLYLTAAD, MR ARLYLTAA | BRCA |
| MAP3K1 | c.971C>T | p.P324L | YSPEETNRRVNKVMRARLYLYLLQQIG[p.P324L]LNSFLIGGDSPDNKYRVFIGPQNCSC | QQIGLNSFL, LYLLQQIGL, LQQIGLNSF, RLYLLQQIGL, QQIGL NSFLI, LIQQIGLNSF, LQQIGLNSFL | GBM |
| MAP3K12 | c.1345_1347de\|AGG | p.R449de\| | KLHFEKIKSEGTCLHRLEEELVMR[p.R449de\|]EELRHALDIREHYERKLERANNLYMELN | LVMRREELR, ELVMRREEL, ELVMRREELR, MRREELRHAL, E ELVMRREEL | STAD |
| MAP3K4 | c.824G>A | p.R275Q | ENTSGFWLNRSNELIWLELQAWHAG[p.R275Q]QTINDQDFFLYTARQAIPDIIN EILT | LQAWHAGQT, QAWHAGQTI, GQTINDQDF, LQAWHAGQ T, QTINDQDFFL, GQTINDQDFF, LELQAWHAGQ | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MAP3K7 | c.1570G>C | p.E524Q | AYLTLDHQLQPLAPCPNSKESMAVF[p.E524Q]QQHCKMAQEYMKVQTEIALLLQRKQE | MAVFQQHCK, AVFQQHCKM, SMAVFQQHCK, QQHCKMA QEY, MAVFQQHCKM, KESMAVFQQH | HNSC |
| MAP4K2 | c.1021C>G | p.R341G | SRGQHGPAERTPSEIQFHQVKFGAP[p.R341G]GRKETDPLNEPWEEEWTLLGKEELSG | QVKFGAPGR, HQVKFGAPG, QVKFGAPGRK, HQVKFGAPGR, APGRKETDPL | TGCT |
| MAP4K3 | c.1970del C | p.P657fs | LFDYARQMQKLPVAIPAHKLPDRIL[p.P657fs]QGNFLYQQKSLKPNGARSVVL* | RILQGNFLY, FLYQQKSLK, KSLKPNGAR, KPNGARSVV, YQQKSLKPN, SLKPNGARSV, NFLYQQKSLK, KPNGARSVVL, GNFLYQQKSL, YQQKSLKPNG, LPDRILQGNF | HNSC |
| MAP7D1 | c.239_240insC | p.A80fs | ATSSKQLPLEPESPSGQVGPPAPP[p.A80fs]AGRVPFL* | RPAPPAGRV, APPAGRVPF, PPAGRVPFL, RPAPPAGRVP, APPAGRVPFL | STAD |
| MAP7D2 | c.1459C>T | p.R487C | ERLEKEEQDRLEREELKRKAEEERL[p.R487C]CLEEEARKQEEERKRQEEEKKKQEGE | RKAEEERLCL, EERLCLEEEA | CRC |
| MAP7D3 | c.922del C | p.Q308fs | PQTKVEESPLEKVETPPKASVDAPP[p.Q308fs]R* | KASVDAPPR | STAD |
| MAP9 | c.1455G>T | p.K485N | QKKAAKREEALASFRAWKAMKEKEA[p.K485N]NKIAAKKRLEEKNKKKTEEENAARKG | AMKEKEANK, KEANKIAAK, KEKEANKIA, AMKEKEANKI, KA MKEKEANK, EANKIAAKKR, KEKEANKIAA | HNSC |
| MAPK1 | c.964G>A | p.E322K | NPHKRIEVEQALAHPYLEQYYDPSD[p.E322K]KPIAEAPFKFDMELDDLPKEKLKELI | YYDPSDKPI, KPIAEAAPPK, QYYDPSDKPI, SDKPIAEAPF, KPIA EAPFKF | CESC, HNSC |
| MAPK13 | c.943G>A | p.E315K | ELDVDKRLITAAQALTHPFFEPFRDP[p.E315K]KEETEAQQPFDDSLEHEKLTVDEWKQ | KEETEAQQPF | BRCA |
| MAPK15 | c.1533del G | p.Q511fs | PPRLPPEARPGRRMFSTSALQGAQG[p.Q511fs]VPGLCLEATPKPTGLSATRHWATCPCWRGTMCEPPYSLHLALCSCPSPFPRPLSSLHPLALPALPGLPKFQGACPGLLGGADEGPAPAPLTSSNKVMSAPN | TMCEPPYSL, PLSSLLHPL, LLHPLALPA, GLSATRHWA, SLHLA LCSC, ALPALPGPL, GLCLEATPK, CSCPSPFPR, KFQGACPGL, RGTMCEPPY, HWATCPCWR, EPPYSLHLA, TPKPTGLSA, PP YSLHLAL, CPSPFPRPL, SPFPRPLSS, FPRPLSSLL, APLTSSNKV, SSLLHPLAL, ALCSCPSPF, LQGAQGVPG, AQGVPGLCL, RH WATCPCW, LKFQGACPG, FQGACPGLL, DEGPAPAPL, CEPP YSLHL, GTMCEPPYSL, SLLHPLALPA, LLHPLALPAL, GLSATRHWAT, ALPALPGPLK, PPPRPLSSLL, KFQGACPGLL, ATRHW ATCPC, TSALQGAQGV, TPKPTGLSAT, EPPYSLHLAL, SPFPR PLSSL, FPRPLSSLLH, RPLSSLLHPL, LPALPGPLKF, APLTSSNK VM, LALCSCPSPF, LQGAQGVPGL, LEATPKPTGL, WRGTMC EPPY, LSSLLHPLAL, LALPALPGPL, LKFQGACPGL, CEPPYSLH LA | STAD |
| MAPK4 | c.298G>A | p.V100M | DNIVKYEVLGPKGTDLQGELFKFS[p.V100M]MAYIVQEYMETDLARLLEQGTLAEEH | LFKFSMAYI, ELFKFSMAY, SMAYIVQEY, MAYIVQEYM, FKFS MAYIV, GELFKFSMA, FSMAYIVQEY, ELFKFSMAYI, SMAYIV QEYM, LQGELFKFSM, GELFKFSMAY, FKFSMAYIVQ | BRCA |
| MAPK7 | c.1502C>A | p.A501D | KAALKAALLKSLRSRLRDGPSAPLE[p.A501D]DPEPRKPVTAQERQREREEKRRRQE | LEDPEPRKPV | KIRP, TGCT |
| MAPK8IP1 | c.651_652insCC | p.L217fs | SSSPLKTGEQTPPHEHICLSDELPP[p.L217fs]PRAAPPPPQIEAPPPTALAAAAQPPRWHLRVVPLLPRLGVGATRIETESTTRPMCD* | RVVPLLPRL, LLPRLGVGA, RLGVGATRI, RWHLRVVPL, RAAP PPPQI, AQPPRWHLR, LAAAAQPPR, EAPPPTALA, APPPTAL AA, PPRWHLRVV, VPLLPRLGV, LPRLGVGAT, IEAPPPTAL, A AQPPRWHL, WHLRVVPLL, DELPPPRAA, ETESTTRPM, QPP RWHLRV, ALAAAAQPPR, HLRVVPLLPR, AAQPPRWHLR, R WHLRVVPLL, CLSDELPPPR, EAPPPTALAA, APPPTALAAA, I | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MAPK APK2 | c.640_641i nsC | p.T214f s | ENLLYTSKRPNAILKLTDFGFAKET[p.T2 14fs]HQPQLFDHSLLYTVLCGSRSAGSR EV* | EAPPPTALA,LAAAAQPPRW,AAAQPPRWHL,LRVVPLLPRL, IETESTTRPM,DELPPPRAAP,QPPRWHLRVV QLFDHSLLY,LLYTVLCGS,QPQLFDHSL,AKETHQPQL,KETH QPQLF,FDHSLLYTV,QLFDHSLLYT,GSRSAGSREV,PQLFDH SLLY,LLYTVLCGSR,TYVLCGSRSA,QPQLFDHSLL,FAKETHQ PQL,AKETHQPQLF,HQPQLFDHSL,FDHSLLYTVL | KIRC |
| 11-Mar | c.578G>T | p.R193 L | PICKICFQGAEQGELLNPCRCDGSV[p.R 193L]LYTHQLCLLKWISERGSWTCELCC YR | VLYTHQLCL,LYTHQLCLL,GSVLYTHQL,VLYTHQLCLL,NPCR CDGSVL | LUAD |
| 5-Mar | c.508C>T | p.R170 C | GLPTIPVMLLIGKMIRWEDYVLRLW[p. R170C]CKYSNKLQILNSIFPGIGCPVPRI PA | RLWCKYSNK,LWCKYSNKL,YVLRLWCKY,DVYLRLWCIK,CK YSNKLQI,RLWCKYSNKL,CKYSNKLQIL | BRCA |
| MARC KS | c.454de|A | p.K152f s | ASSTSSPKAEDGATPSPSNETPKKK[p.K 152fs]RSAPPSRSLSS* | KKRSAFPSR,RSAFPSRSL,SAFPSRSLS,TPKKKRSAF,KKKRSA FPSR,RSAFPSRSLS,KRSAFPSRSL,SAFPSRSLSS | KIRC |
| MARS 2 | c.1442G>A | p.R481 Q | LPKQVADHVDNFRIYKALEAVSSCV[p.R 481Q]QQTNGFVQRHAPWKLNWESP VDAPWL | SCVQQTNGF,VQQTNGFVQ,SSCVQQTNGF,QQTNGFVQR H | HNSC |
| MAS1 L | c.970A>G | p.R324 G | ISLFLIINSSANPIYFFVGSLRKK[p.R324 G]GLKESLRVILQRALADKPEVGRNKKA | GLKESLRVI,GSLRKKGLK,RKKGLKESL,GLKESLRVIL,VGSLR KKGLK | PRAD,THCA |
| MAT2 A | c.497A>G | p.E166 G | YATDETEECMPLTIVLAHKLNAKLA[p.E 166G]GLRRNGTLPWLRPDSKTQVTVQ YMQD | KLNAKLAGL,KLNAKLAGLR,LAGLRRNGTL,GLRRNGTLPW, HKLNAKLAGL | TGCT |
| MAX | c.106A>T | p.R36 W | SDEEQPRFQSAADKRAHHNALERK[p. R36W]MDHIKDSFHSLRDSVPSLQGEK ASRA | RWDHIKDSF,KRWDHIKDSF | MM |
| MAX | c.83A>G | p.H28R | DNDDIEVESDEEQPRFQSAADKRAH[p. H28R]RNALERKKRRDHIKDSFHSLRDSV PSL | RAHRNALER,SAADKRAHR,AHRNALERK,DKRAHRNAL,RA HRNALERK,QSAADKRAHR | UCEC |
| MB21 D2 | c.931C>G | p.Q311 E | EWRLSFARSEVQLKKCISSSLMQAY[p.Q3 11E]EACKAIIIKLLSRPKAISPYHLRS MM | SLMQAYEAC,MQAYEACKA,LMQAYEACK,QAYEACKAI, YEACKAIII,LMQAYEACKA,MQAYEACKAI,SLMQAYEACK,EA CKAIIIKL,QAYEACKAII | HNSC,LUSC |
| MBD6 | c.2194de|C | p.P732f s | SVTTATTDPGASSLGKAPSNSGRPP[p.P 732fs]NSLALCWVPACWTCLH* | SLALCWVPA,SGRPPNSLA,VPACWVTCL,PPNSLALCW,SLA LCWVPAC,ALCWVPACWV,SGRPPNSLAL,NSLALCWVPA, WVPACWVTCL,RPPNSLALCW,LALCWVPACW | STAD |
| MBD6 | c.2338_233 9insG | p.G780 fs | LPSLLQPPGPLLSGQLGLQLLPGGG[p.G 780fs]SSSTPLRGF* | SSSTPLRGF,LLPGGGSSST,LQLLPGGGSS,GSSSTPLRGF | STAD |
| MBOA T2 | c.128G>A | p.R43Q | AVQLPIDQVNFVVCQLFALLAAIWF[p. R43Q]QTYLHSSKTSSFIRHVVATLLGLYL A | LAAIWFQTY,LLAAIWFQT,AIWFQTYLFI,AAIWFQTYL,FQT YLHSSK,LLAAIWFQTY,ALLAAIWFQT,WFQTYLHSSK,LAAI WFQTYL,FQTYLHSSKT | CRC,UCEC |
| MBOA T7 | c.1270C>T | p.R424 W | HWFLKMRAYDYMCMGFVLLSLADTL[p. R424W]WYWASIYFCIHFLALAALGL GLALGG | LSLADTLWY,SLADTLWYW,TLMYWASIY,TLMYWASIYL,W YWASIYFC,DTLMYWASI,LLSLADTLW,LLSLADTLWY,SLAD TLMYWA,LSLADTLWYW,TLMYWASIYF,WYWASIYFCI,DT LWYWASIY,VLLSLADTLW,ADTLWYWASI | HNSC |
| MC5R | c.325G>A | p.A109 T | LVSMSSAWETITIYLLNNKHLVIAD[p.A 109T]TFVRHIDNVFDSMICISVVASMC SLL | HLVIADTFV,LVIADTFVR,KHLVIADTF,TFVRHIDNV,VIADT FVRHI,TFVRHIDNVF,HLVIADTFVR,DTFVRHIDNV,NKHLVI ADTF | UCEC |
| MCF2 L2 | c.2777G>A | p.R926 Q | KTMKLMTLSIRQLGRGSHRKFEIAS[p.R 926Q]QNGLEKYILQAASKEIRDCWFSEI SK | ASQNGLEKY,IASQNGLEK,FEIASQNGL,SQNGLEKYI,IASQ NGLEKY,RKFEIASQNG,SQNGLEKYIL | CRC |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MCHR1 | c.917C>T | p.S306F | QFFLAFALPFVVITAAYVRILQRMT[p.S306F]FSVAPASQRSIRLRTKRVTRTAIAIC | ILQRMTFSV,RMTFSVAPA,RILQRMTFS,LQRMTFSVA,MTFSVAPAS,VRILQRMTF,RILQRMTFSV,ILQRMTFSVA,TFSVAPASQR,YVRILQRMTF,LQRMTFSVAP,QRMTFSVAPA,RMTFSVAPAS | LUSC |
| MCOLN3 | c.421G>A | p.V141I | VYTQSDVYDQLIFAVNQYLQLYNVS[p.V141I]IGNHAYENKGTKQSAMAICQHFYKRG | YLQLYNVSI,NVSIGNHAY,LQLYNVSIG,SIGNHAYENK,QYLQLYNVSI,YNVSIGNHAY | GBM |
| MECOM | c.2744G>A | p.R915Q | SELLQSVPSMFNFRAPPNALPENLL[p.R915Q]QKGKERYTCRYCGKIFPRSANLTRHL | LLQKGKERY,NALPENLLQK | PRAD |
| MECOM | c.2905C>T | p.R969C | TGEQPYRCKYCDRSFSISSNLQRHV[p.R969C]CNIHNKEKPFKCHLCDRCFGQQTNLD | NLQRHVCNI,RHVCNIHNK,LQRHVCNIH,HVCNIHNKEK,CNIHNKEKPF | CRC |
| MED1 | c.107T>G | p.L36R | HRPLKRPRLGPPDVYPQDPKQKEDE[p.L36R]RTALNVKQGFNNQPAVSGDEHGSAKN | QKEDERTAL,KQKEDERTAL,RTALNVKQGF,KEDERTALNV | CLL |
| MED1 | c.130G>A | p.G44S | LGPPDVYPQDPKQKEDELTALNVKQ[p.G44S]SFNNQPAVSGDEHGSAKNVSFNPAKI | KQSFNNQPA,TALNVKQSF,QSFNNQPAV,KQSFNNQPAV,LTALNVKQSF,VKQSFNNQPA | CLL |
| MED1 | c.3670C>T | p.L1224F | IRSSCDRHLLAASQNRIVDGAVFAV[p.L1224F]FKAVFVLGDAELKGSGFTVTGGTEEL | AVFAVFKAV,FAVFKAVFV,AVFKAVFVL,VFAVFKAVF,VDGAVFAVF,AVFAVF,FAVFKAVFVL,AVFAVFKAVF,IVDGAVFAVF | PRAD |
| MED1 | c.3875G>A | p.C1292Y | LCTDKELILDVLSNMQAQKLLQLI[p.C1292Y]YYPHGIKECTEGDNLQRQHIKRILQN | QLIYYPHGI,LIYYPHGIK,AQKLLQLI,AQKLLQLIYY,QKLLQLIYY,QAQKLL QLIY,LQLIYYPHGI,QLIYYPHGIK,AQKLLQLIYY | TGCT |
| MED1 | c.6211C>T | p.P2071S | QDPMRPRQPQVRQQQRLLQMQQPQQ[p.P2071S]SQPQQPPQPQQSSQSQSQTLGLQAMQ | LQMQQPQQS,MQQPQQSQP,LQMQQPQQSQ,MQQPQ QSQPQ | KIRC |
| MED1 | c.6331_6333delCAG | p.Q2115del | LGLQAMQPQQPLFPRQGLQQTQQQQ[p.Q2115del|TTAALVRQLQKQLSSNQPQGVTPYGHPS | QQTQQQQTA,TQQQQTAAL,TQQQQTAALV,LQQTQQQ QTA,QQTQQQQTAA | PRAD |
| MED1 | c.104G>T | p.S35I | WRSTAFRQKLVSQIEDAMRKAGVAH[p.S35I]IKSSKDMESHVFLKAKTRDEYLSLVA | GVAHIKSSK,MRKAGVAHI,AHIKSSKDM,AMRKAGVAHI,MRKAGVAHIK,AGVAHIKSSK | THCA |
| MED16 | c.1347C>G | p.H449Q | TAGPAVHLKAMQLSWTSLALVGIDS[p.H449Q]QGKLSVLRLSPSMGHPLEVGALRHL | DSQGKLSVLR,IDSQGKLSVL,SQGKLSVLRL | KIRP |
| MEF2A | c.295C>T | p.P99S | EPHESRTNSDIVEALNKKEHRGCDS[p.P99S]SDPDTSYVLTPHTEEKYKKINEEFDN | SSDPDTSYV,DSSDPDTSY,DSSDPDTSYV,CDSSDPDTSY | KIRP |
| MEF2A | c.380G>A | p.R127Q | DTSYVLTPHTEEKYKKINEEFDNM[p.R127Q]QNHKIAPGLPPQNFSMSVTVPVTSPN | NMMQNHKIA,MMQNHKIAP,MQNHKIAPG,MQNHKIAPGL,MMQNHKIAPG,EEFDNMMQNH | TGCT |
| MEFV | c.1130G>A | p.R377H | CPRCQDSHERKSPGSLSPQPLPQCK[p.R377H]HHLKQVQLLFCEDHDEPICLICSLSQ | KHHLKQVQL,HHLKQVQLL,HHLKQVQLLF,QPLPQCKHHL,CKHHLKQVQL,KHHLKQVQLL | BRCA |
| MEGF10 | c.3158C>T | p.S1053L | NPYATIKDPPVLIPKSSECGYVEMK[p.S1053L]LPARRDSPYAEINNSTSANRNVYEVE | YVEMKLPAR,LPARRDSPY,KLPARRDSPY,YVEMKLPARR,LPARRDSPYA,SECGYVEMKL | UCEC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MEGF6 | c.1178A>G | p.Y393C | RTCIDVDDCADSPCCQQVCTNNPGG[p.Y393C]CECGCYAGYRLSADGCGCEDVDECAS | CECGCYAGY, NPGGCECGCY | THCA |
| MEGF6 | c.1746_1747insC | p.A582fs | DTFGKNCSFSCSCQNGGTCDSVTGA[p.A582fs]LPLPPGCQWN* | LPLPPGCQW, CDSVTGALPL | KIRC |
| MET | c.3280C>T | p.H1094Y | VVIGPSSLIVHFNEVIGRGHFGCVY[p.H1094Y]YGTLLDNDGKKIHCAVKSLNRITDIG | RGHFGCVYY, HFGCVYYGTL | KIRP |
| MET | c.3749T>C | p.M1250T | LARDMYDKEYYSVHNKTGAKLPVKW[p.M1250T]TALESLQTQKFTTKSDVWSFGVLLWE | KLPVKWTAL, VKWTALESL, TALESLQTQK, AKLPVKWTAL, LPVKWTALES | KIRP |
| METTL15 | c.157C>G | p.Q53E | VWPNRIHTTAEKYREYEAREQTDQT[p.Q53E]EAQELHRSQDRDFETMAKLHIPVMVD | REQTDQTEA | BRCA |
| METTL16 | c.599G>A | p.R200Q | EIIYDRCMCNPPFFANQLEAKGVNS[p.R200Q]QNPRRPPPSSVNTGGITEIMAEGGEL | SQNPRRPPP, SQNPRRPPPS | CRC |
| METTL21A | c.521G>A | p.R174Q | EETFTDLLQTLEHLCSNHSVILLAC[p.R174Q]QIRYERDNNFLAMLERQFTVRKV | ILLACQIRY, LACQIRYER, VILLACQIRY, SVILLACQIR, LLACQIRYER | CRC |
| METTL6 | c.168C>A | p.F56L | DFKQQKLEQEAQKNWDLFYKRNSTN[p.F56L]LFKDRHWTREFEELRSCREFEDQKL | FYKRNSTNL, KRNSTNLF, YKRNSTNLFK, LFYKRNSTNL, FYKRNSTNLF, YKRNSTNLFK, LFKDRHWTTR | CRC |
| METTL9 | c.170A>T | p.Y57F | LYVNMTSGPGGPAAAAGGRKENHQW[p.Y57F]FVCNREKLCESLQAVFVQSYLDQGTQ | QWFVCNREK, NHQWFVCNR, GRKENHQWF, KENHQWFV C, HQWFVCNREK, ENHQWFVCNR | CLL |
| MEX3C | c.1600C>A | p.R534S | IWTPFBPVNPLSGFGSDPSGNMKTQ[p.R534S]SRGSQPSTPRLSPTFPESIEHPLARR | TQSRGSQPS, KTQSRGSQPS, TQSRGSQPST | TGCT |
| MEX3C | c.537_545del e|CGCGGCGGC | p.179_182AAAA>A | IPGGSLGSVLLPAARPDAREAAAAA[p.179_182AAAA>A]GVLYGGDDAQGMMAAMLSHAYGPGGCGAAAAALN | EAAAAAGVL, REAAAAAGV, EAAAAAGVLY, REAAAAAGVL | ACC |
| MFF | c.19_20AG>TT | p.S7F | MSKGTS[p.S7F]FDTSLGRVSRAAPPSPTAAEMAEISRI | TSFDTSLGR, KGTSFDTSL, GTSFDTSLGR, TSFDTSLGRV, SKGTSFDTSL | TGCT |
| MFF | c.484C>T | p.R162C | TTPQNEIRAVGRLKRERSMSENAV[p.R162C]CQNGQLVRNDSLWHRSDSAPRNKISR | RSMSENAVC, SENAVCQNG, NAVCQNGQLV | CRC |
| MFGE8 | c.508G>A | p.D170N | GASRLASHEYLKAFKVAYSLNGHEF[p.D170N]NFIHDVNKHKEFVGNWNKNAVHVNL | SLNGFIEFNF, HEFNFIHDV, SLNGHEFNFI, YSLNGHEFNF, EFNFIHDVNK, HEFNFIHDVN | UCEC |
| MFSD5 | c.839G>A | p.R280Q | FEAWYIHEHVERHDFPAEWIPATFA[p.R280Q]QAAFWNHVLAVVAGVAAEAVASWIGL | WIPATFAQA, AQAAFWNHV, QAAFWNHVL, IPATFAQAA, ATFAQAAFW, FAQAAFWNHV, AQAAFWNHVL, WIPATFAQAA, QAAFWNHVLA, IPATFAQAAF, AEWIPATFAQ | CRC |
| MGA | c.7304G>A | p.R2435Q | WSDKLQKEAEAFAYYRRTHTANERR[p.R2435Q]QRGEMRDLFEKLKITLGLLHSSKVSK | HTANERRQR, NERRQRGEM, RQRGEMRDL, RQRGEMRDLF | OV |
| MGAT4B | c.1330A>C | p.T444P | STSLKTYQHFTLEKAYLREDFWAF[p.T444P]PPAAGDFIRFRFFQPLRLERFFFRSG | FFWAFPPAA, AFPPAAGDF, DFFWAFPPA, FPPAAGDFI, AFPPAAGDFI, WAFPPAAGDF, PPAAGDFIRF, REDFFWAFPP, EDFFWAFPPA | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MGAT 4C | c.1034C>T | p.T345 M | LAQKNVIRFKPSLFQHMGYYSSYKG[p.T 345M]MENKLKDDFEEESPDIPDPP ASLY | SSYKGMENK,SYKGMENKL,GYYSSYKGM,YSSYKGMENK,S YKGMENKLK,MGYYSSYKGM,SSYKGMENKL,MENKLKDD DF | PRAD |
| MGST 2 | c.304de|A | p.K102f s | FATCLGLVIYGRHLYFWGYSEAAK[p.K 102fs]NGSPVSD* | EAAKNGSPV,SEAAKNGSPV | STAD |
| MGST 3 | c.429_430i nsT | p.G143 fs | SIALLGLVGTTVCSARQHLGWVKSG[p. G143fs]FGQWTQMLPLKNYRGLKTLIH FK* | GQWTQMLPL,GLKTLIHFK,QMLPLKNYR,GFGQWTQML, RGLKTLIHF,QWTQMLPLK,PLKNYRGLK,TQMLPLKNY, LPLKNYRGL,HLGWVKSGF,WVKSGFGQW,SGFGQWTQM, KNYRGLKTL,WTQMLPLKN,MLPLKNYRGL,GQWTQMLPLK, RGLKTLIHFK,TQMLPLKNY,GWVKSGFGQW,QHLGWVKS GF,KSGFGQWTQM,SGFGQWTQML,FGQWTQMLPL,LKN YRGLKTL,KNYRGLKTLI,YRGLKTLIHF | KIRC |
| MICA | c.952de|G | p.G318 fs | HPVPSGK[VLVLQSHWQTFHVSAVAA[p. G318fs]LLLFLLLLFSMSVVVRRKHQLQR VQSS* | VSAVAALLF,AVAALLFLL,LLLLFSMSV,LLLFSMSVV,LLFSMS WV,HVSAVAALL,SMSVVVRRK,FSMSVVVRR,ALLFLLLLF, LFLLLLFSM,VVRRKHQLQ,LFSMSVVVR,SAVAALLFL,VVVR RKHQL,FHVSAVAAL,VAALLFLLL,HQLQRVQSS,SAVAALLF LL,AVAALLFLLL,LLFLLLLFSM,FLLLLFSMSV,LLLLFLLLLF,V VRRKHQLQR,HVSAVAALLF,LFSMSVVVR,SVVVRRKHQL, FHVSAVAALL | CESC |
| MIER2 | c.391C>T | p.L131 F | ESEGGDVAPNLPDMTLDKEQIAKDL[p. L131F]FSGEEEETQSSADDLTPSVTSH EAS | KEQIAKDLF | TGCT |
| MKI67 | c.3241C>A | p.R108 1S | REPAGDGKSIRTFKESPKQILDPAA[p.R 1081S]SVTGMKKWPRTPKEEAQSLEDL AGFK | AASVTGMKK,DPAASVTGM,SVTGMKKWPR,AASVTGMK KW | LUAD |
| MKI67 | c.4991_499 2insCA | p.T166 4fs | VGVKEELLAVGKLTQTSGETTHTHT[p.T 1664fs]KSQQEMVRA* | HTKSQQEMV,HTHTKSQQEM,HTKSQQEMVR | STAD |
| MKI67 | c.4992_499 3insCA | p.T166 4fs | VGVKEELLAVGKLTQTSGETTHTHT[p.T 1664fs]QSQQEMVRA* | HTQSQQEMV,THTQSQQEM,HTHTQSQQEM,HTQSQQE MVR | UCEC |
| MKI67 | c.6637C>G | p.H221 3D | AQPLEDIAGLKELFQTPICTDKPTT[p.H 2213D]DEKTKIACRSPQPDPVGTPTIF KPQ | CTDKPTTDEK | CLL |
| MKL1 | c.920de|C | p.P307f s | HHNYQAILPAPPKSAGEALGSSGTP[p.P 307fs]QYAASPLPIAAPARAPLGPVGW HVRTAPH* | PLGPVGWHV,QYAASPLPI,GWHVRTAPH,LGSSGTPQY,YA ASPLPIA,IAAPARAPL,TPQYAASPL,SPLPIAAPA,LPIAAPAR A,ALGSSGTPQY,YAASPLPIA,APARAPLGPV,PQYAASPLP I,ARAPLGPVGW,APLGPVGWHV | STAD |
| MKLN 1 | c.1455C>A | p.F485 L | CMLFHSKNRCLYVFGGQRSKTYLND[p. F485L]LFSYDVDSDHVDIISDGTKKDSG MVP | YLNDLFSYD,TYLNDLFSY,RSKTYLNDL,KTYLNDLFS,SKTYLN DLF,KTYLNDLFSY,YLNDLFSYDV,RSKTYLNDLF | UCEC |
| MKRN 3 | c.1343C>A | p.P448 H | PEGWGDEPPGPGGGSFSAYWHQLVE[p. P448H]HVRMGEGNMLYKSIKKELVV LRLASL | YWHQLVEH,HVRMGEGNM,HQLVEHVRM,AYWHQLVE HV,HVRMGEGNML,YWHQLVEHVR,SAYWHQLVEH,WH QLVEHVRM | LUAD |
| MKRN 3 | c.809G>T | p.G270 V | YYASRGVCFRGESCMYLHGDI[p.G270V]VLQTLHPMDAAQREHMRACI EAHEK | CVLQTLHPM,CDMCVLQTL,MCVLQTLHPM | LUSC |
| MLL2 | c.1939_194 0insC | p.P647f s | ASRLSPPPEDSPMSPPPEESPMSPP[p.P 647fs]T* | EESPMSPPT | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|------|-------------|----------------|---|---|---|
| MLL2 | c.1940del|C | p.P647fs | EASRLSPPPEDSPMSPPPEESPMSP[p.P647fs]HLRYRAYPPCLWCHACLHRLRN LPCPHRLRSLPRPLHLRLHASPHHLRTPP HPHHLRTHLLPHHRRTRSCPCRWRSHP CCHYLRSNSAPGPRGRTCHPGLRSRT CPPGLRSHTYLRRLRSHTCPPSLRSHAY ALCLRSHTCPPRLRDHICPLSLRNCTCPP RLRSRTCLLCLRSHACPPNLRNHTCPPSL RSHACPPGLRNRICPLSLRSHPCPLGLKS PLRSQANALHLRSCPCSLPLGNHPYLPC LESQPCLSLGNHLCPLCPRSCRCPHLGS HPCRLS* | RLHASPHHL,SLRSHAYAL,RLRDHICPL,SLGNHLCPL,RLRSR TCLL,GLRNRICPL,SLRSHPCPL,HLRSCPCSL,HLGSHPCRL,H LRTHLLPH,GLRSHTYLR,RTHLLPHHR,SQANALHLR,RYRAY PPCL,HLRYRAYPP,RLRNLPCPH,RLRSLPRPL,RSLPRPLHL,H LRLHASPH,HLRTPPHPH,RTPPHPHL,RTRSCPCRW,RWR SHPCCH,RSHPCCHYL,HYLRSRNSA,RSRNSAPGP,RGRTCH PGL,RSRTCPPGL,RSHTYLRRL,HTYLRRLRS,RLRSHTCPP,RS HTCPPSL,RSHAYALCL,RSHTCPPRL,RSRTCLLCL,RSHACPP NL,RNHTCPPSL,RSHACPPGL,RNRICPLSL,RSHPCPLGL,RS QANALHL,RSCPCSLPL,SPMSPHLRY,SLPLGNHPY,ESPMSP HLR,PMSPHLRYR,NLPCPHRLR,SLPRPLHLR,LLPHHRRTR,S HAYALCLR,DHICPLSLR,MSPHLRYRA,SPHLRYRAY,LPRPL HLRL,RPLHLRLHA,SPHHLRTPP,HPHHLRTHL,LPHHRRTRS, APGPRGRTC,CPLGLKSPL,LPLGNHPYL,CPRSCRCPH,CPHL GSHPC,YLRSRNSAP,NLRNHTCPP,WRSHPCCHY,RDHICPL SL,LESQPCLSL,EESPMSPHL,PPSLRSHAY,CPPRLRDHI,CPP GLRNRI,ESPMSPHLRY,CSLPLGNHPY,SLPLGNHPYL,SLPRP LHLRL,GLKSPLRSQA,YLPCLESQPC,RLRNLPCPHR,RLRSLP RPLH,RLHASPHHLR,GLRSHTYLRR,RSHAYALCLR,CLRSHT CPPR,SLRNCTCPPR,RSRTCLLCLR,RSHPCPLGLK,RSLPRPL HLR,RTHLLPHHRR,RSHPCCHYLR,RTCHPGLRSR,RSHTCPP SLR,RSHTCPPRLR,CTCPPRLRSR,RSHACPPNLR,RSHACPP GLR,RSAQANALHLR,RYRAYPPCLW,LWCHACLHRL,HLRYR AYPPC,RNLPCPHRLR,HLRLHASPHH,HLRTPPHPHH,RTPP HPHHLR,HLRTHLLPHH,HLLPHHRRTR,RTRSCPCWRR,RSC PCRWRSH,RWRSHPCCHY,RSRNSAPGPR,RGRTCHPGLR, GLRSRTCPPG,RSRTCPPGLR,RSHTYLRRLR,HTYLRRLRSH,R LRSHTCPPS,SLRSHAYALC,RLRDHICPLS,RLRSRTCLLC,RN HTCPPSLR,SLRSHACPPG,GLRNRICPLS,RNRICPLSLR,SLRS HPCPLG,KSPLRSQANA,MSPHLRYRAY,SPMSPHLRYR,CL WCHACLHR,CPHRLRSLPR,HPCCHYLRSR,HACPPGLRNR,L PCPHRLRSL,RPLHLRLHAS,SPHHLRTPPH,HPHHLRTHLL,L PHHRRTRSC,PPRLRSRTCL,SPLRSQANAL,CPRSCRCPHL,Y LRSRNSAPG,YLRRLRSHTC,HAYALCLRSH,LRYRAYPPCL,R AYPPCLWCH,HRLRSLPRPL,LRSLPRPLHL,LHLRLHASPH,LR LHASPHHL,LRTPPHPHL,HHLRTHLLPH,WRSHPCCHYL,C HYLRSRNSA,LRSHTYLRRL,LRSHTCPPSL,LRSHAYALCL,LRS HTCPPRL,LRNCTCPPRL,LRSHACPPNL,LRNHTCPPSL,LRSH ACPPGL,LRNRICPLSL,LSLRSHPCPL,LRSQANALHL,SQANA LHLRS,LHLRSCPCSL,LRSCPCSLPL,LSLGNHLCPL,CPPGLRS HTY,CPPSLRSHAY | STAD |
| MLL2 | c.1966del|C | p.L656fs | EDSPMSPPPEESPMSPPPEVSRLSP[p.L656fs]CLWCHACLHRLRNLPCPHRLRSL PRPLHLRLHASPHHLRTPPHPHHLRTHL LPHHRRTRSCPCRWRSHPCCHYLRSRN SAPGPRGRTCHPGLRSRTCPPGLRSHTY LRRLRSHTCPPSLRSHAYALCLRSHTCPP RLRDHICPLSLRNCTCPPRLRSRTCLLCL RSHACPPNLRNHTCPPSLRSHACPPGLR | RLHASPHHL,SLRSHAYAL,RLRDHICPL,SLGNHLCPL,RLRSR TCLL,GLRNRICPL,SLRSHPCPL,HLRSCPCSL,HLGSHPCRL,H LRTHLLPH,GLRSHTYLR,RTHLLPHHR,SQANALHLR,RLRNL PCPH,RLRSLPRPL,RSLPRPLHL,HLRLHASPH,HLRTPPHPH, RTPPHPHL,RTRSCPCRW,RWRSHPCCH,RSHPCCHYL,HY LRSRNSA,RSRNSAPGP,RGRTCHPGL,RSRTCPPGL,RSHTYL RRL,HTYLRRLRS,RLRSHTCPP,RSHTCPPSL,RSHAYALCL,RS HTCPPRL,RSRTCLLCL,RSHACPPNL,RNHTCPPSL,RSHACP | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| | | | NRICPLSLRSHPCPLGLKSPLRSQANALH LRSCPCSLPLGNHPYLPCLESQPCLSLGN HLCPLCPRSCRCPHLGSHPCRLS* | PGL, RNRICPLSL, RSHPCPLGL, RSQANALHL, RSCPCSLPL, SL PLGNHPY, NLPCPHRLR, SLPRPLHLR, LLPHHRRTR, SHAYAL CLR, DHICPLSLR, EVSRI, PCL, LPRPLHLRL, RPLHLRLHA, SPH HLRTPP, HPHHLRTHL, LPHHRRTRS, APGPRGRTC, CPLGLKS PL, LPLGNHPY, CPRSCRCPH, CPHLGSHPC, YLRSRNSAP, NL RNHTCPP, VSRLSPCLW, WRSHPCCHY, RDHICPLSL, LESQP CLSL, PPSLRSHAY, CPPRLRDHI, CPPGLRNRI, CSLPLGNHPY, RLSPCLWCHA, SLPLGNHPYL, SLPRPLHLRL, GLKSPLRSQA, Y LPCLESQPC, RLRNLPCPHR, RLRSLPRPLH, RLHASPHHLR, GL RSHTYLRR, RSHAYALCLR, CLRSHTCPPR, SLRNCTCPPR, RSR TCLLCLR, RSHPCPLGLK, RSLPRPLHLR, RTHLLPHHRR, RSHP CCHYLR, RTCHPGLRSR, RSHTCPPSLR, RSHTCPPRLR, CTCP PRLRSR, RSHACPPNLR, RSHACPPGLR, RSQANALHLR, LWC HACLHRL, RNLPCPHRLR, HLRLHASPHH, HLRTPPHPHH, RT PPHPHHLR, HLRTHLLPHH, HLLPHHRTR, RTRSCPCRWR, R SCPCRWRSH, RWRSHPCCHY, RSRNSAPGPR, RGRTCHPGL R, GLRSRTCPPG, RSRTCPPGLR, RSHTYLRRLR, HTYLRRLRSH, RLRSHTCPPS, SLRSHAYALC, RLRDHICPLS, RLRSRTCLLC, R NHTCPPSLR, SLRSHACPPG, GLRNRICPLS, RNRICPLSLR, SL RSHPCPLG, KSPLRSQANA, CLWCHACLHR, CPHRLRSLPR, H PCCHYLRSR, HACPPGLRNR, LPCPHRLRSL, RPLHLRLHAS, S PHHLRTPPH, HPHHLRTHLL, LPHHRRTRSC, PPRLRSRTCL, S PLRSQANAL, CPRSCRCPHL, YLRSRNSAPG, YLRRLRSHTC, H AYALCLRSH, HRLRSLPRPL, LRSLPRPLHL, LHLRLHASPH, LRL HASPHHL, LRTPPHPHHL, HHLRTHLLPH, WRSHPCCHYL, CH YLRSRNSA, LRSHTYLRRL, LRSHTCPPSL, LRSHAYALCL, LRSH TCPPRL, LRNCTCPPRL, LRSHACPPNL, LRNHTCPPSL, LRSHA CPPGL, LRNRICPLSL, LSLRSHPCPL, LRSQANALHL, SQANAL HLRS, LHLRSCPCSL, LRSCPCSLPL, LSLGNHLCPL, CPPGLRSH TY, CPPSLRSHAY | |
| MLL2 | c.7061delC | p.P235 4fs | APLTPRASQVEPQSPGLGLRPQEPP[p.P 2354fs]LPRLWHLLLQVTQTSFALAPTL THMLSPH* | RLWHLLLQV, ALAPTLTHM, LQVTQTSFA, VTQTSFALA, QVT QTSFAL, QTSFALAPT, LPRLWHLLL, LLQVTQTSF, GLRPQEP PL, TQTSFALAP, TSFALAPTL, FALAPTLTH, RLWHLLLQVT, LAPTLTHML, LLQVTQTSFA, LQVTQTSFAL, LLLQVTQTSF, Q VTQTSFALA, QTSFALAPTL, RPQEPPLPRL, FALAPTLTHM, TQTSFALAPT | STAD |
| MLL3 | c.1066C>A | p.Q356 K | IDQAPERSKEDANCAVCDSPGDLLD[p. Q356K]KFFCTTCGQHYHGMCLDIAVT PLKRA | LLDKFFCTT, SPGDLLDKF, SPGDLLDKFF | LUAD |
| MLL3 | c.1179C>A | p.N393 K | GMCLDIAVTPLKRAGWQCPECKVCQ[p. N393K]KCKQSGEDSKMLVCDTCDKGY HTFCL | KCKQSGEDSK | LUAD |
| MLL3 | c.13488del T | p.F449 6fs | TSGCHRPRCTNIYHFTCAIKAQCMF[p.F 4496fs]LRTKLCFAPCTNQREFMSKN* | FLRTKLCFA, AIKAQCMFL, AQACMFLRTK, MFLRTKLCF, RTKL CFAPC, CFAPCTNQR, AIKAQCMFLR, KAQCMFLRTK, CTNQ REFMSK, CMFLRTKLCF, RTKLCFAPCT, FLRTKLCFAP, AQCM FLRTKL, FAPCTNQREF | STAD |
| MLL5 | c.197A>G | p.Y66C | YPHQLYTSSSHHSHSYIGLPYADHN[p.Y 66C]CGARPPTPPASPPPSVLISKNEVG I | LPYADHNCGA | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MLXIPL | c.2368A>C | p.S790R | NWKFWFSILIRPLFESFNGMVSTA[p.S790R]RVHTLRQTSLAWLDQYCSLPALRPTV | STARVHTLR, RVHTLRQTS, GMVSTARVH, VSTARVHTL, STARVHTL, VSTARVHTLR, RVHTLRQTSL, SFNGMVSTAR | KIRC |
| MMAA | c.976C>T | p.R326C | RIQAEYVSALKLLRRSQVWKPKVI[p.R326C]CISARSGEGISEMDKMKDFQDLMLA | CISARSGEGI | CRC |
| MMP3 | c.190del|A | p.I64fs | ENYYDLKKDVKQFVRRKDSGPVVKK[p.I64fs]SEKCRSSLDWR* | KSEKCRSSL, KCRSSLDWR, KKSEKCRSSL, SEKCRSSLDW | STAD |
| MMRN1 | c.2751C>A | p.F917L | QALQLQVLNSRFKALEAKSIHLSIN[p.F917L]LFSLNKTLHEVLTMCHNASTSVSELN | HLSINLFSL, NLFSLNKTL, SINLFSLNK, KSIHLSINLF, KSIHLSINL, LSINLFSLNK, KSIFHLSINLF, AKSIHLSINL, IHLSINLFSL | UCEC |
| MMRN1 | c.3037G>T | p.A1013S | RSLPGSLANVKSQKQVKSLPKKIN[p.A1013S]SLKKPTVNLTTVLIGRTQRNTDNIIY | SLPKKINSL, SLKKPTVNL, KSLPKKINS, LPKKINSLK, SLPKKINS LK, KSLPKKINSL, KINSLKKPTV | LUAD |
| MMS19 | c.3013G>A | p.D1005N | ALTRLPTPVLLPYKPQVIRALAKPL[p.D1005N]NDKKRLVRKEPAVSARGEWFLLGSPGS | ALAKPLNDK, LAKPLNDKK, RALAKPLNDK, ALAKPLNDKK | TGCT |
| MN1 | c.1415C>T | p.S472L | APPYMNVAKRPRFDFPGSAGVDRCA[p.S472L]LWNGSMHNGALDNHLSPSAYPGLPGE | RCALWNGSM | BLCA |
| MOCOS | c.2545T>C | p.S849P | NQHVFQKLSESRETKVNFGMYLMHA[p.S849P]PLDLSSPCFLSVGSQVLPVLKENVEG | GMYLMHAPL, YLMHAPLDL, FGMYLMHAPL, YLMHAPLDLS, MYLMHAPLDL, APDLSSPCF, LMHAPLDLSS | KIRC |
| MOCS2 | c.65del|C | p.P22fs | MSSLEISSSCFSLETKLPLSP[p.P22fs]H* | LETKLPLSPH | STAD |
| MOGAT2 | c.197_198insG | p.Q66fs | TRFWLLTVLYAAWYLDRDKPRQGGI[p.Q66fs]PAHPGHQVLDYMEVHEGLFPHLAGQDC* | HQVLDYMEV, GLFPHLAGQ, DYMEVHEGL, KPRQGGPAH, GPAHPGHQV, RQGGPAHPG, DYMEVHEGLF, HPGHQVLDY, EVHEGLFPH, HEGLFPHLA, DYMEVHEGLF, EVHEGLFPHL, GPAHPGHQVL, RQGGPAHPGH, AHPGHQVLDY, HQVLDYM EVH, LDYMEVHEGL, MEVHEGLFPH, HPGHQVLDYM | LUAD |
| MORC1 | c.337G>T | p.D113Y | KRLSTLKFIGQYGNGLKSGSMRIGK[p.D113Y]YFILFTKKEETMTCVFFSQTFCEEES | SMRIGKYFI, RIGKYFILF, KYFILFTKK, SGSMRIGKY, MRIGKYF IL, GSMRIGKYF, IGKYFILFTK, MRIGKYFILF, GSMRIGKYFI, S MRIGKYFIL, KSGSMRIGKY, SGSMRIGKYF | CRC |
| MORC2 | c.2219G>A | p.R740H | SDSAGEDSADLKRAQKDKGLHVEV[p.R740H]HVNREWYTGRVTAVEVGKHVVRWKVK | VEVHVNREW, HVNREWYTGR, VEVHVNREWY | CRC |
| MPDZ | c.2410C>A | p.L804I | VRIGVAKPLPLSPEEGVSAKEDSF[p.L804I]IYPPHSCEEAGLADKPLFRADLALVG | SAKEDSFIY, KEDSFIYPP, VSAKEDSFIY, YVSAKEDSFI | CRC |
| MPDZ | c.4745del|A | p.K1582fs | KLTIHAENPDSQAVPSAAGAASGEK[p.K1582fs]RTAPSL* | GEKRTAPSL | STAD |
| MPRIP | c.1052del|C | p.A351fs | SSDTRQGRSEKRAFPPKRDFTNEAP[p.A351fs]QLLSQTPRLPPCLHTEEPSHWTGGPRSPP* | FTNEAPQLL, QLLSQTPRL, SQTPRLPPC, RDFTNEAPQL, SQT PRLPPCL, CLHTEEPSHW, NEAPQLLSQT | STAD |
| MR1 | c.137C>T | p.S46L | DSRTHSLRYFRLGVSDPIHGVPEFI[p.S46L]LVGYVDSHPITTYDSVTRQKEPRAPW | VPEFILVGY, GVPEFILVGY, VPEFILVGYV | CRC |
| MRPL47 | c.700C>A | p.L234I | LRLEREKRARIKARKENLERKKAKI[p.L234I]ILKKFPHLAEFAQKSSLV* | ILKKFPHLA, RKKAKIILK, IILKKFPHL, KAKIILKKF, RKKAKIILKK, KIILKKFPHL, LERKKAKIIL, KKAKIILKKF | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MRPS25 | c.355_357de|GAG | p.E119del | SNKEIMEHIRKILGKNEETLREEE|p.E119de|]KKQLSHPANFGPRKYCLRECICEVEGQV | REEEEKKQL | TGCT |
| MS4A4A | c.295G>A | p.V99M | ALMSLSMGITMMCMASNTYGSNPISM|V99M]MYIGYTIWGSVMFIISGSLSIAAGIR | ISMYIGYTI, TYGSNPISM, SMYIGYTIW, MYIGYTIWG, YGSNPISMY, NPISMYIGY, ISMYIGYTIW, MYIGYTIWGS, TYGSNPISMY, NTYGSNPISM | BRCA |
| MS4A8B | c.8C>T | p.S3L | MN[p.S3L]LMTSAVPVANSVLVVAPHNGYPVTPG | NLMTSAVPV, LMTSAVPVA, NLMTSAVPVA, MNLMTSAVPV | CRC, UCEC |
| MSH4 | c.1392G>T | p.K464N | KNCNTPLLRAYYGSLEDKRFGIILE|p.K464N]NIKTVINDDARYMKGCLNMRTQKCYA | IILENIKTV, RFGIILENI, GIILENIKTV, RFGIILENIK, KRFGIILENI | CRC |
| MSH4 | c.2188G>A | p.E730K | YVPAEYSSFRIAKQIFTRISTDDDI[p.E730K]KTNSSTFMKEMKEIAYILHNANDKSL | KTNSSTFMK, KTNSSTFM | UCEC |
| MSH6 | c.1727A>C | p.D576A | GHTRAYGCVFDTSLGKFFIGQFSD[p.D576A]ARHCSRFRTLVAHYPPVQVLFEKGNL | FSDARHCSR, DARHCSRFR, GQFSDARHC, SDARHCSRF, FSDARHCSRF, KFFIGQFSDA, FFIGQFSDAR, QFSDARHCSR, GQFSDARHCS, ARHCSRFRTL | TGCT |
| MSH6 | c.3254_3255insC | p.T1085fs | LANYSRGGDGPMCRPVILLPEDTPP[p.T1085fs]LLRA* | LLPEDTPPL, LPEDTPPLL, ILLPEDTPPL, LLPEDTPPLL | CRC, STAD |
| MSH6 | c.3284G>A | p.R1095H | GDGPMCRPVILLPEDTPPFLELKGS[p.R1095H]HHPCITKTFFGDDFIPNDILIGCEEE | GSHHPCITK, KGSHHPCITK, ELKGSHHPCI, SHHPCITKF, LELKGSHHPC | CRC |
| MSLNL | c.202A>C | p.T68P | MTSARRRTDVGPRVAFTYPCTQLSP[p.T68P]PRAHRHLPVHTVTYPCTQLSPTRAHS | QLSPPRAHR, SPPRAHRHL, TQLSPPRAH, PPRAHRHLPV | PRAD |
| MST1 | c.1304de|A | p.N435fs | AETPHKPQFTFTSEPHAQLEENFCR[p.N435fs][TQMGIAMGPGATRWTQGPHSTTVPCDAALMTSRHQSWTPQTRCSLRSVARGWIGWISGVPSCAWLGAIRATHPGQSACGIGRASISAGGL* | GWIGWISGV, WISGVPSCA, RTQMGIAMG, QTRCSLRSV, RCSLRSVAR, AIRATHPGQ, HQSWTPQTR, HPGQSACGI, EENFCRTQM, CRTQMGIAM, SLRSVARGW, ISGVPSCAW, RATHPQQSA, SLRSVARGWI, SVARGWIGWI, QTRCSLRSVA, RGWIGWISGV, AIRATHPGQS, WTPQTRCSLR, VPSCAWLGAI, FCRTQMGIAM, LEENFCRTQM, CSLRSVARGW, RSVARGWIGW, WISGVPSCAW | KIRP |
| MTG1 | c.1390A>G | p.M464V | FNGLLGPVQVTALYVTRLDNVTVAH[p.M464V]VGTMDGRILQVELVRSLNLLYVSNF | VTVAHVGTM, RLDNVTVAHV | KIRC |
| MTG1 | c.315de|A | p.L105fs | LNKMDLADLTEQQKIMQHLEGEGLK[p.L105fs]MSFLPTV* | HLEGEGLKM, LKMSFLPTV, GEGLKMSFL, GLKMSFLPTV, LEGEGLKMSF | STAD |
| MTG1 | c.981de|C | p.H327fs | DFLQTFRRGLLGSVMLDLDVLRGH[p.H327fs]RLRLCPELVRVGRAGGMWPPRPPDLGG* | RLCPELVRV, RLRLCPELV, RAGGMWPPR, MWPPRPPDL, VLRGHPRLR, RGHPRLRLC, LVRVGRAGG, HPRLRLCPE, RVGRAGGMW, GMWPPRPPDL, RLRLCPELVR, VLRGHPRLRL, LVRVGRAGGM, DLDVLRGHP, DVLRGHPLR, HPRLRLCPEL | STAD |
| MTIF2 | c.326de|A | p.N109fs | STKSKKVVEVWIGMTIEELARAMEK[p.N109fs]TQIMYMKLY* | AMEKTQIMY, KTQIMYMKL, RAMEKTQIM, TQIMYMKLY, MEKTQIMYM, KTQIMYMKLY, RAMEKTQIMY, MEKTQIMY, MK, ARAMEKTQIM, AMEKTQIMYM | STAD |
| MTMR9 | c.577de|A | p.K193fs | DEALRKVATFRHGGRFPVLSYHKK[p.K193fs]MGW* | SYHKKMGW, VLSYYHKKM, LSYYHKKMGW | KICH |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MTOR | c.4379T>C | p.L146 0P | YAMKHFGELEIQATWEKLHEWEDA[p. L1460P]PVAYDKKMDTNKDDPELML GRMRCLE | APVAYDKKM,HEWEDAPVA,KLHEWEDAPV,HEWEDAPV AY | KIRC |
| MTOR | c.4448G>T | p.C148 3F | DALVAYDKKMDTNKDDPELMLGRMR[p. C1483F]FLEALGEWGLHQQCCEK WTLVNDET | LMLGRMRFL,RFLEALGEW,LGRMRFLEA,RMRFLEALG,EL MLGRMRF,GRMRFLEAL,MLGRMRFLEA,RMRFLEALGE LMLGRMRFL,LGRMRFLEAL,MRFLEALGEW | KIRC |
| MTOR | c.6644C>A | p.S221 5Y | EDLRQDERVMQLFGLVNTLLANDPT[p. S2215Y]YLRKNLSIQRYAVIPLSTNSGLI GWV | LLANDPTYL,LANDPTYLR,TYLRKNLSI,TLLANDPTY,TLLAN DPTYL,LLANDPTYLR,LANDPTYLRK,NTLLANDPTY,YLRKNL SIQR | UCEC |
| MTUS 2 | c.3013C>T | p.R100 5W | YPKQRTAAARNGFPPKPDPQAREAE[p. R1005W]WQLVLRLKERCEQQTRQLGV AQGELK | EAEWQLVLR,REAEWQLVL,AEWQLVLRL,DPQAREAEW,A EWQLVLRLK | STAD |
| MUC1 6 | c.15355C>T | p.P511 9S | LPNFSSTSDKILATSKDSKDTKEIF[p.P51 19S]SSINTEETNVKANNSGHESHSPAL AD | DTKEIFSSI,KEIFSSINT,KDTKEIFSSI | SKCM |
| MUC1 6 | c.18466G>A | p.A615 6T | PDISPEASSSHSNSPPLTISTHKTI[p.A61 56T]TTQTGPSGVTSLGQLTLDTSTIATS A | TTQTGPSGV,ITTQTGPSGV | STAD |
| MUC1 6 | c.25817G>A | p.R860 6H | ESISSSPHPVTALLTLGPVKITDML[p.R8 606H]HTSSEPETSSPPNLSSTSAEILATS E | MLHTSSEPET | CRC |
| MUC1 6 | c.31355_31 356insC | p.P104 52fs | GIMEHITKIPNEAAHRGTIRPVKGP[p.P 10452fs]SDIHFACQS* | RPVKGPSDI,VKGPSDIHF | KICH |
| MUC1 6 | c.33014C>T | p.T110 05I | VLPEVPGMVTSLVASSRAVTSTTLP[p.T H005I]ILTLSPGPETTPSMATSHGAE ASST | AVTSTTLPI,LPILTLSPG,RAVTSTTLPI | CLL |
| MUC1 6 | c.33778C>G | p.P112 60A | IDSWVAHPGTEASSVVPTLTVSTGE[p.P 11260A]AFTNISLVTHPAESSSTLPRTTS RFS | STGEAFTNI,EAFTNISLV,LTVSTGEAF,GEAFTNISL,TLTVST GEAF,GEAFTNISLV | KIRC |
| MUC1 6 | c.34782C>A | p.N115 94K | YEPETTATWLTHPAETSTTVSGTIP[p.N 11594K]KFSHRGSDTAPSMVTSPGVDT RSGVP | TTVSGTIPK,GTIPKFSHR,STTVSGTIPK,TTVSGTIPKF | LUSC |
| MUC1 6 | c.38321G>A | p.R127 74H | SGCRLTLLRSEKDGAATGVDAICTH[p.R 12774H]HLDPKSPGVDREQLYWELSQL TNGIK | HLDPKSPGV,AICTHHLDPK | HNSC |
| MUC1 7 | c.13244G>A | p.R441 5H | LVYGLVGAGVVLMLIIVALLMLVF[p.R44 15H]HSKREVKRQKYRLSQLYKWQEE DSGP | LLMLVFHSK,VFHSKREVK,LMLVFHSKR,MLVFHSKREV, ALLMLVFHSK,LVFHSKREVK,HSKREVKRQK,LLMLVFHSKR,VF HSKREVKR | BRCA |
| MUC1 7 | c.229G>A | p.V77 M | CQQLSQHVRTGSAANTATGTTSTNV[p. V77M]MEPRMYLSCCSTNPEMTSIESSV TSDT | NVMEPRMYL,TSTNVMEPR,MEPRMYLSC,STNVMEPRMY, TTSTNVMEPR,NVMEPRMYLS,ATGTTSTNVM | GBM |
| MUC1 7 | c.3680_368 1insC | p.R122 7fs | PTAEVTSMPTSTPGERSTPLTSMPV[p. R1227fs]STHASGQF* | TSMPVSTHA,VSTHASGQF,MPVSTHASG,LTSMPVSTHA, MPVSTHASGQ | KIRC |
| MUC1 7 | c.3683de lA | p.H122 8fs | TAEVTSMPTSTPGERSTPLTSMPVR[p. H1228fs]PRQWPVLRLAPFQHLPLTPA HL* | FQHLPLTPA,HLPLTPAHL,LTSMPVPR,PVRPRQWPV,RPR QWPVLR,RQWPVLRLA,WPVLRLAPF,LRLAPFQHL,LAPFQ HLPL,RLAPFQHLPL,VLRLAPFQHL,QWPVLRLAPF,PVRPR QWPVL,MPVRPRQWPV,RPRQWPVLRL,FQHLPLTPAH,TS MPVRPRQW,RQWPVLRLAP | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MUC17 | c.6836C>A | p.T2279N | STEATSSPTTAEGTSIPTSTLSEGT[p.T2279N]NPLTSIPVSHTLVANSEVSTLSTTPV | TLSEGTNPL, TLSEGTNPLT, GTNPLTSIPV, STLSEGTNPL, SEG TNPLTSI, NPLTSIPVSH | TGCT |
| MUC2 | c.4703C>T | p.T1568M | TTTVTPTPTGTQTPTTPITTT[p.T1568M]MVTPTPTPTGTPTSTPITTTTTVT | TTPITTTM, TPITTTMV, TTTTMVTPT, TTMVTPTPT, MVTPTPT, TTTPITTTTM, TTPITTTTMV, TMVTPTPTPT, TPITTTTMVT | TGCT |
| MUC2 | c.4739C>A | p.T1580N | TQTPTTTPITTTTTVTPTPTPTGTQ[p.T1580N]NPTSTPITTTTVTPTPTPTGTQTPT | TQNPTSTPI, TQNPTSTPIT | TGCT |
| MUC2 | c.4745C>G | p.T1582R | TPTTTPITTTTTVTPTPTPTGTQTP[p.T1582R]RSTPITTTTTVTPTPTPTGTQTPTTT | TQTPRSTPI, GTQTPRSTPI, TPRSTPITTT | KIRP |
| MUC2 | c.4790C>T | p.T1597I | TPTPTGTATPTSTPITTTTTVTPTP[p.T1597I]IPTGTQTPTTTPITTTTTVTPTPTPT | TTTVTPTPI, TTTTVTPTPI, TTVTPTPTPT, | TGCT |
| MUC2 | c.5111C>T | p.T1704I | TTTTVTPTPTGTQTPTSTPITT[p.T1704I]ITTVTPTPTGTQTPTPTSTTTTT | TTITTVTPT, TPITTITTV, STPITTITTV, TPITTTTTVT, TPTSTPITTI | TGCT |
| MUC2 | c.5117C>T | p.T1706M | TTTVTPTPTGTQTPTSTPITTN[p.T1706M]MVTPTPTGTQTPTPTSTTT | TPITTTMV, TTTTMVTPT, TTMVTPTPT, MVTPTPTPT, STPI TTTTMV, TSTPITTTTM, TMVTPTPTPT, TPITTTMVT | TGCT |
| MUC2 | c.5143G>A | p.G1715S | PTGTQTPTSTPITTTTVTPTPTPT[p.G1715S]STQTPTPTPISTTTTVTPTPTPTGT Q | STQTPTPTPI | TGCT |
| MUC2 | c.5165C>T | p.T1722I | TSTPITTTTVTPTPTGTQTPTP[p.T1722I]IPISTTTTVTPTPTGTQTPTTTPI | IPISTTTTV, TQTPTPIPI, TPIPISTTT, TPIPISTTT, IPISTTTTVT | KIRP |
| MUC5B | c.2041A>G | p.S681G | YMGIFLVIETHGMAVSMDRKTSVFI[p.S681G]GLHQDYKGRVCGLCGNFDDNAI NDFA | KTSVFIGLH, FIGLHQDYK, VFIGLHQDY, RKTSVFIGL, GLHQD YKGRV, VFIGLHQDYK, SVFIGLHQDY | ACC |
| MUC5B | c.2045A>G | p.D682G | MGIFLVIETHGMAVSMDRKTSVFIR[p.D682G]RHQDYKGRVCGLCGNFDDNAINDFAT | FIRRHQDYK, KTSVFIRRH, VFIRRHQDY, VFIRRHQDYK, SVFI RRHQDY | ACC, KIRP |
| MUC6 | c.4707_4708insA | p.P1569fs | ITPNPTSTRTRPTPVAHTNSATSSRP[p.P1569fs]TTTLHHTLPTYREQSLLFHRSHD GNILQDHHYLSNPITPSDHTSHSRSTFL HLFGDSKYSHSHHPYPCTDGHFCLHPL NANRHDSSTDNAQGHRVHPHSANND ADHQRDQPSPELIKHSQNLYIPTFTHFL HTPC* | CTDGHFCLH, YLSNPITPS, YIPTFTHFL, FLHLFGDSK, CLHPLN ANR, TYREQSLLF, SRSTFLHLF, KYSHSHHPY, SQNLYIPTF, LYIPTFTHF, SSRPTTTLH, TSHSRSTFL, HSRSTFLHL, RSTFLH LFG, RVHPHSANN, TLHHTLPTY, LHLFGDSKY, LIKHSQNLY, FTHF LHTPC, LPTYREQSL, HPHSANNDA, ELIKHSQNL, HTSHSRST F, TSSRPTTTL, HRSHDGNIL, GNILQDHHY, HHYLSNPIT, SKY SHSHHP, AQGHRVHPH, IKHSQNLYI, HPYPCTDGH, IPTFTH FLH, TTLHHTLPTY, STDNAQGHRV, LIKHSQNLYI, TLHHTLPT YR, TSHSRSTFLH, TFLHLFGDSK, PTYREQSLLF, HSRSTFLHLF, HSQNLYIPTF, NLYIPTFTHF, LYIPTFTHFL, ATSSRPTTTL, SSR PTTTLHH, HTSHSRSTFL, RVHPHSANND, HQRDQSPEL, FL HLFGDSKY, SKYSHSHHPY, ELIKHSQNLY, RPTTTLHHTL, LPT YREQSLL, HPYPCTDGHF, EQSLLFHRSH, FHRSHDGNIL, SHS RSTFLHL, HLFGDSKYSH, YSHSHHPYC, KHSQNLYIPT, SQN LYIPTFT, YPCTDGHFCL, REQSLLFHRS, QDHHYLSNPI, IPTFT HFLHT | KIRC |
| MUC6 | c.5930C>A | p.P1977H | AHTTSASSRLPTPFTTHSPPTGSS[p.P1977H]HFSSTGPMTATSFQTTTYPTPS HPQ | SHFSSTGPM, SSHFSSTGPM, HSPPTGSSHF, SHFSSTGPMT | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MUC6 | c.6000C>G | p.H200 0Q | SSPFSSTGPMTATSFQTTTYPTPS[p.H2000Q]QPQTTLPTHVPPFSTSLVTPSTHTVI | TPSQPQTTL, SQPQTTLPT, SQPQTTLPTH, QPQTTLPTHV | TGCT |
| MUC6 | c.6387_6389del CTC | p.2129_2130S S>S | SPITTQLPHLSSATTPVSTTNQLSS[p.2129_2130SS>S]FSPSPSAPSTVSSYVPSSHSSPQTSSPS | STTNQLSSF, NQLSSFSPS, VSTTNQLSSF, NQLSSFSPSP | STAD |
| MUC7 | c.1007C>T | p.S336 L | PNSSPTTLAPDTSETSAAPTHQTTT[p.S336L]LVTTQTTTTKQPTSAPGQNKISRFLL | APTHQTTTL, HQTTTLVT, LVTTQTTTTK, APTHQTTTLV, HQTTTLVTTQ | UCEC |
| MVK | c.412del C | p.P138f s | YLSICRKQRALPSLDIVVWSELPPG[p.P138fs]RAWAPAPPTRCVWQPS* | RAWAPAPPT, APAPPTRCV, SELPPGRAW, RAWAPAPPTR, VVWSELPPGR, WAPAPPTRCV, LPPGRAWAPA, APAPPTRCVW, SELPPGRAWA | STAD |
| MXRA5 | c.970G>T | p.D324 Y | EEDGGSQLILEKFQLPQWSISLNMT[p.D324Y]YEHGNMVNLVCDIKKPMDVYKIHLNQ | WSISLNMTY, MTYEHGNMV, NMTYEHGNM, YEHGNMVNL, NMTYEHGNMV, TYEHGNMVNL, QWSISLNMTY, LNMTYEHGNM, YEHGNMVNLV | LUAD |
| MYB | c.1443del A | p.R481f s | ESSLDPPKVLPPARHSTIPLVILRK[p.R481fs]NGARPAP* | VILRKNGAR, ILRKNGARPA, LVILRKNGAR | STAD |
| MYBPC2 | c.1937G>A | p.R646 H | TNPVGEDVASIFLQWDVPDPPEAV[p.R646H]HITSVGEDWAILVWEPPMYDGGKPVT | PEAVHITSV, VPDPPEAVHI | UCEC |
| MYD8 | c.719T>C | p.M24 0T | TCVWSIASELIEKRLARRPRGGCRR[p.M240T]TVVVVSDDYLQSKECDFQTKFALSLS | TVVVVSDDY, RPRGGCRRT, RTVVVVSDDY, TVVVVSDDYL, RPRGGCRRTV | CLL |
| MYD8 | c.752G>A | p.S251 N | EKRLARRPRGGCRRMVVVVSDDYLQ[p.S251N]NKECDFQTKFALSLSPGAHQKRLIPI | YLQNKECDF, VVSDDYLQNK, NKECDFQTKF | DLBCL |
| MYD8 | c.818T>C | p.L273 P | YLQSKECDFQTKFALSLSPGAHQKR[p.L273P]PIPIKYKAMKKEFPSILRFITVCDYT | HQKRPIPIK, RPIPIKYKA, QKRPIPIKY, AHQKRPIPIK, QKRPIPIKY, HQKRPIPIKY, SPGAHQKRPI, RPIPIKYKAM | CLL, DLBCL |
| MYEF2 | c.967A>G | p.K323 E | LFDRPMHVKMDDKSVPHEEYRSHDG[p.K323E]ETPQLPRGLGGIGMGLGPGGQPISAS | ETPQLPRGL, RSHDGETPQL, GETPQLPRGL | TGCT |
| MYEOV | c.807del G | p.L269f s | CSTWGLPLRVAGSWLTVVTVEALGG[p.L269fs]GAWELGGLARWGPLCTHPQCQVLLLSSTTSSSSSSSSLVEDVLCAKWFICPASFNPQNDSMR* | ALGGGAWEL, SLVEDVLCA, GLARWGPLC, LVEDVLCAK, KWFICPASF, SSSSSSSLV, CAKWFICPA, DVLCAKWFI, HPQCQVLLL, VEALGGGAW, WELGGLARW, CQVLLLSSS, SFNPQNDSM, SLVEDVLCAK, SSSSSSSSLV, SFNPQNDSMR, VTVEALGGGA, EALGGGAWEL, LARWGPLCTH, CQVLLLSSST, AKWFICPASF, ASFNPQNDSM, WELGGLARWG | STAD |
| MYEOV | c.905T>A | p.L302 H | RRTGQVGPTMHPPPVSGASPLLLHH[p.L302H]HLLLLLILTC* | LLLHHLLLL, LLHHHLLLL, SPLLLHHHL, LHHHLLLLL, LLLHHHL, LLL, LLHHHLLLL, SPLLLHHHL, LHHHLLLLLI, HHHLLLLLII | TGCT |
| MYH10 | c.3271_3272insC | p.L109 1fs | MISDLEERLKKEEKTRQELEKAKRK[p.L1091fs]PRRGDDRPAGPDRRAAGAD* | KAKRKPRRG, RPAGPDRRA, KPRRGDDRPA, RPAGPDRRAA | LUAD |
| MYH1 | c.2977G>A | p.E993 K | EEEAARQKLQLEKVTAEAKIKKLED[p.E993K]KILVMDDQNNKLSKERKLLEERISDL | KLEDKILVM, KKLEDKILVM | HNSC |
| MYH1 | c.3787_3789del AAG | p.K126 3del | KENADLAGELRVLGQAKQEVEHKKK[p.K1263del]LEAQVQELQSKCSDGERARAELNDKVHK | VEHKKKLEA, KQEVEHKKKL | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MYH3 | c.931G>A | p.D311N | HIFYQIMSNKKPELIDLLLLISTNPF[p.D311N]NPFPFVSQGEVTVASIDDSEELLATDN | LISTNPFNF,STNPFNPF,TNPFNFPFV,NPFNFPFVS,STNPF NFPFV,LLISTNPFNF,ISTNPFNFPF | CRC |
| MYH4 | c.2369C>T | p.T790M | TKVFFKAGLLGTLEEMRDEKLAQLI[p.T790M]MRTQAICRGFLMRVEFRKQME RRESI | KLAQLIMRT,QLIMRTQAI,IMRTQAICR,AQLIMRTQA,DEK LAQLIM,LIMRTQAICR,IMRTQAICRG,RDEKLAQLIM,AQLI MRTQAI,MRTQAICRGF | LUAD |
| MYH6 | c.2540C>T | p.T847M | AFMGVKNWPWMKLYFKIKPLLKSAE[p.T847M]MEKEMATMKEEFGRIKETLEK SEARR | LLKSAEMEK,KPLLKSAEM,KSAEMEKEM,AEMEKEMAT,E MEKEMATM,IKPLLKSAEM,LKSAEMEKEM,AEMEKEMAT M | BRCA |
| MYH7 | c.4459G>A | p.A1487T | ESQSELESSQKEARSLSTELFKLKN[p.A1487T]TYEESLEHLETFKRENKNLQEEISD L | TYEESLEHL,ELFKLKNTY,LKNTYEESL,KLKNTYEESL,NTYEES LEHL,TELFKLKNTY | KIRP |
| MYH7 | c.5065C>T | p.R1689C | NDDLKENIAIVERRNNLLQAELEEL[p.R1689C]CAVVEQTERSRKLAEQELIETSE RVQ | AELEELCAV,EELCAVVEQ,AELEELCAVV,EELCAVVEQT | CRC |
| MYH8 | c.2354C>T | p.A785V | KFGHTKVFFKAGLLGLLEEMRDEKL[p.A785V]VQIITRTQAVCRGFLMRVEYQK MLQR | KLVQIITRT,VQIITRTQA,DEKLVQIIT,VQIITRTQAV,EMRDE KLVQI | TGCT |
| MYH8 | c.3016C>A | p.H1006N | LTEEMAGLDETIAKLSKEKKALQET[p.H1006N]NQQTLDDLQAEEDKVNILTKAK TKLE | LQETNQQTL,ALQETNQQTL | LUAD |
| MYH8 | c.3143G>A | p.R1048Q | LTKAKTKLEQQVDDLEGSLEQEKKL[p.R1048Q]QMDLERAKRKLEGDLKLAQES TMDME | KLQMDLERA,LEQEKKLQM,LQMDLERAK,QEKKLQMDL,K LQMDLERAK | CRC |
| MYH8 | c.3349C>T | p.R1117C | NLISKIEDEQAVEIQLQKKIKELQA[p.R1117C]CIEELGEEIEAERASRAKAEKQRS DL | KIKELQACI,KKIKELQAC,KKIKELQACI,KELQACIEEL | LUAD |
| MYO18A | c.627del|C | p.P209fs | PRPGHRSRAPELVTKFPVDLRLPP[p.P209fs]WCPCPHLPSGSWSCNDGPLETL ASPCGAQPCWIGAPRARPVGVWSTLL SLVQAPRTWPWGWCQEIDWWRLMG TMWRASPGMRLWR* | GVWSTLLSL,RLMGTMWRA,TMWRASPGM,VWSTLLSLV, VQAPRTWPW,WWRLMGTMW,RARPVGVWS,GTMWRA SPG,MWRASPGMR,QPCWIGAPR,CWIGAPRAR,LLSLVQA PR,ETLASPCGA,CPHLPSGSW,APRARPVGV,RPVGVWSTL, SLVQAPRTW,QEIDWWRLM,WRASPGMRL,RASPGMRL W,LPPWCPCPH,SPCGAQPCW,WPWGWCQEI,GVWSTLL SLV,WIGAPRARPV,TMWRASPGMR,TLLSLVQAPR,RASPG MRLWR,TWPWGWCQEI,DWWRLMGTMW,MWRASPG MRL,RARPVGVWST,GTMWRASPGM,WWRLMGTMWR, FPVDLRLPPW,APRARPVGVW,RPVGVWSTLL,GSWSCND GPL,VGVWSTLLSL,LSLVQAPRTW,LVQAPRTWPW,CQEID WWRLM,IDWWRLMGTM,WRASPGMRLW,LETLASPCGA, LPPWCPCPHL | STAD |
| MYO1D | c.326C>T | p.T109M | AAYKAMKRRSKDTCIVISGESGAGK[p.T109M]MEASKYIMQYIAAITNPSQRAEV ERV | GAGKMEASK,AGKMEASKY,GKMEASKYI,KMEASKYIM,SG AGKMEASK,GAGKMEASKY,MEASKYIMQY,GKMEASKYI M,GESGAGKMEA | GBM |
| MYO1D | c.736G>A | p.E246K | LQKSLSSYNYIHVGAQLKSSINDAA[p.E246K]KFRVVADAMKVIGFKPEEIQTVY KIL | KSSINDAAK,SINDAAKFR,KFRVVADAM,DAAKFRVVA,SSI NDAAKF,SINDAAKFRV,SSINDAAKFR,AAKFRVVADA,KFR VVADAMK,KSSINDAAKF,AKFRVVADAM | CRC |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MYO3A | c.1573A>C | p.N525H | AVVGAQISEYLLEKSRVIHQAIGEK[p.N525H]HFHIFYYIYAGLAEKKKLAHYKLPEN | AIGEKHFHI,IGEKHFHIF,KHFHIFYYI,HFHIFYYIY,HQAIGEK HF,GEKHFHIFY,EKHFHIFYY,HFHIFYYIA,IGEKHFHIFY,GE KHFHIFYY,KHFHIFYYI,QAIGEKHFHI,IHQAIGEKHF,AIGEK HFHIF | CRC |
| MYO3A | c.1574A>G | p.N525S | AVVGAQISEYLLEKSRVIHQAIGEK[p.N525S]FHIFYYIYAGLAEKKKLAHYKLPEN | AIGEKSFHI,KSFHIFYYI,GEKSFHIFY,SFHIFYYIY,HQAIGEKS F,IGEKSFHIF,EKSFHIFYY,KSFHIFYYI,SFHIFYYIA,IGEKSF HIFY,GEKSFHIFY,QAIGEKSFHI,IHQAIGEKSF,HQAIGEKSF H,AIGEKSFHIF | KIRC,OV |
| MYO5A | c.1214C>T | p.A405V | KLVTTSETYVKTMSLQQVINARNAL[p.A405V]VKHIYAQLFGWIVEHINKALHTSLKQ | VINARNALV,LVKHIYAQL,RNALVKHIY,VKHIYAQLF,ALVKH IYAQL,QVINARNALV,VINARNALVK,RNALVKHIYA,LVKHI YAQLF,ARNALVKHIY | BRCA |
| MYO5B | c.2123G>T | p.R708L | VLETIRISAAGYPSRWAYHDFNRY[p.R708L]LVLVKKRELANTDKKAICRSVLEN LI | FFNRYLVLV,DFNRYLVL,FNRYLVLVK,HDFNRYLIV,AYHD FFNRYL,HDFNRYLVL | LUAD |
| MYO5B | c.2742_2743insA | p.Q914fs | EQIQKEYDALVKSSEELLSALQKKK[p.Q914fs]TAGRGSRKAEAYSRRNGKGKKK T* | KTAGRGSRK,LQKKKTAGR,GSRKAEAYS,EAYSRRNGK,YSR RNGKGK,RGSRKAEAY,KTAGRGSRKA,GSRKAEAYSR,AYSR RNGKGK,YSRRNGKGKK | GBM |
| MYO6 | c.3538G>A | p.D1180N | IPARQREIEMNRQQRFFRIPFIRPA[p.D1180N]NQYKDPQSKKKGWWYAHFDG PWIARQ | FIRPANQYK,IPFIRPANQY | CRC |
| MYO7B | c.6119C>A | p.P2040H | KQTSEPSYPDVLIIAINRHGVLLIH[p.P2040H]HKTKDLLTTYPFTKISSWSSGSTYF H | VLLIHHKTK,LLIHHKTKDL,GVLLIHHKTK,RHGVLLIHHK,HKT KDLLTTY | LUAD |
| MYO9A | c.500G>A | p.R167Q | QPQQKDFDDLCSLPDLNEKTLLENL[p.R167Q]QNRFKHEKIYTYVGSILIVINPFKF L | LQNRFKHEK,TLLENLQNR,LLENLQNRF,KTLLENLQNR,TLL ENLQNRF,LQNRFKHEKI | CRC |
| MYO9A | c.6536G>A | p.R2179Q | FLRAMGLQERKETIRGVYSVIDQLS[p.R2179Q]QTHLNTLERLIFHLVRIALQEDT NRM | SVIDQLSQT,QTHLNTLER,LSQTHLNTL,QLSQTHLNTL | CRC |
| MYO9B | c.281G>T | p.R94L | KESGGEWVLDANDSPVHRVLLWPR[p.R94L]LAQDEHPQEDGYYFLLQERNAD GTIK | RVLLWPRLA,HRVLLWPRL | LUAD |
| MYOD | c.1478C>T | p.T493M | AGSLPDTFNDASPSFGLHPSPVHVC[p.T493M]MEEESLMSSLNGGSVPSELDGLD SEKD | HPSPVHVCM,MEEESLMSSL,CMEEESLMSSL,VHVCMEESLM | HNSC |
| MYOD | c.678del|C | p.G226fs | ENDRNDSASQPSHQSDAGKQGLGPP[p.G226fs]APP* | GKQGLGPPA | STAD |
| MYOC | c.910_912del|CAG | p.Q310del | AYARLLQQQQLFLQLQILSQQQQQQ[p.Q310del|]HRFSYLGMHQAQLKEPNEQ MVRNPNSSS | SQQQQQQHRF | PRAD |
| MYOF | c.495_496insG | p.G165fs | PGMGGDGEEDEGDEDRLDNAVRGPG[p.G165fs]AQGASWDGVGSSACSEAH QSKEQPADAVK* | GPGAQGASW,SACSEAHQSK,AVRGPGAQGA | LUAD |
| MYOM1 | c.188G>A | p.R63Q | VYTQGSTAYSSRSSAAHRRESEAFR[p.R63Q]QASASSSQQQASQHALSSEVSRK AAS | AFRQASASS,RESEAFRQA,SEAFRQASA,RQASASSSQ,AFR QASASSS,RESEAFRQAS,RQASASSSQQ,SEAFRQASAS | HNSC |
| MYOM2 | c.2962G>A | p.D988N | DHSKYLYLKNPDKEDLGTYSVSVSDT[p.D988N]NGVSSSFVLDPEELERLMALSNEI KN | VSVSDTNG,DTNGVSSSF,NGVSSSFVL,SVSVSDTNG,DT NGVSSSFV,SDTNGVSSSF | CESC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| MYOZ2 | c.751G>A | p.E251K | LSGRRSFNRTPKGWISENIPIVITT[p.E251K]KPTDTTVPESEDL* | TTKPTDDTTV | CRC |
| MYT1 | c.676G>A | p.E226K | AAEGAASEEGEKGLFIQPEDAEEVV[p.E226K]KVTTERSQDLCPQSLEDAASEESSKQ | EVVKVTTER, AEEVVKVTT | CRC |
| MYT1L | c.1052C>A | p.P351Q | SLECLRNQCFDLARKLSETNPQERN[p.P351Q]QQQNMNIRQHVRPEDFPGRTPDRNY | QERNQQQNM, QQQNMNIRQH | LUAD |
| N4BP2L2 | c.1516C>T | p.R506C | STKNKRKRKRIFNLVPNFDLLGQS[p.R506C]CIGVKEREKCDLLTKNHGLKITLGEE | LLGQSCIGV, FDLLGQSCI, LLGQSCIGVK | UCEC |
| NAA1 | c.551C>A | p.T184K | RRQMDLKKGGTVVLGSRENQETQGS[p.T184K]KLSDSEEACQQKNPATEESGSDSKEP | NQETQGSKL | LUAD |
| NAA16 | c.1542del T | p.H514fs | CISAYQRLGRYGDALKKCHEVERHF[p.H514fs]LR* | HEVERHFLR | STAD |
| NAA25 | c.2420C>A | p.S807Y | DIYELDTSGLEDTMEIQERIENSFK[p.S807Y]YLLDQLKDVFSKCKGDLLEVKDGNLK | YLLDQLKDV, RIENSFKYL, IENSFKYLL, KYLLDQLKDV, YLLDQLKDVF, SFKYLLDQLK, QERIENSFKY, NSFKYLLDQL | CRC |
| NAB1 | c.216G>C | p.L72F | EEFLEIMALVGMASKPLHVRRLQKA[p.L72F]FRDWVTNPGLFNQPLTSLPVSSIPIY | RLQKAFRDW, HVRRLQKAF, LQKAFRDWV, RLQKAFRDWV, HVRRLQKAFR, LHVRRLQKAF, RRLQKAFRDW, LQKAFRDWVT | LUAD |
| NANOS3 | c.548C>T | p.S183L | KTQDTGHRRGGGGAGPRGAGKSEP[p.S183L]LPSCSPSMST* | RGAGKSEPL, EPLPSCSPSM, FRGAGKSEPL | HNSC |
| NAP1L3 | c.1058C>G | p.P353R | MIQKYDEPILKFLSDVSLKFSKPGQ[p.P353R]RVSYTFEFHFLPNPYFRNEVLVKTYI | RVSYTFEFH, PGQRVSYTF, QRVSYTFEF, SKPGQRVSY, RVSYTFEFHF, SLKFSKPGQR, FSKKPGQRVSY, KPGQRVSYTF, GQRVSYTFEF, LKFSKPGQRV | TGCT |
| NAP1L4 | c.854_855CC>AA | p.P285Q | VTVKTIKKQHKGRGTVRTITKQV[p.P285Q]ONESFFNFNPLKASGDGESLDEDSEF | VQNESFFNF, KQVQNESFF, TKQVQNESF, QVQNESFFNF, V QNESFFNFF, ITKQVQNESF, TKQVQNESFF | SKCM |
| NAPSA | c.362G>A | p.R121Q | DTGSSNLWVPSRRCHFFSVPCWLHH[p.R121Q]QFDPKASSSFQANGTKFAIQYGTGRV | WLHHQFDPK, VPCWLHHQF, HQFDPKASS, WLHHQFDPKA, CWLHHQFDPK, SVPCWLHHQF, QFDPKASSSF, HQFDPKASSS | UCEC |
| NARS | c.719C>G | p.P240R | AFLTVSGQLHLEVMSGAFTQVFTFG[p.P240R]RTFRAENSQSRRHLAEFYMIEAEISF | FTFGRTFRA, FTQVFTFGR, VFTFGRTFR, QVFTFGRTF, QVFTFGRTFR, AFTQVFTFGR, TQVFTFGRTF | BRCA |
| NAT10 | c.1178T>C | p.I393T | IQYIHPADAVKLGQAELVVIDEAAA[p.I393T]TPLPLVKSLLGPYLVFMASTINGYEG | AAATPLPIV, AATPLPLVK, LGQAELVVID, EAAATPL, IDEAAAA TPL, DEAAATPLP, VIDEAAATPL, AAATPLPLVK, EAAATPLPL V, TPLPLVKSLL, DEAAATPLPL | TGCT |
| NBPF1 | c.2428G>A | p.E810K | SSSHVEWEDAVHIIPENESDDEEEE[p.E810K]KKGPVSPRNLQESEEEEVQESWDEG | KKGPVSPRNL | MM |
| NBPF14 | c.73C>T | p.R25C | MVVSAGPWSSEKAEMNILEINEKL[p.R25C]CPQLAENKQQFGNLKERCFVTQLAGF | KLCPQLAENK | PAAD |
| NBPF16 | c.1347del T | p.D449fs | RELLDEKEPEVLQDSLLDRCYSTPSD[p.D449fs]ILNCLT* | RCYSTPSDI, TPSDILNCL, STPSDILNCL, RCYSTPSDIL | PAAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| NBPF3 | c.1472A>T | p.D491V | QEEEDQGPPCPRLSRELPEVVEPE[p.D491V]VLQDSLDRWYSTPFSYPELPDSCQPY | LPEVVEPEV, ELPEVVEPEV | KIRC |
| NCAM2 | c.2092G>T | p.G698C | GYSEPTVYEFSMPPKPNIIKDTLFN[p.G698C]CLGLGAVIGLGVAALLLIVVTDVSC | DTLFNCLGL, TLFNCLGLGA, IIKDTLFNCL, KDTLFNCLGL | LUAD |
| NCAPD2 | c.659G>T | p.R220L | VSLVTGCCYRLLENPTINHQKNRPT[p.R220L]LEAITHLLGVALTRYNHMLSATVKII | TLEAITHLL, KNRPTLEAI, LEAITHLLG, HQKNRPTLEA, RPTLEAITHL, INHQKNRPTL, QKNRPTLEAI, LEAITHLLGV | LUAD |
| NCAPD3 | c.2725delC | p.Q909fs | ASSADADHSPSSQGSSEAPASQPPP[p.Q909fs]RSEVLSCPL* | QPPPRSEVL, RSEVLSCPL, EAPASQPPPR, SQPPPRSEVL | STAD |
| NCAPH | c.1398delA | p.T466fs | HWRFRPPRRKQDAPSQSENKKKSTKK[p.T466fs]ILKLTLKMILTLMYILEKQRLLLF* | KMILTLMYI, MILTLMYIL, YILEKQRLL, ILKLTLKMI, TLKMILTLM, LTLMYILEK, MYILEKQRL, KKSTKKILK, KILKLTLKM, LKMIL TLMY, LMYILEKQR, LKLTLKMIL, LTLKMILTL, LEKQRLLLF, KL TLKMILTL, KMILTLMYIL, YILEKQRLLL, ILTLMYILEK, MYILEK QRLL, ILEKQRLLLF, KKKSTKKILK, STKKILKLTL, TLKMILTLMY, TLMYILEKQR, ILKLTLKMIL, KKSTKKILKL, KKILKLTLKM, LTL KMILTLM, LKMILTLMYI, LMYILEKQRL | STAD |
| NCOA3 | c.3759_3760del|GC | p.Q1253fs | RSRELLSHHFRQQRVAMMQQQQQQ[p.Q1253fs]TAAAAAAAAATATATATAATAANPGLQPTS* | QTAAAAAAA, MQQQQQQTA, QQQQQQTAA, QQQQQTA, AQ, QQQQQTAAAA, QQQQTAAAAA, QQTAAAAAA, MMMQQ QQQQT, MMQQQQQQTA, ATATATATAA, ATATATAATA, QTAAAAAAAA, TAATAANPGL, MQQQQQQTAA, QQQQQ QTAAA, QQQQQTAAAA, QQQQTAAAAA, QQQTAAAAAA, QQQTAAAAAAA | PAAD |
| NCOA4 | c.1685G>A | p.R562Q | ADWVLPGKKMGNLSQLSSGEDKWLL[p.R562Q]QKKAQEVLLNSPLQEEHNFPPDHYGL | LLQKKAQEV, LQKKAQEVL, WLLQKKAQEV, LLQKKAQEVL, L QKKAQEVLL | CRC |
| NCOA7 | c.1107G>T | p.E369D | DSRPIVPLEKSTGHTPTKPSGGSVS[p.E369D]DKLKKLDSSRETSHGSPTVTKLSKEP | SSVSDKLKK, GSSVSDKLKK | UCEC |
| NCOR1 | c.4682G>A | p.R1561Q | PGVDPWSHSPFDPHHRGSTAGEVY[p.R1561Q]QSHLPTHLDPAMPFHRALDPAAAAYL | YQSHLPTHL, EVYQSFILPT, VYQSHLPTHL, EVYQSHLPTF, GE VYQSHLPT | HNSC |
| NCR1 | c.772C>T | p.R258W | TYLLTTETGLQKDHALWDHTAQNLL[p.R258W]WMGLAFLVLVALVWFLVEDWLSRKRT | LLWMGLAFL, WMGLAFLVL, AQNLLWMGL, LWMGLAFLV, HTAQNLLWM, NLLWMGLAF, NLLWMGLAFL, LLWMGLAF LV, WMGLAFLVLV, AQNLLWMGLA, LWMGLAFLVL, QNLL WMGLAF | UCEC |
| NDST3 | c.1279G>A | p.V427I | LNKKFALEHGIPTDMGYAVAPHHSG[p.V427I]IYPVHVQLYEAAWKKVWNIKITSTEEY | GIYPVHVQL, AVAPHHSGI, IYPVHVQLY, VAPHHSGIY, GIYP VHVQLY, AVAPHHSGIY, YAVAPHHSGI, APHHSGIYPV, SGIY PVHVQL | LUAD |
| NEDD4L | c.570_572del|TCC | p.P194del | DMEHGWEVVDSNDSASQHQEELPPP[p.P194del]|LPPGWEEKVDNLGRTYYVNHNNRTTQWH | HQEELPPPL, LPPLPPGW | CLL |
| NEDD9 | c.2392G>A | p.A798T | RNKVMNSSNQLCEQLKTIVMATKMA[p.A798T]TLHYPSTTALQEMVHQVTDLSRNAQL | VMATKMATL, TLHYPSTTA, ATKMATLHY, KMATLHYPS, M ATKMATLHY, IVMATKMATL, KMATLHYPST, TLHYPSTTAL, ATKMATLHYP, ATLHYPSTTA, VMATKMATLH, TKMATLHY PS | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| NEDD9 | c.946G>A | p.A316T | ARRHQSLSPNHPPQLGQSVGSQND[p.A316T]TYDVPRGVQFLEPPAETSEKANPQER | SVGSQNDTY,DTYDVPRGV,TYDVPRGVQF,QSVGSQNDTY | CRC |
| NEFH | c.1933G>A | p.E645K | SPVKEEAKSPAEVKSPEKAKSPTKE[p.E645K]KAKSPEKAKSPEKERAKSPEKAKSPV | KAKSPTKEK,KSPTKEKAK,KEKAKSPEK,KAKSPTKEKA,KEKAKSPEKA | KIRP |
| NEFH | c.1993_1994insAGGAAG | p.665_666insEE | PTKEEAKSPEKAKSPEKEEAKSPEK[p.665_666insEE]EEAKSPVKAEAKSPEKAKSPVKAEAKSPEKA | EEAKSPVKA,KEEAKSPVKA | ACC, KIRP |
| NEFH | c.2009T>A | p.V670E | EAKSPEKAKSPEKEEAKSPEKAKSP[p.V670E]EKAEAKSPEKAKSPVKAEAKSPEKAK | KSPEKAEAK,KAKSPEKAEA | TGCT |
| NEFM | c.638C>T | p.A213V | RPEEEARLRDTEAAIRALRKDIEE[p.A213V]VSLVKVELDKKVQSLQDEVAPLRSNH | ALRKDIEV,EVSLVKVEL,RKDIEEVSL,IEEVSLVKV,VSLVKVELDK,EEVSLVKVEL | STAD |
| NEK1 | c.1822C>T | p.R608C | EVYLARLRQIRLQNFNERQQIKAKL[p.R608C]CGEKKEANHSEGQEGSEEADMRRKKI | KAKLCGEKK,QIKAKLCGEK | CRC |
| NEK11 | C.1121G>A | p.R374Q | KLQAADEKARKLKKIVEEKYEENSK[p.R374Q]QMQELRSRNFQQLSVDVLHEKTHLKG | NSKQMELR,QMQELRSRNF,EKYEENSKQM,KQMQELRSRN | UCEC |
| NEK2 | c.715C>A | p.R239S | PPFTAFSQKELAGKIREGKFRRIPY[p.R239S]SYSDELNEIITRMLNLKDYHRPSVE | KFRRIPYSY,SYSDELNEI,IPYSYSDEL,SYSDELNEII,KFRRIPYS YS,GKFRRIPYSY,YSYSDELNEI | LUAD |
| NEK8 | c.2070del | p.V690fs | VTSVSCCHGNTLLAVRSVTDEPVPP[p.V690fs]EAPGFTSGPP* | EPVPPEAPGF | STAD |
| NELL2 | c.509G>A | p.G170D | QTHLNSGVILSIHHLDHRYLELESS[p.G170D]DHRNEVRLHYRSGSHRPHTEVFPYIL | ESSDHRNEV,ESSDHRNEVR,LESSDHRNEV | TGCT |
| NES | c.1831G>C | p.V611L | LKSLEKENKELLKDVEVVRPLEKEA[p.V611L]LGQLKPTGKEDTQTLQSLQKENQELM | LEKEALQGL,ALGQLKPTGK,KEALGQLKPT | KIRC |
| NF1 | c.2027_2028insC | p.T676fs | PGASLRKGKGNSSMDSAAGCSGTPP[p.T676fs]DLPTSPDqTRSGPVHVSVEP* | QTRSGPVHV,RSGPVHVSV,SPDQTRSGPV | STAD |
| NF1 | c.4974_4977delTCTC | p.F1658fs | AKPYEIVVDLTHTGPSNRFKTDFLS[p.F1658fs]GLLFFLALLTTTSPQSISITVTPGSGSTPSIMSGC* | KTDFLSGLL,FLSGLLFFL,GLLFFLALL,FLALLTTTS,DFLSGLLFF,RFKTDFLSG,TTSPQSISI,STPSIMSGC,SPQSISITV,FKTDFLSGL,TDFLSGLLF,SGLLFFLAL,GSGSTPSIM,KTDFLSGLLF,FLSGLLFFLA,LLFFLALLTT,FLALLTTTSP,LLTTTSPQSI,DFLSGLLFFL,RFKTDFLSGL,TTTSPQSISI,TSPQSISITV,TPGSGSTPSI,FKTDFLSGLL,TDFLSGLLFF,LSGLLFFLAL | GBM |
| NFASC | c.766G>A | p.V256I | QFEEDQFQPGVWHDHSKYPGSVNSA[p.V256I]ILRLSPYVNYQFRVIAINEVGSSHPS | AILRLSPYV,GSVNSAILR,SAILRLSPY,YPGSVNSAI,NSAILRLSPY,SAILRLSPYV,KYPGSVNSAI,ILRLSPYVNY,YPGSVNSAIL | CRC |
| NFAT5 | c.2716C>G | p.Q906E | QQQQQQQVMESSAAMVMEMQQSIC[p.Q906E]EAAAIQSELFPSTASANGNLQQSPV | EMQQSICEA,SICEAAAQI,MQQSICEAA,CEAAAQIQS,QSICEAAAQI,EAAAQI,EAAAIQSEL,MEMQQSICEA,MQQSICEAAA | KIRC |
| NFE2L2 | c.100C>G | p.R34G | PGLPSQQDMDLIDILWRQDIDLGVS[p.R34G]GEVFDFSQRRKEYELEKQKKLEKERQ | IDLGVSGEVF,LGVSGEVFDF | BLCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| NFE2L2 | c.101G>A | p.R34Q | PGLPSQQDMDLIDILWRQDIDLGVS[p. R34Q]QEVFDFSQRRKEYELEKQKKLEK ERQ | IDLGVSQEVF,LGVSQEVFDF | LUSC |
| NFE2L2 | c.235G>A | p.E79K | LEKERQEQLQKEQEKAFFAQLQLDE[p. E79K]KTGEFLPIQPAQHIQSETSGSANY SQ | QLDEKTGEFL,LQLDEKTGEF,DEKTGEFLPI | BLCA,HNSC |
| NFE2L2 | c.235G>C | p.E79Q | LEKERQEQLQKEQEKAFFAQLQLDE[p. E79Q]QTGEFLPIQPAQHIQSETSGSAN YSQ | AQLQLDEQT,QLDEQTGEF,EQTGEFLPI,QLDEQTGEFL,LQL DEQTGEF,DEQTGEFLPI | HNSC,LUSC |
| NFE2L2 | c.241G>A | p.G81S | KERQEQLQKEQEKAFFAQLQLDEET[p. G81S]SEFLPIQPAQHIQSETSGSANYSQ VA | QLDEETSEF,EETSEFLPI,SEFLPIQPA,QLDEETSEFL,LQLDEE TSEF,DEETSEFLPI,SEFLPIQPAQ | LUSC |
| NFE2L2 | c.85G>C | p.D29H | LELPPPGLPSQQDMDLIDILWRQDI[p. D29H]HLGVSREVFDFSQRRKEYELEKQ KKL | ILWRQDIHL,HLGVSREVF,DIHLGVSREV,IHLGVSREVF | CESC,HNSC,LUSC |
| NFE2L2 | c.88C>T | p.L30F | ELPPPGLPSQQDMDLIDILWRQDID[p. L30F]FGVSREVFDFSQRRKEYELEKQKK KKL | ILWRQDIDF,IDPGVSREV,IDFGVSREVF,FGVSREVFDF | LUSC |
| NFE2L2 | c.92G>C | p.G31A | LPPPGLPSQQDMDLIDILWRQDIDL[p. G31A]AVSREVFDFSQRRKEYELEKQKK LEK | DLAVSREVF,WRQDIDLAV,AVSREVFDF,ILWRQDIDLA,IDL AVSREVF,LAVSREVDF | LUSC |
| NFIA | c.882G>C | p.L294F | SVTELVRVSQTPIAAGTGPNFSLSD[p. L294F]FESSSYYSMSPGAMRRSLPSTSST SS | LSDFESSSY,SDFESSSYY,FESSSYYSM,GPNFSLSDF,LSDFES SSY,SLSDFESSSY,FESSSYYSMS | LUAD |
| NHEJ1 | c.326G>A | p.R109Q | LKDAAHPSEATFSCDCVADALILRV[p. R109Q]QSELSGLPFYWNFHCMLASPSLV SQH | RVQSELSGL,QSELSGLPF,QSELSGLPFY,ALILRVQSEL,VQSE LSGLPF,LRVQSELSGL | UCEC |
| NHLRC1 | c.612del T | p.F204fs | DVTITNDCHVVTDAGDRSIKVFDF[p. F204fs]LARSSLSLEANSPYLGVWRPPLR MGLW* | LSLEANSPY,FLARSSLSL,SLEANSPYL,YLGVWRPPL,RSIKVF DFL,SIKVFDFLA,LGVWRPPLR,EANSPYLGV,FDFLARSSL,A NSPYLGVW,SIKVFDFLAR,DFLARSSLSL,PYLGVWRPPL,RSI KVFDFLA,LARSSLSLEA,VWRPPLRMGL,SLSLEANSPY,YLG VWRPPLR,LSLEANSPYL,LEANSPYLGV,LGVWRPPLRM,EA NSPYLGVW | STAD |
| NHP2L1 | c.250C>T | p.R84C | DAEPLEIILHLPLLCEDKNVPYVFV[p.R8 4C]CSKQALGRACGVSRPVIACSVTIKEG | YVFVCSKQAL,NVPYVFVCSK,FVCSKQALGR | GBM |
| NHS | c.4681G>A | p.D156IN | ATEILKSPILPKPPGELTAESPQST[p.D15 6IN]NDAHQSQGAEALSPLSPCSPRV NAE | AESPQSTNDA | TGCT |
| NID2 | c.3103del C | p.R1035fs | EPTQRPPTICERWRENLLEHYGGTP[p.R 1035fs]GMTSTCPSAMTWATSSPCSAT ERATSAGVWTKMAERCRAPAPSQAPP LRVYPPSLHPWSGPRPGQM* | GMTSTCPSA,ATSAGVWTK,SLHPWSGPR,GVWTKMAER, VYPPSLHPW,RVYPPSLHP,MTSTCPSAM,SQAPPLRVY,WT KMAERCR,MTWATSSPC,TSAGVWTKM,HPWSGPRPG,PL RVYPPSL,LEHYGGTPG,EHYGGTPGM,STCPSAMTW,AMT WATSSP,TERATSAGV,CPSAMTWAT,AERCRAPAP,KMAE RCRAPA,GMTSTCPSAM,AMTWATSSPC,TSSPCSATER,RA TSAGVWTK,RVYPPSLHPW,WTKMAERCRA,RCRAPAPSQ A,MTSTCPSAMT,MTWATSSPCS,TSAGVWTKMA,APAPS QAPPL,APSQAPPLRV,LEHYGGTPGM,TERATSAGVW,ATS AGVWTKM,SQAPPLRVYP,CPSAMTWATS,AERCRAPAPS,TSTCPSAMTW | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| NINL | c.4096C>T | p.R1366C | VRALQATEEKQRGAEKQSRLLEEKV[p.R1366C]CALNKLVSRIAPAALSV* | LLEEKVCAL, KVCALNKLV, CALNKLVSR, RLLEEKVCAL | CRC |
| NKD1 | c.856_857insC | p.P286fs | AGIENYTSQFGPGSPSVAQKSELPP[p.P286fs]PHLQSHSISLP* | HLQSHSISL, AQKSELPPP, LQSHSISLP, AQKSELPPPH, QKSEL PPPHL | STAD |
| NKD2 | c.1315_1317del|CAC| | p.H447del | GYAVPVIQRHEHHHHEHHHHHH[p.H447del]FHPS* | EHHHHHHHF | TGCT |
| NLK | c.570del|T | p.C190fs | KKMPNVFQNLVSCKRVFRELKMLCF[p.C190fs]LSMIMYSLPLTYSNLHTLTILKKY MLSQN* | IMYSLPYY, YSNLHTLTI, KMLCFLSMI, FLSMIMYSL, SMIMY SLPL, MIMYSLPLT, LTYSNLHTL, SLPLTYSNL, NLHTLTILK, HT LTILKKY, LTILKKYML, MLCFLSMIM, RELKMLCFL, LKMLCFL SM, LCFLSMIM, SNLHTLTIL, LPLTYSNLH, MIMYSLPLTY, K MLCFLSMIM, SMIMYSLPLT, IMYSLPLTY, FLSMIMYSLP, M LCFLSMIMY, NLHTLTILK, SNLHTLTIL, CFLSMIMYSL, YSL PLTYSNL, TYSNLFITLI, ELKMLCFLSM, LSMIMYSLPL, LKML CFLSMI, SNLHTLTI, LHTLTILIK, RELKMLCFLS, LPLTYSN LHT | STAD |
| NLRC4 | c.1225G>A | p.E409K | SDFIRSLDHCGDLALEGVFSHKFDF[p.E409K]KLQDVSSVNEDVLLTTGLLCKYTA QR | VFSHKFDFK, FSHKFDFKL, FKLQDVSSV, GVFSHKFDFK, VFS HKFDFKL, HKFDFKLQDV | CRC |
| NLRC4 | c.1777G>A | p.D593N | KSALSQEFEAFFQGKSLYINSGNIP[p.D593N]NYLFDFFEHLPNCASALDFIKLDFY G | NIPNYLFDF, INSGNIPNY, IPNYLFDFF, SGNIPNYLF, NSGNIP NYLF, GNIPNYLFDF, NIPNYLFDFF, NYLFDFFEHL, YINSGNIP NY | CRC |
| NLRC4 | c.862C>T | p.R288W | ALIKENHRFKNMVIVTTTECLRHI[p.R288W]FQGALTAEVGDMTEDSAQALI REVL | ECLRHIWQF, RHIWQFGAL, WQFGALTAE, WQFGALTAEV, CLRHIWQFGA, TECLRHIWQF, LRHIWQFGAL, RHIWQFGA LT, HIWQFGALTA | BRCA |
| NLRP3 | c.469C>T | p.R157C | MKKDYRKKYRKYVRSRFQCIEDRNA[p.R157C]CLGESVSLNKRYTRLRLIKEHRS QQE | RNACLGESV, CLGESVSLNK | LUAD |
| NLRP4 | c.685G>A | p.V229I | LISREWPDPAAPITEIVSQPERLLF[p.V229I]IIDSFEELQGGLNEPDSDLCGDLME K | SQPERLLFI, FIIDSFEEL, RLLFIIDSF, QPERLLFII, SQPERLL- FII,L FIIDSFEEL | CRC |
| NLRP5 | c.1175G>A | p.R392H | LGSVLNNDTKLLCKDWAEKQPPFTLI[p.R392H]HSLLRKVLLPESFLIVTVRDVGTEK L | LIHSLLRKV, TLIHSLLRK, FTLIHSLLR, PFTLIHSLL, HSLLRKVLL, PPFTLIHSL, KQPPFTLIH, TLIHSLLRKV, FTLIHSLLRK, QPPFTLI HSL, LIHSLLRKVL | CRC |
| NLRP5 | c.2209C>T | p.R737W | LPINQNLDLIASSFCLQHCPYLRKI[p.R737W]WVDVKGIFPRDESAEACPVVPL WMRD | YLRKIWVDV, IWVDVKGIF, CPYLRKIWV, YLRKIWVDVK, PYL RKIWVDV, WVDVKGIFPR, RKIWDVKGI, KIWVDVKGIF | GBM |
| NLRP6 | c.1832A>G | p.E611G | CPGVAPEVTEGAKGLEDTEEPEEEE[p.E611G]GGEBPNYPLELLYCLYETQEDAFV RQ | EEGGEEPNY, EEEGGEEPNY | THCA |
| NME9 | c.223G>A | p.E75K | QKMRIEVGLDLLHFALAEADRLDVL[p.E75K]KKYRGKCEPTFLFYAGGELVAVVR GA | KKYRGKCEPT | CRC |
| NMU | c.53C>A | p.A18E | MLRTESCRPRSPAGQVA[p.A18E]EASP LLLLLLLLLAMCAGACRGAPILP | QVAEASPLL, EASPLLLLL, GQVAEASPL, AEASPLLLL, QVAEA SPLLL, EASPLLLLLL, GQVAEASPLL, AEASPLLLLL | ACC |
| NMU | c.56C>A | p.A19E | MLRTESCRPRSPAGQVAA[p.A19E]ESP LLLLLLLAMCAGACRGAPILPQ | QVAAESPLL, GQVAEASPL, VAAESPLLL, AESPLLLLL, QVAAE SPLLL, GQVAAESPLL, VAAESPLLLL, AESPLLLLLL | ACC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| NNMT | c.697G>A | p.E233K | EQKFSSLPLGREAVEAAVKEAGYTI[p.E233K]KWFEVISQSYSSTMANNEGLFSLVAR | YTIKWFEVI, GYTIKWFEV, KEAGYTIKW, AVKEAGYTI, GYTI KWFEVI, KWFEVISQSY, KEAGYTIKWF | UCEC |
| NOL9 | c.172T>G | p.S58A | PRRRLGSLRWCGRRRLRWRLLQAQA[p.S58A]AGVDWREGARQVSRAAAARPNTATP | WRLLQAQAA, RWRLLQAQAA | ACC |
| NOLC1 | c.1283C>T | p.T428M | VTTKSPAVKPAAAPKQPVGGGQKLL[p.T428M]MRKADSSSSEEESSSEEKTKKMVA | LMRKADSSS, LMRKADSSSS | CRC |
| NOM1 | c.70C>G | p.R24G | MAASRSAGEAGPGGSQGRVVRMK[p.R24G]GRGRGPRRGPAGGGEKALKRLKLAV | RMKGRGGRG, KGRGGRGPR, QGRVVRMKGR, VVRMKGR GGR, KGRGGRGPRR | ACC |
| NOS1AP | c.901_903del\|CAG | p.Q306del | LGTETPLSTHHQMQLLQQLLQQQQ[p.Q306del\|]TQVAVAQVHLLKDQLAAEAAARLEAQAR | LQQQQQTQV, LLQQQQQTQV, LQQQQQTQVA | BLCA |
| NOS1AP | c.7541_7542del\|CT | p.P2514fs | SYSSPVDNTPSHQLQVPEHPFLTPS[p.P2514fs]RVP* | HPPLITPSRV | CLL |
| NOTCH1 | c.17_18del\|CC | p.P6fs | MPALR[p.P6fs]RSAVGAAGALAVLRGPRACIAVSRWL* | ALRRSAVGA, AAGALAVLR, RSAVGAAGA, VLRGPRACI, ALA VLRGPR, MPALRRSAV, ALRRSAVGAA, AVGAAGAL, GAAGA LAVL, RACIAVSRW, ALRRSAVGAA, AVGAAGALAV, ALAVLR GPRA, RSAVGAAGAL, GALAVLRGPR, VLRGPRACIA, RACIA VSRWL, MPALRRSAVG, VGAAGALAVL | BLCA |
| NOTCH2 | c.57C>G | p.C19W | MPALRPALLWALLALWLC[p.C19W]WAAPAHALQCRDGYEPCVNEGMCVTY | LLALWLCWA, CWAAPAHAL, ALLALWLCW, WLCWAAPAH, ALLALWLCWA, LLALWLCWAA, ALWLCWAAPA, WLCWAA PAHA, WALLALWLCW, LCWAAPAHAL | ACC |
| NOTCH2 | c.6314G>T | p.R2105L | LSPVICGPNRSFPLSLKHTPMGKKSR[p.R2105L]LPSAKSTMPTSLPNLAKERAKDAKGSR | KSRLPSAKS, TPMGKKSRL, RLPSAKSTM, MGKKSRLPSA, KS RLPSAKST, LPSAKSTMPT, SRLPSAKSTM | LUAD |
| NOTCH2 | c.6892C>T | p.R2298W | APAEGTHPGIAPQSRPPEGKHITTP[p.R2298W]WEPLPPIVTFQLIPKGSTAQPAGAPQ | HITTPWEPL, TPWEPLPPI, WEPLPPIVT, TTPWEPLPPI, KHIT TPWEPL, WEPLPPIVTF, TPWEPLPPIV | CESC |
| NOX3 | c.1210_1211del\|TG | p.C404fs | SLPRLAVDGPFGTALTDVFHYPVCV[p.C404fs]RCRGDRSHSLRCSSEIYMVQMQ* | RSHSLRCSS, SLRCSSEIY, VFHYPVCVR, HSLRCSSEI, LRCSSEI YM, SLRCSSEIYM, CVRCRGDRSH, RSHSLRCSS, HSLRCSSEI Y, DVFHYPVCVR, RCRGDRSHSL, CSSEIYMVQM | PRAD |
| NOX5 | c.1401del\|T | p.P467fs | AVCIMEVNLLPSKVTHLLIKRPPFF[p.P467fs][TIDLVTTCI* | FTIDLVTTC, RPPFFTIDL, IKRPPFFTI, PPFFTIDLV, LLIKRPPFF T, FTIDLVTTCI, LIKRPPFFTI | STAD |
| NOXA1 | c.18C>G | p.D6E | MASLG[p.D6E]ELVRAWHLGAQAVDRGDWARALHLFS | SLGELVRAW, GELVRAWHL, ELVRAWHLGA, ASLGELVRAW, GELVRAWHLG | ACC |
| NOXO1 | c.8_9insG | p.G3fs | MAGP[p.G3fs]PIPSFSARGSPGADQEAPNVCLLCALVRRQRHLRAQELGRIQAAQEDPQGDLPGGGGPAAEI* | FSARGSPGA, LVRRQRHLR, RQRHLRAQE, HLRAQELGR, CLL CALVRR, NVCLLCALV, LPGGGGPAA, ALVRRQRHL, QRHLR AQEL, MAGPPIPSF, QEAPNVCLL, AQELGRIQA, QELGRIQA A, HLRAQELGRI, SFSARGSPGA, LVRRQRHLRA, RQRHLRAQ EL, RAQELGRIQA, NVCLLCALVR, LLCALVRRQR, ALVRRQRFI LR, APNVCLLCAL, CALVRRQRHL, AQELGRIQAA | KIRC |
| NPAS2 | c.602A>G | p.Q201R | DSITPLLGHLPSDVMDQNLLNFLPE[p.Q201R]REHSEVYKILSSHMLVTDSPSPEYLK | NLLNFLPER, PEREHSEVY, REHSEVYKI, LPEREHSEV, FLPERE FISEV, LPEREHSEVY, REHSEVYKIL | OV |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| NPC1 | c.1351G>A | p.E451K | GADVPFGPPLDIQILHQVLDLQIAI[p.E451K]KNITASYDNETVTLQDICLAPLSPYN | AIKNITASY, LQIAIKNIT, QVLDLQIAIK, IAIKNITASY, LQIAIKNITA | CRC |
| NPIP | c.812C>T | p.A271V | QPPPPTQQHSIIDNSLSLKTPSELS[p.A271V]VHSPSTLSSTLSG* | LKTPSELSV, SELSVHSPS, LSVHSPSTL, SLKTPSELSV, LKTPSE LSVH, SELSVHSPST | PRAD |
| NPM1 | c.859_860insTCTG | p.L287fs | KVEAKFINYVKNCFRMTDQEAIQDL[p.L287fs]CLAVEEVSLRK* | AIQDLCLAV, AVEEVSLRK, EAIQDLCLA, QEAIQDLCL, LAVEE VSLRK, EAIQDLCLAV, QEAIQDLCLA | LAML |
| NPM1 | c.861_862insCTGC | p.L287fs | KVEAKFINYVKNCFRMTDQEAIQDL[p.L287fs]LLAVEEVSLRK* | AIQDLLLAV, LLAVEEVSL, LAVEEVSLRK, EAIQDLLLA, QEAIQ DLLL, LLLAVEEVSL, LAVEEVSLRK, EAIQDLLLAV, QEAIQDLL LA | LAML |
| NPM1 | c.863_864insTCTG | p.W288fs | KVEAKFINYVKNCFRMTDQEAIQDL[p.W288fs]CLAVEEVSLRK* | AIQDLCLAV, AVEEVSLRK, EAIQDLCLA, QEAIQDLCL, LAVEE VSLRK, EAIQDLCLAV, QEAIQDLCLA | LAML |
| NPR3 | c.412T>C | p.Y138H | LFSLVDRVAAARGAKPDLILGPVCE[p.Y138H]HAAAPVARLASHWDLPMLSAGALAAG | ILGPVCEHA, HAAAPVARL, CEHAAAPVA, GPVCEHAAA, ILG PVCEHA, HAAAPVARLA | STAD |
| NPSR1 | c.704G>A | p.R235Q | YMTIVAFLVYFIPLTIISIMYGIVI[p.R235Q]QTIWIKSKTYETVISNCSDGKLCSSY | IMYGIVIQT, IVIQTIWIK, MYGIVIQTI, QTIWIKSKT, YGIVIQTI W, IMYGIVIQTI, SIMYGIVIQT, VIQTIWIKSK, GIVIQTIWIK, M YGIVIQTIW, QTIWIKSKTY | CRC |
| NPTX1 | c.787G>A | p.A263T | YMYAKVKKSLPEMYAFTVCMWLKSS[p.A263T]TTPGVGTPFSYAVPGQANELVLIEWG | LKSSTTPGV, WLKSSTTPGV, STTPGVGTPF | GBM |
| NPY1R | c.1111G>A | p.A371T | DYETIAMSTMHTDVSKTSLKQASPV[p.A371T]TFKKINNNDDNEKI* | KQASPVTFK, QASPVTFKK, LKQASPVTF, KQASPVTFKK, SLK QASPVTF | UCEC |
| NR2C1 | c.809G>T | p.S270I | HPSGVKTESAVLMTSDKAESCQGDL[p.S270I]ITLANVTSLANLGKTKDLSQNSNEM | AESCQGDLI, ITLANVVTSL, GDLITLANVV, AESCQGDLIT | KIRC |
| NR4A2 | c.941G>T | p.R314L | RTVQKNAKYVCLANKNCPVDKRRRN[p.R314L]LCQYCRFQKCLAVGMVKEVRTDSLK | RNLCQYCRF, KRRRNLCQY, NLCQYCRFQK, CPVDKRRRNL, R RNLCQYCRF | LUAD |
| NR5A2 | c.238G>A | p.E80K | SHGEQGQMPENMQVSQFKMVNYSYD[p.E80K]KDLEELCPVCGDKVSGYHYGLLTCES | KMVNYSYDK, KDLEELCPV, YSYDKDLEEL | CESC |
| NRAP | c.979G>A | p.E327K | YEEHRGKGSFPAMITPAYQNAKKAH[p.E327K]KLASDIKYRQDFNMKGAAHYHSLPA | YQNAKKAHK, KAHKLASDI, KLASDIKYR, HKLASDIKY, YQNA KKAHKL, KAHKLASDIK, AYQNAKKAHK, KKAHKLASDI, AHKL ASDIKY | CRC |
| NRAS | c.181C>A | p.Q61K | IEDSYRKQWIDGETCLLDILDTAG[p.Q61K]KEEYSAMRDQYMRTGEGFLCVFAINN | LDTAGKEEY, AGKEEYSAM, ILDTAGKEEY, DTAGKEEYSA | CRC, LAML, MM, SKCM, THCA |
| NRAS | c.182A>G | p.Q61R | IEDSYRKQVVIDGETCLLDILDTAG[p.Q61R]REEYSAMRDQYMRTGEGFLCVFAINN | LDTAGREEY, AGREEYSAM, ILDTAGREEY, AGREEYSAMR, D TAGREEYSA | CLL, MM, OV, SKCM, TGCT, THCA, UCEC |
| NRAS | c.182A>T | p.Q61L | IEDSYRKQVVIDGETCLLDILDTAG[p.Q61L]LEEYSAMRDQYMRTGEGFLCVFAINN | LDTAGLEEY, AGLEEYSAM, ILDTAGLEEY, LLDILDTAGL, DTA GLEEYSA | CRC, LUAD, MM, SKCM |
| NRAS | c.183A>C | p.Q61H | IEDSYRKQVVIDGETCLLDILDTAG[p.Q61H]HEEYSAMRDQYMRTGEGFLCVFAINN | LDTAGHEEY, AGHEEYSAM, ILDTAGHEEY, DTAGHEEYSA | MM |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| NRAS | c.183A>T | p.Q61H | IEDSYRKQVVIDGETCLLDILDTAG[p.Q61H]HEEYSAMRDQYMRTGEGFLCVFAINN | LDTAGHEEY, AGHEEYSAM, ILDTAGHEEY, DTAGHEEYSA | LAML |
| NRAS | c.34G>T | p.G12C | MTEYKLVVVGA[p.G12C]CGVGKSALTIQLIQNHFVDEYDPTIE | LVVVGACGV, VVVGACGVG, KLVVVGACGV, VVVGACGVGK | CRC |
| NRAS | c.35G>A | p.G12D | MTEYKLVVVGA[p.G12D]DGVGKSALTIQLIQNHFVDEYDPTIE | LVVVGADGV, VVVGADGVG, KLVVVGADGV, VVVGADGVGK | CRC, LAML, MM |
| NRAS | c.37G>C | p.G13R | MTEYKLVVVGAG[p.G13R]RVGKSALTIQLIQNHFVDEYDPTIED | VVVGAGRVG, RVGKSALTI, KLVVVGAGR, AGRVGKSAL, KLVVVGAGRV, VVVGAGRVGK, GRVGKSALTI | CRC, MM |
| NRAS | c.38G>A | p.G13D | MTEYKLVVVGAG[p.G13D]DVGKSALTIQLIQNHFVDEYDPTIED | VVVGAGDVGK, KLVVVGAGDV, VVVGAGDVGK | LAML |
| NRG1 | C.1441G>T | p.V481L | VSSMTVSMPSMAVSPFMEEERPLLL[p.V481L]LTPPRLREKKFDHHPQQFSSFHHNPA | LLLLTPPRL, LTPPRLREK, LLLTPPRL, EEERPLLLL, EERPLLLLT, LLTPPRLREK, MEEERPLLLL | LUAD |
| NRG2 | c.737C>T | p.T246M | LKKEVGKILCTDCATRPKLKKMKSQ[p.T246M]MGQVGEKQSLKCEAAAGNPQPSYRWF | KMKSQMGQV, SQMGQVGEK, KLKKMKSQM, MKSQMGQVG, KSQMGQVGEK, KLKKMKSQMG, KMKSQMGQVG, KKMKSQMGQV | CRC |
| NRG4 | c.63_64insG | p.G21fs | ANRSRRALWSQSQVVLPEWGA[p.G21fs]VM* | VLPEWGAVV, LPEWGAVVM, VVLPEWGAVV, VLPEWGAVV, VM, QVVLPEWGAV | CLL |
| NRXN3 | C.307C>T | p.R103C | FETPEAYISLPKWNTKRMGSISFDF[p.R103C]CTTEPNGLILFTHGKPQERKDARSQK | CTTEPNGLI | LUAD |
| NRXN3 | c.68C>A | p.P23H | MLGSDDFFYVGGSPSTADLPGS[p.P23H]HVSNNFMGCLKEVVYKNNDIRLELSR | GSHVSNNFM, STADLPGSH, STADLPGSHV, HVSNNFMGCL, LPGSHVSNNF | LUAD |
| NSMCE1 | c.730G>A | p.D244N | YFQSNAEPRCPHCNDYWPHEIPKVF[p.D244N]NPEKERESGVLKSNKKSLRSRQ | KVFNPEKER, HEIPKVFNP, HEIPKVFNPE | UCEC |
| NSMCE2 | c.91_92insA | p.Q31fs | SNSGSTGFISFSGVESALSSLKNFQ[p.Q31fs]SLYQLWYGHSF* | FQSLYQLWY, YQLWYGHSF, SLKNFQSLY, SSLKNFQSL, NFQSLYQLW, KNFQSLYQL, SLYQLWYGFI, SSLKNFQSLY, KNFQSLYQLW, LYQLWYGHSF, NFQSLYQLWY, LSSLKNFQSL, LKNFQSLYQL | KIRC |
| NT5C3 | c.7G>C | p.A3P | MR[p.A3P]PPSMDRAAVARVGAVASASVCALVAG | RPPSMDRAA, PPSMDRAAV, RPPSMDRAAV | TGCT |
| NT5M | c.616del C | p.P206fs | AEPTPSWEHVLFTACHNQHLQLQPP[p.P206fs]AAGCTRGRTTGRPFWTASGPAELDCASGSSVGL* | LQLQPPAAG, NQHLQLQPPA | STAD |
| NTM | c.997G>T | p.G333C | IMLFEVKTTALTPWKGPGAVSEVSN[p.G333C]CTSRRAGCVWLLPLLVLHLLLKF* | EVSNCTSRR | LUAD |
| NTN4 | C.175G>A | p.E59K | CNPRMGNLALGRKLWADTTCGQNAT[p.E59K]KLYCFYSENTDLTCRQPKCDKCNAAY | TTCGQNATK, ATKLYCFYS, CGQNATKLY, NATKLYCFY, KLYCFYSENT, QNATKLYCFY, DTTCGANATK, GQNATKLYCF | CRC |
| NUAK1 | c.517G>T | p.G173C | RRLSERETRHFFRQIVSAVHYCHKN[p.G173C]CVVHRDLKLENILLDDNCNIKIADFG | AVHYCHKNCV, KNCVVHRDLK, VHYCHKNCVV, HKNCVVHRDL | LUAD |
| NUB1 | c.1118G>A | p.R373Q | RLVHIKGNCGKEKVLFLRLYLLQGI[p.R373Q]QNYHSGNDVEAYEYLNKARQLFKELY | YLLQGIQNY, IQNYHSGNDV | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| NUDT 15 | c.248C>A | p.S83Y | ECAQRETWEEAALHLKNVHFASVVN[p. S83Y]YFIEKENYHVTILMKGEVDVTH DSE | FASVVNYFI,SVVNYFIEK,HFASVVNYF,VHFASVVNY,ASVV NVYFIEK,VHFASVVNYF,HFASVVNYFI,YFIEKENYHY,NVHFA SVVNY,VNYFIEKENY | CRC |
| NUDT 21 | c.39_40ins G | p.W13fs | MSVVPPNRSQTGW[p.W13fs]APGG HSVRQQVHPADEAPHPGAHHQPVPSYQ LYFWYKRAPLREGQLCCSQISAHEGRI* | QLYFWYKRA,SYQLYFWYK,YQLYFWYKR,YFWYKRAPL,RSQTGWAPG, SVRQQVHPA,FWYKRAPLR,AAHHQPVSY,PSYQLYFWY,HPGAHHQPV, QPVPSYQLY,HQPVPSYQL,DEAPHPGAH,VPSYQLYFW,YQLYFWYKRA, PSYQLYFWYK,SYQLYFWYKR,LYFWYKRAPL,GAHHQPVPSY,HQPVPSY QLY,YFWYKRAPLR,VPSYQLYFWY,RQQVHPADEA,HHQPVP SYQL,QPVPSYQLYF,REGQLCCSQI,GQLCCSQISA,SQISAHEGRI, DEAPHPGAHH | KIRC |
| NUF2 | c.1019C>T | p.S340 L | KESLNLEDQIESDESELKKLKTEEN[p.S3 40L]LFKRLMIVKKEKLATAQFKINKKHE D | NLFKRLMIV,KTEENLFKR,LFKRLMIVK,KKLKTEENL,KLKTEE NLF,EENLFKRLM,TEENLFKRL,KLKTEENLFK,NLFKRLMIVK, LFKRLMIVKK,KKLKTEENLF,TEENLFKRLM,EENLFKRLMI | CRC |
| NUFIP 2 | c.670del A | p.R224fs | TNGYMGKGADNDGSGSESGYTTPKK[p. R224fs]GKLGAIVPRVVKTLI* | KLGAIVPRV,GAIVPRVVK,VPRWKTLI,KKGKLGAIV,KLGAI VPRVV,AIVPRVVKTL,SGYTTPKKGK,KGKLGAIVPR,LGAIVP RVVK,TPKKGKLGAI | STAD |
| NUFIP 2 | c.86_88del AGC | p.Q29del | KPGQPQHHHSHHHPHHHPQQQQ Q[p.Q29del]PHHHHHYFYNHSHNHH HHHHHQQPHQY | HPQQQQQPH | GBM |
| NUP2 10 | c.403del C | p.L135fs | DAIVDLIHDIQIVSTTRELYLEDSP[p.L13 5fs]WS* | ELYLEDSPW,RELYLEDSPW | STAD |
| NUP8 8 | c.905C>T | p.A302 V | FLTYISLLHSPGNIGKLLGPLPMHP[p.A3 02V]VAEDNYGYDACAVLCLPCVPNILVI A | PVAEDNYGY,LLGPLPMHPV,PMHPVAEDNY,HPVAEDNY GY | CRC |
| NUP9 3 | c.40G>A | p.E14K | MDTEGFGELLQQA[p.E14K]KQLAAET EGISELPHVERNLQEIQQA | LQQAKQLAA,KQLAAETEG,KQLAAETEGI,LLQQAKQLAA,G ELLQQAKQL | BRCA |
| NYAP 1 | c.1438C>T | p.P480 S | DKAVSTMVYSAVKVTTHSVLPAGP[p. P480S]SLGAGEPKTEKEISVLHGMLCTS SRP | SVLPAGPSL,LPAGPSLGA,VLPAGPSLGA,HSVLPAGPSL | TGCT |
| NYAP 2 | c.1310C>T | p.P437 L | SSPPPPSTLYRTQSPHGYPKSHSTS[p.P4 37L]LSPVSMGRSLTPLSLKRPPPYDAVH S | SLSPVSMGR,KSHSTSLSP,YPKSHSTSL,SHSTSLSPV,STSLSP VSM,TSLSPVSMGR,KSHSTSLSPV,HSTSLSPVSM | LUAD |
| NYAP 2 | c.590G>A | p.R197 Q | RTEASAKPRPHSDEYSKKIPPPKPK[p.R1 97Q]QNPNTQLSTSFDETYIKKHGPRRT SL | KQNPNTQLS,KPKQNPNTQL,KQNPNTQLST | CESC |
| NYNRI N | c.339del C | p.G113fs | AFLGAQGLFLDCLCWSTLAYLVPG[p. G113fs]LAP* | LAYLVPGPL,TLAYLVPGPL | STAD |
| OBSC N | c.13546C>T | p.R451 6W | LLLRSAQPHHAGEVTFACRDAVASA[p. R4516W]WLTVLGLPDPPEDAEVVARS SHTVTL | AVASAWLTV,VASAWLTVL,SAWLTVLGL,AVASAWLTVL,D AVASAWLTV,ACRDAVASAW,ASAWLTVLGL | ACC |
| OBSC N | c.2721_272 2TG>CA | p.A908 T | VSEPKVVFAKEQLARRKLQAEAGAS[p.A90 8T]TTLSCEVAQAQTEVTWYKDGK KLSSSS | LQAEAGAST,AEAGASTTL,LQAEAGASTT, QAEAGASTTL,AEAGASTTLS | TGCT |
| OBSC N | c.2989_299 0insG | p.G997fs | LDVKEPKVVFAKDQVAHSEVQAEAG[p.G9 97fs]GQCHAELRGPGPGDGGDVVQRWEEA ELQLESACRGQGLQTEAGGAA VQAEAGGQCH,AELRGGPGP,AELQLESAC,GLLPPAHHRA, VQAEAGGQCH,QRWEEAELQL,LESACRGQGL,LQTEAGGAAG, GRQDRCRGLQL,LQLRGQGPEG,EEAELQLESA | LLPPAHHRA,AEAGGQCHA,VQRWEEAEL,LQTEAGGAA, EEAELQLES,AELRGGPGP,AELQLESAC,GLLPPAHHRA, VQAEAGGQCH,QRWEEAELQL,LESACRGQGL,LQTEAGGAAG, RQDRCRGLQL,LQLRGQGPEG,EEAELQLESA | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OBSL1 | c.4924G>A | p.E164 2K | RCAARLIVREVPVTIVRGPHDLEVT[p.E1642K]KGDTATFECELSQALADVTWEKDGNA | VTKGDTATF, LEVTKGDTA, EVTKGDTATF | CESC |
| ODF2L | c.1221del A | p.K407fs | TTLAALKDEVVSVENELSELQEVEK[p.K407fs]NRKPLLKCIKLRYKSCKKQLK* | KLRYKSCKK, RYKSCKKQL, LLKCIKLRY, ELQEVEKNR, KPLLKC IKL, CIKLRYKS, VEKNRKPLL, LLKCIKLRYK, VEKNRKPLLK, K NRKPLLKCI, CIKLRYKSCK, RYKSCKKQLK, QEVEKNRKPL, LRY KSCKKQL | KICH |
| ODF2L | c.880G>A | p.E294 K | DQEAKLSETISASNAWKSHYEKIVI[p.E294K]KKTELEVQIETMKKQIINLLEDLKKM | KKTELEVQI, YEKIVIKKT, IVIKKTELEV, KSHYEKIVIK | MM |
| ODF4 | c.181C>T | p.R61C | TGELGQDGRLLSSTLSLSSNRSLGQ[p.R61C]CQNSPLPFQWRITHSFRWMAQVLASE | QCQNSPLPF, SLGQCQNSPL, GQCQNSPLPF, CQNSPLPFQW | GBM |
| ODZ1 | c.1097G>T | p.R366 M | HLFGLITWQLQPVEGELYANGVSKGN[p.R366M]MGTESMDTTYSPIGGKVSDKSEKKVF | KGNMGTESM, MGTESMDTTY, YANGVSKGNM, SKGNMGTESM | HNSC |
| ODZ1 | c.7666C>T | p.R255 6W | KGIKFAIKDGIVTADIIGVANEDSR[p.R2556W]WLAAILNNAHYLENLHFTIEGRDTHY | WLAAILNNA, NEDSRWLAA, RWLAAILNNA, WLAAILNNAH, NEDSRWLAAI | CRC |
| ODZ2 | c.1882_188 3ins6 | p.W62 8fs | KAACPVLCSGNGQYSKGTCQCYSGW[p.W628fs]ERCRVRRAHESVHRSFLRGPRLLH* | SFLRGPRLL, RVRRAHESV, SVHRSFLRG, RSFLRGPRL, CYSG WERCR, SGWERCRVR, ESVHRSFLR, AHESVHRSF, HESVHR SFL, WERCRVRRA, RVRRAHESVH, RAHESVHRSF, VHRSFLR GPR, RSFLRGPRLL, SGWERCRVRR, WERCRVRRAH | KIRC |
| ODZ3 | c.653C>A | p.P218 Q | SAQHHPSITSLNRNSLTNRRNQSPA[p.P218Q]QPAALPAELQTTPESVLQDSWVLGS | QPAALPAEL, NQSPAQPAA, SPAQPAALPA, RRNQSPAQPA, NQSPAQPAAL, AQPAALPAEL | LUAD |
| OGDH | c.233del T | p.I78fs | NYVEEMYCAWLENPKSVHKSWDIFF[p.I78fs]ATRMPEPHRALPTRVPFP* | RMPEPHRAL, RALPTRVPF, ATRMPEPHR, SWDIFFATR, WD IFFATRM, FATRMPEPH, KSWDIFFATR, ATRMPEPHRA, RAL PTRVPFP, FATRMPEPFIR, MPEPHRALPT, TRMPEPHRAL, H RALPTRVPF, EPHRALPTRV | GBM |
| OGDH | c.2844_284 5insC | p.Y948f s | VAITRIEQLSPPFPFDLLLKEVQKYP[p.Y948fs]QC* | KEVQKYPQC | STAD |
| OGDH L | c.1279G>A | p.A427 T | TKAEQFYRGDAQGKKVMSILVHGDA[p.A427T]TFAGQGVVYETFHLSDLPSYTTNGTV | LVHGDATFA, ATFAGQGVV, TFAGQGVVY, DATFAGQGV, IL VHGDATF, ATFAGQGVVY, ILVHGDATFA, SILVHGDATF | CRC |
| OGDH L | c.169C>T | p.R57C | RLLPSRLGVQAARLLAAHDVPVFGW[p.R57C]CSRSSGPPATFPSSKGGGGSSYMEEM | CSRSSGPPA, VPVFGWCSR, CSRSSGPPAT, DVPVFGWCSR | UCEC |
| OGFO D1 | c.1430_1431 insGTTTTT TT | p.G477 fs | SKAEFALDLILYCGCEGWEPEYGG[p.G477fs]FFLLLTLPKVKMSC* | FLLLTLPKV, FFLLLTLPK, LTLPKVKMK, EYGGFFFLL, YGGFFFL LL, GFFFLLLTL, LPKVKMKSC, WEPEYGGFF, PEYGGFFFL, EPE YGGFFF, FFFLLLTLPK, GWEPEYGGFF, EYGGFFFLLL, WEPEY GGFFF, GGFFFLLLTL, LLLTLPKVKM, PEYGGFFFLL, EPEYGGF FFL | PAAD |
| OGFR | c.1670G>C | p.S557 T | DEPAESPSETPGPRAGPAGDEPAE[p.S557T]TPSETPGPRPAGPAGDEPAESPSETP | ETPSETPGPR | ACC |
| OIT3 | c.1522C>A | p.R508 S | FVGKDHKEVFLHCRVLVCGVLDERS[p.R508S]SCAQGCHRRMRRGAGGEDSAGLQGQT | VLDERSSCA, RSSCAQGCHR | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OLFM4 | c.396G>T | p.K132N | HVLSQKFEKELSKVREYVQLISVYE[P.K132N]KLLNLTVRIDIMEKDTISYTELDFE | QLISVYENK,VYENKLLNL,YENKLLNLIT,QLISVYENKL,SVYEN KLLNL,VQLISVYENK,YENKLLNLTV | CRC |
| OMA1 | c.1334G>A | p.R445Q | MEFVDSLHGQPKMPEWLSTHPSHGNI[R445Q]QVEYLDRLIPQALKIREMCNCPPLSN | NQVEYLDRL,PSHGNQVEY,STHPSHGNQV,HPSHGNQVEY, NQVEYLDRLI | UCEC |
| ONECUT1 | c.1270T>A | p.L424M | TLHAIFKENKRPSKELQITISQQLGM[L424M]MELSTVSNFFMNARRSLDKWQDEGS | QLGMELSTV,ITISQQLGM,MELSTVSNF,ISQQLGMEL,QQL GMELST,QQLGMELSTV,GMELSTVSNF,MELSTVSNFF,SQ QLGMELST | KIRC |
| OOEP | c.301C>T | p.R101C | TSQALLTVDIVDSGNLVEITVFGRP[p.R101C]CVQNRVKSMLLCLAWFHREHRARAEK | ITVFGRPCV,CVQNRVKSM,EITVFGRPCV,VEITVFGRPC | LUAD |
| OPLAH | c.2699C>A | p.A900D | QQEGAVPLSFKLVQGGVFQEEAVTE[p.A900D]DLRAPGKVPNCSGTRNLHDNLSDLRA | QEEAVTEDL,VTEDLRAPGK,FQEEAVTEDL,EEAVTEDLRA | TGCT |
| OPN1LW | c.848C>A | p.P283H | STQKAEKEVTRMVVMLFAYCVCWG[p.P283H]HYTFPACFAAANPGYAFHPLMAALPA | CVCWGHYTF,VCWGHYTFF,AYCVCWGHY,GHYTFFACF,Y CVCWGHYTF,CVCWGHYTFF,FAYCVCWGHY,WGHYTFFACF | LUAD |
| OPN1MW | c.853G>A | p.A285T | QKAEKEVTRMVWMLAFCFCWGPY[p.A285T]TFFACFAAANPGYPFHPLMAALPAFF | CFCWGPYTF,FCWGPYTFF,FCWGPYTFFA,FCFCWGPYTF, CFCWGPYTFF | HNSC |
| OPRD1 | c.80G>T | p.C27F | EPAPSAGAELQPPLFANASDAYPSA[p.C27F]FPSAGANASGPPGARSASSLALAIAI | ASDAYPSAF,AYPSAFPSA,FPSAGANAS,YPSAFPSAG,DAYP SAFPSA,YPSAFPSAGA,NASDAYPSAF,SAFPSAGANA,FPSA GANASG | ACC |
| OPRM1 | c.1058G>A | p.R353H | KICVFIFAFIMPVLLITVCYGLMIL[p.R353H]HLKSVRMLSGSKEKDRNLRRITRMVL | LMILHLKSV,YGLMILHLK,CYGLMILHL,HLKSVRMLS,MILHL KSVR,ILHLKSVRM,LHLKSVRML,GLMILHLKSV,ILHLKSVR ML,HLKSVRMLSG,LMILHLKSVR,MILHLKSVRM | CRC |
| OPRM1 | c.1384C>T | p.R462C | NFKRCFREFCIPTSSNIEQQNSTRI[p.R462C]CQNTRDHPSTANTVDRTNHQLENLEA | STRICQNTR,NSTRICQNTR | UCEC |
| OPTN | c.70del C | p.P24fs | MSHQPLSCLITEKEDSPSESTGNGPP[p.P24fs]TWPTQWTRLPRRSCCCSR* | TQTWTRLPR,QTWTRLPRR,TWPTQTWTR,WPTQTWTRL, PPTWPTQTW,TWPTQTWTRL,RLPRRSCCCSR,PTWPTQTW TR,PTQTWTRLPR,TQTWTRLPRR,SESTGNGPPT,ESTGNG PPTW | STAD |
| OR10A3 | c.217T>G | p.F73V | IISLNQSLHVPMYLFLLNLSVVEVS[p.F73V]VSAVITPEMLVVLSTEKTMISPVGCF | NLSVVEVSV,SVVEVSVA,VEVSVSAVI,VSAVITPEM,SVVE VSVSAV,SVSAVSAVIT,VEVSVSAVIT | KIRC |
| OR10A3 | c.278C>A | p.S93Y | VVEVSPSAVITPEMLVVLSTEKTMI[p.S93Y]YFVGCFAQMYFILLFGGTECFLLGAM | LSTEKTMIY,VLSTEKTMIY,MIYFVGCFA,YFVGCFAQM,KTMI YFVGC,TMIYFVGCF,TEKTMIYFV,TMIYFVGCFA,KTMIYFV GCF,IYFVGCFAQM,VLSTEKTMIY,YFVGCFAQMY,STEKTM IYFV,LSTEKTMIYF | CRC |
| OR10H4 | c.597G>T | p.M199I | VIHHFPCHVLSLLKLACENKTSSVI[p.M199I]IGVMLVCVTALIGCLFLIILSYVFIV DRYVALCNPLRYMVIMNKRLRIQLV | KTSSVIIGV,SVIIGVMLV,IIGVMLVCV,TSSVIIGVM,VIIGVM LVCV,KTSSVIIGVM,SVVIIGVMLV,CENKTSSVII | LUAD |
| OR10J1 | c.470T>A | p.L157Q | DRYVALCNPLRYMVIMNKRLRIQLV[p.L157Q]QGACSIGLIVAITQVTSVRLPFCAR | QLVQGACSI,RLRIQLVQG,VQGACSIGL,RLRIQLVQGA,IQL VQGACSI,VQGACSIGLI | LUAD |
| OR10J1 | c.731G>A | p.R244Q | VPMGLVFISYVLIISTILKIASVEG[p.R244Q]QKKAFATCASHLTVVIVHYSCASIAY | KIASVEGQK,KIASVEGQKK,ASVEGQKKAF | TGCT |
| OR10X1 | c.892C>A | p.L298I | IVYLKPEASGDDTLIAVPYTVITPF[p.L298I]ISPIIFSLRNKDMKNAFRRMGNTVA | VITPFISPI,FISPIIFSL,ISPIIFSLR,PYTVITPFI,ITPFIS PII,TPFISPIIF,TVITPFISPI,VITPFISPII,FISPIIFSLR, ITPFISPIIF,PPISPIIFSL,VPYTVTPFI | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OR10 Z1 | c.615G>C | p.L205 F | DTPPVLSLACGDTGPSELRIFILSL[p.L20 5F]FVLLVSFFFITISYAYILAAILRIPS | RIFILSLFV, FIILSLFVLL, IiLSLFVLLV, LRIFILSLF, IFILSLFVL, SLFVLLVSF, LFVLLVSFF, FVLLVSFFF, RIFILSLFVL, FILSLFV-LLV, FVLLVSFFFI, IFILSLFVLL, LSLFVLLVSF, SLFVLLVSFF, LFVLL VSFFF, ELRIFILSLF | LUAD |
| OR11 H12 | c.461A>C | p.H154 P | LLTVMAFDQYLAICRPLLYPNIMTGP[p. 154P]PLCAKLVILCWVCGFLWFLIPIVLI S | IMTGPLCAK, MTGPLCAKL, YPNIMTGPL, GPLCAKLVI, IMTG PLCAKL, LLYPNIMTGP, NIMTGPLCAK, LYPNIMTGPL, MTG PLCAKLV, GPLCAKLVIL, YPNIMTGPLC | GBM |
| OR13 C2 | c.25C>G | p.L9V | MEWENHTI[p.L9V]VEFFLKGLSGHPR LELLFVLIFIM | TIVVEFFLK, HTIVVEFFL, MEWENHTIV, IVVEFFLKGL, HTIVV EFFLK, MEWENHTIVV, WENHTIWEF | CESC |
| OR13 G1 | c.773G>A | p.R258 H | KAFSTCSSHLTVVTLYYSPVIYTYI[p.R25 8H]HPASSYTFERDKVVAALYTLVTPTLN S | VIYTYIHPA, YIHPASSYT, IHPASSYTF, TYIHPASSY, YTYIHPAS S, SPVIYTYIH, YTYIHPASSY, YIHPASSYTF, HPASSYTFER | BRCA |
| OR14 A16 | c.478G>T | p.G160 C | DRSTCVQRATVSWLYGGLIAVMHTA[p. G160C]CTFSLSYCGSNMVHQFFCDIP QLLAI | TACTFSLSY, HTACTFSLS, AVMHTACTF, MHTACTFSL, HTAC TFSLSY, VMHTACTFSL, GLIAVMHTAC, IAVMHTACTF | LUAD |
| OR1M 1 | c.205G>A | p.V69I | LILALISIDSHLHTPMYFFLANLSL[p.V69I] IDFCLATNTIPKMLVSLQTGSKAISY | NLSLIDFCL, SLIDFCLAT, FFLANLSLI, LANLSLIDF, NLSLIDFCL A, FLANLSLIDF, YFFLANLSLI, IDFCLATNTI | PRAD |
| OR2A 25 | c.240G>A | p.M80I | HTPMYFFLSHLAVVDIACACSTVPQ[p. M80I]ILVNLLHPAKPISFAGCMTQMFL FLS | ILVNLLHPA, CSTVPQIIV, TVPQILVNL, VPQILVNLL, ILVNLL HPAK, STVPQILVNL, TVPQILVNLL | LUAD |
| OR2A 25 | c.313A>T | p.S105 C | MLVNLLHPAKPISFAGCMTQMFLFL[p. S105C]CFAHTECLLLVVMSYDRYVAICH PLR | QMFLFLCFA, FLFLCFAHT, FLCFAHTEC, TQMFLFLCF, LCFAH TECL, MTQMFLFLCF, TQMFLFLCFA, FLCFAHTECL, CFAHTE CLLL, QMFLFLCFAH | CLL |
| OR2A 5 | c.212C>T | p.S71L | GLIWLDSRLHTPMYFFLSHLAIIDI[p.S7 1L]LYASNNVPKMLTNLGLNKRKTISFVP | HLAIIDILY, AIIDILYAS, LYASNNVPK, DILYASNNV, ILYASNN VP, HLAIIDILYA, ILYASNNVPK, LYASNNVPKM, SHLAIIDILY, LSHLAIIDIL, IDILYASNNV | SKCM |
| OR2A G2 | c.745G>T | p.G249 W | TVLRMPSNEGRKKALVTCSSHLIVV[p.G 249W]WMFYGAATFMYVLPSSFHSPK QDNII | IVVWMFYGA, WMFYGAATF, HLIVVWMFY, SHLIVVWMF, SSHLIVVWM, CSSHLIVVW, LIVVWMFYGA, WMFYGAATF M, SSHLIVVWMF, VWMFYGAATF, SHLIWWMFY, IWWM FYGAA | LUAD |
| OR2A K2 | c.111G>C | p.W37 C | LVSAMKTGNQSFGTDFLLVGLFQYG[p. W37C]CINSLLFVVIATLFVVALTGNIMLI H | FQYGCINSL, CINSLLFVV, QYGCINSLL, YGCINSLLF, FQYGCI NSLL, CINSLLFVVI, QYGCINSLLF | LUAD |
| OR2A K2 | c.133G>A | p.V45I | NQSFGTDFLLVGLFQYGWINSLLFV[p.V 45I]IIATLFVALTGNIMLIHLIRLNTRL | WINSLLFVI, SLLFVIIAT, LLFVIIATL, VIIATLFTV, IIATLFTVA, L FVIIATLF, WINSLLFVI, SLLFVIIATL, FVIIATLFTV, VIIATLFTV A, IIATLFTVAL, GWINSLLFVI, LLFVIIATLF | BRCA |
| OR2B 11 | c.29G>T | p.G10V | MKSDNHSFL[p.G10V]VDSPKAFILLGV SDRPWLELPLFVL | KSDNHSFLV, FLVDSPKAF, HSFLVDSPK, FLVDSPKAFI, SFLV DSPKAF, MKSDNHSFLV | LUSC |
| OR2H 1 | c.859G>A | p.V287I | NPYAQGRGKFFGLFYAVGTPSLNPL[p. V287I]IYTLRNKEIKRALRLLGKERDSR ES | IYTLRNKEI | GBM |
| OR2H 2 | c.615G>C | p.L205 F | PALIRLSCEDTSYNEIQVAVASVFI[p.L20 5F]FVVPLSLILVSYGAITWAVLRINSAK | AVASVFIPV, SVFIFVVPL, FIFVVPLSL, FVVPLSLIL, VAVASVFI F, IFVVPLSLI, VASVFIFVV, VAVASVFIFV, AVASVFIFVV, FIFV VPLSLI, FVVPLSLILV, VFIFVVPLSL, IFVVPLSLIL, QVAVASVFI F, ASVFIFVVPL | LUAD |
| OR2J2 | c.700G>T | p.G234 W | LIPLILILTTYGAIARAVLSMQSTT[p.G23 4W]WLQKVFRTCGAHLMVSLFFIPV MCM | MQSTTWLQK, TTWLQKVFR, QSTTWLQKV, VLSMQSTTW, LSMQSTTWL, STTWLQKVF, VLSMQSTTWL, MQSTTWLQK V, SMQSTTWLQ, STTWLQKVFR, AVLSMQSTTW, QSTTW LQKVF | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OR2L13 | c.318G>T | p.M106I | AYNFLSGQKGISFLGCGVQSFFFLT[p.M106I]IACSEGLLLTSMAYDRYLAICHSLY | VQSFFFLTI,QSFFFLTIA,LTIACSEGL,IACSEGLLL,FLTIACSEG L,GVQSFFFLTI,LTIACSEGLL,VQSFFLTIA | LUAD |
| OR2L13 | c.724A>G | p.T242A | CGRVLFAVYHMHSKEGRKKAFTTIS[p.T242A]AHLTVVIFYYAPFVYTLRPRNLR SP | TISAHLTVV,KAFTTISAH,AHLTVVIFY,FTTISAHLT,TTISAHL TV,SAHLTVVIF,KKAFTTISA,ISAFILTVVI,FTTISAHLTV,TTIS AFILTVV,TISAFILTVVI,ISAFILTVVIF,RKKAFTTISA,KAFTTIS AHL,SAHLTVVIFY,AHLTVVIFYY,KAFTTISAH | LUAD |
| OR2L3 | c.199C>A | p.L67I | LSMILIFLDTHLHTPMYFLLSQLS[p.L67I]IIDLNYISTIVPKMASDFLSGNKSIS | QLSIIDLNY,FLLSQLSII,LLSQLSIIDL,QLSIIDLNYI, YFLLSQLSII,SQLSIIDLNY | LUAD |
| OR2L3 | c.3G>T | p.M1I | [p.M1I]IENYNQTSTDFILLGFFPPSRIGL FL | IENYNQTST | LUAD |
| OR2L3 | c.881A>G | p.K294R | EDKVLAVFYTTLTPMLNPIIYSLRN[p.K294R]REVMGALTRVSQRICSGKM* | IIYSLRNREV,RNREVMGALT,REVMGALTRV | TGCT |
| OR2L8 | c.361C>T | p.R121C | CGIQSFFLALGGAEAILLASMAYD[p.R121C]CYIAICFPLHYLIRMSKRVCVLMIT G | ASMAYDCYI,SMAYDCYIA,MAYDCYIAI,CYIAICFPL,SMAY DCYIAI,AYDCYIAICF,CYIAICFPLH | LUAD |
| OR2L8 | c.513G>T | p.R171S | GSWIIGSINACAHTVVLHIPYCRS[p.R171S]SAINHFFCDVPAMVTLACMDTWV YEG | RSSAINHFF,IPYCRSSAI,CRSSAINHF,HIPYCRSSAI,SAINHF FCDV,RSSAINHFFC,YCRSSAINHF,LHIPYCRSSA,CRSSAINH FF | LUAD |
| OR2L8 | c.603_604del|TG | p.S201fs | FCDVPAMVTLACMDTWVYEGTVFLS[p.S201fs]HHLSRVSLHWYFMFLWPGSL CCLPHEICRREEESLFDLQHPPHCSNFLL CTFCLHLSTSKIPAISNRGQGSGCLLHHP HPNAQPHHL* | FLSHHLSRV,SLHWYFMFL,FMFLWPGSL,FMFLWPGSLC,SLC CLPHEI,LLCTFCLHL,SLFDLQHPP,CLHLSTSKI,HLSTSKIPA,L LHHPHPNA,SRVSLHWYF,VSLHWYFMF,WYFMFLWPG,C SNFLLCTF,NFLLCTFCL,VFLSHHLSR,RVSLHWYFM,LSRVSL HWY,HPPHCSNFL,HPHNAQPHL,HPNAQPHHL,YEGTVFL SH,SHHLSRVSL,HLSRVSLHW,CRREEESLF,REEESLFDL,LQ HPPHCSN,RGQGSGCLL,GQGSGCLLH,EESLFDLQH,LHWY FMFLW,HLSRVSLHWY,VSLHWYFMFL,FMFLWPGSLC,FL WPGSLCCL,FLLCTFCLHL,HLSTSKIPAI,CLLHHPHNA,FLSH HLSRVS,TVFLSHHLSR,TFCLHLSTSK,VFLSHHLSRV,RVSLH WYFMF,SLHWYFMFLW,YFMFLWPGSL,TSKIPAISNR,HPP HCSNFLL,LSRVSLHWYF,LQHPPHCSNF,SLFDLQHPPH,YE GTVFLSHH,LSHHLSRVSL,HHLSRVSLHW,SRVSLHWYFM,I CRREEESLF,HCSNFLLCTF,LHLSTSKIPA,GQGSGCLLHH,WP GSLCCLPH | KIRP |
| OR2M2 | c.284delC | p.A95fs | DLMLICTTVPKMAFNVLSGKSISM[p.A95fs]VVVSHKFSSIYHCLALNVFWLLW LMTAILLFATL* | VSHKFSSIY,LALNVFFWL,ALNVFWLL,NVFFWLLWL,WLL WLMTAI,LLWLMTAIL,LMTAILLFA,VVSHKFSSI,ISMVVVS HK,SMVVVSHKF,KFSSIYHCL,IYHCLALNV,CLALNVFFW,VF FWLLWLM,LWLMTAILL,WLMTAILLF,GSKSISMVV,FSSIY HCLA,MTAILLFAT,TAILLFATL,SSIYHCLAL,SKSISMVVV,HK FSSIYHC,YHCLALNVF,HCLALNVFF,SIYHCLALNV,CLALNV FFWL,LALNVFFWLL,WLMTAILLFA,LMTAILLFAT,MTAILLFATL,VVS HKFSSI,SISMVVVSHK,VSHKFSSIYH,ISMVVVSHKF,IYHCLA LNVF,YHCLALNVFF,FWLLWLMTAI,LWLMTAILLF,GSKSIS MVVV,KFSSIYHCLA,VVSHKFSSIY,KSISMVVVSH,HKFSSIY HCL,FSSIYHCLAL | HNSC |
| OR2M2 | c.531C>A | p.F177L | GSTDGIIDAVATFSFCGSREIAH[p.F177L]LFCEFPSLLILSCNDTSIFEEVIFIC AHLFCEFPSL | HLFCEFPSL,GSREIAHLF,EIAHLFCEF,REIAHLFCE,HLFCEFP SLL,REIAHLFCEF,LFCEFPSLLI,GSREIAHLF,CGSREIAHLF, AHLFCEFPSL | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OR2M2 | c.967T>C | p.F323L | TRAFMKILGKSESELPHKLYVLL[p.F323L]LAKFFFLISIFFYDVKILALIMYIA | LLLAKFFFL,LLAKFFFLI,LLAKFFFLIS,KLYVLLLAK,LVVLLLAKF,VLLLAKFFF,VLLLAKFFFL,LLLAKFFFLI,LLAKFFFLIS,KLYVLLLAKF,LYVLLLAKF,YVLLLAKFFF,LAKFFFLISI,LPHKLYVLLL | LUAD |
| OR2M3 | c.704G>A | p.R235H | PVAIIIASYARVILAVIHMGSGEGR[p.R235H]HKAFTTCSSHLLWGMYYGAALF MYI | SGEGRHKAF,HMGSGEGRHK,GSGEGRHKAF,HKAFTTCSS H,GEGRHKAFTT | CRC |
| OR2M3 | c.819G>T | p.M273I | VGMYYGAALFMYIRPTSDRSPTQDK[p.M273I][IVSVFYTILTPMLNPLIYSLRNKE VT | KIVSVFYTI,TQDKIVSVF,TQDKIVSVFY,KIVSVFYTIL,SPTQD KIVSV | HNSC |
| OR2M5 | c.613G>T | p.V205L | DFPSLLILSCNDTSIFEKVLFICCI[p.V205L][LMVFPVAIIIASYARVILAVIHMGS | FICCILMIV,CILMIVFPV,ILMIVFPVA,LMIVFPVAI,LFICCILM I,KVLFICCIL,VLFICCILM,VLFICCILMI,ILMIVFPVAI,LMIVFP VAII,KVLFICCILM,FICCILMIVF | LUAD |
| OR2M12 | c.551G>A | p.R184H | VATLSFPYCGAHEIDHFFCEAPVLV[p.R184H]HLACADTSVFENAMYICCVLMLL VPF | HLACADTSV,EAPVLVHLA,CEAPVLVHL,HLACADTSVF,CEA PVLVHLA | GBM |
| OR2M12 | c.772A>T | p.M258L | KKAFATCSSHVAVVGLFYGAGIFTY[p.M258L]LRPKSHRSTNHDKVVSAFYTM FTPLL | YGAGIFTYL,GIFTYLRPK,GAGIFTYLR,TYLRPKSHR,YLRPKS HRS,AGIFTYLRPK,FTYLRPKSHR,FYGAGIFTYL,YGAGIFTYL R,YLRPKSHRST | LUAD |
| OR2T2 | c.37T>G | p.F13V | MGMEGLLQNSTN[p.F13V]VVLTGLIT HPAFPGLLFAIVFSIFVV | GLLQNSTNVV,LLQNSTNVV,STNVVLTGL,LQNSTNVVL,GLL QNSTNVV,LLQNSTNVVL,NSTNVVLTGL,STNVVLTGLI,LQ NSTNVVLT | LUSC |
| OR2T27 | c.31G>T | p.D11Y | MEQSNYSVSYA[p.D11Y]YFILLGLFSNA RFPWLLFALILIVFL | QSNYSVYAY,SVVAYFIL,YAYFILLGL,SNYSVYAYF,NYSVYA YFI,YSVYAYFIL,VYAYFILLG,AYFILLGLF,YSVYAYFIL,NYSV YAYFIL,VYAYFILLGL,YAYFILLGLF,EQSNYSVYAY,QSNYSVY AYF,SNYSVYAYFI | LUAD |
| OR2T33 | c.358C>A | p.R120S | CGVQIFLPLPTLGGGECFLLAAMAYD[p.R120S]SYAAVCHPLRYPTLMSWQLCLR MTMS | AMAYDSYAA,MAYDSYAAV,AAMAYDSYA,SYAAVCHPL,L AAMAYDSY,FLLAAMAYDS,AMAYDSYAAV,AAMAYDSYA A,LLAAMAYDSY,SYAAVCHPLR,LAAMAYDSTA,DSYAAVC HPL,MAYDSYAAVC | HNSC |
| OR2T33 | c.494C>A | p.P165Q | LRMTMSCWLLGAADGLLQAWTLSF[p.P165Q]QYCCGAHEIDHFFCETPVLVRLA CADT | FQYCCGAHEI,TLSFQYCGA,AVVTLSFQY,LSFQYCCGAH,SFQY CGAHEI,QAVVTLSFQY,FQYCCGAHEID | LUAD |
| OR2T34 | c.737G>T | p.C246F | SSYTLILHLIHRMNSAAGRRKALAT[p.C246F]FSSHMIIVLLLFGASFYTYMLRSSY H | ALATFSSHM,KALATFSSH,ATFSSHMII,GRRKALATF,RKAL ATFSS,FSSHMIIVL,LATFSSHMI,ALATFSSHMI,ATFSSHMII V,FSSHMIIVLL,TFSSHMIIVL,KALATFSSHM,AGRRKALATF, RKALATFSSH,LATFSSHMII | LUAD |
| OR2T4 | c.408_409CG>TC | p.V137L | KMLLDQVMGVNKISAPECGMQMFFY[p.V137L][LTLAGSEFFLLATMAYDRYVAI CHPLR | GMQMFFYLT,MQMFFYLTL,CGMQMFFYL,GMQMFFYLT L,MQMFFYLTLA,FYLTLAGSEF | LIHC |
| OR2T6 | c.637G>T | p.V213L | ACGDKITYETVMYVCCVAMLLIPFS[p.V213L][LVTASYTRILITVHQMTSAEGRK KAF | AMLLIPFSL,MLLIPFSLV,LLIPFSLVT,LIPFSLVTA,LVTASYTRI, SLVTASYTR,PFSLVTASY,IPFSLVTAS,AMLLIPFSLV,LLIPFSL VTA,SLVTASYTRI,FSLVTASYTR,IPFSLVTASY,VAMLLIPFSL | LUAD |
| OR4C12 | c.744C>A | p.F248L | LKNNSLEGRCKALSTCISHIIVVVL[p.F248L]LFVPCIFVYLRSVTTLPIDKAVAVFY | IIVVVLLFV,LLFVPCIFV,HIIVVVLLF,VLLFVPCIF,LFVPCIFVY, HIIVVVLLFV,LLFVPCIFVY,IIVVVLLFVP,SHIIVVVLLF,VVLLF VPCIF,LFVPCIFVYL,ISHIIVVVLL | UCEC |
| OR4C12 | c.837G>T | p.M279I | FVYLRSVTTLPIDKAVAVFYTMWVP[p.M279I][ILNPVVYTLRNAEVKSAIRKLWR KKV | MVVPILNPV,ILNPVVTL,VFYTMVVPI,FYTMVVPIL,VPILN PVVY,AVFYTMVVPI,TMVVPILNPV,MVVPILNPVV,ILNPV VTLR,VFYTMVVPIL,VVPILNPVVY | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OR4C12 | c.925G>T | p.D309Y | VYTLRNAEVKSAIRKLMRKKVTSDN[p.D309Y]Y | RKKVTSDNY,WRKKVTSDNY | LUAD |
| OR4C16 | c.188A>T | p.Y63F | LGNLLIISVKTSQALKNPMFFLF[p.Y63F]LSLSDTCLSTSITPRMIVDALLKKT | PMFFLFFL,FLSLSDTCL,FFFLFFLSL,NPMFFLFF,FLFFLSLS DT,FLSLSDTCLS,KNPMFFLFF,MFFFLFLSL,NPMFFFLFFL | CLL |
| OR4C16 | c.403A>C | p.S135R | IFILILTAVDRYVDICKPLHVMTII[p.S135R]RQWVCGVLMAVAWVGSCVHSLVQIFL | YMTIIRQWV,IIRQWVCGV,HYMTIIRQW,RQWVCGVLM,T IIRQWVCGV,RQWVCGVLMA,HVMTIIRQWV,LHYMTIIRQ W,IRQWVCGVLM | STAD |
| OR4C16 | c.484C>A | p.L162M | WVCGVLMAVAWVGSCVHSLVQIFLA[p.L162M]MSLPFCGPNVINHCFCDLQP LLKQAC | SLVQIFLAM,VQIFLAMSL,FLAMSLPFC,IFLAMSLPF,MSLPF CGPNV,FLAMSLPFCG,QIFLAMSLPF,HSLVQIFLAM,VQIFL AMSLP | LUAD |
| OR4C3 | c.389_390insT | p.H130fs | IADSLYEGRTISYECCMAQLFGAHF[p.H130fs]FGRC* | AQLFGAHFF,LFGAHFFGR,QLFGAHFFGR,MAQLFGAHFF | LUAD |
| OR4E2 | c.677G>A | p.R226Q | TNSGTISLSCFLAVVTSYMVLVSL[p.R226Q]QKHSAEGRQKALSTCSAHFMVA LFF | MVILVSLQK,ILVSLQKFISA,YMVILVSLQK | SKCM |
| OR4K2 | c.761G>T | p.C254F | SSRGSSKALSTCTAHFIVVFLFFGP[p.C254F]FIFIYMWPLSSFLTDKILSVFYTIFT | FLFFGPFIF,FIFIYMWPL,VFLFFGPFI,LFFGPFIFI,FFGPFIFIY,VVFLFFGPF,GPFIFIYMW,VVFLFFGPFI,FLFFGPFIFI,IVVFLF FGPF,VFLFFGPFIF,FFGPFIFIYM,FGPFIFIYMW,PFIFIYMW PL,LFFGPFIFIY | LUSC |
| OR4K5 | c.529del T | p.F177fs | VHTLSQLSFTVNLPFCGPNWDSFF[p.F177fs]VIFLESPNLPAWTLTSLKY* | NVVDSFFVI,FLESPNLPA,PAWTLTSLK,AWTLTSLKY,SPNLP AWTL,LPAWTLTSL,VVDSFFVIF,LESPNLPAW,VVDSFFVIFL, FVIFLESPNL,NLPAWTLTSL,PAWTLTSLKY,ESPNLPAWTL, NVVDSFFVIF,FLESPNLPAW,LESPNLPAWT | STAD |
| OR4M1 | c.122G>A | p.G41E | GLSQTREVQLVLFVIFLSFYLFILP[p.G41E]ENILLICTIRLDPHLTSPMYFLLANL | YLFLFILPEN,FILPENILI,ILPENILLI,YLFILPENIL,FILPEN ILLI,FYLFILPENI,LFILPENILI,ENILLICTIR | SKCM |
| OR4M2 | c.355G>T | p.A119S | FDGCIAQLFFLHFAGASEMFLTVMI[p.A119S]SFDLYTAICRPLFIYATIMNQRLC CIL | LTVMSFDLY,LLTVMSFDL,VMSFDLYTA,MSFDLYTAI,MFLL TVMSF,TVMSFDLYT,LLTVMSFDLY,FLLTVMSFDL,TVMSF DLYTA,VMSFDLYTAI,EMFLLTVMS,MSFDLYTAIC,SEMFL LTVMS | LUAD |
| OR4M2 | c.481G>T | p.A161S | MNQRLCCILVALSWRGGFIHSIIQV[p.A161S]LIVRLPFCGPNELDSYFCDITQVV R | SIIQVSLIV,IQVSLIVRL,SLIVRLPFC,VSLIVRLPF,HSIIQVSLI,I HSIIQVSL,FIHSIIQVSL,SIIQVSLIVR,HSIIQVSLIV,QVSLIVRL PF | LUAD |
| OR4M2 | c.803C>T | p.S268F | YSHITIVVLMFGPSIYIYARPFDSF[p.S268F]FLDKVVSVFNTLIFPLRNPIIYTLRN | FFLDKVVSV,FLDKVVSVF,YARPFDSFF,IYARPFDSFF,FFLDK VVSVF,YARPFDSFFL,RPFDSFFLDK | SKCM |
| OR4N2 | c.122G>A | p.G41E | GLTQSQDIQLLVFVLVLIFYFIILP[p.G41E]ENFLIIFTIKSDPGLTAPLYFFLGNL | FILPENFLI,IILPENFLII,LLPENFLII,YFIILPENF,ENFLIIFTI, LPENFLIIF,FIILPENFLI,FYFIILPENF,YFIIL PENFL,ILPENFLIIF,PENFLIIFTI | SKCM |
| OR4N2 | c.448_449insT | p.L150fs | ICRPLHYPTVMNPRTCYAMMLALWL[p.L150fs]WGFCPLHYPGGPHPPLAFLM PKPAGQLL* | MLALWLWGF,AMMLALWLW,LWLWGFCPL,LWGFCPLH Y,YPGGPHPPL,GPHPPLAFL,WPKPAGQLL,LHYPGGPHP,L AFLWPKPA,MMLALWLWGF,MLALWLWGFC,ALWLWGF CPL,FLWPKPAGQL,YAMMLALWLW,HYPGGPHPPL,LWP KPAGQLL,WLWGFCPLHY,WPKPAGQLLL,LHYPGGPHPP, GPHPPLAFLW | BLCA,KIRC |
| OR4N4 | c.448_449insT | p.L150fs | ICRPLHCSTVMNPRACYAMMLALWL[p.L150fs]WGFCPLHYPGGPHPPLAFLM PKPAGQLL* | MLALWLWGF,AMMLALWLW,LWLWGFCPL,LWGFCPLH Y,YPGGPHPPL,GPHPPLAFL,WPKPAGQLL,LHYPGGPHP,L AFLWPKPA,MMLALWLWGF,MLALWLWGFC,ALWLWGF CPL,FLWPKPAGQL,YAMMLALWLW,HYPGGPHPPL,LWP KPAGQLL,WLWGFCPLHY,WPKPAGQLLL,LHYPGGPHPP, GPHPPLAFLW | CLL |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OR51A7 | c.371T>G | p.L124R | AQEFFIHGFTVMESSVLLIMSLDRF[p.L124R]RAIHNPLRYSSILTSNRVAKMGLILA | IMSLDRFRA,LIMSLDRFR,RFRAIHNPL,MSLDRFRAI,RAIHNPLRY,IMSLDRFRAI,LIMSLDRFRA,MSLDRFRAIH,RFRAIHNPLR,FRAIHNPLRY,LLIMSLDRFR | STAD |
| OR51B2 | c.488C>T | p.S163L | RVIALGVGVFLRGFVSILPVIILRF[p.S163L]LFSYCKSHVITRAFCLHQEIMRLACA | RLFLFSYCK,PVILRLFLF,ILRLFLFSY,LPVILRLFL,FLFSYCKSH,FLFSYCKSHV,ILPVILRLF,VILRLFLFSY,LPVILRLFLF | SKCM |
| OR51B5 | c.197_213del e\|CCACAGACCTGGGGCTG | p.A66fs | GTLLLLIKEDHNLHEPMYFFLAMLA[p.A66fs]GPDHNAHGAGSPLAGSQGDWKCGLLFPGLLYTLTFLSRVWHSACHGL* | MLAGPDHNA,LLFPGLLYT,GLLYTLTFL,LLYTLTFLS,YTLTFLSRV,FLSRVWHSA,GLLFPGLLY,LFPGLLYTL,VWHSACHGL,LYTLTFLSR,NAHGAGSPL,SQGDWKCGL,GDWKCGLLF,FPGLLYTLT,AMLAGPDHNA,GLLFPGLLYT,LLFPGLLYTL,FLSRVWHSAC,RVWHSACHGL,LLYTLTFLSR,LYTLTFLSRV,YTLTFLSRVW,LSRVWHSACH,CGLLFPGLLY,HNAHGAGSPL,FPGLLYTLTF,MLAGPDHNAH,SQGDWKCGLL,WKCGLLFPGL,SPLAGSQGDW | KIRC |
| OR51F2 | c.200G>C | p.R67P | SIPFCLLYVAVSGNSMILFVVLCE[p.R67P]PSLHKPMYYFLSMLSATDLSLSLCTL | VLCEPSLHK,PSLHKPMYY,CEPSLFHPM,VVLCEPSLHK,LCEPSLHKPM,EPSLHKPMYY | LUSC |
| OR51S1 | c.476G>A | p.R159Q | ICRPLHYPALLTNGVISKISLAISF[p.R159Q]QCLGLHLPLPFLLAYMPYCLPQVLTH | SLAISFQCL,SFQCLGLHL,ISFQCLGLH,FQCLGLHLPL,ISLAISFQCL,LAISFQCLGL,ISFQCLGLHL | LUSC |
| OR51V1 | c.892C>A | p.P298T | FGKHLSPVAHVLIGNIYILFPPLMN[p.P298T]TIIYSVKTQQIHTRMRLFSLKRY | ILFPPLMNT,LMNTIIYSV,LFPPLMNTI,MNTIIYSVK,NTIIYSVKT,PPLMNTIIY,FPPLMNTII,ILFPPLMNTI,PLMNTIIYSV,LMNTIIYSVK,LFPPLMNTII,FPPLMNTIIY | LUAD |
| OR52M1 | c.397C>T | p.R133C | FVHALTAMESGVLLAMACDRAAAIG[p.R133C]CPLHYPVLVTKACVGYAALALALKAV | RAAAIGCPL,AAIGCPLHY,CPLHYPVLV,AIGCPLHYPV,RAAAIGCPLH,AAAIGCPLHY,IGCPLHYPVL | CRC |
| OR5AK2 | c.267G>T | p.K89N | QHLAFVDICYTSAITPKMLQSFTEE[p.K89N]NNLMLFQGCVIQFLVYATFATSDCYL | FTEENLML,TEENNLMLF,FTEENNLMLF,LQSFTEENNL,QSFTEENNLM | UCEC |
| OR5AS1 | c.117G>T | p.M39I | FVGFTDYLPLRVTLFLVFLVYTLT[p.M39I]IVGNILLIILVNINSSLQIPMYFLS | FLLVYTLTI,LLVYTLTIV,VFLLVYTLTI,YTLTIVGNI,LLVYTLTIV,TIVGNILLI,LTIVGNILL,LLVYTLTIV,VFLLVYTLTI,YTLTIVGNI,YTLTIVGNIL,LTIVGNILLI | LUAD |
| OR5AU1 | c.935G>A | p.R312H | KAFSTCASHLTAICLFFGTTLFMYL[p.R312H]HPRSSYSLTQDRTVAVIYTVVIPVLN | FMYLHPRSS,YLHPRSSYS,TLFMYLHPR,GTTLFMYLH,MYLHPRSSY,HPRSSYSLT,LHPRSSYSL,YLHPRSSYSL,FMYLHPRSSY,TTLFMYLHPR | CRC |
| OR5B12 | c.865A>T | p.S289C | HFMGTDKMASVFYAIVIPMLNPLVY[p.S289C]CLRNKEVKSAFKKTVGKAKASIGFIF | MLNPLVYCL,LVYCLRNKEV,MLNPLVYCLR,CLRNKEVKSA | LUAD |
| OR5B17 | c.488G>A | p.R163H | VCACLAIGCVVIGFLNASIQIGDTF[p.R163H]HLSFCMSNVIHHFFCDKPAVITLTCS | IQIGDTFHL,HLSFCMSNV,DTFHLSFCM,IGDTFHLSF,HLSFCMSNVI,DTFHLSFCMS,QIGDTPHLSF | CRC |
| OR5B17 | c.798G>T | p.M266I | SHLIAIFLFYITVIMIRPSSSHS[p.M266I]IDTDKIASVFYTMIIPMLSPIVYTLR | SSHSIDTDK,SIDTDKIASV,YIRPSSSHSI,SSSHSIDTDK,RPSSSHSIDT,IDTDKIASVF | LUAD |
| OR5D13 | c.706C>T | p.R236C | SSLIIILTSYMLIFFTIMKMRSASG[p.R236C]CQKTFSTCASHLTAITIFHGTILFLY | KMRSASGCQ,SASGCQKTF,CQKTFSTCA,KMRSASGCQK,RSASGCQKTF,CQKTFSTCAS | GBM |
| OR5D14 | c.736C>A | p.H246N | VFIFVTVLKIRSVSGRHKAFSTWAS[p.H246N]NLTSITIFHGTILFLYCVPNSKNSRQ | TWASNLTSI,KAFSTWASN,ASNLTSITI,SNLTSITIF,STWASNLTSI,KAFSTWASNL,WASNLTSITI,ASNLTSITIF | LUAD |
| OR5D16 | c.790C>A | p.P264T | VFSTCASHLTAITIFHGTILFLYCV[p.P264T]TNSKNSRHTVKVASVFYTVVIPLLNP | FLYCVTNSK,CVTNSKNSR,LFLYCVTNSK | LUAD |
| OR5D18 | c.812C>A | p.T271K | LTAITIFHGTILFLYCVPNSKNSRH[p.T271K]KVKVASVFYTVVIPMLNPLIYSLRNK | KVKVASVFY,RHKVKVASV,HKVKVASVF,NSKNSRHVK,KVKVASVFYT,RHKVKVASVF,HKVKVASVFY | LUSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OR5F1 | c.131G>T | p.G44V | DTLELQIILFLFFLVIYTLTVLGNL[p.G44V]VMILLIRIDSQLHTPMYFFLANLSFV | VLGNLVMIL,TLTVLGNLIV,TVLGNLVMI,LTVLGNLVM,YTLT VLGNLV,VLGNLVMILL,NLVMILLIRI,TLTVLGNLVM | LUAD |
| OR5J2 | c.106G>T | p.A36S | EFILLGLTDHAELKAVLFVVFLVIY[p.A36]S|STLLRNLGMILLIQITSKLHTPMYF | VVFLVIYSI,FLVIYSITL,LVIYSITLL,VIYSITLLR,YSITLLRNL, FV VFLIVIYSI,FLVIYSITLL,LVIYSITLL,VFLIVIYSITL,IYSITILL-RNL | LUAD |
| OR5L1 | c.824C>A | p.T275N | VFHGTVLSIYCRPSSGNSGDADKVA[p.T275N]NVFYTVVIPMLNSVIYSLRNKDVKEA | KVANVFYTV,ANVFYTVVI,DADKVANVF,DADKVANVFY,K VANVFYTVV,NVFYTVVIPM,GDADKVANVF,VANVFYTVVI | LUAD |
| OR5M3 | c.265de|A | p.T89fs | LSFVDVNFSSNVTPKMLENLLSDKK[p.T89fs]QLLMLVV* | LSDKKQLLM,LLSDKKQLL,KKQLLMLW,LSDKKQLLML,LLS DKKQLLM | STAD |
| OR5P2 | c.299C>T | p.A100V | PNMLVNFLVERNTVSYLGCAIQLGS[p.A100V]VAFFATVECVLLAAMAYDRFVAICSP | QLGSVAFFA,GSVAFFATV,IQLGSVAFF,AIQLGSVAF,CAIQL GSVA,IQLGSVAFFA,VAFFATVECV,CAIQLGSVAF,AIQLGS VAFF | GBM |
| OR6C65 | c.460_461insT | p.I154fs | TTIMSNKVCNWLVISSWLAGFLIIF[p.I154fs]SPRDYGPPTGFL* | DYGPPTGFL,GFLIIFSPR,LIIFSPRDY,SPRDYGPPT,RDYGPP TGF,WLAGFLIIFS,AGFLIIFSPR,FLIIFSPRDY,RDYGPPTGFL | LUAD |
| OR6C75 | c.280G>T | p.G94W | ISFTSVCIPRFLVTVVTGNRTISYN[p.G94W]WCVAQLFFFIFLGVTEFYLLAAMSYD | RTISYNWCV,SYNWCVAQL,YNWCVAQLF,NWCVAQLFF,S YNWCVAQLF,NWCVAQLFFF,RTISYNWCVA,ISYNWCVAQL | LUAD |
| OR6K2 | c.236C>A | p.P79Q | HLHTPMYTFISALSPLEIWYTTATI[p.P79Q]QKMLSSLLSERSISFNGCLLQMYFFH | TIQKMLSSL,IQKMLSSLL,YTTATIQKM,TTATIQKML,ATIQK MLSSL,TIQKMLSSLL,IWYTTATIQK,WYTTATIQKM,YTTATI QKML,IQKMLSSLLS | LUAD |
| OR6K6 | c.931T>C | p.F311L | YLRFSATYSVFWDTAIAVTFVILAP[p.F311L]LFNPIIYSLKNDMKEAIGRLFHYQK | VTFVILAPL,ILAPLFNPI,TFVILAPLF,APLFNPIIY,VILAPLFNPI, ILAPLFNPII,AVTFVILAPL,LFNPIIYSLK,VTFVILAPLF,LAPLF NPIIY | TGCT,THCA |
| OR6N2 | c.877C>T | p.R293C | LTLDRTLAIVVSVLTPMVNPIIYSL[p.R293C]CNKEIIKAIKRTIFQKGDKASLAHL | SLCNKEIIK,PIIYSLCNK,IYSLCNKEI,YSLCNKEII,IYSLCNKEI, YSLCNKEIIK,IYSLCNKEII,CNKEIIKQIK,MVNPIIYSLC | GBM |
| OR6V1 | c.744de|C | p.I248fs | VLRIPSASSCQKAFSTCGSHLTLVF[p.I248fs]MATVVPSFCMSGLAKLTLCKSGRSWPW* | LTLVFMATV,TLVFMATVV,FMATVVPSF,FCMSGLAKL,GL AKLTLCK,SFCMSGLAK,GSHLTLVFM,VPSFCMSGL,MSGLA KLTL,TLCKSGRSW,CKSGRSWPW,HLTLVFMATV,LTLVFM ATW,FMATVVPSFC,VVPSFCMSGL,CMSGLAKLTL,PSFC MSGLAK,SGLAKLTLCK,VFMATVVPSF,MATVVPSFCM,LTL CKSGRSW | HNSC |
| OR7C1 | c.311de|T | p.F104fs | PKMLNLILTQNKFITYAGCLSQIFF[p.F104fs]SLHLDAWTIYS* | CLSQIFFSL,SQIFFSLHL,SLHLDAWTI,FFSLHLDAW,LHLDA WTIY,FSLHLDAWTI,IFFSLHLDAW,SLHLDAWTIY,LSQIFFS LHL | KIRC |
| OR7C1 | c.535de|T | p.C179fs | MGSLLETLTVLRLSFCTEMEIPHFF[p.C179fs]VIYLKS* | MEIPHFFVI,EMEIPHFFV,IPHFFVYL,MEIPHFFVIY,IPHFFV IYLK,TEMEIPHFFV,EMEIPHFFVI,EIPHFFVYL | STAD |
| OR7E24 | c.21_22insT | p.L7fs | MSYFPILFFFF[p.L7fs]PQKVSELHRATESHRCLRIPPPGTLRGSRTAAGPRWAVPVHVPGHGAGEPAHHPGCQL* | ILFFFFPQK,LFFFFPQKA,ATESHRCLR,GSRTAAGPR,RTAAG PRWA,TAAGPRWAV,TLRGSRTAA,RATESHRCL,LRIPPPGT L,FPQKVSELH,ILFFFFPQKV,RTAAGPRWAV,PLLFFFFPQK, FFFFPQKVSEL,RATESHRCLR,CLRIPPPGTL,GTLRGSRTAA,R GSRTAAGPR,ELHRATESHR,GPRWAVPVHV,EPAHHPGCQ L,SELHRATESH,HRATESHRCL,GSRTAAGPRW,FPILFFFFP Q | PRAD |
| OR8D2 | c.917G>T | p.R306M | IIPMLNPLIYSLRNKDVKNALKKMT[p.R306M]MGRQSS | ALKKMTMGR,KNALKKMTM,KKMTMGRQS,KMTMGRQSS,NALKKMTMGR,VKNALKKMTM,KKMTMGRQSS | LUAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OR8H2 | c.498G>T | p.L166F | CLALITGPYVIGFIDSFVNVSMSR[p.L166F]FHFYDSNVIHHFFCDTSPILALSCTD | VSMSRFHPY,VVSMSRFHF,MSRFHFYDS,RFHFYDSNV,VN VVSMSRF,FHFYDSNVI,VVSMSRFHFY,RFHFYDSNVI,MSR FHFYDSN,FVNVSMSRF,NVVSMSRFHF,SRFHFYDSNV,F HFYDSNVIH | LUSC |
| OR8J3 | c.479C>T | p.S160L | VVSRRLCLLLVSLTYLYGFSTAIVV[p.S160L]LPCIFSVSYCSSNIINHFYCDIAPLL | VVLPCIFSV,TAIVVLPCI,LPCIFSVSY,AIVVLPCIF,IVVLPCIFS V,VLPCIFSVSY,STAIVVLPCI,YGFSTAIVVL,TAIVVLPCIF | LUSC |
| OR8K3 | c.705G>T | p.K235N | SLLIVLLSYLLILVAILRMNSAGRQ[p.K235N]NAFSTCGAHLTVIVFYGTLLFMYV Q | NSAGRQNAF,NAFSTCGAH,RQNAFSTCG,RMNSAGRQNA, RQNAFSTCGA,MNSAGRQNAF,NAFSTCGAHL | LUSC |
| OR8S1 | c.296C>T | p.A99V | SSVIVPKMLENLLSQRKTISVEGCL[p.A9 9V]VQVFFVFVTAGTEACLLSGMAYDR HA | LVQVFFVFV,TISVEGCLV,CLVQVFFVF,VEGCLVQVF,VQVF FVFVT,CLVQVFFVFV,VQVFFVFVTA,KTISVEGCLV,GCLVQ VFFVF,EGCLVQFFV,SVEGCLVQVF,VEGCLVQVFF | CRC |
| OR9A2 | c.865C>T | p.R289W | VEYNKIVSLLVSVLTPFLNPFIFTL[p.R28 9W]WNDKVKEALRDGMKRCCQLLKD* | FIFTLWNDK,FLTWNDKVK,LNPFIFTLW,FIFTLWNDKV,TL WNDKVKEA,FLNPFIFTLW | LUAD |
| OR9G9 | c.506G>T | p.R169L | VAVSYCGGFINSSIITKKTFSFNFC[p.R16 9L]LENIIDDFFCDLLPLVELACGEKGGY | KTFSFNFCL,SFNFCLENI,FNFCLENII,LENIIDDFF,FSFNFCLE NI,SFNFCLENII,KTFSFNFCLE,KKTFSFNFCL | LUAD |
| OSBP | c.2163G>C | p.Q721H | FSELALTLNAWESGTAPTDSRLRPD[p. Q721H]HRLMENGRMDEANAEKQRLE EKQRLS | RLRPDHRLM,DSRLRPDHR,RLRPDHRLME,SRLRPDHRLM | CESC |
| OSBP2 | c.1881_1882insC | p.H627fs | ETFELDRLDDMGLRSLCEQVSHHPP[p. H627fs]LSCALRVLQAWLEPLAGDHHL QQVPGKIHLHHAARCHPLR IPGQWESL RVEEEHLNCSQHHRGQALDRPVRGHR DCEP* | VLQAWLEPL,ALRVLQAWL,KIHLHHAAR,HAARCHPLR,AA RCHPLRI,HLNCSQHHR,SQHHRGQAL,HHAARCHPL,EQVS HHPPL,CALRVLQAW,LQAWLEPLA,LQQVPGKIH,QQVPG KIHL,GKIHLHHAA,GQWESLRVE,EPLAGDHHL,HPLRIPGQ W,RVLQAWLEPL,VLQAWLEPLA,KIHLHHAARC,HHAARC HPLR,CEQVSHHPPL,SHHPPLSCAL,LQAWLEPLAG,LQQVP GKIHL,QQVPGKIHLH,LHHAARCHPL,LRIPGQWESL,WESL RVEEEH,LEPLAGDHHL,HPPLSCALRV,IPGQWESLRV | STAD |
| OSBPL6 | c.1730G>A | p.R577Q | SEDNTSVADNISRQILNGELTGGAF[p.R 577Q]QNGRRACLPAPCPDTSNINLWN ILRN | FQNGRRACL,LTGGAFQNGR | UCEC |
| OSTN | c.344G>A | p.R115Q | PLDRLSAGSVDHKGKQRKVVDHPKR[p. R115Q]QFGIPMDRIGRNRLSNSRG | RQFGIPMDR,PKRQFGIPM,RQFGIPMDRI,HPKRQFGIPM, KVVDHPKRQF | CRC |
| OTOF | c.1163C>T | p.T388M | DDISSGLKGYVKCDVAWGKGDNIK[p. T388M]MPHKANETDEDDIEGNLLLPE GVPPE | KGDNIKMPHK | BRCA |
| OTOF | c.3910G>A | p.E1304K | KLETMVKLDATSEAVVKDVAEEEK[p. E1304K]KKKKKKKGTAEEPEEEEPDES MLDWW | KVDAEEEKK | STAD |
| OTOL1 | c.1291G>A | p.V431I | VAQNKFQFKSRETLYGQEIDQASLL[p.V 431I]IILKLSAGDQVWLEVSKDWNGVY VSA | QASLLIIIK,DQASLLIII,QEIDQASLLI,DQASLLIIL | CRC |
| OTOP1 | c.310_318delCTGCTGTGG | p.LLW104del | AWAVHAAGVSKSDLLCFLTALMLLQ[p. LLW104de|]MLWVGRSSAHRRLFRLK DTHAGAGWLRGSITLF | MLLQMLWVY,LQMLWYVGR,LMLLQMLWY,LTALMLLQ M,ALMLLQMLW,FLTALMLLQM,LMLLQMLWYV,ALMLL QMLWY,LLQMLWYVGR,TALMLLQMLW | ACC |
| OTUD3 | c.830G>T | p.R277I | VQNLEAENYNIESAIIAVLRMNQGK[p. R277I]INNAEENLEPSGRVLKQCGPLW EEGG | RMNQGKINNA,GKINNAEENL | CRC |
| OTUD4 | c.2726C>T | p.T909I | ALASIPPVAEGKAHPPTQILNRERE[p.T9 09I]IVPVELEPKRTIQSLKEKTEKVKDPK | ILNREREIV,RREREIVPVE,LNREREIVPV,TQILNREREI,REREI VPVEL,REIVPVELEP | BLCA,PRAD, THCA |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| OTUD4 | c.458_460del\|CTG | p.A153 del\| | VADEDNSEISDSEDDSCKSKTAAAA[p.A153del\|]DVNGFKPLSGNEQLKNNGNSTSLPLSRK | KSKTAAAAD, KSKTAAAADV, TAAAADVNGF | PRAD |
| OTX2 | c.130de\|C | p.R44fs | TSGMDLLHPSVGYPGPWASCPAATP[p.R44fs\|GNSAGRGRRSLGRS* | RGRRSLGRS, SAGRGRRSL, AGRGRRSLGR, CPAATPGNSA, N SAGRGRRSL | STAD |
| OXR1 | c.364G>A | p.E122K | GTIEYTVESRDSLNSIALKFDTTPN[p.E122K]KLVQLNKLFSRAVVTGQVLIVPDPEY | KLVQLNKLF, ALKFDTTPNK, DTTPNKLVQL, LKFDTTPNKL, N KLVQLNKLF | UCEC |
| P2RX1 | c.58de\|C | p.R20fs | MARRFQEELAAFLFEYDTP[p.R20fs\|AWCWCVIRRWALSSD* | FLFEYDTPA, DTPAWCWCVI, TPAWCWCVI, WCVIRRWAL, F LFEYDTPAW, AWCWCVIRRW, CWCVIRRWAL, TPAWCWC VIR, DTPAWCWCVI, FEYDTPAWCW | STAD |
| P2RX7 | c.425C>A | p.P142Q | RLCPEYPTRRTLCSSDRGCKKGWMD[p.P142Q]QQSKGIQTGRCVVYEGNQKTCEVSAW | WMDQQSKGI, KGWMDQQSK | LUAD |
| PABPC1 | c.1223A>T | p.Y408F | MQRMASVRAVNPVINPYQPAPPSGF[p.Y408F]FFMAAIPQTONRAAYYPPSQIAQLRP | YQPAPPSGF, QPAPPSGFY, PYQPAPPSGF, YQPAPPSGFF, Q PAPPSGFFM, APPSGFFMAA, PPSGFFMAAI | KIRC |
| PABPC1 | c.280C>T | p.R94C | LDTMNFDVIKGKPVRIMWSQRDPSL[p.R94C]CKSGVGNIFIKNLDKSIDNKALYDTF | SQRDPSLCKXK, CSGVGNIF, SLCKSGVGN, WSQRDPSLCK, LC KSGVGNIF | DLBCL |
| PABPC1 | c.467_468i nsG | p.E156fs | DENGSKGYGFVHFETQEAAERAIEK[p.E156fs]NEWNAPK* | AERAIEKNEW | KIRC |
| PABPC1 | c.541G>A | p.A181T | EKMNGMLLNDRKVFVGRFKSRKERE[p.A181T]TELGARAKEFTNVYIKNFGEDMDDER | SRKERETEL, KERETELGA, RETELGARA, KSRKERETEL, TELG ARAKEF | KIRC |
| PABPC1 | c.761_762i nsT | p.K254fs | KSKGFGFVSFERHEDAQKAVDEMNG[p.K254fs]NGAQWKTNLCWSSSEKGGTADGT* | NLCWSSSEK, KTNLCWSSS, AQWKTNLCW, DEMNGNGAQ, TNLCWSSSEK, AQWKTNLCWS, DEMNGNGAQW | CLL |
| PABPC1 | c.999de\|A | p.K333fs | LRKEFSPFGTITSAKVMMEGGRSKG[p.K333fs\|]VLYLYVSPPQKKPLKQLQK* | VLYVSPPQK, RSKGLVLYV, GRSKGLVLY, MMEGGRSKGL, LV LYVSPPQK, VLYVSPPQKK, RSKGLVLYVS, VSPPQKKPLK, GG RSKGLVLY | KIRC |
| PABPC3 | c.975_979d e\|TATGA | p.V325 fs | LDDGIDDERLRKAFSPFGTITSAKV[p.V325fs\|GRWSQQRVWFCMFLLPRRSH* | RVWFCMFLL, KVGRWSQQR, RWSQQRVWF, QQRVWFC MF, TITSAKVGR, WFCMFLLPR, GRWSQQRVW, SQQRVWF CM, GTITSAKVGR, VWFCMFLLPR, SQQRVWFCMF, KVGR WSQQRV, QQRVWFCMFL, WFCMFLLPRR, VGRWSQQRV W, GRWSQQRVWF, WSQQRVWFCM, CMFLLPRRSH | TGCT |
| PABPC3 | c.997de\|A | p.K333fs | LRKAFSPFGTITSAKVMMEGGRSKG[p.K333fs\|]LVLYVSPPQKKPLKQLQK* | VLYVSPPQK, RSKGLVLYV, GRSKGLVLY, MMEGGRSKGL, LV LYVSPPQK, VLYVSPPQKK, RSKGLVLYVS, VSPPQKKPLK, GG RSKGLVLY | BLCA |
| PACSIN1 | c.1075G>A | p.E359K | AVESTSQAGDRGSVSSYSDRGQPYAT[p.E359K]KWSDDESGNPFGGSETNGGANPFEDD | RGQPYATKW | HNSC |
| PACSIN2 | c.993G>C | p.Q331H | ADLNRTLSRREKKKATDGVTLTGIN[p.Q331H]HTGDQSLPSKPSSTLNVPSNPAQSAQ | INHTGDQSL, HTGDQSLPSK | BRCA |
| PADI2 | c.340A>C | p.T114P | SSDKVTVNYDEEGSIPIDQAGLFL[p.T114P]PAIEISLDVDADRDGVVEKNNPKKAS | GLFLPAIEI, FLPAIEISL, DQAGLFLPA, LFLPAIEISL, DQAGLFL PAI, LPAIEISLDV, IDQAGLFLPA | MM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PAFAH1B1 | c.904del|A | p.K302fs | VECISWAPESSYSSISEATGSETKK|p.K302fs]VVNLGHSCCLDPETRLLRCGMSVLACAL* | RLLRCGMSV, GMSVLACAL, LLRCGMSVL, SETKKVVNL, RLL RCGMSVL, LLRCGMSVLA, CGMSVLACAL | STAD |
| PALB2 | c.839del|A | p.N280fs | DSGSSQHLEHIPPKGSSELTTHDLK|p.N280fs]TLDLLHL* | LKTLDLLHL, SELTTHDLKT | STAD |
| PALLD | c.2986G>A | p.A996T | DSAHKMLVRENGVHSLLIEPVTSRD|p.A996T]TGIYTCIATNRAGQNSFSLELVVAAK | VTSRDTGIY, RDTGIYTCI, PVTSRDTGIY | KIRC |
| PALM2-AKAP2 | c.3213_3214insGAAGCT | p.1075_1076insEA | KAVSKTSRDGAEQQGPEATVEEAEA|p.1075_1076insEA]EAAAFGSEKPQSMFEPPQVSSPVQEKRDVLP | EAEAEAAAF, VEEAEAEAA, AEAEAAAFG, EEAEAEAAAF, AE AEAAAFGS, VEEAEAEAAA | KIRC |
| PALM2-AKAP2 | c.3354_3355insC | p.G1118fs | VQEKRDVLPKILPAEDRALRERGPP|p.G1118fs]PATASCAAQWPD* | RERGPPPAT, ALRERGPPPA, RERGPPPATA | KIRC |
| PALM2-AKAP2 | c.895G>A | p.A299T | KLEMVHKSRKDHSSGNPGQQQAQAPS|p.A299T]TAGPEANLDQPVTMIFMGYQNIEDEE | STAGPEANL, APSTAGPEA, GQQAQAPST, QQAQAPSTA, G QQAQAPSTA, QQAQAPSTAG | BRCA |
| PAMR1 | c.302del|G | p.G101fs | CDSCLIHPGCTIFENCKSCRNGSWG|p.G101fs]VPWMTSM* | WGVPWMTSM, RNGSWGVPW, KSCRNGSWGV, CRNGSW GVPW, RNGSWGVPWM, SWGVPWMTSM | STAD |
| PANK1 | c.1199del|A | p.K400fs | DSVGFNGKPECYFENPTNPELCQK|p.K400fs]SRTALITHTLCCWLTWAQVSAF* | TLCCWLTWA, WLTWAQVSA, RTALITHTL, HTLCCWLTW, C QKSRTALI, KSRTALITH, LTWAQVSAF, LCQKSRTAL, LITHTLC CWL, KSRTALITHT, HTLCCWLTWA, ELCQKSRTAL, WLTWA QVSAF, SRTALITHTL, ALITHTLCCW | STAD |
| PANK2 | c.1251del|T | p.T417fs | VSILAVYSKDNYKRVTGTSLGGGTF|p.T417fs]LVSAVFLLAVPLLKKLLKWHLVEIAPKWIN* | SLGGGTFLV, FLVSAVFLL, AVFLLAVPL, LLKWHLVEI, LVSAVF LLA, FLLAVPLLK, LLAVPLLKK, TFLVSAVFL, VFLLAVPLL, GTFL VSAVF, VSAVFLLAV, LKWHLVEIA, HLVEIAPKW, FLVSAVFLL, A, LVSAVFLLAV, AVFLLAVPLL, LLAVPLLKKL, KLLKWHLVEI, L LKKLLKWHL, LLKWHLVEIA, HLVEIAPKWI, FLLAVPLLKK, VF LLAVPLLK, AVPLLKKLLK, TFLVSAVFLL, GTFLVSAVFL, KWHL VEIAPK, TSLGGGTFLV, SAVFLLAVPL, GGTFLVSAVF, VPLLK KLLKW | PRAD |
| PANK2 | c.377G>C | p.G126A | AAEEARRNPTLGGLLGRQRLLLRMG|p.G126A]AGRLGAPMERHGRASATSVSSAGEQA | LLRMGAGRL, RMGAGRLGA, LLLRMGAGR, GAGRLGAPM, RQRLLLRMGA, RLLLRMGAGR, AGRLGAPMER, MGAGRLG APM, LRMGAGRLGA | ACC |
| PANK3 | c.779G>T | p.R260I | LEMASKGDSTQADKLVRDIYGGDYE|p.R260I]IFGLPGWAVASSPGNMIYKEKRESVS | IYGGDYEIF, IFGLPGWAV, DIYGGDYEI, EIFGLPGWA, YEIFG LPGW, EIFGLPGWAV, DIYGGDYEIF, RDIYGGDYEI, YEIFGLP GWA | CRC |
| PANK3 | c.319C>T | p.H107Y | QLAAEYGLLGEKELSQENQLVETGG|p.H107Y]YVGLPSVSYASSGASVSLQIVAEMAT | QLVETGGYV, NQLVETGGY, YVGLPSVSY, VETGGVVGL, YVG LPSVSYA, GYVGLPSVSY | CESC |
| PAPD4 | c.675_676insT | p.C225fs | SLNGFGTRSSDGDLCLWKEEPCFF|p.C225fs]SGKSED* | KEEPCFFSG | STAD |
| PAPPA2 | c.2749C>A | p.P917T | QYVHTASSRRVCDSSGYWTPEEAVG|p.P917T]TPDVDQPCEPSLQAWSPEVHLYHMNM | EEAVGTPDV | LUAD |
| PAPPA2 | c.5049del|C | p.I1683fs | NSVEYKCEQGYGIGAVCSPLCVIPP|p.I1683fs]VTP* | SPLCVIPPV, CSPLCVIPPV | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PAPPA2 | c.5117C>A | p.P1706H | CVIPPSDPVMLPENITADTLEHWME[p. P1706H]HVKVQSIVCTGRRQWHPDV LVHCIQ | TLEHWMEHV,MEHVKVQSI,WMEHVKVQSI,TLEHWMEH VK,DTLEHWMEHV,MEHVKVQSIV,LEHWMEHKV | LUAD |
| PARD6A | c.252_253insC | p.G84fs | TDAHGDLLPLTNDDSLHRALASGPP[p. G84fs]ATAPTGAFAGRS* | ALASGPPAT,RALASGPPA,ALASGPPATA,RALASGPPAT,H RALASGPPA | KIRC |
| PARG | c.1750G>A | p.A584T | KYNVAYSKKWDFTALIDFWDKVLEE[p. A584T]TEAQHLYQSILPDMVKIALCLPN ICT | EETEAQHLY,LEETEAQHL,TEAQHLYQS,LEETEAQHLY,TEA QHLYQSI | KIRP,PRAD |
| PARP1 | c.1381delA | p.K461fs | PSLKTVKVVIFQPELLNIFYDSMKK[p.K 461fs]ETSLHH* | SMKKETSLH,DSMKKETSL,MKKETSLHH,SMKKETSLHH | STAD |
| PARP4 | c.2541delA | p.K847fs | SSLDSGFSLHIGLSAAYLPRMWVE[p.K 847fs]NIQKKKARLACLSFNPISMSTSLT* | RMWVENIQK,IQKKKARLA,KARLACLSF,LPRMWVENI,NPI SMSTSL,NIQKKKARL,KKKARLACL,LACLSFNPI,CLSFNPIS M,YLPRMWVENI,RLACLSFNPI,RMWVENIQKK,KARLACL SFN,KKARLACLSF,ACLSFNPISM | STAD |
| PASD1 | c.685_687del\|GCT | p.A236 del\| | SSQGQRGHTSMKAVVVEPAAAAAAA[p. A236de\|]ISDDQIDIAEVEQYGPQEN VHMFVDSDS | EPAAAAAAI | GBM |
| PASK | c.185C>T | p.T62I | PSRSFSSAHRHLSRRNGLSRLCQSR[p.T 62I]IALSEDRWSSYCLSSLAAQNICTSKL YSHPQYTAYNEAWRFSNPALLMPPV[p. P395fs]VRPCRCCRCL* | RLCQSRIAL,LSRLCQSRI,GLSRLCQSRI,LSRLCQSRIA,SRLCQ SRIAL | KIRC |
| PAX2 | c.1183delC | p.P395fs | | PVRPCRCCR,MPPPVRPCR,RPCRCCRCL,LLMPPPVRPC,L MPPPVRPCR,NPALLMPPPV | STAD |
| PAX3 | c.1271C>T | p.T424M | HGGVPHQPQTDYALSPLTGGLEPTT[p. T424M]MVSASCSQRLDHMKSLDSLPT SQSYC | MVSASCSQR,LEPTTMVSA,MVSASCSQRL,TMVSASCSQR | CRC |
| PAX3 | c.590C>T | p.S197L | LERKEAEESEKKAKHSIDGILSERA[p.S1 97L]LLAPQSDEGSDIDSEPDLPLRKQRR S | SERRALAPQS | BLCA |
| PAX6 | c.1124delC | p.P375fs | QTSSYSCMLPTSPSVNGRSYDTYTP[p.P 375fs]HICRHT* | RSYDTYTPH,SYDTYTPHI,DTYTPHICR,RSYDTYTPHI | STAD |
| PBLD | c.164C>A | p.P55Q | LDEDMHQKIAREMNLSETAFIRKLH[p. P55Q]QTDNFAQSSCFGLRWFTPASEV PLCG | KLHQTDNFA,RKLHQTDNF,IRKLHQTDNF,HQTDNFAQSS | LUAD |
| PBX2 | c.208G>A | p.E70K | PGGRKQDIGDILQQIMTITDQSLD[p. E70K]KAQAKKHALNCHRMKPALFSVL CEIK | TITDQSLDK,QSLDKAQAK,SLDKAQAKK,KAQAKKHAL,MTI TDQSLDK,QSLDKAQAKK | BLCA |
| PBX2 | c.785A>T | p.Y262F | LRSRFLDARRKRRNFSKQATEVLNE[p.Y 262F]FFYSHLSNPYPSEEAKEELAKKCGI T | QATEVLNEF,TEVLNEFFY,NEFFYSHLS,ATEVLNEFFY,VLNE FFYSHL,KQATEVLNEF,FFYSHLSNPY,NEFFYSHLSN | KIRP,LUSC,TGCT |
| PBXIP1 | c.2186_2188delACC | p.H729del | KKDKHSQSPRAAGPREGHSHSHHHH[p. H729de\|]RG* | HSHSHHHHR | BLCA |
| PCBP1 | c.305T>A | p.L102Q | DKLEEDINSSMTNSTAASRPPVTLR[p.L 102Q]QVVPATQCGSLIGKGGCKIKEIRE ST | RPPVTLRQV,RQVVPATQC,RPPVTLRQVV,RQVVPATQCG | CRC |
| PCCA | c.689G>A | p.R230H | AVRIAREIGYPVMIKASAGGGKGM[p. R230H]HIAWDDEETRDGFRLSSQEAAS SFGD | HIAWDDEETR | STAD |
| PCDH10 | c.1429G>A | p.V477M | QVSDVNDNAPRFSQPVYDVYVTENN[p. V477M]MPGAYIYAVSATDRDEGANA QLAYSI | NMPGAYIYA,TENNMPGAY,NNMPGAYIY,MPGAYIYAV,V TENNMPGAY,YVTENNMPGA,NMPGAYIYAV,YDVYVTEN NM,MPGAYIYAVS,TENNMPGAYI | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PCDH 10 | c.1759C>A | p.R587 S | ILIVDQNDNAPAIVAPLPGRNGTPA[p.R 587S]SEVLPRSAEPGYLLTRVAAVDAD DGE | GTPASEVLPR, RNGTPASEVL | LUAD |
| PCDH 10 | c.2956G>T | p.V986 L | SDGRQAADYRSNLHVPGMDSVPDTE[p. V986L]LFETPEAQPGAERSFSTGKEK ALHS | TELFETPEA, GMDSVPDTEL, MDSVPDTELF | LUAD |
| PCDH 10 | c.354_355i nsC | p.N118 fs | EVFLENPLELFQVEIEVLDINDNPP[p.N1 18fs]LFPGARPDGGNL* | VLDINDNPPL, LDINDNPPLF | STAD |
| PCDH 10 | c.673_674i nsC | p.P225f s | TAVDGGGGGVGEGGGGGGAGLPP [p.P225fs]PAAAHRHGPTHHPSAGLQ* | AAHRHGPTH, GPTHHPSAGL, RHGPTHHPSA | STAD |
| PCDH 11X | c.1457C>T | p.T486 M | DNAPVFTQSFVTVSIPENNSPGIQL[p.T 486M]MKVSAMDADSGPNAKINYLLG PDAPP | IQLMKVSAM, QLMKVSAMDA | GBM |
| PCDH 11X | c.3029G>T | p.R101 0I | SSDPYSVSDCGYPVTTFEVPVSVHT[p.R 1010I]IPPMKEVVRSCTPMKESTTMEI WIHP | SVHTIPPMK, EVPVSVHTI, HTIPPMKEV, VSVHTIPPM, VSVH TIPPMK, TIPPMKEVVR, HTIPPMKEVV, FEVPVSVHTI | LUAD |
| PCDH 15 | c.4655G>T | p.R155 2I | DDLSAHNPLYKENISQVSTNSDISQ[p.R 1552I]ITDFVDPFSPKIQAKSKSLRGPRE KI | DISQITDFV, QITDFVDPF, SDISQITDF, SQITDFVDPF | CRC |
| PCDH 15 | c.5138G>T | p.C171 3F | VELKSEPNVISSPAECSLELSPSRP[p.C17 13F]FVLHSSLSRRETPICMLPIETERNIF | ELSPSRPFV, FVLHSSLSR, RPFVLHSSL, LELSPSRPF, FVLHSSL SRR, SLELSPSRPF, LELSPSRPFV | KIRC |
| PCDH 19 | c.1588G>A | p.E530 K | YVSINPNSGDIYALRSFNHEQTKAF[p.E 530K]KFKVLAKDGGLPSLQSNATVRVII LD | QTKAFKFKV, KAFKFKVLA, APKFKVLAK, TKAFKFKVL, HEQT KAFKF, KAFKFKVLAK, QTKAFKFKVL | UCEC |
| PCDH 19 | c.856C>T | p.R286 C | NASDPDEGTNGQVVYSFYGYVNDRT[p. R286C]CELFQIDPHSGLVTVTGALDYE EGHV | YVNDRTCEL, YVNDRTCELF | BRCA |
| PCDH AC2 | c.1555G>A | p.A519 T | LVERRVGERALSNYVSVHAESGKVY[p. A519T]TLQPLDHEELELLQFQVSARDA GVPP | AESGKVYTL, GKVYTLQPL, TLQPLDHEEL, KVYTLQPLDH, SG KVYTLQPL, HAESGKVYTL | CRC |
| PCDH AC2 | c.2207C>T | p.A736 V | ALSTVSFIFLLTIIILSIIKCYRYT[p.A736V] VYGTACCGGFCGVRERSPAELYKQAN | IIKCYRYTV, YTVYGTACC, IKCYRYTVY, YRYTVYGTA, SIIKCYR YTV, VYGTACCGGF, IIKCYRYTVY, CYRYTVYGTA, YRYTVYGT AC | CRC |
| PCDH AC2 | c.2225C>T | p.A742 V | TALRCSAAPTEGACGPVKPTLVCSS[p.A 742V]VVGSWSYSQQRRQRVCSGEGLP KADL | SSVVGSWSY, KPTLVCSSV, CSSVVGSWSY, KPTLVCSSVV, LV CSSVVGSW | LUAD |
| PCDH AC2 | c.414G>T | p.K138 N | PLQVFHVDVEVKDINDNPPVPPATQ[p. K138N]NNLFIAESRPLDSRFPLEGASDA DIG | VFPATQNNL, NNLFIAESR, FPATQNNLF, VPPATQNNLF, FP ATQNNLFI | UCEC |
| PCDH AC2 | c.467C>T | p.A156 V | RFSRQEQRLFILESRMPDSRFPLEG[p.A 156V]VSDLLDIGANAQLRYRLNPNEYFD LDV | DSRFPLEGV, FPLEGVSDL | CRC |
| PCDH AC2 | c.568G>A | p.E190 K | NALLSYKLSSSEFFFLDIQANDELS[p.E19 0K]KSLSLVLGKSLDREETAEVNLLVAT | ELSKSLSLIV, KSLSLVLGK, LSKSLSLVL, DELSKSLSL, DELSKSLS LV | CRC |
| PCDH AC2 | c.796G>A | p.A266 T | AFERTIYKVRLLENAPNGTLVVTVN[p.A 266T]TTDLDEGVNKDIAYSFNTDMSAD ILS | NTTDLDEGV, TTDLDEGVNK | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PCDHAC2 | c.811G>A | p.E271K | SYKVVLSENVQNDTRVIQLNASDPD[p.E271K]KGLNGEISYGIKMLPVSEKCMFSIN | QLNASDPDK, KGLNGEISY | CRC |
| PCDHB1 | c.1704C>G | p.N568K | SSQVTVRVVLDDNDNRPMILYPLQ[p.N568K]KGTLPCNDLVPRSAEAGYLVTKVVAV | ILYPLQKGT, PMILYPLQK, ILYPLQKGTL, RPMILYPLQK, YPLQKGTLPC | LUSC |
| PCDHB12 | c.865C>T | p.R289C | VSAWDLDSGTNSELSYTFSHASEDI[p.R289C]CKTFEINQKSGDITLTAPLDFEAIES | ASEDICKTF, FSHASEDICK, HASEDICKTF, SEDICKTFEI | UCEC |
| PCDHB13 | c.662C>T | p.P221L | VLDKALDREEEAELRLTLTALDGGS[p.P221L]LPRSGTAQVIEVLDVNDNAPEFEQP | LPRSGTAQV, SLPRSGTAQV, TALDGGSLPR, LPRSGTAQVY | GBM |
| PCDHB4 | c.763_764CC>TT | p.P255F | LIMDINDNAPEFVHTPYGVQVLENS[p.P255F]FLDSPIVRVLARDIDAGNPGSVSYGLF | FLDSPIVRV, SFLDSPIVR, NSFLDSPIV, GVQVLENSF, VQVLENSFL, FLDSPIVRVL, NSFLDSPIVR, YGVQVLENSF, LENSFLDSPI | TGCT |
| PCDHB5 | c.151G>T | p.D51Y | AGSEAVRYSIPEETESGYSVANLAK[p.D51Y]YLGLGVGELATRGARMHYKGNKELLQ | YSVANLAKY, YLGLGVGEL, AKYLGLGVG, NLAKYLGLGV, YLGLGVGELA, KYLGLGVGEL, GYSVANLAKY, YSVANLAKYL | CRC |
| PCDHB5 | c.1945C>T | p.P649S | RTARLLSERDAAKHRLVLVKDNGE[p.P649S]SPRSATATLHVLLVDGFSQPYLPLPE | SPRSATATL, GESPRSATA, LVKDNGESPR, ESPRSATATL, GESPRSATAT | LUAD |
| PCDHB8 | c.703G>A | p.D235N | RLTLTALDGGSPPRSGTAQVIEVV[p.D235N]NVNDNAPEFEQPFYRVQISEDSPISF | QVYIEVNV, EVVNVNDNA, NVNDNAPEF, AQVYIEVNV, V NVNDNAPEF, IEVVNVNDNA | CRC |
| PCDHGC5 | c.1796G>T | p.G599V | GVELAPRSAERGYLVTKVVAVDRDS[p.G599V]VQNAWLSYRLLKASEPGLFSVGLHTG | SVQNAWLSY, VQNAWLSYR, VVAVDRDSV, VQNAWLSYRL, SVQNAWLSY, DSVQNAWLSY, VDRDSVQNAW | KIRC |
| PCDHGC5 | c.1984G>A | p.V662M | ALKQSLVVAVQDHGQPPLSATVTLT[p.V662M]MAVADSIPEVLADIGSLEPSDGPYNY | LSATVTLTM, ATVTLTMAV, LTMAVADSI, TVTLTMAVA, MAVADSIPEV, TLTMAVADSI, SATVTLTMAV, PLSATVTLTM | CRC |
| PCDHGC5 | c.1990G>A | p.D664N | RLLVAVRDGGQPPLSATATLHLVFA[p.D664N]NSLQEVLPDITDRPDPSDLQAELQFY | VFANSLQEV, LHLVFANSL, FANSLQEVL, LVFANSLQEV, TLH LVFANSL, VFANSLQEVL | BRCA |
| PCDHGC5 | c.2051C>A | p.P684H | TVTVAVADRIPDILADLGSIKTPID[p.P684H]HEDLDLTLYLVVAVAVSCVPLAFVI | HEDLDLTLY, IDHEDLDLTL, TPIDHEDLDL, HEDLDLTLYL | LUAD |
| PCDHGC5 | c.208G>A | p.A70T | SVVGNLAKDLGLSVLDVSARKLRVS[p.A70T]TEKLHFSVDAESGDLLVKNRIDREQI | SARKLRVST, RKLRVSTEK, KLRVSTEKL, STEKLHFSV, RVSTEKLHF, KLRVSTEKLH, VSTEKLHFSV, RKLRVSTEKL, LRVSTEKLHF, TEKLHFSVDA | UCEC |
| PCDHGC5 | c.36G>T | p.K12N | MAALQKLPHCR[p.K12N]NLVLLCFLLATLMEARAGQIRYSVRE | KLPHCRNLV, NLVLLCFLL, LPHCRNLVL, QKLPHCRNL, KLPH CRNLVL, LPHCRNLVLL, LQKLPHCRNL, HCRNLVLLCF | LUAD |
| PCDHGC5 | c.866C>T | p.S289L | LTATDPDEGINGKLTYSFRNEEEKI[p.S289L]LETFQLDSNLGEISTLQSLDYEESRF | EEEKILETF, NEEEKILETF, LETFQLDSNL | CRC |
| PCDHGC5 | c.877C>T | p.R293C | DPDEGANGEVTYSFHNVDHRVAQIF[p.R293C]CLDSYTGEISNKEPLDFEEYKMYSME | CLDSYTGEI, AQIFCLDSY, HRVAQIFCL, VAQIFCLDSY, AQIFCLDSYT | SKCM |
| PCGF3 | c.189delC | p.H63fs | SCLVKYLEENNTCPTCRIVIHQSHP[p.H63fs]CSTSVMTEPCKILFTNWYQASKKRK* | ILFTNWYQA, FTNWYQASK, TSVMTEPCK, HQSHPCSTS, QS HPCSTSV, SHPCSTSVM, VMTEPCKIL, MTEPCKILF, CKILFTN WY, KILFTNWYQA, HQSHPCSTSV, ILFTNWYQAS, FTNWYQ | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PCLO | c.11836C>A | p.P3946T | PYQTQPTFQAVATMSFTPQVQPTPT[p.P3946T]TQPSYQLPSQMMVIQQKPRQTTLYLE | ASKK,STSVMTEPCK,VMTEPCKILF,LFTNWYQASK,QSHPCSTSVM,EPCKILFTNW PTPTTQPSY,TPTTQPSYQL,QPTPTTQPSY | LUAD |
| PCLO | c.12397C>T | p.R4133C | VKAEEDPMEDPYELKLLKHQIKQEFI[p.R4133C]CRGTESLDHLAGLSHYYHADTSYRHF | HQIKQEFCR,QEFCRGTES,QEFCRGTESL | SKCM |
| PCMTD1 | c.812G>T | p.R271M | LARIYIRRTLRNFINDEMQAKGIPQ[p.R271M]MAPPKRKRKRVKQRINTYVFVGNQLI | MQAKGIPQM,GIPQMAPPK,MAPPKRKRK,QMAPPKRKR,MQAKGIPQMA,KGIPQMAPPK,QMAPPKRKRK,MAPPKRKRKR,EMQAKGIPQM | LUAD |
| PCMTD1 | c.842T>C | p.V281A | RNFINDEMQAKGIPQRAPPKRKRKR[p.V281A]AKQRINTYVFVGNQLIPQLDSEEDE | RAKQRINTY,RAKQRINTYV,KRAKQRINTY,AKQRINTYVF | TGCT |
| PCNXL2 | c.404G>A | p.R135Q | GEHITNHRNPSNNRQIHNGKKEEAS[p.R135Q]QNLSTPPLRCSSRQSITSHHSGPL | SQNLSTPPL,KKEEASQNL,SQNLSTPPLR,GKKEEASQNL,ASQNLSTPPL,KEEASQNLST | CRC |
| PCOLCE2 | c.1043C>T | p.A348V | ITTITRDGSLHATVSIINIYKEGNL[p.A348V]VIQQAGKNMSARLTVVCKQCPLLRG | NIYKEGNLV,IYKEGNLVI,LVIQQAGKNM,KEGNLVIQQA | CRC |
| PCOLCE2 | c.260G>A | p.R87H | KITVPEGKVVLNFRFIDLESDNLC[p.R87H]HYDFVDYNGHANGQRIGRFCGTFRP | LESDNLCHY,CHYDFVDV,SDNLCHYDF,ESDNLCHYDF,NLCHYDFVDV,LCHYDFVDY | CRC |
| PCP4L1 | c.191A>G | p.K64R | DLTAPETEKAALAIQGKFRRFQKRK[p.K64R]RDPSS* | KFRRFQKRKR | TGCT |
| PDE4B | c.1250C>T | p.S417L | MMTLEDHYHSDVAYHNSLHAADVAQ[p.S417L]LTHVLLSTPALDAVFTDLEILAAIFA | HAADVAQLT,DVAQLTHVL,LHAADVAQL,AQLTHVLLS,SLHAADVAQL,DVAQLTHVLI,LTHVLLSTPA,HAADVAQLTH,ADVAQLTHVL,AQLTHVLLST | CRC |
| PDGFRA | c.685G>A | p.E229K | NVYALKATSELDLEMEALKTVYKSG[p.E229K]KTIVVTCAVFNNEVVDLQWTYPGEVK | KTIVVTCAV,TVYKSGKTI,YKSGKTIVV,ALKTVYKSGK,KTIVVTCAVF,KTVYKSGKTI,TVYKSGKTIV,YKSGKTIVVT | GBM |
| PDGFRB | c.1949C>T | p.S650L | SQATMKVAVKMLKSTARSSEKQALM[p.S650L]LELKIMSHLGPHLNVVNLLGACTKGG | KQALMLELK,EKQALMLEL,ALMLELKIM,LELKIMSHL,MLELKIMSHL,RSSEKQALMI,SEKQALMLEL,KQALMLELKI,LMLELKIMSH | GBM |
| PDIA6 | c.168T>G | p.N56K | PCSPTSPAHSLSRKSPIMYPSTTMA[p.N56K]KAPGLVSCTFLAVNGLYSSSDDVIE | TMAKAPGLV,MYPSTTMAK,TTMAKAPGL,YPSTTMAKA,TTMAKAPGLV,IMYPSTTMAK,MYPSTTMAKA,KAPGLVSCTF | TGCT |
| PDILT | c.1498G>A | p.E500K | LYKGEHTLKGFSDFLESHIKTKIED[p.E500K]DELLSVEQNEVIEEEVLAEEKEVPM | HIKTKIEDK,IEDKDELLSV | CESC |
| PDPR | c.2377G>T | p.G793W | TMFILDDHDSDLDLMPWWGEPIYRN[p.G793W]WQYVGKTTSSAYSYSLERHVCLGFVH | EPIYRNWQY,WQYVGKTTS,WWGEPIYRNW,IYRNWQYVGK,EPIYRNWQYV,WQYVGKTTSS | LUAD |
| PDS5A | c.3927G>C | p.L1309F | KNDDLNKPINKGRKRAAVGQESPGG[p.L1309F]FEAGNAKAPKLQDLAKKAAPAERQID | QESPGGFEA,GQESPGGFEA | TGCT |
| PDYN | c.571G>T | p.G191W | EDPKEQVKRYCGFLRKYPKRSSEVA[p.G191W]WEGDGDSMGHEDLYKRYGGFLRR.IRP | YPKRSSEVAW,VAWEGDGDSM | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PDZD2 | c.1693C>A | p.R565S | RKHSLPQLLDSSASQEYHIVKKST[p.R565]SLSLSTTQVESPWRLIRPSVISIIGLY | IVKKSTSSL,TSSLSTQV,KKSTSSLST,HIVKKSTSSL,STSSLST TQV,IVKKSTSSLS,KKSTSSLSTT | LUAD |
| PDZD2 | c.302_303insG | p.R101fs | DTETVGLSFGNIPVFGDYGEKRGG[p.R101fs]QEEENPGSCAGCGLHLGDRAEEEQPSREEWEGPTAG* | REEWEGPTA,EEQPSREEW,EEWEGPTAG,EENPPGSCA | STAD |
| PELI2 | c.589del|G | p.G197fs | AKWKNPDGHMDGLTTNGVLVMHPRG[p.G197fs]ASPRSPSPGSGARSLSVEMCTPCEKPGRPSNEESWWKVRPTSCRTAPSLTCVGPLSSGEQMGFFILQLRST* | RTAPSLTCV,QMGFFILQL,VLVMHPRGA,MGFFILQLR,GAR SLSVEM,KVRPTSCRT,SPGSGARSL,RPTSCRTAP,VMHPRG ASP,SSGEQOMGF,GEQOMGFFI,EQQMGFFIL,RPSNEES WW,QOMGFFILQL,VMHPRGASPR,SVEMCTPCEK,QMGF FILQLR,RSPSPGSGAR,KVRPTSCRA,WWKVRPTSCR,HPR GASPRSP,RPTSCRTAPS,APSLTCVGPL,GPLSSGEQQM,SG ARSLSVEM,LSSGEQOMGF,GEQOMGFFIL,EESWWKVRPT | STAD |
| PEX1 | c.1108del|A | p.I1370fs | QSKTKQNVLSPEKEKQMSEPLDQKK[p.I1370fs]LGQIIMKKMRRPVCYK* | KLGQIIMKK,KMRRPVCYK,IMKKMRRPV,QIIMKKMRR,M KKMRRPVC,QKKLGQIIM,KKMRRPVCY,IIMKKMRRPV,KK MRRPVCYK,IMKKMRRPVC,DQKKLGQIIM,KLGQIIMKKM, MKKMRRPVCY | BLCA,PRAD |
| PFKM | c.352C>A | p.R118S | TSGGDAQGMNAAVRAVVRVGIFTGA[p.R118S]SVFFVHEGYQGLVDGGDHIK EATWES | FTGASVFFV,SVFFVHEGY,IFTGASVFF,GIFTGASVF,VGIFT GASV,RVGIFTGASV,ASVFFVHEGY,IFTGASVFFV,VGIFTGA SVF,GIFTGASVFF | LUAD |
| PFKP | c.1779del|G | p.M593fs | SGTKRRVFIIETMGGYCGYLANMGG[p.M593fs]SRPELMPHTFSKSPSTSGICSP TWST* | ELMPHTFSK,GSRPELMPH,HTPSKSPST,YLANMGGSR,STS GICSPT,RPELMPHTF,NMGGSRPEL,SKSPSTSGI,TSGICSPT W,MPHTFSKSPS,ANMGGSRPEL,NMGGSRPELM,SRPEL MPHTF,FSKSPSTSGI,STSGICSPTW | STAD |
| PGAM1 | c.719G>A | p.R240H | PIVYELDKNLPIKPMQFLGDEETV[p.R240H]HKAMEAVAAQGKAKK* | TVHKAMEAV,ETVHKAMEA,HKAMEAVAA,DEETVHKAM, ETVHKAMEAV,EETVHKAMEA | CRC |
| PGAP1 | c.1694T>G | p.F565C | QAPSSTEISLKLHIAQPENNTHVAL[p.F565C]CKMYTSSDCRYEVTVKTSFSQILG QV | THVALCKMY,NTHVALCKMY | OV |
| PGM5 | c.1277_1278insC | p.G426fs | VWLSIIAARKQSVEEIVRDHWAKFG[p.G426fs]PPLLLQV* | HWAKFGPPL,AKFGPPLLL,HWAKFGPPLL,KFGPPLLLQV | KIRC |
| PGM5 | c.292A>G | p.I98V | RTAIEIVVQMAAANGIGRLIIGQNG[p.I98V]VLSTPAVSCIIRKIKAAGGIILTASH | RLIIGQNGV,VLSTPAVSCI,RLIIGQNGVL,GQNGVLSTPA | STAD |
| PGPEP1L | c.490_491insA | p.R164fs | KGCAALIHVPPLSRGLPASLLGRAL[p.R164fs]KSHHPGNAGRGGKAQAQSPVRR KLNHGPSSQRELTGGLLL* | SQRELTGGL,ASLLGRALK,RALKSHHPG,KSHHPGNAG,KAQ AQSPVR,QAQSPVRRK,GKAQAQSPV,AQSPVRRKL,RKLNH GPSS,RELTGGLLL,ALKSHHPGNA,KLNHGPSSQR,KSHHPG NAGR,KAQAQSPVRR,AQAQSPVRRK,SQRELTGGLL | KIRC |
| PHACTR1 | c.752_753insG | p.V251fs | LPCLPVKLSPPLPPKKVMICMPVGG[p.V251fs]ARPLTGVLHSPEEWPAGCGPAP PHCPALPDPAPAAVRQPRPAPPLHHRL PPHAPLGLQNDRRAQQNAGHDHAEA GKL* | ALPDPAPAA,AVRQPRPAP,RQPRPAPPL,MICMPVGGA,M PVGGARPL,GARPLTGVL,GPAPPHCPA,LPDDAPAAV,LPPH APLGL,HRLPPHAPL,AQQNAGHDH,WPAGCGPAP,VMIC MPVGGA,VLHSPEEWPA,ALPDDAPAAV,RLPPHAPLGL,C MPVGGARPL,MICMPVGGAR,GARPLTGVLH,AVRQPRPA PP,AGHDHAEAGK,MPVGGARPLT,GPAPPHCPAL,CPALPD PAPA,RPAPPLHHRL,HRLPPHAPL,EEWPAGCGPA,VRQP RPAPPL,RQPRPAPPLH,AQQNAGHDHA,WPAGCGPAPP | LAML |
| PHACTR1 | c.753del|G | p.V251fs | LPCLPVKLSPPLPPKKVMICMPVGG[p.V251fs]QTSHWCPTQPRVASRVWPST TTLSCPPRSSTSCSTAATASTSPPPPAPS PCTPRAAE* | RVWPSTTL,TTTLSCPPR,RVASRVWPS,ASRVWPSTT,RSS TSCSTA,HWCPTQPRR,TQPRRVASR,CPTQPRRVA,QPRRV ASRV,WPSTTTLSC,GQTSHWCPT,SRVWPSTTT,MPVGGQ TSH,TSHWCPTQPR,STTTLSCPPR,RVASRVWPST,ASRVW PSTTT,RSSTSCSTAA,STSCSTAATA,PTQPRRVASR,CPTQP | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PHACTR2 | c.711_712insA | p.S237fs | APVPPPKPASRNTTREAAGSSHSKK[p.S237fs]NNWL* | RRVAS, QPRRVASRVW, APSPCTPRAA, MPVGGQTSHW, SR VWPSTTTL, SSHSKKNNWL | STAD |
| PHACTR4 | c.1061del|C | p.S354fs | DEREKSTCMGSELLPMISPRSPSP[p.S354fs]HCLLIYLQSLHAPLHSLLRLFKLCQKLSFHHP* | CLLIYLQSL, YLQSLHAPL, SLHAPLHSL, RLFKLCQKL, LIYLQSL HA, RSPSPHCLL, LHSLLRLFK, HAPLHSLLR, SPSPHCLLI, SPHC LLIYL, APLHSLLRL, LQSLHAPLH, LHAPLHSLL, FKLCQKLSF, LL IYLQSLHA, SLHAPLHSL, PLHSLLRLFK, LIRLFKLCQK, RSPSP HCLLI, IYLQSLHAPL, LFKLCQKLSF, SPSPHCLLY, SPRSPSPH CL, APLHSLLRLF, YLQSLHAPLH, QSLHAPLHSL | STAD |
| PHC3 | c.104_106del|CCA | p.T35del | STAMDTEPNPGTSVSVSTTTSSTTTT[p.T35del]ITTSSSRMQQPQISVYSGSDRHAVQVIQ | TTSSTTTTI, TTTSSTTTI | GBM |
| PHGDH | c.517_518GG>TT | p.G173L | LGILGLGRIGREVATRMQSFGMKTIL[p.G173L]LYDPIISPEVASFGVQQLPLEEIWPL | KTILYDPII, SFGMKTILY, QSFGMKTIL, MKTILYDPI, GMKTILY DPI, QSFGMKTILY, LYDPIISPEV, MQSFGMKTIL, MKTILYDPII | SKCM |
| PHIP | c.5043C>G | p.I1681M | KKRGRKPKKLQYAKPEDLEQNNVHP[p.I1681M]MRDEVLPSSTCNFLSETNNVKEDLLQ | EQNNVHPMR, NVHPMRDEV, LEQNNVHPM, HPMRDEVLPS | LUSC |
| PHOSPHO1 | c.95_97del|CCT | p.S32del | PWPANQPLPGGLLPRPLSLAPSSSSS[p.S32del]CCSSPPCSQDGRMAAQGAPRFLLTFDFDE | SLAPSSSSC, SLAPSSSSCC | PRAD |
| PI15 | c.64G>T | p.V22F | MIAISAVSSALLFSLLCEAST[p.V22F]FVLLNSTDSSPPTNNFTDIEAALKAQ | LLCEASTFV, SLLCEASTF, CEASTFVLL, SLLCEASTFV, LLCEAS TFVL, FSLLCEASTF | LUAD |
| PIAS2 | c.1556C>T | p.S519L | SETQSSPTKGVLMYQPSSVRVPSVT[p.S519L]LVDPAAIPPSLTDYSVPFHHTPISSM | SVRVPSVTL, SVRVPSVTLV, SSVRVPSVTL | CRC |
| PIAS3 | c.1378G>A | p.D460N | GGDPSENKKVEVIDLTIESSSDEE[p.D460N]NLPPTKKHCSVTSAAIPALPGSKGVL | IESSSDEENL | CESC |
| PIAS3 | c.348del|C | p.H116fs | LAPIPPTLLAPGTLLGPKREVDMHP[p.H116fs]LCPSLCTLMSP* | KREVDMHPL, REVDMHPLC, DMHPLCPSL, HPLCPSLCTL, V DMHPLCPSL, REVDMHPLCP | STAD |
| PIGM | c.674G>T | p.R225L | NDKSLRQFRYTFQACLYELLKRLCN[p.R225L]LAVLLFVAVAGLTFFALSFGFYYEYG | RLCNLAVLL, NLAVLLFVA, LLKRLCNLA, LAVLLFVAV, ELLKRL CNL, LKRLCNLAV, KRLCNLAVL, LCNLAVLLF, NLAVLLFVAV, L LKRLCNLAV, RLCNLAVLLF, YELLKRLCNL, LKRLCNLAVL, KRL CNLAVLL | LUAD |
| PIGO | c.2361del|C | p.P787fs | VTVLVKAGAGAPRTRTVLTPFSGPP[p.P787fs]LLLKLTWIMWSLKSTDTCRRSSGAG* | KLTWIMWSL, WIMWSLKST, LTWIMWSLK, SLKSTDTCR, TP FSGPPLL, LLKLTWIMW, VLTPFSGPPL, KLTWIMWSL, SLKS TDTCRR, LKLTWIMWSL | STAD |
| PIGR | c.548T>G | p.V183G | NAQKRKSLYKQIGLYPLVIDSSGY[p.V183G]GNPNYTGRIRLDIQGTGQLLFSVVIN | SSGYGNPNY, DSSGYGNPNY | TGCT |
| PIGT | c.1037del|C | p.A346fs | TAMINNSRNLNIQLKWKRPPENEAP[p.A346fs]QCPSCMPSGT* | NEAPQCPSCM | STAD |
| PIK3C2B | c.4419C>G | p.F1473L | EELNGYIWHLIHAPPEVAECDLVYT[p.F1473L]LFHPLPRDEKAMGTSPAPKSSDGTWA | LVYTLFHPL, YTLFFIPLPR, AECDLVYTL, DLVYTLFFIPL, LFHPL PRDEK, VYTLFHPLPR, AECDLVYTLF | KIRC |
| PIK3C2B | c.859del|C | p.R287fs | PLDFSKDTSGKPVARSKTMPQVPP[p.R287fs]APMPPAMATERMRLARTAG | TMPPQVPPA, LLHFATCWI, AMSGVLSPL, RLARTAGFL, FLQ PRWAPG, LLPMAMSCL, EMRLLHFA, WISFDLALT, VLSPLA | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| | | | FLQPRWAPGPTLLPMAMSCLRSQRE MRRLLHFATCWISFDLALTSKTTSSLAM SGVLSPLAQSTSGMRST* | QST, AMATERMR, AMSCLRSQK, RTAGFLQPR, RWAPGPT LL, REMRRLLHF, HFATCWISF, CWISFDLAL, RMRRLARTA, R SQKREMR, TSKTTSSLA, LPMAMSCLR, MSCLRSQKR, LTSK TISSL, TSSLAMSGV, PPQVPPAPM, VPPAPMPPA, PPAPMP PAM, APMPPAMAT, QPRWAPGPT, APGPTLLPM, GPTLLP MAM, MATERMRRL, CLRSQKREM, RRLARTAGF, PRWAPG PTL, SQKREMRRL, QKREMRLL, RLLHFATCW, SKTTSSLAM, SSLQMSGVL, LAMSGVISP, TLLPMAMSCL, RLLHFATCWI, L AMSGVLSPL, AMSGVLSPLA, KTMPPQVPPA, AMATERMR RL, ALTSKTTSSL, TTSSLAMSGV, MAMSCLRSQK, ISFDLALTS K, ATERMRRLAR, RMRRLARTAG, CLRSQKREMR, RSQKRE MRRL, SQKREMRLL, TSKTTSSLAM, RTAGFLQPRW, LLPM AMSCLR, AMSCLRSQKR, QVPPAPMPPA, FATCWISFDL, LT SKTTSSLA, MPPQVPPAPM, VPPAPMPPAM, MPPAMATER M, QPRWAPGPTL, SPLAQSTSGM, MRRLARTAGF, EMRRLL HFAT, RRLARTAGFL, WAPGPTLLPM, KREMRRLLFIF, REMR RLLHFA, RRLLHFATCW, LHFATCWISF, AQSTSGMRST, LPM AMSCLRS | |
| PIK3C A | c.1035T>A | p.N345 K | GETSTKSLWVINSALRIKILCATYV[p. N3 45K]KVNIRDIDKIYVRTGIYHGGEPLCD N | ILCATYKV, KILCATYVK, KVNIRDIDK, ATYVKVNIR, KILCATY VKV, TYVKVNIRDI, CATYVKVNIR | BRCA, CRC, STAD, UCEC |
| PIK3C A | c.1049A>G | p.D350 G | KSLWVINSALRIKILCATYVNVNIR[p. D3 50G]GIDKIYVRTGIYHGGEPLCDNVNT QR | YVNVNIRGI, NVNIRGIDK, NIRGIDKIY, TVNVNIRGI, VNIRG IDKIY | CRC |
| PIK3C A | c.113G>A | p.R38H | IHLMPPRILVECLLPNGMIVTLECL[p. R3 8H]HEATLITIKHELFKEARKYPLHQLLQ | VTLECLHEA, LECLHEATL, CLHEATLITI, HEATLITIKH, LECLH EATLI | UCEC |
| PIK3C A | c.115G>A | p.E39K | HLMPPRILVECLLPNGMIVTLECLR[p. E 39K]KATLITIKHELFKEARKYPLHQLLQD | IVTLECLRK, LRKATLITI, LECLRKATL, CLRKATLITI, MIVTLECL RK, RKATLITIKH, LECLRKATLI | UCEC |
| PIK3C A | c.1258T>C | p.C420 R | DLPRAARLCLSICSVKGRKGAKEEH[p. C 420R]RPLAWGNINLFDYTDTLVSGKM ALNL | KEEEHRPLAW, GAKEEHRPLA, RPLAWGNINL, AKEEHRPLA W | BRCA, UCEC |
| PIK3C A | c.1338_136 4de\|GCCAG TACCTCAT GGATTAGA AGATTT | p.PVPH GLEDL4 47de\| | LAWGNINLFDYTDTLVSGKMALNLW[p. PVPHGLEDL447de\|\|LNPIGVTGSNPN KETPCLELEFDWFSSVVKFPDMSVIEEH ANWSVSREAGFS | ALNLWLNPI, NLWLNPIGV, GKMALNLWL, MALNLWLNPI | BRCA |
| PIK3C A | c.1357G>A | p.E453 K | NLFDYTDTLVSGKMALNLWVPHGL[p. E453K]KDLLNPIGVTGSNPNKETPCLEL EFD | GLKDLLNPI, LWPVPHGLK, VPHGLKDLL, NLWPVPHGLK, W PVPHGLKDL, HGLKDLLNPI | BRCA |
| PIK3C A | c.1364_136 5insG | p.L455fs | DYTDTLVSGKMALNLWPVPHGLEDL[p. L455fs]AEPYWCYWIKSK* | GLEDLAEPY, DLAEPYWCY, AEPYWCYWI, LAEPYWCYW, H GLEDLAEPY | BRCA |
| PIK3C A | c.1624G>A | p.E542 K | LARDNELRENDKEQLKAISTRDPLS[p. E 542K]KITEQEKDFLWSHRHYCVTIPEILP K | ISTRDPLSK, STRDPLSKI, LSKITEQEK, AISTRDPLSK, SKITEQE KDF | BLCA, BRCA, CESC, CRC, HNSC, LUAD, LUSC, STAD, UCEC |
| PIK3C A | c.1633G>A | p.E545 K | DNELRENDKEQLKAISTRDPLSEIT[p. E5 45K]KQEKDFLWSHRHYCVTIPEILPKLL L | SEITKQEKDF, KQEKDFLWSH | BLCA, BRCA, CESC, CRC, GBM, HNSC, KIRC, |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PIK3CA | c.1634A>C | p.E545A | DNELRENDKEQLKAISTRDPLSEIT[p.E545A]AQEKDFLWSHRHYCVTIPEILPKLLL | TAQEKDFLW, SEITAQEKDF, AQEKDFLWSH, ITAQEKDFLW | LUAD, LUSC, STAD, TGCT, UCEC, UCS |
| PIK3CA | c.1634A>G | p.E545G | DNELRENDKEQLKAISTRDPLSEIT[p.E545G]QEKDFLWSHRHYCVTIPEILPKLLL | SEITGQEKDF, GQEKDFLWSH | BRCA, CRC |
| PIK3CA | c.1636C>A | p.Q546K | NELRENDKEQLKAISTRDPLSEITE[p.Q546K]EKDFLWSHRHYCVTIPEILPKLLLS | KEKDFLWSH, TEKEKDFLW, SEITEKEKDF | CRC |
| PIK3CA | c.1637A>C | p.Q546P | NELRENDKEQLKAISTRDPLSEITE[p.Q546P]EKDFLWSHRHYCVTIPEILPKLLLS | EITEPEKDFL, SEITEPEKDF, EPEKDFLWSH | BRCA, CRC, UCEC |
| PIK3CA | c.1637A>G | p.Q546R | NELRENDKEQLKAISTRDPLSEITE[p.Q546R]EKDFLWSHRHYCVTIPEILPKLLLS | REKDFLWSH, TEREKDFLW, SEITEREKDF | UCEC |
| PIK3CA | c.1A>G | p.M1V | [p.M1V]VPPRPSSGELWGIHLMPPRIIVECLL | VPPRPSSGEL | BRCA, UCEC |
| PIK3CA | c.2176G>A | p.E726K | HLNRQVEAMEKLINLITDILKQEKKD[p.E726K]KTQKVQMKFLVEQMRRPDFMDALQGF | KTQKVQMKF, KDKTQKVQMK, KTQKVQMKFL, KKDKTQKV QM | GBM |
| PIK3CA | c.263G>A | p.R88Q | QDESSYIFVSVTQEAEREEFFDETR[p.R88Q]LCDLRLFQPPLKVIEPVGNREEKIL ALQGF | RQLCDLRLF, ETRQLCDLR, EEFFDETRQL | BRCA, CESC, LUSC |
| PIK3CA | c.278G>A | p.R93Q | YIFVSVTQEAEREEFFDETRRLCDL[p.R93Q]QLFQPFLKVIEPVGNREEKILNREIG | QLFQPFLKV, LQLFQPFLK, RRLCDLQLF, CDLQLFQPF, LQLF QPPLKV, QLFQPFLKVI, DLQLFQPFLK, TRRLCDLQLF, LCDLQ LFQPF, CDLQLFQPFL | BRCA, CRC, GBM, STAD, UCEC |
| PIK3CA | c.3012G>A | p.M1041I | RFQEMCYKAYLAIRQHANLFINLFS[p.M1041I]IMLGSGMPELQSFDDIAYIRKT LALD | NLFINLFSI, FINLFSIML, LFINLFSIM, FSIMLGSGM, IMLGSG MPEL, NLFINLFSIM, LFINLFSIML, LFSIMLGSGM | UCEC |
| PIK3CA | c.3127A>G | p.M1043V | DIAYIRKTLALDKTEQEALEYFMKQ[p.M1043V]VNDAHHGGWTTKMDWIFHTI KQHALN | ALEYFMKQV, FMKQVNDAH, MKQVNDAH, EALEYFMKQ V, FMKQVNDAHH | BRCA |
| PIK3CA | c.3129G>A | p.M1043I | DIAYIRKTLALDKTEQEALEYFMKQ[p.M1043I]INDAHHGGWTTKMDWIFHTI QHALN | FMKQINDAH, KQINDAHHG, EALEYFMKQI, FMKQINDAHH, KQINDAHHGG | GBM, HNSC, UCEC |
| PIK3CA | c.3130A>T | p.N1044Y | IAYIRKTLALDKTEQEALEYFMKQM[p.N1044Y]YDAHHGGWTTKMDWIFHTIK QHALN* | MYDAHHGGW, FMKQMYDAH, LEYFMKQMY, MKQMYDA HH, KQMYDAHHG, ALEYFMKQMY, FMKQMYDAHH, QMY DAHHGGW, KQMYDAHHGG | BRCA, UCEC |
| PIK3CA | c.3132T>A | p.N1044K | IAYIRKTLALDKTEQEALEYFMKQM[p.N1044K]KDAHHGGWTTKMDWIFHTIK QHALN* | FMKQMKDAH, FMKQMKDAHH, MKDAHHGGW, ALEYFMK QMK, FMKQMKDAH, KQMKDAHHGG, QMKDAHHGGW | BRCA |
| PIK3CA | c.3140A>G | p.H1047R | IRKTLALDKTEQEALEYFMKQMNDA[p.H1047R]RHGGWTTKMDWIFHTIKQH ALN* | FMKQMNDAR, KQMNDARHG, RHGGWTTKM, YFMKQM NDAR, FMKQMNDARH, KQMNDARHG, QMNDARHGG W, ARHGGWTTKM | KIRC |
| PIK3CA | c.3140A>G | p.H1047R | | | BRCA, CRC, GBM, HNSC, LIHC, LUSC, STAD, UCEC, UCS |
| PIK3CA | c.3140A>T | p.H1047L | IRKTLALDKTEQEALEYFMKQMNDA[p.H1047L]LHGGWTTKMDWIFHTIKQH ALN* | FMKQMNDAL, ALHGGWTTK, KQMNDALHG, LHGGWTTK M, QLHGGWTTKM, YFMKQMNDAL, DALHGGWTTK, FMK QMNDALH, KQMNDALHGG, QMNDALHGGW | BRCA, HNSC, UCEC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PIK3CA | c.317G>T | p.G106V | EFFDETRRLCDLRLFQPFLKVIEPV[p.G106V]VNREEKILNREIGFAIGMPVCEFDMV | FLKVIEPVV, KVIEPVVNR | UCS |
| PIK3CA | c.323G>A | p.R108H | FDETRRLCDLRLFQPFLKVIEPVGN[p.R108H]EEKILNREIGFAIGMPVCEFDMVKD | HEEKILNREI | UCEC |
| PIK3CA | c.325_327del GAA | p.E110del | ETRRLCDLRLFQPFLKVIEPVGNRE[p.E110del]KILNREIGFAIGMPVCEFDMVKDPEVQD | REKILNREI | BRCA, UCEC |
| PIK3CA | c.331A>G | p.K111E | TRRLCDLRLFQPFLKVIEPVGNREE[p.K111E]ILNREIGFAIGMPVCEFDMVKDPEV | REEEILNREI, EEILNREIGF | UCEC |
| PIK3CA | c.331_333del AAG | p.K111del | TRRLCDLRLFQPFLKVIEPVGNREE[p.K111del]ILNREIGFAIGMPVCEFDMVKDPEVQDF | REEILNREI, EEILNREIGF | BRCA |
| PIK3CD | c.1141T>C | p.C381R | CFALYAVIEKAKKARSTKKKSKKAD[p.C381R]RPIAWANLMLFDYKDQLKTGERCLYM | KSKKADRPI, RPIAWANLM, KKADRPIAW, KSKKADRPIA, RPIAWANLML, KKSKKADRPI, SKKADRPIAW, ADRPIAWANL | TGCT |
| PIK3G | c.493G>A | p.V165I | RHPPSEESQAFQRQLTALIGYDVTD[p.V165I]ISNVHDDELEFTRRGLVTPRMAEVAS | LIGYDVTDI, ALIGYDVTDI | LUAD |
| PIK3R1 | c.1126G>A | p.G376R | ADGTFLVRDASTKMHGDYTLTLRKG[p.G376R]RNNKLIKIFHRDGKYGFSDPLTFSSV | TLRKGRNNK, KGRNNKLIK, YTLTLRKGR, RNNKLIKIF, LTLRK GRNNK, TLRKGRNNKL, KGRNNKLIKI, GRNNKLIKIF | GBM |
| PIK3R1 | c.1137A>T | p.K379N | TFLVRDASTKMHGDYTLTLRKGGNN[p.K379N]NLIKIFHRDGKYGFSDPLTFSSVVEL | KGGNNNLIK, NNLIKIFHR, RKGGNNNLI, GNNNLIKIF, TLRKG GNNNL, NNNLIKIFHR, GGNNNLIKIF | GBM |
| PIK3R1 | c.1697_1708del TTAAACCAGACC | p.KPDL567del | RRRLEEDLKKQAAEYREIDKRMNSI[p.KPDL567del][IQLRKTRDQYLMWLTQKGVRQKKLNEWLGNENTEDQY | RMNSIIQLR, MNSIIQLRK, SIIQLRKTR, KRMNSIIQL, RMNSIIQLRK, NSIIQLRKTR | BRCA |
| PIK3R5 | c.1112T>G | p.L371R | LLSTSSLASHDSTLSLASSQASGPA[p.L371R]RSRHLLTSFVSGLSDGMDSGYVEDSE | SSQASGPAR, RSRHLLTSF, GPARSRHLL, ASSQASGPAR, RSR HLLTSFV, ARSRHLLTSF | KIRC |
| PILRA | c.872_873insC | p.S291fs | VYASLALSSSTSPRAPPSHRPLKSP[p.S291fs]PERDPVLCLKGLTNGQPSQD* | SPPERDPVL | LUAD |
| PIM1 | c.490C>T | p.L164F | LQEELARSFFWQVLEAVRHCNCGV[p.L164F]FHRDIKDENILIDLNRGELKLIDFGS | RHCHNCGVF, HCHNCGVFHR, VRHCHNCGVF | DLBCL |
| PIM1 | c.550C>T | p.L184F | HNCGVLHRDIKDENILIDLNRGELK[p.L184F]FIDFGSGALLKDTVTFDFDGTRVYSP | FIDFGSGAL, RGELKFIDF, FIDFGSGALL, IDLNRGELKF, LKFID FGSGA, KFIDFGSGAL, GELKFIDFGS | DLBCL |
| PIP4K2A | c.656G>A | p.R219K | IVTRNVFSHRLSVYRKYDLKGSTVA[p.R219K]KEASDKEKAKELPTLKDNDFINEGQK | TVAKEASDK, KEASDKEKA, STVAKEASDK, VAKEASDKEK | KIRP |
| PIP4K2C | c.611G>A | p.R204H | NTLLPQFLGMYRVSVDNEDSYMLVM[p.R204H]HNMFSHRLPVHRKYDLKGSLVSREAS | VMHNMFSHR, LVMHNMFSH, SYMLVMHN, YMLVMHN MF, MHNMFSHRL, VMHNMFSHRL, LVMHNMFSHR, SYML VMHNMF, DSYMLVMHNM, HNMFSHRLPV, MLVMHNMFSH | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PITPN M1 | c.884del|C | p.P295fs | PPGKPSTEARSAASNTGTPDGPEAP|p. P295fs|QAQMPPPMPALGSSGPHPPV PPTHPNMEGLCLPRACLSGACRTLPETL RTAPRKSSLMPTKASRTVRRSSPRR* | AQMPPPMPA,QMPPPMPAL,CLSGACRTL,TLPETLRTA,RT VRRSSPR,ETLRTAPRK,RTAPRKSSL,RKSSLMPTK,KSSLMPT KA,SLMPTKASR,ASRTVRRSS,TVRRSSPRR,NMEGLCLPR,G PEAPQAQM,HPNMEGLCL,LPRACLSGA,MPTKASRTV,PQ AQMPPPM,MEGLCLPRA,AQMPPPMPAL,CLPRACLSGA,S LMPTKASRT,LMPTKASRTV,RTVRRSSPRR,SSLMPTKASR, RTLPETLRTA,RTAPRKSSLM,PTKASRTVRR,APQAQMPPP M,MPALGSSGPH,LPRACLSGAC,APRKSSLMPT,LRTAPRKS SL,RKSSLMPTKA | STAD |
| PIWIL 1 | c.2095G>A | p.V699 M | GLKVCLQAALRAWNSCNEYMPSRII|p. V699M|MYRDGVGDGQLKTLVNYEVP QFLDCL | RIIMYRDGV,EYMPSRIIM,YMPSRIIMY,MPSRIIMYR,YMPS RIIMYR,NEYMPSRIIM | HNSC |
| PKD1 | c.2813C>T | p.T938 M | VENSASRANLSLRVTAEEPICGLRA|p.T 938M|MPSPEARVLQGVLVRYSPVVEA GSDM | AMPSPEARV,RAMPSPEAR,RAMPSPEAR,EPICGLRAM,MPSPEARVL,GL RAMPSPEA,RAMPSPEARV,AMPSPEARVL,EEPICGLRAM | TGCT |
| PKD2 | c.1457A>T | p.Y486 F | KLIRYVTTFDFFLAACEIIFCFFIF|p.Y486 F|FYVVEEILEIRIHKLHYFRSFWNCLD | FCFFIFFYV,IIFCFFIFF,CFFIFFYVV,IFFYVVEEI,FFYVVEEIL, IF CFFIFFY,FCFFIFFYVV,FIFFYVVEI,IIFCFFIFFY,IF- CFFIFFYV, IFFYVVEEIL,FYVVEEILEI,EIIFCFFIFF | CLL |
| PKHD 1L1 | c.5568C>A | p.F185 6L | PPVASLSPTSGSIGGGTTLVITGNG|p.F1 856L|LYPGNTTVTIGDEPCQIISINPNEV Y | LVITGNGLY,GLYPGNTTV,TLVITGNGL,GLYPGNTTVT,LYP GNTTVTI,TLVITGNGLY,TTLVITGNGL | CRC |
| PKN2 | c.226del|A | p.K76fs | KREIRKELKIKEGAENLRKVTTDKK|p.K7 6fs|VWLM* | TTDKKVWLM,RKVTTDKKVW | STAD |
| PLA2G 15 | c.689del|G | p.W23 0fs | FLQRQPQAWKDKYIRAFVSLGAPWG|p. W230fs|AWPRPCASWLQETTTGSQSS GP* | WLQETTTGS,AWPRPCASW,GAPWGAWPR,WPRPCASW L,SLGAPWGAW,FVSLGAPWGA,LGAPWGAWPR,VSLGAP WGAW,GAWPRPCASW | STAD |
| PLA2G 1B | c.157_158i nsTG | p.L53fs | KMIKCVIPGSDPFLEYNNYGCYCGL|p.L 53fs|WGAOAPPWMNWTSAARHMTT AMTRPRSWTAVNFCWTWTRTPTPIHTR ALARQSPVAAKTKSVRPSFATATATLPS AFQKLHITRHTRTWTPRSIVRVEYHLSK ASPLSASSHTVLSNKAPC* | ALARQSPVA,SVRPSFATA,TLPSAFQKL,PLSASSHTV,ATLPS AFQK,SSHTVLSNK,MTTAMTRPR,AVNFCWTTR,NYGCYC GLW,LWGAQAPPW,SWTAVNFCW,SFATATATL,AARHM TTAM,RHMTTAMTR,MTRPRSWTA,RSWTAVNFC,TTRTP TPIH,RTPTPIHTR,HTRALARQS,RALARQSPV,LARQSPVAA, KTKSVRPSF,KLHITRHTR,ITRHTRTWT,HTRTWTPRS,RTW TPRSIV,RSIVRVEYH,RVEYHLSKA,LSKASPLSA,WMNWTSA AR,AFQKLHITR,TWTPRSIVR,WTSAARHMT,WTAVNFCW T,WTTRTPTPI,WTPRSIVRV,RPRSWTAVN,TPIHTRALA,RP SFATATA,YHLSKASPL,ATATLPSAF,AQAPPWMNW,TAMT RPRSW,RQSPVAAKT,FQKLHITRH,HITRHTRTW,SKASPLS AS,LSASSHTVL,VEYHLSKAS,AMTRPRSWTA,MTRPRSWT AV,ALARQSPVAA,ATATATLPSA,HLSKASPLSA,RTWTPRSI VR,IVRVEYFILSK,ASSFITVLSNK,TAVNFCWTTR,TATLPSAF QK,SAFQKLHITR,RSWTAVNFCW,CWTRTPTPI,AARHMT TAMT,TRRTPTPIHT,RTPTPIHTRA,HTRALARQSP,RALARQ SPVA,LARQSPVAAK,RQSPVAAKTK,KTKSVRPSFA,KSVRPS FATA,SVRPSFATAT,KLHITRHTRT,ITRHTRTWTP,HTRTWT PRSI,RSIVRVEYHL,SSHTVLSNKA,PWMNWTSAAR,HMTI AMTRPR,TPIHTRALAR,TSAARHMTTA,WTAVNFCWTT,A PPWMNWTSA,SAARHMTTAM,RPRSWTAVNF,TPTPIHTR | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PLA2G3 | c.602G>A | p.R201Q | GPDLCCREHDRCPQNISPLQYNYGI[p.R201Q]QNYRFFITISFICDCDTRFQQCLQNQHD | AL,SPVAAKTKSV,RPSFATATAT,LPSAFQKLHI,SPLSASSHTV,MNWTSAARHM,TATATLPSAF,GLMGAQAPPW,WMNWTSAARH,AKTKSVRPSF,PSFATATATL,FQKLHITRHT,LHITRHTRTW,KASPLSASSH,TPRSIVRVEY IQNYRFHTI,NYGIQNYRF,QYNYGIQNY,YNYGIQNYR,LQYNYGIQN,YNYGIQNYRF,LQYNYGIQNY,QYNYGIQNYR,IQNYRFHTIS,QNYRFHTISH | UCEC |
| PLAG1 | c.551del|A | p.K184fs | FESTGVLLEHLKSHAGKSSGGVKEK[p.K184fs]STSANIVIAGSTPERMSGDTWWCTLEERTSSVSIVHRDLGERIT* | RMSGDTWWC,TLEERTSSV,VIAGSTPER,RTSSVSIVH,TSSVSIVHR,GVKEKSTSA,KSTSANIVI,TWWCTLEER,RMSGDTWWCT,CTLEERTSSV,IVIAGSTPER,RTSSVSIVHR,KSTSANIVIA,DTWWCTLEER,SIVHRDLGER,KEKSTSANIV,MSGDTWWCTL,LEERTSSVSI,EERTSSVSIV,TPERMSGDTW | STAD |
| PLAGL2 | c.30del|C | p.P10fs | MTTFFTSVPP[p.P10fs]GFKMQSRRRKWAGN* | FTSVPPGFK,FFTSVPPGF,TSVPPGFKM,KMQSRRRKW,FFTSVPPGFK,TFFTSVPPGF,GFKMQSRRRK,KMQSRRRKWA,FTSVPPGFKM,FKMQSRRRKW | STAD |
| PLAU | c.602_603insG | p.R201fs | IIGGEFTTIENQPWFAAIYRRHRGG[p.R201fs]LCFILRVWRQPHQPLLGDQRHTLLH* | LLGDQRHTL,VWRQPHQPL,HLRVWRQPH,GLCHLRVWR,RHRGGLCHL,WRQPHQPLL,LLGDQRHTLL,VWRPHQPLL,AIYRRHRGGL,RHRGGLCHLR,HLRVWRQPHQ,RVWRQPHQPL,RRHRGGLCHL,RGGLCHLRVVV | STAD |
| PLCD3 | c.1495del|G | p.E499fs | KGRVLVKGKKLPAARSEDGRALSDR[p.E499fs]RRRRRMTRRKKRRWRLQRRGGWPSRSPRSCRPWLCTATPPA* | WLCTATPPA,RALSDRRRR,RRRRRMTR,RRRRRMTRR,RRRMTRRK,RRRMTRKKR,RMTRKKKR,KKRRWRLQR,KRRWRLQRR,RWRLQRRGG,GGWPSRSPR,WPSRSPRSC,SPRSCRPWL,RRKKRRWRL,LQRRGGWPS,RSPRSCRPW,RALSDRRRRR,ALSDRRRRRR,RRRRRRMTRR,RRRRRMTRRK,RRRRMTRRKK,MTRRKKRWR,RKKRRWRLQR,KKRRWRLQRR,RWRLQRRGGW,LQRRGGWPSR,RGGWPSRSPR,RSPRSCRPWL,RSCRPWLCTA,RPWLCTATPP,TRRKKRRWRL,RMTRRKKRRW,SRSPRSCRPW | CLL |
| PLCE1 | c.1315G>T | p.G439C | NTVGSLLHFLTKLPASETAHGRISV[p.G439C]CPCLKQCVRDTVCEYRATLQRTSISQ | RISVCPCLK,GRISVCPCL,HGRISVCPCL | LUSC |
| PLCE1 | c.1690G>T | p.G564C | LMEQEQTIYRRVLPVDYLCFLTRDL[p.G564C]CTPECQSSLLPCLKASISASILTTQNG | CTPECQSSL | LUAD |
| PLCL1 | c.1692G>T | p.M564I | VKGKKLPSDPDVLEGEVTDEDEEAE[p.M564I]ISRRMSVDYINGEQKQIRLCRELSDLV | ISRRMSVDY,AEISRRMSV,EEAEISRRM,EISRRMSVDY,DEEAEISRRM | LUAD |
| PLEC | c.4157G>A | p.R1386Q | QDARRRQEQIQAMPLADSQAVREQL[p.R1386Q]QQEQALLEEIERHGEKVEECQRFAKQ | EQLQQEQAL,REQLQQEQA,REQLQQEQAL,EQLQQEQALL,QQEQALLEEI | ACC |
| PLEKHA6 | c.329G>T | p.R110L | VDRCLFYYKDEKEESILGSIPLLSF[p.R110L]LVAAVQPSDNISRKHTFKAEHAGVRT | SIPLLSFLV,LLSFLVAAV,FLVAAVQPS,IPLLSFLVA,GSIPLLSFL,GSIPLLSFLV,PLLSFLVAAV,IPLLSFLVAA | LUAD |
| PLEKHA6 | c.982del|G | p.V328fs | TNPDKIAQRKSSMNQLQQWVNLRRG[p.V328fs]YPRLKTFGVPLGSILCLAGSLSTMAPTPPSTPMIISTTRQECGRRASVPCRPMIGSARPGPWRTSAMPSAMGVALPTSCESGRSPPATGGRMPPSGSQAPPG | RLKTFGVPL,CLAGSLSTM,SAMPSAMGV,IMMSWMPPL,MMSWMPPLA,WMPPLAPCA,FTPLSAHPV,PLSAHPVPV,VLSGCHLAV,NLRRGYPRL,TMAPTPPST,AMPSAMGVA,RMPPSGSQA,HLAVRTSML,RGYPRLKTF,RAPTAVPAF,LRRGYPRLK,STMAPTPPS,RASVPCRPM,SARPGPWRT,RTSAMP | CRC,STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PLEKHB1 | | | SQSIMMSWMPPLAPCAACPCSPAPTLCPAHPARAPTAVPAFTPLSAHPVPVLSGCHLAVRTSMLTLLPM* | SAM, AVRTSMLTL, QWNLRRGY, VNLRRGYPR, TPMIISTT R, STTRQECGR, TLCPAHPAR, CAACPCSPA, TAVPAFTPL, YP RLKTFGV, APTPPSTPM, RPGPWRTSA, MPSAMGVAL, SPPA TGGRM, APPGSQSIM, MPPLAPCAA, CPCSPAPTL, SPAPTLC PA, HPARAPTAV, VPAFTPLSA, VPVLSGCHL, SQSIMMSWM, TS MLTLLPM, FGVPLGSIL, RQECGRRAS, IGSARPGPW, WRTSQMPSA, SAMGVALPT, CESGRSPPA, SQAPPGSQS, GSQSIMMSW, MSWMPPLAP, ARAPTAVPA, LSAHPVPVL, CHLAVRTSM, VRTSMLTLL, VPLGSILCL, QECGRRASV, TPPSTPMI, RTSMLTLLPM, CLAGSLSTMA, AMPSAM GVAL, SIMMSWMPPL, IMMSWMPPLA, WMPPLAPCAA, KTFGVPLGSI, SQAPPGSQSI, TLCPAHPARA, HLAVRTSMLT, AVRTSMLTLL, NLRRGY PRLK, WVNLRRGYPR, STPMIISTTR, RGYPRLKTFG, RLKTFGVPLG, ST MAPTPPST, CGRRASVPCR, RASVPCRPMI, SARPGPWRTS, PWRTSAMP SA, RTSAMPSAMG, SWMPPLAPCA, QOWNLRRGY, PTLCPAHPAR, VLS GCHLAVR, MAPTPPSTPM, TSAMPSAMGV, YPRLKTFGVP, APTPPST PMI, RPMIGSARPG, RPGPWRTSAM, APPGSQSIMM, APTLCPAHPA, CPAHPARAPT, TPLSAHPVPV, RRGYPRLKTF, LCLAGSLSTM, RQECGRRASV, RRASVPCRPM, MIGSARPGPW, WRTSAMP SAM, SAMPSAMGVA, RMPPSGSQAP, MMSWMPPLAP, A RAPTAVPAF, GCHLAVRTSM, CHLAVRTSML, LAVRTSMLTL, MPSAMGVALP, MPPLAPCAAC, SPAPTLCPAH, VPAFTPLSA H, HPVPVLSGCH, CESGRSPPAT, VPLGSILCLA, VPVLSGCHL A | |
| | c.436T>C | p.S146P | TALLEANSTPAPAGATVPPRSRRVC[p.S146P]PKVRCVTRSWSPCKVERRIWVRVYSP | RSRRVCPKV, RVCPKVRCV, CPKVRCVT, RSRRVCPKVR | CLL |
| | c.1150G>A | p.E384K | AIIFLQNSFCSLNTHRTPRTAQEVA[p.E384K]KLIDQHETMMKLVLEDPLIVSLRLEG | KLIDQHETM, RTAQEVAKL, KLIDQHETMM, AKLIDQHETM | CRC |
| PLEKHM1 | c.2684C>T | p.A895V | RIIHMWDLTKRPICRQALKFLTQIR[p.A895V]VQPLINLQMVNASLYEHVERMHLIGR | TQIRVQPLI, LTQIRVQPL, LKFLTQIRV, IRVQPLINL, VQPLINL QM, FLTQIRVQPL, ALKFLTQIRV, QIRVQPLINL, RVQPLINLQ M | TGCT |
| PLEKHM2 | c.1376C>T | p.S459L | DQSFRTGSPGDAPERPPLCDFSEGL[p.S459L]LAPMDFYRFTVESPSTVTSGGGFIHDP | LLAPMDFYR, LAPMDFYRF, GLLAPMDFY, FSEGLLAPM, LLA PMDFYRF, GLLAPMDFYR, SEGLLAPMDF, DFSEGLLAPM | BLCA |
| PLEKHO1 | c.761del|C | p.T254fs | QPSADRASSLSRPWEKTDKGATYTP[p.T254fs]RHPRS* | ATYTPRHPR, ATYTPRHPRS, GATYTPRHPR | STAD |
| PLEKHO2 | c.1051G>C | p.E351Q | GEMQASGPPAPGTVQVSVNGMDDSP[p.E351Q]QPAKPSQAEGTPGTPPKDATTSTALP | GMDDSPQPA, GMDDSPQPAK, SPQPAKPSQA | CESC |
| PLIN5 | c.916C>T | p.R306W | LETLVLSRSLITQELQGTVEALESSV[p.R306W]WGLPAGAQEKVAEVRRSVDALQTAFA | ALESSVWGL, ESSVWGLPA, SVWGLPAGA, VEALESSVW, EA LESSVWGL, SSVWGLPAGA, LESSVWGLPA | ACC |
| PLK1 | c.698A>G | p.D233G | KKTLCGTPNYIAPEVLSKKGHSFEV[p.D233G]GVWSIGCIMYTLLVGKPPFETSCLKE | SFEVGVWSI, KGHSFEVGV, GVWSIGCIM, FEVGVWSIG, GV WSIGCIMY, HSFEVGVWSI, EVGVWSIGCI, KGHSFEVGVW, VGVWSIGCIM, FEVGVWSIGC | CRC |
| PLOD3 | c.888_889insC | p.P296fs | GWTPEGGCGFCNQDRRTLPGGQPPP[p.P296fs]PGVSGRVCGTAYSVSAPLPAAATPGLSPRQGHPFPAQQRGLP* | RVCGTAYSV, SVSAPLPAA, SGRVCGTAY, AATPGLSPR, TAYS VSAPL, YSVSAPLPA, APLPAAAT, LPAAAATPG, LSPRQGHP F, RQGHPFPAQ, VSGRVCGTAY, GTAYSVSAPL, SVSAPLPAA | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PLOD3 | c.889de|C | p.R297fs | GWTPEGGCGFCNQDRRTLPGGQPPP|p.R297fs]GCFWPCLWNSLLRFCPASCSGCYSWTIPPTGSPFSCTTTRSSMNPTSLTPGRSSRTTSQL* | A,AAATPGLSPR,YSVSAPLPAA,LPAAAATPGL,SPRQGHPFPA,HPFPAQORGL,GLSPQGHPF,GRVCGTAYSV,FWPCLWNSL,CLWNSLLRF,NSLLRFCPA,TRRSSMNPT,RSSMNPTSL,RSSRTTSQL,SPFSCTTTR,SLTPGRSSR,TIPPTGSPF,CPASCSGCY,ASCSGCYSW,SCTTTRSSM,SMNPTSLTP,WPCLWNSLL,CFWPCLWNSL,FWPCLWNSLL,WTIPPTGSPF,TTRSSMNPTS,RSSMNPTSLT,TSLTPGRSSR,MNPTSLTPGR,FSCTTTRSSM,TRSSMNPTSL,SMNPTSLTPG,GRSSRTTSQL | CRC,STAD |
| PLSCR3 | c.229G>A | p.E77K | FPSPGPVALGSAAPFLPLPGVPSGL|p.E77K]KFLVQIDQILIHQKAERVETPLGWET | KFLVQIDQI,VPSGLKFLV,GVPSGLKFLV,KFLVQIDQIL,LPGVPSGLKF,LKFLVQIDQI | CRC |
| PLXNA1 | c.3046de|C | p.P1016fs | LTPPGQSPGSAPIIININRAQLTNP|p.P1016fs]R* | INRAQLTNPR | STAD |
| PLXNA1 | c.3883G>A | p.E1295K | ALECKEAFAELQTDIHELTNDLDGA|p.E1295K]SIPFLDYRTYAMRVLFPGIEDHPVLK | ASIPFLDYR,GASIPFLDY,DLDGASIPF,GASIPFLDY,SIPFLDYRTY,LTNDLDGASI,NDLDGASIPF | UCEC |
| PLXNA2 | c.1392_1393insCC | p.P464fs | YNGYSVVFVGTKSGKLKKIRADGPP|p.P464fs]PMVGSSTRWSLCSRTEAPSSGTWPSPLISATCTSCLRDRSPGSPWSHVSSIRLVGSA* | STRWSLCSR,KIRADGPPP,SATCTSCLR,WPSPLISAT,SPWSHVSSI,IRADGPPPM,PMVGSSTRW,VGSSTRWSL,TEAPSSGTW,ISATCTSCL,RDRSPGSPW,WSHVSSIRL,SPGSPWSHV,LISATCTSCL,SSTRWSLCSR,ISATCTSCLR,KIRADGPPPM,STRWSLCSRT,RWSLCSRTEA,MVGSSTRWSL,RTEAPSSGTW,WPSPLISATC,PPMVGSSTRW | STAD |
| PLXNA3 | c.172C>T | p.P58S | LTHLAVHRVTGEVFVGAVNRVFKLA|p.P58S]SNLTELRAHVTGPVEDNARCYPPPSM | KLASNLTEL,RVFKLASNL,LASNLTELR,KLASNLTELR,RVFKLASNLT,FKLASNLTEL | HNSC |
| PLXNC1 | c.1385C>T | p.S462L | IYIYLTAGKEVRRIRVANCNKHKSC|p.S462L]LECLTATDPHCGWCHSLQRCTFQGDC | NKHKSCLECL | CRC |
| PLXNC1 | c.2455C>T | p.R819C | NINVSEYCVATYCGFLAPSLKSSKV|p.R819C]CTNVTVKLRVQDTYLDCGTLQYREDP | KVCTNVTVK,CTNVTVKLR,KSSKVCTNV,SKVCTNVTV,SSKVCTNVTV | CRC |
| PLXND1 | c.1100G>T | p.R367L | GLQCAGGAGRGDLYSRLVSVPPARE|p.R367L]LLFAVFERPQGSPAARAAPAALCAFR | VFPARELLF,SVPPARELL,ELLFAVFER,ARELLFAVF,FPARELLFA,RELLFAVFE,SVPPARELLF,FPARELLFAV,PARELLFAVF | TGCT |
| PMEPA1 | c.624de|C | p.P208fs | RAPPNRTIFDSDLMDSARLGGPCPP|p.P208fs]AVTRASAPRATAAGAWRGRPPTARSSATTRGPPSSTSRAVGRPCWRGPGSTTHTSRP* | RLGGPCPPA,AVTRASAPR,ATAAAGAWR,SSTSRAVGR,AVGRPPCWR,VTRASAPRA,RASAPRATA,AWRGRPPT,RGRPPTAR,TARSSATTR,AAGAWRGRR,SAPRATAAA,APRATAAAG,RPPTARSSA,RPPCWRGPG,RATAAGAW,RAVGRPPCW,RLGGPCPPAV,VTRASAPRAT,RASAPRATAA,ASAPRATAAA,RATAAAGAWR,AWRGRPPTA,RGRPPTARS,TSRAVGRPPC,CPPAVTRASA,APRATAAAGA,RPPTARSSAT,GPPSSTSRAV,ARLGGPCPPA | STAD |
| PMS2 | c.1952A>G | p.K651R | AKRIKQLHHEAQQSEGEQNYRKFRA|p.K651R]RICPGENQAAEDELRKEISKTMFAEM | NYRKFRARI,KFRARICPG,RARICPGEN,QNYRKFRAR,KFRARICPGE,RARICPGENQ,EQNYRKFRAR,RKFRARICPG | TGCT |
| PNKP | c.520G>T | p.G174W | NLEKLLVFTAAGVKPQGKVAGFDLD|p.G174W]WTLITTRSGKVFPTGPSDWRILYPEI | AGFDLDWTL,WTLITTRSGK,DLDWTLITTR,GKVAGFDLDW | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PNLIP | c.110C>T | p.T37M | GAVAGKEVCYERLGCFSDDSPWSGI[p. T37M]MERPLHILPWSPKDVNTRFLLYT NEN | GIMERPLHI, SPWSGIMER, IMERPLHIL, GIMERPLHIL, DSP WSGIMER, MERPLHILPW | MM |
| PNPLA 4 | c.668T>C | p.L223 P | LDLYVNIAKQDIMLSLANLVRLNQA[p.L 223P]PFPPSKRKMESLYQCGFDDTVKF LLK | NQAPFPPSK, LVRLNQAPF, LNQAPFPPSK, NQAPFPPSKR, A PFPPSKRKM, NLVRLNQAPF, RLNQAPFPPS | TGCT |
| PNPLA 7 | c.3597del C | p.P119 9fs | LAYVCCVRQLEVVKSSDYCEYLRPP[p.P 1199fs]STATAPWTSASSTRSAKWATST GARCLTSGAAAACWRRCSATSRGRARS PRVRSSPVPTPPSRTLPKLCLALSPPSPP WWMTNLTTRRSTRRSCWTSPGMHTQ TSRAPQPSRAQTWRTSPHCGIDTPVWL SQNCLRAPLTRTGRGLC* | YLRPPSTAT, CLTSGAAAA, TLPKLCLAL, GMHTQTSRA, WLS QNCLRA, SQNCLRAPL, SASSTRSAK, STRSAKWAT, KWATST GAR, GARCLTSGA, AACWRRCSA, RGRARSPRV, RARSPRVR S, RVRSSPVPT, RTLPKLCLA, TTRRSTRRS, STRRSCWTS, RSC WTSPGM, TSRAPQPSR, LTRTGRGLC, SATSRGRAR, WWMT NLTTR, WMTNLTTRR, NLTTRRSTR, LTTRRSTRR, VWLSQNC LR, RAPLTRTGR, TATAPWTSA, ATAPWTSAS, APWTSASST, SPRVRSSPV, VPTPPSRTL, SPPWWMTNL, AQPSRAQT, RS AKWATST, AKWATSTGA, ALSPPSPPW, AQTWRTSPH, PPS TATAPW, CEYLRPPST, YLRPPSTATA, TSASSTRSAK, RTLPKL CLAL, STATAPWTSA, STRSAKWATS, SAKWATSTGA, GARC LTSGAA, AAACWRRCSA, CWRRCSATSR, TSRGRARSPR, RG RARSPRVR, RARSPRVRSS, RSPRVRSSPV, RVRSSPVPTP, RS SPVPTPPS, TTRRSTRRSC, STRRSCWTSP, TSRAPQPSRA, RA QTWRTSPH, TWRTSPHCGI, CSATSRGRAR, WWMTNLTTR R, TNLTTRRSTR, NLTTRRSTRR, QTSRAPQPSR, PVWLSQNC LR, WTSASSTRSA, RPPSTATAPW, TPPSRTLPKL, APQPSRA QTW, SPHCGIDTPV, TPVWLSQNCL, APLTRTGRGL, CEYLRP PSTA, SASSTRSAKW, WATSTGARCL, LALSPPSPPW, ALSPP SPPWW, RRSCWTSPGM, AQTWRTSPHC, LSQNCLRAPL, S QNCLRAPLT, LTSGAAAACW | STAD |
| PNRC 1 | c.217C>T | p.R73C | PRALPPTLFLPHFLGGDGPCLTPQP[p.R 73C]CAPAALPNRSLAVAGGTPRAAPKK RR | LTPQPCAPA, TPQPCAPAA, CLTPQPCAPA, TPQPCAPAAL | CESC |
| PODN | c.903del C | p.I301f s | RHVPKHLPPALYKLHLKNNKLEKIP[p.I3 01fs]RGPSAS* | LEKIPRGPSA | STAD |
| PODN L1 | c.449C>T | p.A150 V | QLQHLCVAHNKLSVAPQFLPRSLRV[p. A150V]VDLAANQVMEIFPLTFGEKPAL RSVY | FLPRSLRVV, RSLRVVDLA, VDLAANQVM, RVVDLAANQV, R SLRVVDLAA, LPRSLRVVDL | GBM |
| PODX L | c.486_487i nsC | p.S162f s | TATAKPNTTSSQNGAEDTTNSGGKS[p. S162fs]QPQCDHRPHIH* | QPQCDHRPHI, SQPQCDHRPH | GBM |
| POGZ | c.223G>T | p.G75 W | SAPVPIAAHASVAGHLSTSTTVSSS[p.G 75W]WAQNSDSTKKTLVTLIANNNAG NPLV | TSTTVSSSW, STSTTVSSSW | LUAD |
| POLA 1 | c.1809G>T | p.E603 D | PFQSHFCVVSKPKDCIFPYAFKEVI[p.E6 03D]DKKNVKVEVAATERTLLGFFLAKV HK | YAFKEVIDK, AFKEVIDKK, YAFKEVIDKK, EVIDKKNVKV | CRC |
| POLE | c.1231G>T | p.V411 L | EIGFQKDSQGEYKAPQCIHMDCLRW[p. V411L]LKRDSYLPVGSHNLKAAAKAKL GYDP | HMDCLRWLK, RWLKRDSYL, IHMDCLRWL, LRWLKRDSY, L KRDSYLPV, WLKRDSYLPV, IHMDCLRWLK, CLRWLKRDSY, HMDCLRWLKR, LRWLKRDSYL | CRC, UCEC |
| POLE | c.1376C>T | p.S459 F | YDPVELDPEDMCRMATEQPQTLATY[p. S459F]FVSDAVATYYLYMKYVHPPIFAL CTI | FVSDAVATY, ATYFVSDAV, QPQTLATYF, FVSDAVATYY, TLA TYFVSDA, ATYFVSDAVA, YFVSDAVATY, LATYFVSDAV, EQP QTLATYF, QPQTLATYFV | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| POLE | c.1718G>T | p.R573L | ESGVFRSDIPCRFRMNPAAFDFLLQ[p.R573L]LVEKTLRHALEEEKVPVEQVTNFEE | FLLQLVEKT,DFLLQLVEK,AAPDFLLQL,AAFDFLLQLV,FLLQL VEKTL,QLVEKTLRHA,LQLVEKTLRH | LUAD |
| POLE | c.857C>G | p.P286R | DDLVERPDPVVLAFDIETTKLPLKF[p.P286R]RDAETDQIMMISYMIDGQGYLITNRE | TTKLPLKFR,RDAETDQIM,KFRDAETDQI,ETTKLPLKFR,RD AETDQIMM | UCEC |
| POLM | c.290de|C | p.P97fs | EETSAEEAVSWQERRMAAAPPGCTP[p.P97fs]QLCWT* | APPGCTPQL | STAD |
| POLQ | c.2579G>A | p.R860Q | NAVPFKSARKAVDEEEEAVEERRNM[p.R860Q]QTIWVTGRKGLTEREAAALIVEARM | QTIWVTGRK,MQTIWVTGR,RNMQTIWVT,MQTIWVTGR K,NMQTIWVTGR,RNMQTIWVTG,EERRNMQTIW | CRC |
| POLR1C | c.994A>C | p.K332Q | IFSVESTGVLPPDVLVSEAIKVLMG[p.K332Q]QCRRFLDELDAVQMD* | KVLMGQCRR,VLMGQCRRF,LMGQCRRFL,VLMGQCRRFL, AIKVLMGQCR,KVLMGQCRRF,GQCRRFLDEL | KIRC |
| POLR3B | c.1114C>T | p.L372F | GDNKVDDRDYYGNKRLELAGQLLSL[p.L372F]FFEDLFKKFNSEMKKIADQVIPKQRA | LLSLFFEDL,SLFFEDLFK,LFFEDLFKK,LSLFFEDLF,FFEDLFKK F,LAGQLLSLF,AGQLLSLFF,QLLSLFFED,LSLFFEDLFK,SLFF EDLFKK,LFFEDLFKKF,ELAGQLLSLF,LAGQLLSLFF,LLSLFFE DLF | BLCA |
| POM121L12 | c.691C>A | p.P231T | GRRNLQPRPSAFKPLSKNGAVASFV[p.P231T]TRPGPLKPSLGPWSLSFCDDAWPSVL | FVTRPGPLK,GAVASFVTR,SFVTRPGPL,SFVTRPGPLK,ASF VTRPGPL,NGAVASFVTR | LUAD |
| POM121L12 | c.725C>A | p.P242H | FKPLSKNGAVASFVPRPGPLKPSLG[p.P242H]HWSLSFCDDAWPSVLVQPAPSAIWDF | SLGHWSLSF,KPSLGHWSL,PSLGHWSLSF,LKPSLGHWSL,G PLKPSLGHW | LUAD |
| PON1 | c.917G>A | p.R306Q | WVGCHPNGMKIFFYDSENPPASEVL[p.R306Q]QIQNILTEEPKVTQVYAENGTVLQGS | SEVLQIQNI,LQIQNILTE,PPASEVLQI,SEVLQIQNIL,NPPASE VLQI | UCEC |
| POP1 | c.2248de|A | p.K750fs | VASSPNGKESDLRRSEVPCAPMPKK[p.K750fs]LISHLMKWAHP* | LISHLMKWA,KLISHLMKW,KKLISHLMK,APMPKKLIS,MPK KLISHL,ISHLMKWAH,KLISHLMKWA,APMPKKLISH,MPKK LISHLM,KKLISHLMKW | STAD |
| POSTN | c.1522C>T | p.R508C | GAIHIFREIIKPAEKSLHEKLKQDKL[p.R508C]CFSTFLSLLEAADLKELLTQPGDWTL | KQDKCFSTF,CFSTFLSLL,KCFSTFLSL,KQDKCFSTFL,LKQDK CFSTF,KCFSTFLSLL | CRC |
| POTEC | c.1519A>G | p.K507E | EEQNTGISQDEILTNKQKQIEVAEK[p.K507E]EMNSELSLSHKKEEDLLRENSMLQEE | AEKEMNSEL,KEMNSELSL,KEMNSELSLS,AEKEMNSELS | GBM, PRAD |
| POTE | c.496G>A | p.V166M | DKLHRAAWWGKVPRKDLIVMLRDTD[p.V166M]MNKKDKQKRTALHLASANGNSEVVKL | MLRDTDMNKK | GBM |
| POTEE | c.862G>A | p.V288M | ADIESKNKHGLTPLLGVHEQKQQVP[p.V288M]MKFLIKKKANLNALDRYGRTALILAV | QVMKFLIKK,VMKFLIKKK,KQQVMKFLI,QQVMKFLIK,VHE QKQQVM,EQKQQVMKF,QVMKFLIKKK,KQQVMKFLIK,Q QVMKFLIKK,GVHEQKQQVM,HEQKQQVMKF | LUAD |
| POTEE | c.908G>T | p.R303I | LGVHEQKQQVKFLIKKKANLNALD[p.R303I]IYGRTALILAVCCGSASIVSLLLEQN | IYGRTALIL,DIYGRTALI,KANLNALDI,ANLNALDIY,LDIYGRT AL,ALDIYGRTAL,IYGRTALILA,KANLNALDIY,NLNALDIYGR, KKANLNALDI | UCEC |
| POTEF | c.2022G>T | p.K674N | STLREEIAMLRELDTMKHQSLRE[p.K674N]NKYLEDIESVKKRNDNLLKALQLNEL | SQLRENKYL,RENKYLEDI,KHQSQLRENK,HQSQLRENKY,N KYLEDIESV | UCEC |
| POTEF | c.334A>G | p.S112G | DDSAMKTLRNKMGKWCCHCFPCCRG[p.S112G]GSKSKVGAWGDYDDSAFMEPRYHVRG | CCRGGSKSK | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| POTEG | c.151G>A | p.D51N | KWCRHCFPWCRGSGKSNVGTSGDHD[p. D51N]NSAMKTLRSKMGKMCRHCFP WCRGSS | DNSAMKTLR, NSAMKTLRSK | SKCM |
| POTEG | c.407G>A | p.R136H | GSGKSKVGPWGDYDDSAFMEPRYHV[p. R136H]HREDLDKLHRAAWWGKVPR KDLIVML | HVHREDLDK, FMEPRYHVH, FMEPRYHVHR | GBM |
| POU2F2 | c.715A>G | p.T239A | RIKLGFTQGDVGLAMGKLYGNDFSQ[p. T239A]ATISRFEALNLSFKNMCKLKPLL FKW | ATISRFEAL, DFSQATISR, FSQATISRF, KLYGNDFSQA, SQATI SRFFA, DFSQATISRF, YGNDFSQATI | DLBCL |
| POU2F2 | c.715A>T | p.T239S | RIKLGFTQGDVGLAMGKLYGNDFSQ[p. T239S]STISRFEALNLSFKNMCKLKPLLE KW | STISRFEAL, FSQSTISRF, DFSQSTISR, DFSQSTISRF, YGNDFS QSTI, SQSTISRFEA | DLBCL |
| POU3F3 | c.961G>T | p.D321Y | GGGGGAGPGLNSHDPHSDEDTPTSD[p.D 321Y]YLEQFAKQFKQRRIKLGFTQA DVGLA | YLEQFAKQF, DEDTPTSDY, TSDYLEQFAK, DYLEQFAKQF, TP TSDYLEQF | LUAD |
| PPARGC1B | c.403del|C | p.P135fs | APPALDGGDALSCTSASPAPSSAPP[p. P135fs]ALPRRSPRPQPLRWTSSHCCRSS SWPHPTQHQALTPRRKGPPGARQASD LKVNGLVLRRTAPKTRRLP* | KVNGLVLRR, LVLRRTAPK, SSAPPALPR, RSPRPQPLR, SSHC CRSSS, HQALTPRRK, GARQASDLK, RTAPKTRRL, PALPRRSP R, TQHQALTPR, APSSAPPAL, RPQPLRWTS, WPHPTQHQA, RRSPRPQPL, SHCCRSSSW, SPRPQPLRW, ASDLKVNGLV, GL VLRRTAPK, SSAPPALPRR, VLRRTAPKTR, RTAPKTRRLP, DLK VNGLVLR, SPAPSSAPPA, SPRPQPLRWT, RPQPLRWTSS, W PHPTQHQAL, TPRRKGPPGA, SSHCCRSSSW, SDLKVNGLVL KSSHSHTRK, SSHSHTRKK, HSHTRKKHK, HTRKKHKKK, KSSHSHTRKK, HSHTRKKHKK, DSKSHSHTR | STAD |
| PPIL4 | c.1146T>A | p.S382R | PKQDTKYDLIIDEQAEDSKSSHSHT[p. S382R]RKKHKKKTHHCSEEKEDEDYMPIK NT | KSSHSHTRK, SSHSHTRKK, HSHTRKKHK, HTRKKHKKK, KSSHSHTRKK, HSHTRKKHKK, DSKSHSHTR | CLL |
| PPL | c.1362del|C | p.P454fs | GESWELMDSAGNKLIAPAVCFVIPP[p. P454fs]QTLRPWLWLTAWAASTGACG RRQLGANARCSSGMRC* | TLRPWLWLT, WLWLTAWAA, WLTAWAAST, FVIPPQTLR, C FVIPPQTL, PQTLRPWLW, NARCSSGMR, TAWAASTGA, RP WLWLTAW, RQLGANARC, ANARCSSGM, IPPQTLRPW, TLR PWLWLTA, LTAWAASTGA, CGRRQLGANA, CFVIPPQTLR, WAASTGACGR, IPPQTLRPWL, RPWLWLTAWA, RQLGANA RCS, GANARCSSGM | STAD |
| PPL | c.976C>T | p.H326Y | DWKEYLNLLICEESHLKYMEDYHQF[p.H3 26Y]YEDVKDAQELLRKVDSDLNQKY GPDF | YMEDYHQFY, KYMEDYHQFY, HQFYEDVKDA, YEDVKDAQ EL | BLCA |
| PPM1E | c.931C>T | p.R311W | IHLHVNLVRQEMFPHDPAEALCRAF[p. R311W]WVTDERFVQKAARESLRCGTT GVVTF | RAFWVTDER, AFWVTDERF, EALCRAFWV, AEALCRAFW, WVTDERFVQK, RAFWVTDERF, AEALCRAFWV | KIRC |
| PPM1H | c.678del|C | p.P226fs | NSRTLTRAASLRGGVGAPGSPSTPP[p. P226fs]HASLPRRRFPMSAWSSERLKVH SRKWTYR* | SLPRRRFPM, SAWSSERLK, ASLPRRRFP, RLKVHSRKW, KVH SRKWTY, PMSAWSSER, MSAWSSERL, FPMSAWSSE, LPRR RFPMS, HASLPRRRF, RRRFPMSAW, MSAWSSERLK, KVHS RKWTYR, STPPHASLPR, ASLPRRRFPM, SERLKVHSRK, RLKV HSRKWT, FPMSAWSSER, SPSTPPHASL, LPRRRFPMSA, RRF PMSAWSS, LKVHSRKWTY | STAD |
| PPP1R12C | c.1116del|C | p.P372fs | LSSREKISLQDLSKERRPGAGGPP[p.P 372fs]SRTRMRGKKVPPNHPLQNPEPS MASPPRRTPALRVPCSLKRPPSPGALAS* | ALRVPCSLK, PSRTRMRGK, RTRMRGKKV, RMRGKKVPP, RG KKVPPNH, ASPPRRTPA, SLKRPPSPG, SPPRRTPAL, RPPSPG ALA, KKVPPNHPL, LQNPEPSMA, SLKRPPSPGA, PSRTRMR GKK, RTRMRGKKVP, RMRGKKVPPN, MASPPRRTPA, ALRV PCSLKR, RPGGAGGPPS, HPLQNPEPSM, TPALRVPCSL, LKR PPSPGAL, GKKVPPNHPL, LQNPEPSMAS | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PPP2R1A | c.536C>G | p.P179R | CYPRVSSAVKAELRQYFRNLCSDDT[p.P1 79R]RMVRRAAASKLGEFAKVLELDNVKSE | TRMVRRAAA, RMVRRAAAS, NLCSDDTRMV, RMVRRAAAS K, RNLCSDDTRM | UCEC, UCS |
| PPP2R1A | c.547C>T | p.R183W | VSSAVKAELRQYFRNLCSDDTPMVR[p. R183W]WAAASKLGEFAKVLELDNVKSE IIPM | MVRWAAASK, DTPMVRWAA, TPMVRWAAA, VRWAAASK L, CSDDTPMVRW, MVRWAAASKL, DTPMVRWAAA, TPMV RWAAAS, WAAASKLGEF | CRC, UCS |
| PPP2R1A | c.656C>T | p.S219L | KVLELDNVKSEIIPMSNLASDEQD[p.S 219L]LVRLLAVEACVNIAQLLPQEDLEA LV | DEQDLVRLL, NLASDEQDLV, DEQDLVRLLA | UCS |
| PPP2R1A | c.767C>T | p.S256F | IAQLLPQEDLEALVMPTLRQAAEDK[p.S 256F]FWRVRYMVADKFTELQKAVGPE ITKT | KFWRVRYMV, FWRVRYRYMVA, QAAEDKFWR, RQAAEDKF W, DKFWRVRYM, KFWRVRYMVA, QAAEDKFWRV, TLRQA AEDKF, AEDKFWRVRY | UCEC |
| PPP2R2B | c.977C>T | p.P326L | SKGTIRLCDMRASALCDRHTKFFEE[p.P 326L]LEDPSNRSFFSEIISSISDVKFSHSG | RHTKFFEEL, LEDPSNRSF, ELEDPSNRSF, LEDPSNRSFF | CRC |
| PPP2R 3B | c.1165de[A | p.T389fs | RKVQKEGKISYADFVWFLISEEDKK[p.T 389fs]HRPASSTGSAAWTWTGTAPCW CSSSSTSTRSSAEGWTAWPSRPCPSRT ASARCWTWSSRGLKGRSRCRT* | WTWSSRGLK, CSSSSSTSR, STGSAAWTW, SSTSTRSSA, RTA SARCWT, SARCWTWSS, EGWTAWPSR, WTWTGTAPC, WT AWPSRPC, RPASSTGSA, RPCPSRTAS, SSAEGWTAW, KKHR PASST, ASSTGSAAW, RSSAEGWTA, AEGWTAWPS, TASAR CWTW, RTASARCWTW, SSSTSTRSSA, SARCWTWSSR, CW TWSSRGLK, SSRGLKGRSR, RGLKGRSRCR, TWSSRGLKGR, S AAWTWTGTA, RPASSTGSAA, RPCPSRTASA, SSTGSAAWT W, RSSAEGWTAW, RCWTWSSRGL, SEEDKKHRPA | STAD |
| PPP2R 3B | c.930C>A | p.F310 L | ELRRSSFLQNVALLEEEADINQLTE[p. 310L]LFSYEHFYVIYCKFWELDTDHDLLID | LTELFSYEH, NQLTELFSY, ELFSYEHFV, ADINQLTEL, TELFSYE HF, ELFSYEHFVI, LFSYEHFVYI, INQLTELFSY, ADINQLTELF, L TELFSYEHF, TELFSYEHFY | UCEC |
| PPP2R 5C | c.776C>A | p.S259 Y | GFALPLKEEHKIFLLKVLLPLHKVK[p.S 259Y]YLSVYHPQLAYCVVQFLEKDSTLTEP | YLSVYHPQL, KYLSVYHPQ, KVKYLSVYH, LPLHKVKYL, LHKVK YLSV, HKVKYLSVY, YLSVYHPQLA, LLPLHKVKYL, KYLSVYHP QL, KVKYLSVYHP, VLLPLHKVY, LHKVKYLSVY, HKVKYLSVY H | CRC |
| PPP4R 1 | c.1791G>C | p.L597 F | DSVPLLISDAVENMDSTLHYIHSDSD[p.L 597F]FSNNSSFSPDEERRTKVQDVVPQ ALL | HYIHSDSDF, SDFSNNSSF, LHYIHSDSDF | CESC |
| PPP6C | c.901C>T | p.R301 C | LVHEGYKFMFDEKLVTVWSAPNYCY[p. R301C]CCGNIASIMVFKDVNTREPKLF RAVP | CYCCGNIASI, YCCGNIASIM | SKCM |
| PPT2 | c.794G>T | p.R265 L | WQSSFPGFYDANETVLEMEEQLVYL[p. R265L]LDSFGLKTLLARGAIVRCPMAGI SHT | VLLDSFGLK, VILLDSFGL, QLVYLLDSF, MEEQLVILL, LVYLLLD SFGL, YLLDSFGLKT, LLDSFGLKTL, EQLVLLLDSF | LUAD |
| PRAM 1 | c.802G>A | p.A268 T | QPEFSEAAQTPLWKPQSSEPKRDSS[p. A268T]TFPKKASQPPLSDFPKPPQPEL GDL | RDSSTFPKK, EPKRDSSTF, SEPKRDSSTF | UCEC |
| PRAM EF11 | c.251G>C | p.C84S | KLQVLDLQDVCENFWMVWSEAMAH G[p.C84S]SFLNAKRNKTPVQDCPRMR ERQPLTV | MAHGSFLNA, SFLNAKRNK, HGSFLNAKR, EAMAHGSFL, SE AMAHGSF, AMAHGSFLNA, MAHGSFLNAK, GSFLNAKRNK, WSEAMAHGSF, SEAMAHGSFL | SKCM |
| PRAM EF11 | c.311G>A | p.R104 Q | AMAHGCFLNAKRNKTPVQDCPRMRE[p. R104Q]QQPLTVFVELMLKNRTLDEY LTCLLL | RMREQQPLT, EQQPLTVFV, REQQPLTVF, RMREQQPLTV, C PRMREQQPL, MREQQPLTVF, REQQPLTVFV | CLL |
| PRAM EF4 | c.743G>A | p.R248 H | LTQFTPYLGHMRNLQKLILSHMDVS[p. R248H]HYVSPEQKEIVTQFTTQFLKLR CLQ | LSHMDVSHY, SHMDVSHYV, VSHYVSPEQK, ILSHMDVSHY, LSHMDVSHYV | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PRAMEF8 | c.1342A>G | p.I1448V | ALCWGRFAELGAELMKTPRDLRQPK[p.I448V]VIVFCTVPCPRCGIRASYDLEPSHCL | LRQPKVIVF, TPRDLRQPKV, DLRQPKVIVF, QPKVIVFCTV | TGCT |
| PRAMEF8 | c.956G>A | p.R319H | LEMVVMTDCLLSESDLKHLSWCPSI[p.R319H]HQLKELDLRGVTLTHFSPEPLTGLLE | SWCPSIHQL, HLSWCPSIH, SWCPSIHQLK, CPSIHQLKEL, LSWCPSIHQL | PRAD |
| PRB1 | c.820del|C | p.R274fs | KPQGPPPGKPQGPPAQGGSKSQSA[p.R274fs]DLLQESHKDHPNKKATILKVPHLQQEAIPSSLRHLLLDSPRDHHALLKGADLPDLPSDSLPSHLGFNDRK* | HPNKKATIL, VPHLQQEAI, IPSSLRHLL, SPRDHHALL, LPDLPSDSL, DSLPSHLGF, SKSQSADLL, LQQEAIPSS, QQEAIPSSL, LPSDSLPSH, LQQEAIPSSL, AIPSSLRHLL, LLKGADLPDL, SADLLQESHK, SPRDHHALLK, EAIPSSLRHL, IPSSLRHLLL, LPSDSLPSHL, KKATILKVPH, LKVPHLQQEA, SDSLPSHLGF | HNSC |
| PRDM1 | c.1763C>G | p.S588C | PYPLKKQNGKIKYECNVCAKTFGQL[p.S588C]CNLKVHLRVHSGERPFKCQTCNKGFT | KTFGQLCNL, GQLCNLKVH, KTFGQLCNLK, QLCNLKVHLR, AKTFGQLCNL, GQLCNLKVHL | MM |
| PRDM16 | c.3107C>T | p.P1036L | HLCNRCFGQQTNLDRHLKKHEHENA[p.P1036L]LVSQHPGVLTNHLGTSASSPTSESDN | ALVSQHPGV, KKHEHENAL, HEHENALVS, HENALVSQH, ALVSQHPGVL, LKKHEHENAL, KKHEHENALV | LUAD |
| PRDM16 | c.811G>C | p.E271Q | RRHKKYTCGSVGAALYEGLAEELKP[p.E271Q]QLGGGSGQAHECKDCERMPNKYSL | AEELKPQGL | BLCA |
| PRDM4 | c.2404T>A | p.*802K | DSVGTEDCRINSAVYSADESLSAHK[p.*802K]KKEKKQAILDENANGKIHITSYLL* | KIHITSYLL, SAHKKKEKK, NGKIHITSY, GKIHITSYL, ILDENANGKI, SLSAHKKKEK, AILDENANGK, ANGKIHITSY, NGKIHITSYL, GKIHITSYLL | CLL |
| PRDM7 | c.1159A>C | p.M387L | GQELGIRSSIEPAESLGQAVNCWSG[p.M387L]LGMSMARNWASSGAASGRKSSWQGEN | SGLGMSMAR, QAVNCWSGL, VNCWSGLGM, CWSGLGMSM, LGMSMARNW, GQAVNCWSGL, AVNCWSGLGM, NCWSGLGMSN | PRAD |
| PRELP | c.601G>T | p.D201Y | LRLSQNHISRIPPGFVSKLENLLL[p.D201Y]YLQHNRLSDGVFKPDTPHGLKNLMQL | KLENLLLY, LLYLQHNR, LLLYLQHNRL, LENLLLYL, KLENLLLYL, LYL, LLLYLQHNRL, SKLENLLLY, LLLYLQHNR | LUAD |
| PREP | c.1407C>A | p.F469L | SKDGTKIPMFIVHKKGIKLDGSHPA[p.F469L]LLYGYGGFNISITPNYSVSRLIFVRH | KLDGSHPAL, SHPALLYGY, ALLYGYGGF, KLDGSHPALL, LLYGYGGFNI, GSHPALLYGY, LDGSHPALLY, IKLDGSHPAL | CESC |
| PREX1 | c.2191G>A | p.V731I | AKEIIKIPDQPDTLCFQIRGAAPPY[p.V731I]YAVRGSEAMAAGLCAGQCILKVNG | AAPPYIYAV, RGAAPPYIY, GAAPPYIYAV, QIRGAAPPYI, RGAAPPYIYA, IRGAAPPYIY | CRC |
| PREX1 | c.3736G>A | p.E1246K | CLEHLFNQVDSINALLKGPVMSRAF[p.E1246K]KETKHFPMNHSLQEFKQKEECTIRGR | MSRAFKETK, FKETKHFPM, RAFKETKHF, VMSRAFKETK, KGPVMSRAFK, MSRAFKETKH, AFKETKHFPM, SRAFKETKHF | UCEC |
| PREX2 | c.1088G>A | p.R363Q | WFVCMAKTPEEKHEWFEAILKERER[p.R363Q]QKGLKLGMEQDTWVMISEQGEKLYKM | ILKERERQK, RQKGLKLGM, KERERQKGL, RERQKGLKL, AILKERERQK, KERERQKGLK | BRCA |
| PREX2 | c.1686_1687insT | p.R562fs | CDNGFMHHVLEKSEFKDEPLLRFF[p.R562fs]FG* | EPLLRFFF, DEPLLRFFF | STAD |
| PRG4 | c.2023A>C | p.N675H | PTTPEEPTPTTPEEPAPTTPKAAAP[p.N675H]HTPKEPAPTTPKEPAPTTPKEPAPTT | KAAAPHTPK, APHTPKEPA | CLL |
| PRIC285 | c.3865G>C | p.E1289Q | LFWVQIVLWRQGFYYPLGIVREVLP[p.E1289Q]QASTWEQGLRILGLEYSLRVPPSDQA | IVREVLPQA, REVLPQAST, EVLPQASTW, GIVREVLPQA, QASTWEQGLR, REVLPQASTW | BLCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PRKA A2 | c.1220G>A | p.R407 Q | CPLDALNTTKPKSLAVKKAKWHLGI[p.R407Q]QSQSKPYDIMAEVYRAMKQLDF EWKV | GIQSQSKPY, KAKWHLGIQS, LGIQSQSKPY, IQSQSKPYDI | CRC |
| PRKA B1 | c.311C>A | p.P104 H | PTVFRWTGGGKEVYLSGSFNNWSKL[p.P104H]HLTRSHNNFVAILDLPEGEHQY KPFV | NWSKLHLTR, HLTRSHNNF, FNNWSKLHL, SKLHLTRSH, HLT RSHNNFV, SFNNWSKLHL, NNWSKLHLTR, LHLTRSHNNF | CLL |
| PRKA R2B | c.926C>T | p.S309 L | ERLKVVDIGTKVYNDGEQIIAQGD[p.S309L]LADSFFIVESGEVKITMKRGKSE VE | DLADSFFIV, AQGDLADSF, GDLADSFFI, AQGDLADSFF, IAQ GDLADSF, GEQIIAQGDL, GDLADSFFIV | CRC |
| PRKC D | c.1294del G | p.G432fs | FLTHLICTFQTKDHLFFVMEFLNGG[p.G432fs]T* | FVMEFLNGGT | GBM |
| PRKCE | c.470_471 insG | p.Q157fs | SSGEAPKDNEERVFRERMRPKRQG[p.Q157fs]GRQAQGPSGQRPQVHGHLSS AAHLLLPLQRLHLGCHRKAGIPVSSLHL RGPQAVPRAHNHKVCWVKEAGDPRP GGLPAVQRQHAPQVRYPQLQGPYLLR SLWVPALGTLAAGFAV* | HLSSAAHLL, YLLRSLWVP, GTLAAGFAV, QVHGHLSSA, SLHL RGPQA, LLRSLWVPA, RLHLGCHRK, AVPRAHNHK, PYLLRSL WV, LWVPALGTL, RPRKRQGGR, HNHKVCWVK, VQRQHAP QV, RQHAPQVRY, RSLWVPALG, RYPQLQGPY, WVKEAGDP R, QLQGPYLLR, SAAHLLLPL, GPSGQRPQV, RPQVHGHLS, V PRAHNHKV, DPRPGGLPA, APQVRYPQL, YPQLQGPYL, VPA LGTLAA, ALGTLAAGF, RKRQGGRQA, GQRPQVHGH, HGHL SSAAH, GHLSSAAHL, LSSAAHLL, LQRLHLGCH, CHRKAGIP V, KAGIPVSSL, LHLRGPQAV, RAHNHKVCW, PQLQGPYLL, G PYLLRSLW, LRSLWVPAL, HLSSAAHLLL, LLLPLQRLHL, SLHL RGPQAV, YLLRSLWVPA, LLRSLWVPAL, SLWVPALGTL, ALG TLAAGFA, AAHLLLPLQR, RYPQLQGPYL, RMRPRKRQGG, L QRLHLGCHR, RLHLGCHRKA, SSLHLRGPQA, HLRGPQAVPR, QAVPRAHNHK, RAHNHKVCWV, VQRQHAPQVR, VRYPQL QGPY, SSAAHLLLPL, RPQVHGHLSS, VPRAHNHKVC, DPRPG GLPAV, YPQLQGPYLL, GPYLLRSLWV, HLGCHRKAGI, GQRP QVHGHL, HGHLSSAAHL, GHLSSAAHLL, RKAGIPVSSL, AGIP VSSLHL, RQHAPQVRYP, LQGPYLLRSL, VPALGTLAAG | KIRC |
| PRKC G | c.1033C>T | p.R345 C | SSSPIPSPSPSPTDPKRCFFGASPG[p.R345C]CLHISDFSFLMVLGKGSFGKVMLA ER | CLHISDFSF, CLHISDFSFL, SPGCLHISDF, GCLHISDFSF | STAD |
| PRKCI | c.1438C>T | p.R480 C | IVGSSDNPDQNTEDYLFQVILEKQI[p.R480C]CIPRSLSVKAASVLKSFLNKDPKER L | KQICIPRSL, CIPRSLSVK, KQICIPRSLS, LEKQICIPRS | CRC |
| PRKC Q | c.971C>T | p.A324 V | GMNVHHRCQTKVANLCGINQKLMAE[p.A324V]VLAMIESTQQARCLRDTEQIF REGPV | KLMAEVLAM, LMAEVLAMI, NQKLMAEVL, AEVLAMIES, GI NQKLMAEV, KLMAEVLAMI, QKLMAEVLAM, AEVLAMIEST | UCEC |
| PRKD C | c.10702C>G | p.Q356 8E | DTSTGHKNKEFVARIKSKLDQGGVI[p.Q3568E]EDFINALDQLSNPELLFKDWSN DVRA | GVIEDFINA, GVIEDFINAL | CESC |
| PRKR A | c.366G>T | p.K122 N | NILKANASICFAVPDPLMPDPSKQP[p.K122N]NNQLNPIGSLQELAIHHGWRLPE YTL | QPNNQLNPI, KQPNNQLNPI | CRC |
| PRMT 8 | c.84del C | p.S28fs | SSRCLLLRRKMAENAAESTEVNSPP[p.S28fs]PSPSPSSLLSPCNASIMCPLNPAA QDGARCPSC* | LLSPCNASI, SIMCPLNPA, IMCPLNPAA, SPPSPSSLL, LSPCN ASIM, SLLSPCNASI, SIMCPLNPAA, LLSPCNLNPAA SSL | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PRMT8 | c.91T>C | p.S31P | SSRCLLLRRKMAENAAESTEVNSPP[p.S31P]PQPPQPVVPAKPVQCVHHVSTQPSCP | SPPPQPPQPV | BLCA |
| PRODH | c.1579C>G | p.L527V | TVRFALRRMEELGLHPADHRVYFGQ[p.L527V]VLGMCDQISFPLGQAGYPVYKVPYG | VYFGQVLGM,RVYFGQVLG,HRVYFGQVL,RVYFGQVLGM,VLGMCDQISF,QGVLGMCDQI | TGCT |
| PROKR2 | c.889G>A | p.V297I | KTVLVLMCILTAYVLCWAPFYGFTI[p.V297I]IRDFFPTVFVKEKHYLTAFVVVECIA | IIRDFFPTV,GFTIIRDFF,TIIRDFFPT,APPYGFTII,YGFTIIRDF,I RDFFPTVF,TIIRDFFPTV,FYGFTIIRDF,YGFTIIRDFF,APFYGF TIIR,FTIIRDFFPT,IIRDFFPTVF | GBM |
| PROX1 | c.1774del|T | p.F592fs | SPYSGSAMQEGLSPNHLKKAKLMFF[p.F592fs]IPVIPAPIC* | KLMFFIPVI,FIPVIPAPI,KAKLMFFIP,MFFIPVIPA,KKAKLMF FI,AKLMFFIPV,LMFFIPVIPA,FFIPVIPAPI,KAKLMFFIPV,AK LMFFIPVI | STAD |
| PROX1 | c.674T>A | p.V225D | PRESTRENKRKQKLPQQQQQSFQQL[p.V225D]DSARKEQKREERRQLKQQLEDMQKQL | SFQQLDSAR,QSFQQLDSAR | KIRC |
| PRPF31 | c.865C>T | p.R289W | STSVLPHTGYIYHSDIVQSLPPDLR[p.R289W]WKAARLVAAKCTLAARVDSFHESTEG | RWKAARLVA,DLRWKAARL,WKAARLVAA,LRWKAARLV,L PPDLRWKA,SLPPDLRWKA,QSLPPDLRWK,RWKAARLVAA, DLRWKAARLV,VQSLPPDLRW,LRWKAARLVA,LPPDLRW KAA | TGCT |
| PRPF6 | c.2288G>T | p.R763L | KCPHSTPLWLLLSRLEEKIGQLTRA[p.R763L]LAILEKSRLKNPKNPGLWLESVRLEY | QLTRALAIL,KIGQLTRAL,GQLTRALAI,ALAILEKSRL,LTRALA ILEK,KIGQLTRALA,RALAILEKSR,EKIGQLTRAL,GQLTRALAI L | LUAD |
| PRRC2C | c.5647C>A | p.P1883T | SASIPILASALASTSAPTPAPAASS[p.P1883T]TAAPVITAPTIPASAPTASVPLAPAS | AASSTAAPV,STAAPVITA,TPAPAAST,TPAPAASSTA,ASST AAPVI,TAAPVITAPT,TPAPAASSTA,APAASSTAAP,AASSTA APVI | KIRC |
| PRRX1 | c.587C>T | p.A196V | DVTAVEQPIVPRPAPRPTDYLSWGT[p.A196V]VSPYSAMATYSATCANNSPAQGINMA | LSWGTVSPY,YLSWGTVSP,TVSPYSAMA,GTVSPYSAM,TD YLSWGTV,PTDYLSWGTV,YLSWGTVSPY,VSPYSAMATY,W GTVSPYSAM | BRCA |
| PRSS1 | c.319G>A | p.D107N | EGNEQFINAAKIIRHPOYDRKTLNN[p.D107N]NIMLIKLSSRAVINARVSTISLPTAP | TLNNNIMLI,KTLNNNIML,RKTLNNNIM,KTLNNNIMLI,TLN NNIMLIK,NIMLIKLSSR,RKTLNNNIML | HNSC |
| PRSS36 | c.2038del|C | p.L680fs | LPQGHQVSRLVLISIRLPQHLGLRPP[p.L680fs]WPSWS* | GLRPPWPSW,QHLGLRPPW,PQHLGLRPPW,LGLRPPWPS W | STAD |
| PRSS57 | c.115G>C | p.E39Q | TVATAMLPVKPPAGSWGAQIIGGH[p.E39Q]QVTPHSRPYMASVRPGGQHHCGGFLL | AQIIGGHQV,QVTPHSRPY,HQVTPHSRPY,AQIIGGHQVT | LUSC |
| PSD2 | c.766del|G | p.G256fs | NVLSRLSLMAMPNGFHEDGPQGPGG[p.G256fs]MRMMMRTRTSC* | GGMRMMMRR,GMRMMMRRT,RMMMRTRT,MMMR RTRTS,MMRRTRTSC,GPGGMRMMM,PQGPGGMRM,M MMRTRTSC,GMRMMMRRTR,RMMMRTRTS,GPQGP GGMRM,PQGPGGMRMM | STAD |
| PSD3 | c.1687A>C | p.T563P | PEIAFWGSNAGVKTTRLEAHSEMGS[p.T563P]PEILEKETPENLSNGTSSNVEAAKRL | MGSPEILEK,SEMGSPEIL,EMGSPEILEK,AHSEMGSPEI | KIRC |
| PSG8 | c.1189C>T | p.R397C | FQLSGQKLFIPQITTKHSGLYACSV[p.R397C]CNSATGKESSKSMTVKVSGKRIPVSL | SVCNSATGK,GLYACSVCNS,CSVCNSATGK | CRC |
| PSG8 | c.958C>T | p.R320C | LILPSVTRNETGPYQCEIRDQYGGI[p.R320C]CSYPVTLNVLYGPDLPRIYPSFTYR | DQYGGICSY,CSYPVTLNV,QYGGICSYPV,RDQYGGICSY,GG ICSYPVTL,CSYPVTLNVL | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PSG9 | c.1210G>A | p.E404K | LFIPQITRNHSGLYACSVHNSATGK[p.E404K]KISKSMTVKVSGPCHGDLTESQS* | KISKSMTVK,SATGKKISK,KKISKSMTV,KISKSMTVKV,SVHN SATGKK | SKCM |
| PSMD11 | c.14C>T | p.A5V | MAAA[p.A5V]VVEFQRAQSLLSTDRE ASIDILHSI | MAAAVVEF,AAAVVEFQR | TGCT |
| PSMD12 | c.602G>A | p.R201Q | SMEKKERVEFIIEQMRLCLAVKDYI[p.R201Q]QTQIISKKINTKFQEENTEKLKLK Y | YIQTQISK,IQTQIISKK,KDYIQTQII,AVKDYIQTQI,YIQTQIIS KK,IQTQISKKI | CRC |
| PSME3 | c.691C>T | p.R231W | IAKYPHVEDYRRTVTEIDEKEYISL[p.R231W]WLIISELRNQYVTLHDMILKNIEKIK | SLWLIISEL,KEYISLWLI,EYISLWLII,DEKEYISLW,SLWLIISEL R,KEYISLWLII,ISLWLIISEL,DEKEYISLWL | CESC |
| PSME4 | c.1483A>G | p.N495D | GGRWFPEGPTHMLPLMRALPGPD[p.N495D]DDFSKCMITFQFIATFSTIVPL VDCS | GVDPDDFSK,LPGVDPDDF,DDFSKCMTF,DPDDFSKCMI | TGCT |
| PSPH | c.433G>A | p.V145I | IRELVSRLQERNVQVFLISGGFRSI[p.V145I]IEHVASKLNIPATNVFANRLKFYFN G | SIIEHVASK,ISGGFRSII,SIEHVASKL,LISGGFRSII,RSIIEHVA SK,GFRSIIEHVA,IEHVASKLNI | GBM |
| PTCH1 | c.2066C>A | p.P689H | LRTEYDPHTHVYYTAEPRSEISVQ[p.P689H]HVTVTQDTLSCQSPESTSSTRDLLS Q | EISVQHVTV,SEISVQHVT,SEISVQHVTV,VQHVTVTQDT | KIRC |
| PTCH1 | c.3921del|C | p.P1307fs | RQQPHLDSGSLLPPGRGQQPRRDPP[p.P1307fs]EKACGHPPTDRAETLLKFLL KGILALAIGPAGALAGPVLTTLGTQRPLP WAAPCPATASPSPL* | FLLKGILAL,LLKGILALA,ILALAIGPA,ALAIGPAGA,LLKFLLKG I,AIGPAGALA,ALAGPVLTT,ETLLKFLLK,KFLLKGILA,TQRPL PWAA,WAAPCPATA,LAIGPAGAL,RPLPWAAPC,LPWAAP CPA,LKFLLKGIL,LKGILALAI,AGALAGPVL,LAGPVLTTL,LGT QRPLPW,AETLLKFLL,ILLKFLLKGI,FLLKGILALA,LLKGILALA I,ALAIGPAGAL,ALAGPVLTTL,KFLLKGILAL,HPPTDRAETL, GPAGALAGPV,CPATASPSPL,LLKFLLKGIL,TDRAETLLKF,LK FLLKGILA,TQRPLPWAAP,LPWAAPCPAT | STAD |
| PTCHD3 | c.1764del|T | p.F588fs | KKFCCFPFGSVPDEHGTDIHPISLF[p.F588fs]LETILAPFSQGVSPSIL* | SLFLETIIA,FLETILAPF,ILAPFSQGV,DIHPISLFL,ISLFLETIL,F SQGVSPSI,SQGVSPSIL,HPISLFLET,LETILAPFS,TILAPFSQG V,LFLETILAPF,HPISLFLETI,FSQGVSPSIL | STAD |
| PTEN | c.388C>G | p.R130G | CEDLDQWLSEDDNHVAAIHCKAGKG[p.R130G]GTGVMICAYLLHRGKFLKAQE ALDFY | GTGVMICAY,GGTGVMICAY,KAGKGGTGVM | UCEC |
| PTEN | c.389G>A | p.R130Q | CEDLDQWLSEDDNHVAAIHCKAGKG[p.R130Q]QTGVMICAYLLHRGKFLKAQE ALDFY | QTGVMICAY,GKGQTGVMI,GQTGVMICAY,KAGKGQTGV M | CESC,CRC,UCEC |
| PTEN | c.389G>C | p.R130P | CEDLDQWLSEDDNHVAAIHCKAGKG[p.R130P]PTGVMICAYLLHRGKFLKAQEA LDFY | PTGVMICAY,GKGPTGVMI,GPTGVMICAY,KAGKGPTGVM | UCEC |
| PTEN | c.389G>T | p.R130L | CEDLDQWLSEDDNHVAAIHCKAGKG[p.R130L]LTGVMICAYLLHRGKFLKAQEA LDFY | LTGVMICAY,GLTGVMICA,KAGKGLTGV,GKGLTGVMI,GL TGVMICAY,KAGKGLTGVM | UCEC |
| PTEN | c.407G>A | p.C136Y | WLSEDDNHVAAIHCKAGKGRTGVMI[p.C136Y]YAYLLHRGKFLKAQEALDFYGE VRTR | GVMIYAYLL,VMIYAYLLH,RTGVMIYAY,KGRTGVMIY,VMI YAYLLHR,GVMIYAYLLH,KGRTGVMIYA,RTGVMIYAYL,GK GRTGVMIY,GRTGVMIYAY | GBM |
| PTEN | c.509G>A | p.S170N | FLKAQEALDFYGEVRTRDKKGVTIP[p.S170N]NQRRYVYYSYLLKNHLDYRPVA LLF | VTIPNQRRY,NQRRYVYY,IPNQRRYVY,GVTIPNQRRY,TIP NQRRYVY,VTIPNQRRYV,IPNQRRYVY | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PTEN | c.518G>A | p.R173H | AQEALDFYGEVRTRDKKGVTIPSQR[p.R173H]HVYYYYSYLLKNHLDYRPVALLFHKM | TIPSQRHYV,HVYYYYSYL,SQRHYVYYY,RHVYYYSY,VTIPS QRHY,IPSQRHYVY,PSQRHYVY,PSQRHYVYY,VTIPSQRH YV,RHVYYYSYL,SQRHYVYYS,GVTIPSQRH Y,TIPSQRHYV,QRHYVYYSY,IPSQRHYVY | GBM |
| PTEN | c.701G>T | p.R234L | GTCNPQFVVCQLKVKIYSSNSGPTR[p.R234L]LEDKFMYFEFPQPLPVCGDIKVEF FH | RLEDKFMYF,YSSNSGPTRL,TRLEDKFMYF,LEDKFMYFEF | LUAD |
| PTEN | c.795de1A | p.L265fs | EFPQPLPVCGDIKVEFFHKQNKMLK[p.L265fs]RTKCFTFG* | KMLKRTKCF,MLKRTKCFT,LKRTKCFTF,MLKRTKCFTF,KQN KMLKRTK,KMLKRTKCFT,NKMLKRTKCF | STAD |
| PTEN | c.830C>T | p.T277I | DIKVEFFHKQNKMLKKDKMFHFWVN[p.T277I]IFFIPGPEETSEKVENGSLCDQE IDS | KMFHFWVNI,MFHFWVNIF,FHFWVNIFF,HFWVNIFFI,K MFHFWVNIF,MFHFWVNIFF,FHFWVNIFFI | GBM |
| PTGR1 | c.119A>C | p.E40A | GYPTNSDFELKTAELPPLKNGEVLL[p.E40A]AALFLTVDPYMRVAAKRLKEGDTM MG | VLLAALFLT,LLAALFLTV,EVLLAALFL,GEVLLAALF,VLLAALF LTV,AALFLTVDPY,LKNGEVLLAA,GEVLLAALFL | TGCT |
| PTH2 | c.64C>G | p.L22V | METRQVSRSPRVRLLLLLLLL[p.L22V]VVPWGVRTASGVALPPVGVLSLRPP | LLLLLLVVV,LLLVVPWGV,LVVVPWGVR,LLLLVVVPW,RLLL LLLLLV,LLLLLLLVVV,LLLLVVPWGV,LLLVVPWGVR,LLLLLV VVPW | PRAD |
| PTPDC1 | c.1288C>T | p.R430W | AVAADFDNRGMIFSNEQQFDPLWKR[p.R430W]MNVECLQPLTHLKRRLSYSD SDLKRA | WKRWNVECL,WNVECLQPL,LWKRWNVECL,RWNVECLQ PL,QQFDPLWKRM | CRC |
| PTPN1 | c.1508G>T | p.G503V | IIREKGVDCDIDVPKTIQMVRSQRS[p.G503V]VMVQTEAQYRFIYMAVQHYIETL QRR | QMVRSQRSV,MVRSQRSVM,RSVMVQTEA,VMVQTEAQY, SQRSVMVQT,IQMVRSQRSV,SVMVQTEAQY,MVRSQRS VMV,QMVRSQRSVM | LUAD |
| PTPN1 | c.226G>A | p.E76K | VTHIKIQNTGDYDYDLYGGEKPATLA[p.E76K]KLVQYYMEHHGQLKEKNGDVIEL KYP | KLVQYYMEH,ATLAKLVQY,LAKLVQYYM,TLAKLVQYY,EKF ATLAKL,TLAKLVQYYM,ATLAKLVQY,FATLAKLVQY,GEKF ATLAKL,KLVQYYMEHH | MM |
| PTPN2 | c.2294G>A | p.R765Q | PPTFSDKREQISENPTEATDIGFGN[p.R765Q]QCGKPKGPRDPPSEWT* | IGFGNQCGK | CRC |
| PTPN3 | c.2660C>T | p.S887L | SYQHKFQLQMRARQSNQDAQDIERA[p.S887L]LFRSLNLQAESVRGFNMGRAI STGSL | RALFRSLNL,LFRSLNLQA,AQDIERALF,IERALFRSL,ALFRSL NLQA | CRC |
| PTPN13 | c.6199G>A | p.E2067K | YIQEDDIYDDSQEAEVIQSLLDVVD[p.E2067K]KEAQNLLNENNAAGYSCCPGT LKMNG | QSLLDVVDK,SLLDVVDKEA | LUAD |
| PTPN14 | c.2147_2149delAGG | p.E716del | QYHHKKTFSDATMLIHSSESEEEEE[p.E716del]APESVPQIPMLREKMEYSAQL QAALARI | SESEEEEEA | GBM |
| PTPN4 | c.856G>A | p.E286K | THNKSTILVELINKEETALFHTDDI[p.E286K]KNAKYISRLFATRHKFYKQNKICTEQ | ALFHTDDIK,HTDDIKNAK,KNAKYISRL,HTDDIKNAKY,TALF HTDDIK,DIKNAKYISR,IKNAKYISRL,KNAKYISRLF | MM |
| PTPN18 | c.1113_1118de1GACGG | p.TG378del | TYAVVQKRGAPAGAGSGTQTGTGT[p.TG378de1]ARSAEEAPLYSKVTPRAQ RPGAHAEDARGTL | QTGTGTGAR | UCS |
| PTPN4 | c.957de1T | p.N319fs | NLWKACVEHHTFFRLLDRPLPPQKNF[p.N319fs]LHIILH* | QKNFLHIIL,RPLPPQKNFL,LPPQKNFLHI | STAD |
| PTPRB | c.2178A>T | p.Q726H | SLTPGRLYTVTITTRSGKYENHSFS[p.Q726H]ERTVPDKVQGVSVSNSARSDYL RVS | HSFSHERTV,ENHSFSHER,FSHERTVPDK,GKYENHSFSH | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| PTPRB | c.4678G>A | p.D156 0N | ENPNSNSKSFNIKLGAEMESLGGKC[p. D1560N]NPTQQKFCDGPLKPHTAYRIS IRAFT | KCNPTQQKF, GGKCNPTQQK, GKCNPTQQKF | SKCM |
| PTPRC | c.2685A>C | p.Q895 H | GLEAENKVDVYGYVVKLRRQRCLMV[p. Q895H]HVEAQYILIHQALVEYNQFGET EVNL | RQRCLMVHV, LMVHVEAQY, MVHVEAQYI, VHVEAQYIL, L MVHVEAQY, RQRCLMVHE, CLMVHVEAQY, MVHVEAQ YIL | STAD |
| PTPRF | c.3521G>A | p.R117 4Q | PRWSTPEELELDELLEAIEQGEEQ[p.R 1174Q]QRRRRQAERLKPYVAAQLDVL PETFT | EQQRRRQA, QQRRRRQAER | PRAD |
| PTPRJ | c.1000G>T | p.G334 W | HDESLVGPVDPSSGQQSRDTEVLLV[p. G334W]WLEPGTRYNATVYSQAANGT EGQPQA | LVWLEPGT, RDTEVLLVW, VWLEPGTRY, VLLVWLEPGT, WLEPGTRYNA, LVWLEPGTRY, RDTEVLLVWL | LUAD |
| PTPRT | c.2783G>T | p.R928 L | SWDTAKEDENRNKNRYGNIISYDHS[p. R928L]LVRLLVLDGDPHSDYINANYIDG YHR | IISYDHSLV, NIISYDHSL, ISYDHSLVR, SYDHSLVRLL, HSLVRLL VL, YDHSLVRLL, NIISYDHSLV, IISYDHSLVR, SYDHSLVRLL, IS YDHSLVRL, YDHSLVRLLV | LUAD |
| PTPRT | c.3224de|C | p.P107 5fs | WPDHGVPCYATGLLGFVRQVKFLNP[p. P1075fs]RKLGP* | RQVKFLNPR, QVKFLNPRK, VKFLNPRKL, RQVKFLNPRK | STAD |
| PTPR U | c.1675C>T | p.P559 S | VNVPGPRRTISKLRNETYHVFSNLH[p. P559S]SGTTYLFSVRARTGKFGQAALT EIT | NLHSGTTYL, LHSGTTYLF, SNLHSGTTY, FSNLHSGTTY, NLHS GTTYLF, SGTTYLFSVR, HVFSNLHSGT, HSGTTYLFSV, SNLHS GTTYL | LUAD |
| PTPR U | c.4300G>A | p.D143 4N | FFAAKTLRNYKPNMVETMDQYHFCY[p. D1434N]NVALEYLEGLESR* | CYNVALEYL, FCYNVALEY, DQYHFCYNV, YHFCYNVAL, QYH FCYNVAL, HFCYNVALEY, NVALEYLEGL, DQYHFCYNVA, MD QYHFCYNV | CRC |
| PUF60 | c.1187C>T | p.S396 L | VMAAQAPGVITGVTPARPPIPVTIP[p.S 396L]LVGVVNPILASPPTLGLLEPKKEKE E | VTIPLVGV, PLVGVVNPI, PPIPVTIPL, RPPIPVTIPL, IPLVGV VNPI, PPIPVTIPLV, IPVTIPLVGV | BLCA |
| PVRL4 | c.1072G>A | p.A358 T | LDPQEDSGKQVDLVSASVVVGVIA[p. A358T]TLLFCLLVVVVVMSRYHRRKA QQMT | VIATLLFCL, ATLLFCLLV, TLLFCLLVV, VVVGVIATL, VGVIATL LF, GVIATLLFCL, VIATLLFCLL, ATLLFCLLVV, TLLFCLLVVV, V VVGVIATLL, VVGVIATLLF | UCEC |
| PWW P2B | c.251de|C | p.S84fs | PVNDSHGRAPEEGDAEVMQLGSSSP[p. S84fs]LLPAGFSPPRPPAPSHPRPSCRR CPPEACPRTLPTSKAPPSLTRCGSGTRTS CGCPSRRPGPSSARGGVCPATATRGAS SSAPSACGRARCSVRSARAR* | MQLGSSSPL, QLGSSSPLL, RTSCGCPSR, GVCPATATR, SSAP SACGR, GFSPPRPPA, LTRCGSGTR, SARGGVCPA, ATRGASS SA, CGRARCSVR, RARCSVRSA, TSCGCPSRR, APSHPRPSC, H PRPSCRRC, RPSCRRCPP, GPSSARGGV, CPATATRGA, LPAG FSPPR, VMQLGSSSPL, MQLGSSSPLL, TSKAPPSLTR, RTSCG CPSRR, SSSAPSACGR, AGFSPPRPPA, RTLPTSKAPP, GTRTS CGCPS, PSRRPGPSSA, RGASSSAPSA, RARCSVRSAR, SSSPLL PAGF, LLPAGFSPPR, RPSCRRCPPE, CPRTLPTSKA, LPTSKAP PSL, CPATATRGAS | STAD |
| PXDN L | c.3935C>T | p.T131 2M | IPKVDLRVWQDCCADCRSRGQFRAV[p. T1312M]MQESQKKRSAQYSYPVDKD MELSHLR | RAVMQESQK, AVMQESQKK, SRGQFRAVM, RSRGQFRAV M, RAVMQESQKK, GQFRAVMQES | CRC |
| PXDN L | c.4366C>A | p.P145 6T | CPPAPCPSPELVKGTCCPVCRDRGM[p. P1456T]TSDSPEK* | GMTSDSPEK, MTSDSPEKR, RGMTSDSPEK | LUAD |
| PYGO 2 | c.448de|C | p.Q150 fs | GPQPLRRQPPPFPPNPMGPAFNMPP[p. Q150fs]RVLATHPQAT* | NMPPRVLAT, VLATHPQAT, RVLATHPQA, MPPRVLATH, AF NMPPRVLA, RVLATHPQAT, MGPAFNMPPR, GPAFNMPPR V | STAD |
| PYHIN 1 | c.443G>C | p.G148 A | NRLTAKGAEETLGPQKRKKPSEEET[p. G148A]ATKRSKMSKEQTRPSCSAGASTS TAM | ATKRSKMSK, TATKRSKMSK | LUSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| QRSL1 | c.677C>T | p.S226L | AHCGLVGFKPSYGLVSRHGLIPLVN[p.S226L]LMDVPGILTRCVDDAAIVLGALAGPD | GLIPLVNLM,NLMDVPGIL,IPLVNLMDV,NLMDVPGILT,LV NLMDVPGI | CRC |
| QSOX1 | c.1202G>T | p.R401L | DDRKEGAVLAKKVNWIGCQGSEPHF[p.R401L]LGFPCSLWVLFHFLTVQAARQ NVDHS | HFLGFPCSL,CQGSEPHFL,GSEPHFLGF,EPHFLGPC,FLGFP CSLWV,HFLGFPCSLW,QGSEPHFLGF,LGFPCSLWVL,SEPH FLGFPC | LUAD |
| QSOX2 | c.2048G>T | p.R683L | SLDMSLCVVLTVASSLFLMVMYFFF[p.R683L]LVRSRRWKVKHHHPAV* | LMVMYFFFL,MVMYFFLV,VMYFFFLVR,FLVRSRRWK,FFL VRSRRW,LVRSRRWKV,YFFFLVRSR,FFFLVRSRR,FLMVMY FFFL,LMVMYFFFLV,FLVRSRRWKV,MVMYFFFLVR,FFFLV RSRRW,MYFFFLVRS,FFLVRSRRWK,LVRSRRWKVK,YFFF LVRSRR | LUAD |
| R3HDM2 | c.1763G>A | p.S588N | MPNQQQAAYQGMIGVQQPQNQCLL S[p.S588N]NQRSSMGGQMGQLVVQY TPLPSYQVP | LLSNQRSSM,NQRSSMGGQM,GLLSNQRSSM | CLL |
| R3HDM2 | c.1774A>G | p.S592G | QQAAYQGMIGVQQPQNQGLLSSQRS[p.S592G]GMGGQMQGLVVQYTPLPSY QVPVGSD | GMGGQMQGL,LLSSQRSGM,QRSGMGGQM,GMGGQM QGLV,SQRSGMGGQM,GLLSSQRSGM | CLL |
| R3HDM2 | c.616C>T | p.R206W | EFINDNNQFKKFPQQMTSYHRMLLH[p.R206W]WVAAYFGMDHNVDQTGKA VIINKTSN | RMLLHWVAA,MLLHWVAAY,SYHRMLLHW,HWVAAYFG M,LLHWVAAYF,HRMLLHWVA,MLLHWVAAYF,RMLLHW VAAY,SYHRMLLHWV,YHRMLLHWVA,TSYHRMLLHW,HR MLLHWVAA,LHWVAAYFGM | CLL |
| RAB11 FIP4 | c.1787C>T | p.S596L | SLYEAKNLFAAQTKAQSLAAEIDTA[p.S596L]LRDELMEALKEQEEINFRLRQYM DKI | ALRDELMEA,LAAEIDTAL,SLAAEIDTAL,ALRDELMEAL,LAA EIDTALR | BLCA |
| RAB11 FIP5 | c.509G>A | p.R170H | WYKLHSKPGKKEKERGEIEVTIQFT[p.R170H]HNNLSASMFDLSMDKPRSPFS KIRD | IEVTIQFTH,IQFTHNNLS,THNNLSASM,HNNLSASMF,IQFT HNNLSA,FTHNNLSASM,VTIQFTHNNL,THNNLSASMF | GBM |
| RAB13 | c.500G>T | p.R167L | EHGIRFPETSAKSSMNVDEAFSSLA[p.R167L]LDILLKSGGRRSGNGNKPPSTDLK TC | SLALDILLK,DEAFSSLAL,FSSLALDIL,SSLALDILLK,EAFSSLAL DI,VDEAFSSLAL | LUAD |
| RAB7L1 | c.235C>T | p.R79W | YEIVRLQLWDIAGQERFTSMTRLYY[p.R79W]WDASACVIMFDVTNATTFSNSQ RWKQ | RLYYWDASA,TSMTRLYYW,YYWDASACV,MTRLYYWDA, WDASACVIM,SMTRLYYWDA,RLYYWDASAC,FTSMTRLYY W,LYYWDASACV,YYWDASACVI,MTRLYYWDAS,YWDAS ACVIM,WDASACVIMF | CRC |
| RAB8A | c.58G>T | p.G20W | MAKTYDYLFKLLLIGDSGV[p.G20W]W KTCVLFRFSEDAFNSTFISTIGIDF | LLIGDSGVWK,GVWKTCVLF,VWKTCVLFR,LLIGDSGVW,W KTCVLFRF,GVWKTCVLFR,SGVWKTCVLF,VWKTCVLFRF,L LLIGDSGVW | LUAD |
| RABGAP1 | c.2782_2783insA | p.K928fs | LEEESAQLKEMCRRELDKAESEIKK[p.K928fs]KQFYHW* | SEIKKKQFY,IKKKQFYHW,AESEIKKQF | STAD |
| RABGAP1 | c.2782delA | p.K928fs | LEEESAQLKEMCRRELDKAESEIKK[p.K928fs]TVLSLVTISRFVLS* | SLVTISRFV,KTVLSLVTI,VLSLVTISR,EIKKTVLSL,LSLVTISRF, KKTVLSLVT,AESEIKKTV,SLVTISRFVL,TVLSLVTISR,EIKKTV LSLV,VLSLVTISRF,AESEIKKTVL,SEIKKTVLSL,KKTVLSLVTI RLQSDIQYI,LQSDIQYIT,SDIQYITRF,QSDIQYITRF | STAD |
| RABGEF1 | c.619A>G | p.N207D | PASADDFLPTLIYIVLKGNPPRLQS[p.N207D]IQYITRFCNPSRLMTGEDGYYFT NL | RTVFDNYSA,YIRTVFDNY,NAFPGEYIR,FPGEYIRTV,FPGEYI RTVF | TGCT |
| RAC1 | c.101C>G | p.P34R | VGDGAVGKTCLLISYTTNAFPGEYI[p.P34R]RTVFDNYSANVMDGKPVNLGLM DTA | | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| RAC1 | c.476C>T | p.A159V | LTPITYPQGLAMAKEIGAVKYLECS[p.A159V]VLTQRGLKTVFDEAIRAVLCPPPVKK | AVKYLECSV, SVLTQRGLK, KYLECSVLT, VKYLECSVL, VLTQRGLKTV, CSVLTQRGLK, AVKYLECSVL | HNSC |
| RAC1 | c.85C>T | p.P29S | IKCVVVGDGAVGKTCLLISYTTNAF[p.P29S]SGEYIPTVFDNYSANVMDGKPVNLG | TTNAFSGEY, FSGEYIPTV, SGEYIPTVF, YTTNAFSGEY, TTNAFSGEYI, FSGEYIPTVF | SKCM |
| RAD50 | c.205G>T | p.D69Y | TIIECLKYICTGDFPPGTKGNTFVH[p.D69Y]YPKVAQETDVRAQIRLQFRDVNGELIRDFTNIYWSQNRPDVKKQLQNDKK[p.T316fs]L* | GNTFVHYPK, NTFVHYPKV, TFVHYPKVA, KGNTFVHYPK, G TKGNTFVHY, NTFVHYPKVA, YPKVAQETDV KQKLQNDKKL | LUAD |
| RAD51AP2 | c.946del|A | p.T316fs | RDFTNIYWSQNRPDVKKQLQNDKK[p.T316fs]L* | | STAD |
| RAD51C | c.499G>A | p.D167N | VQIPECFGGVAGEAAVFIDTEGSFMV[p.D167N]NRVVDLATACIQHLQLIAEKHKGEEH | FMVNRVVDL, MVNRVVDLA, EGSFMVNRV, FMVNRVVDL A, SFMVNRVVDL, DTEGSFMVNR, TEGSFMVNRV | BLCA |
| RAD51C | c.670T>C | p.Y224H | FTLDNILSHIYYFRCRDYTELLAQV[p.Y224H]HLLPDFLSEHSKVRLVIVDGIAFPFR | ELLAQVHLL, AQVHLLPDF, TELLAQVHL, AQVHLLPDFL, LAQ VHLLPDF, HLLPDFLSEH, TELLAQVHLL | BLCA |
| RAF1 | c.770C>T | p.S257L | YSTPHAFTENTSSPSSEGSLSQRQR[p.S257L]LTSTPNVHMVSTTLPVDSRMIEDAIR | RQRLTSTPN, LTSTPNVHM, SQRQRLTST, RLTSTPNVH, LIST PNVHM, RQRLTSTPNV, RLTSTPNVHM, SQRQRLTSTP | CRC |
| RALGAPA1 | c.1192C>T | p.R398C | LTEREPSSSSLCSIDEEHLTDIEIV[p.R398C]CRVFSSKRSNVNFVTEIFRQAFLLPI | IVCRVFSSK, LTDIEIVCRV, EIVCRVFSSK, IVCRVFSSKR, HLTDI EIVCR, TDIEIVCRVF, IEIVCRVFSS | CRC |
| RALGAPB | c.1136del|C | p.T379fs | RSDSAPPTPVNRLSMPQSAAVSTTP[p.T379fs]HITGGTGLL* | TTPHITGGT, SAAVSTTPH, AAVSTTPHI, TPHITGGTGL, SAAV STTPHI | STAD |
| RALGPS1 | c.1142G>A | p.R381Q | SKSATFPSEKARHLLDDSVLESRSP[p.R381Q]QRGLALTSSSAVTNGLSLGSSESSEF | RSPQRGLAL, SVLESRSPQR, LESRSPQRGL, SRSPQRGLAL | BLCA |
| RANBP17 | c.2700G>T | p.M900I | HSDLLQYRKLSQSYYPLLECLTQDH[p.M900I]SFIINLEPPVLMVLTSISEGLITTL | LTQDHISFI, CLTQDHISF, TQDHISFII, CLTQDHISFI, LLECLTQ DHI, LTQDHISFII, QDFIISFIINL | TGCT |
| RANBP2 | c.3691C>T | p.R1231C | VESKEWKERGIGNVKILRHKTSGKI[p.R1231C]CLLMRREQVLKICANHYISPDMKLTP | KTSGKICLL, CLMRREQV, SGKICLLMR, HKTSGKICL, TSGKIC LLMR, KTSGKICLLM, SGKICLLMR, CLLMRREQVL, RHKTSG KICL, HKTSGKICLL | CRC |
| RANBP3 | c.1157T>G | p.L386W | EATPEKESLAESAAAYTKATARKCL[p.L386W]WEKVEVITGEEAESNVLQMQCKLFVF | CLWEKVEVI, TARKCLWEK, KATARKCLW, ATARKCLWEK | KIRC |
| RANBP6 | c.2743C>T | p.R915W | QWGLCIFDDIIEHCSPTSFKYVEYF[p.R915W]WPMLLNMRDNNPEVRQAAAYGLGVM | YVEYFWPM, SPKYVEYFW, KVVEYFWPM, EYFWWPMLL, FWWPMLLNM, FKYVEYFWW, VEYFWWPML, YVEYFWW PML, SPKYVEYFWW, KVVEYFWPM, VEYFWWPMLL, YF WWPMLLNM, FWWPMLLNMR, TSFKYVEYFW | CESC |
| RANBP6 | c.2950A>C | p.I984L | LVKVIKCANSKTKNVIATENCISA[p.I984L]LGKILKFKPNCVNVDEVLPHWLSWLP | ISALGKILK, ALGKILKFK, SALGKILKF, TENCISALG, CISALGKIL K, SALGKILKFK, IATENCISAL, ISALGKILKF | LUSC |
| RAPGEFL1 | c.1067G>T | p.R356L | LPGKFKNLFRKFPENLTDPCRNHKSY[p.R356L]LEVISKMKPPVIPFVPLLIKDLTFLHP | KSYLEVISK, SYLEVISKM, RNHKSYLEV, KSYLEVISKM, SYLEVI SKMK, RNHKSYLEV | LUAD |
| RARS2 | c.16C>T | p.R6C | MACGF[p.R6C]CRAIACQLSRVLNLPPENLITSISAV | MACGFCRAI | BLCA |
| RASAL3 | c.245G>A | p.R82H | VSTQPAPRSIFRRVLSAPPKKESRTS[p.R82H]HLRLSKALWGRHKNPPEPDPEPEQE | RTSHLRLSK, TSHLRLSKA, SHLRLSKAL, HLRLSKALW, RTSHL RLSKA, HLRLSKALWG, KESRTSHLRL, SHLRLSKALW | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| RASGEF1C | c.562G>A | p.A188T | LAALRQQSPEGLVGADKPISYRTKPP[p.A188T]TSIHRELLGVCSDPYTLAQQLTHVEL | SYRTKPPTS,RTKPPTSIH,YRTKPPTSI,SYRTKPPTSI,RTKPPTSIHR,TSIHRELLGV,KPPTSIHREL | KIRC |
| RASIP1 | c.1801C>T | p.R601C | ATLLALCVQHSARELELGHLPRLLG[p.R601C]CLARLIKEAVWEKIKEIGDRQPENHP | RLLGCLARL,HLPRLLGCL,LLGCLARLI,CLARLIKEA,LPRLLGCLA,RLLGCLARLI,CLARLIKEAV,HLPRLLGCLA,LLGCLARLIK | ACC |
| RB1 | c.948_951del|TCTT | p.N316fs | FKNFIPFMNSLGLVTSNGLPEVENL[p.N316fs]NDTKKFILKIKI* | KKFILKIKI,DTKKFILKIK,VENLNDTKKF | GBM |
| RBBP4 | c.988G>A | p.E330K | NLKLKLHSFESHKDEIFQVQWSPHN[p.E330K]KTILASSGTDRRLNVWDLSKIGEQS | QVQWSPHNK,SPHNKTILA,VQWSPHNKT,FQVQWSPHNK,SPHNKTILAS,VQWSPHNKTI | LAML |
| RBBP7 | c.820G>A | p.E274K | QKLIMWDTRSNTTSKPSHLVDAHTA[p.E274K]KVNCLSFNPYSEFILATGSADKTVAL | LVDAHTAKV,HLVDAHTAK,HTAKVNCLS,TAKVNCLSF,HLVDAHTAKV,KVNCLSFNPY,HTAKVNCLSF | CRC |
| RBBP7 | c.937G>A | p.E313K | LATGSADKTVALWDLRNLKLKLHTF[p.E313K]KSHKDEIFQVHWSPHNETILASSGTD | KLHTFKSHK,KLKLHTFKS,LKLHTFKSH,FKSHKDEIF,NLKLKLHTFK,KLKLHTFKSH,KSHKDEIFQV,HTFKSHKDEI | CRC |
| RBFOX2 | c.1018G>A | p.A340T | NTYIPLISLPLVPGFPYPTAATTAA[p.A340T]TFRGAHLRGRGRTVGAVRAVPPTAI | ATPRGAHLR,AATTAATFR,TTAATFRGA,TAATTAATF,TAATTAATFR,TFRGAHLRGR,AATFRGAHLR,YPTAATTAAT,PTAATTAATF | CRC |
| RBL2 | c.379G>A | p.E127K | VSKGTVEGNYVSLTRILKCSEQSLI[p.E127K]KFFNMKKWEDMANLPPHFRERTERL | SLIKFFNKM,QSLIKFFNK,LIKFFNKMK,KFFNKMKKW,CSEQSLIKF,SEQSLIKFF,SLIKFFNKMK,LIKFFNKMKK,EQSLIKFFNK,KCSEQSLIKF,IKFFNKMKKW | UCEC |
| RBM14 | c.856_876del|GCTGCTGCTGCAGCAGCAGCC | p.AAAAAAA286del | LTSTSLDPYDRHLLPTSGAAATAAA[p.AAAAAAA286del]|VTAASTSYYGRDRSPLRRATAPVPTVGEGYGYGHESELSQASAAAR | GAAATAAAV,ATAAAVTAA,TAAAVTAAS,SGAAATAAAV,TAAAVTRAST | PAAD |
| RBM19 | c.1168G>T | p.G390W | FREKNVPTTKGAPKNTTKSWQGRIL[p.G390W]WENEEEEDLAESGRLFVRNLPYTSTE | KSWQGRILW,WENEEEEDL,TKSWQGRILW | LUAD |
| RBM26 | c.1930C>G | p.P644A | TTSPKPLVQQPILPVVKQSVKERLG[p.P644A]|AVPSSTIEPAEAQSASSDLPQNVTKL | SVKERLGAV,KERLGAVPS,LGAVPSSTI,RLGAVPSSTI,KERLGAVPSS | BLCA |
| RBM39 | c.1058C>T | p.T353I | ERTDASSASSFLDSDELERTGIDLG[p.T353I]TGRLQLMARLAEGTGLQIPPAAQQA | LGITGRLQL,ITGRLQLMAR,LERTGIDLGI,LGITGRLQLM | UCEC |
| RBM47 | c.1485_1505del|GGCCGCAGCCGCCCAGCGCGCAGCCGC | p.495_502AAAAAAAA>A | HTVEHMISPIAVQPDPASAAAAAAA[p.495_502AAAAAAAA>A]|VIPTVSTPPFQGRPITPVYTVAPNVQRIPTAGIYGASYVPPAAPA | ASAAAAAAAV,SAAAAAAAVI | PAAD |
| RBM6 | c.2024T>G | p.V675G | RQDGESKTIMLKRIYRSTPPEVIVE[p.V675G]GLEPYVRLTTANVRIIKNRTGPMGHTSYGARDGPHGDYRGGEGPGHDFRGGI | VIVEGLEPY,VIVEGLEPYV,EVIVEGLEPY | MM |
| RBM6 | c.287_288insG | p.R96fs | R96fs|RFFVF* | FRGGRFFVF,HDFRGGRFF,DFRGGRFFVF,HDFRGGRFFV | STAD |
| RCL1 | c.335C>A | p.P112Q | HDCSVLRGIGYYLESLLCLAPFMKH[p.P112Q]|QLKIVLRGVTNDQVDPSVDVLKATAL | FMKHQLKIV,QLKIVLRGV,PFMKHQLKI,APPMKHQLK,MKHQLKIVL,CLAPFMKHQL,HQLKIVLRGV,FMKHQLKIVL,LAPFMKHQLK,APFMKHQLKI | LUAD |
| RDH8 | c.593C>T | p.A198V | LLQFNIFISLVEPGPVVTEFEGKLL[p.A198V]|VQVSMAEFPGTDPETLHYFRDLYLPA | KLLVQVSMA,LVQVSMAEF,TEFEGKLLV,GKLLVQVSM,FEGKLLVQV,VTEFEGKLLV,LLVQVSMAEF,VQVSMAEFPG,TEFEGKLLVQ,FEGKLLVQVS | GBM |
| REG1B | c.170G>T | p.W57L | PRISCPEGTNAYRSYCYYFNEDPET[p.W57L]|LVDADLYCQNMNSGNLVSVLTQAEGA | ETIVDADLIY,YFNEDPETL,YYFNEDPETL | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|------|-------------|----------------|-----|-----|-----|
| REG1B | c.201G>T | p.M67I | AYRSYCYFNEDPETWVDADLYCQN[p. M67I]INSGNLVSVLTQABGAFVASLIKESS | CQNINSGNL,NINSGNLVSV,CQNINSGNLV,INSGNLVSVL | LUSC |
| REG3A | c.449C>T | p.S150L | SDVMNYFAWERNPSTISSPGHCASL[p. S150L]LRSTAFLRWKDYNCNVRLPYVCKFTD | SLLRSTAFL,LLRSTAFLR,SPGHCASLL,ASLLRSTAF,LRSTAFLRW, SLLRSTAFLR,ASLLRSTAFL,CASLLRSTAF,LLRSTAFLRW | LUAD |
| REG4 | c.329G>T | p.G110V | GYQRSQPIWIGLFIDPQKRQQWQWID[p. G110V]VAMYLYRSWSGKSMGGNKHCAEMSSN | WIDVAMYLY,QWIDVAMYL,WQWIDVAMY,RQQWQWID V,QQWQWIDVA,QWQWIDVAM,VAMYLYRSW,WQWID VAMYL,WIDVAMYLYR,QWQWIDVAMY,QWIDVAMYLY,QQW QWIDVAM,RQQWQWIDVA | LUAD |
| REN | c.45_47 del|GCT | p.15_16 LL>L | MDGWRRMPRWGLLLL[p.15_16|LL>L] WGSCTFGLPTDTTTFKRIFLKRMPSIRE | MPRWGLLLLW | GBM |
| RERE | c.528G>C | p.K176N | PACSLPVASQPPQHLSEAGRGPVGS[p. K176N]NRDHLLMNVKWYYRQSEVPDSVYQHL | GSNRDHLLM,AGRGPVGSNR,GPVGSNRDHL | BLCA |
| REV3L | c.88G>T | p.A30S | RIVTADYYMASPLQGLDTCQSPLTQ[p. A30S]SPVKKVPVVRVFGATPAGQKTCLHIH | SPVKKPVV,CQSPLTQSP,CQSPLTQSPV,TQSPVKKVPV | TGCT |
| RFC3 | c.245T>A | p.I82N | RELYGVGVEKLRIEHQTITTPSKKK[p.I82 N]NEISTIASNYHLEVNPSDAGNSDRVV | TPSKKKNEI,KKKNEISTI,KKNEISTIA,NEISTIASNY, SKKKNEISTI | TGCT |
| RFC3 | c.888G>T | p.K296N | LLEVRGRLYELLTHCIPPEIIMKAC[p.K29 6N]NEESRSCDIF* | IMKACNEESR,NEESRSCDIF | TGCT |
| RGMB | c.187A>C | p.S63R | AWTGMGLRAAPSSAAAAAEVEQRR[p.S63R] RPGLCPPPLELLLLLLFSLGLLHAGD | RPGLCPPPL,VEQRRRPGL,RRPGLCPPPL | ACC |
| RGS6 | c.1097G>T | p.W366L | LKDQVGRDQFLRFLESEFSSENLRF[p. W366L]LLAVQDLKKQPLQDVA | FLLAVQDLK,LLAVQDLKK,RFLLAVQDL,FSSENLRFL,SENLR FLLA,FLLAVQDLKK,RFLLAVQDLKK,FSSENLRFLL,SENLRFLL AV,LRFLLAVQDL | LUSC |
| RGS7 | c.130C>T | p.R44C | PNMLVYRKMEDVIARMQDEKNGIPI[p. R44C]CTVKSFLSKIPSVFSGSDIVQWLIKN | CTVKSFLSK,IPICTVKSF,KNGIPICTVK,CTVKSFLSKI,IPICT-VKSFL | SKCM |
| RGS9BP | c.286G>T | p.A96S | ERAEFERLWVAFSGCLDLLEADMRR[p. A96S]SLELGAAFPLHAPRRPLVRTGVAGAS | RSLELGAAF,LEADMRRSL,ADMRRSLEL,SLELGAAFPL,RRSLELGAAF | ACC |
| RGSL1 | c.664G>A | p.V222I | HTKMTMAKEERACHGLMQEYETRLYS[p.V 222I]CYTHIGGLPLNMSIKKCHHFQKRYS | RLYSICYTH,EYETRLYSI,LYSICYTHI,ETRLYSIC,YETRLYSICY, RLYSICYTFHI,SICYTHIGGL,QEYETRLYSI,YETRLYSICY | BRCA |
| RHBDD3 | c.101_102 insG | p.G34fs | SPALPLASSVLMLLMSTLWLVGAGP[p. G34fs]RPGPGPGAVAGPLAGAPAADP CPGPHGAPARPAPEPAAPAHCGLAAGV PPGHAEIPACLSPARPGFWAAGSAAGR PWAVQCSRQLWIHACPPGHAGWGGTPP* | AVAGPLAGA,GLAAGVPPG,EIPACLSPA,SAAGRPWAV,CS RQLWIHA,WAAGSAAGR,RPWAVQCSR,GPRPGPGPG,RP GPGPGAV,GPGAVAGPL,GPLAGAPAA,GPHGPARPA,APA HCGLAA,SPARPGFWA,CLSPARPGF,AEIPACLSP,GFWAA GSAA,AGSAAGRPW,WAVQCSRQL,VQCSRQLWI,RQLWIHACP,WIH ACPPGHA,TLWLVGAGPR,GPRPGPGPGA,RPGPGPGAVA,GPARPAPE PA,RPAPEPAAPA,SPARPGFWAA,RPGFWAAGS A,AEIPACLSPA,ACLSPARPGF,AAGSAAGRPW,WAVQCSRQLW, RQLWIHACPP,HACPPGHAGW | KICH |
| RHEB | c.103T>A | p.Y35N | AILGYRSVGKSSLTIQFVEGQFVDS[p.Y3 5N]NDPTIENTFTKLITVNGQEYHLQLVD | FVDSNDPTI,GQFVDSNDPT,SNDPTIENTF | KIRC |
| RHOA | c.118G>C | p.E40Q | ACGKTCLLIVFSKDQFPEVVPTVF[p.E4 0Q]QNVADIEVDGKQVELALWDTAGQED | VFQNYVADI,VVVPTVFQNY,VPTVFQNYV,F QNYVADIEV,VVVPTVFQNY,TVFQNVADI,VPTVFQNYVA | HNSC |
| RHOA | c.125A>G | p.Y42C | GKTCLLIVFSKDQFPEVYPTVFEN[p.Y4 2C]CVADIEVDGKQVELALWDTAGQEDYD | VPTVFENCV,VVVPTVFENC,TVFENCVADI,CVADIEVDGK, VVVPTVFENC,FENCVADIEV | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| RHOBTB1 | c.1391C>T | p.T464M | VLEMFDLRMMVENIMNKEAFMNQEI[p.T464M]MKAFHVRKANRIKECLSKGTFSDVTF | FMNQEIMKA,IMKAFHVRK,AFMNQEIMK,EIMKAFHVR, MNQEIMKAF,MKAFHVRKA,EAFMNQEIM,QEIMKQFHV, FMNQEIMKAF,IMKAFHVRKA,EAFMNQEIMK,EIMKAFHVRK, KEAFMNQEIM | CRC |
| RHPN2 | c.217G>A | p.V73M | LKAVRMRTGAENLLKVATNSKVREQ[p.V73M]MRLELSFVNSDLQMLKEELEGLNISV | QMRLELSFV,KVREQMRLE,NSKVREQMR,EQMRLELSF,SK VREQMRL,VREQMRLEL,REQMRLELS,EQMRLELSFV,KVR EQMRLEL,REQMRLELSF | TGCT |
| RILPL1 | c.1074C>A | p.S358R | RIPQPPIAHPRTSPQPESGIKRLF[p.S358R]RFFSRDKKRLANTQRNVHIQ ESFGQW | SGIKRLRFF,GIKRLRFFR,KRLFRFFSR,LFRFFSRDK,ESGIKRLF R,RFFSRDKKR,RLFRFFSRDK,SGIKRLFRFF,GIKRLFRFFS,IK RLFRFFSR,LRFFFSRDKK | KICH |
| RIMBP2 | c.2489G>A | p.R830H | FPRGSAGPQRSRPVTVPSIDDYGRD[p.R830H]HLSPDFYEESETDPGAEELPARIFVA | RDHLSPDFY,YGRDHLSPDF | GBM |
| RIMBP3 | c.1187_1189 de|CGG | p.A396de| | HELIKLNWLLAKALWVLARRCYTLQ[p.A396 de|]ENKQLRRAGCPYQADEKVKRLKVKRAEL YADGLKVCEVADATAGSTLLEFSQL[p.Q115 4R]RVPLTWQKVSVRTMSLCGESLDSVPA | RCYTLQENK,TLQENKQLR,QENKQLRRA,YTLQENKQLR | KIRC |
| RIMBP3 | c.3461A>G | p.Q1154R | | LLEFSQLRV,TLLEFSQLR,SQLRVPLTW,LEFSQLRVP,TLLEFSQLRV, QLRVPLTWQK,STLLEFSQLR,PSQLRVPLTW,LEFSQLRVPL | TGCT |
| RIMS2 | c.1203de|A | p.V401fs | LGLKVVGGKWTESGRLCAFITKVKK[p.V 401fs]EV* | FITKVKKEV | STAD |
| RIMS2 | c.164G>T | p.R55L | EREEYSQYATSDTAMPRSPSDYADR[p.R55L]LSQHEPQFYEDSDHLSYRDSNRRSHR | LSQHEPQFY,SPSDYADRL,RLSQHEPQF,RLSQHEPQFY | LUAD |
| RIMS2 | c.1796G>A | p.R599Q | KRRTKVKKTLEPKWNQTFIYSPVH[p.R 599Q]QREFRERMLEITLMDQARVREEESEF | FIYSPVHQR,HQREFRERM,IYSPVHQREF,TFIYSPVHQR,YS PVHQREF,HQREFRERML | CRC |
| RIN3 | c.1345C>G | p.L449V | DTPRESTEQGQDTEVKASDPHSMPE[p.L44 9V]VPRTAKQPPVPPPRKKRISRQLASTL | SMPEVPRTA,SMPEVPRTAK,HSMPEVPRTA,VPRTAKQPPV | KIRC |
| RIN3 | c.2123C>T | p.S708L | LYKCVLKPLKEAINSCLHQIHSKDG[p.S 708L]LLQQLKENQLVILATTTDLGVTTSV | HQIHSKDGL,SKDGLLQQL,HQIHSKDGLL | CRC |
| RING1 | c.511de|G | p.G171fs | QAMHRAQRVRRPIPGSDQTTTMSGG[p.G171fs]KESPGREKGMEKM* | QTTTMSGGK,GGKESPGREK,KESPGREKGM | STAD |
| RINL | c.1205C>T | p.P402L | RRQTALRAGAGPPGAQGPGPEGQS[p.P402L]LAPALRSRIHERLAHLHAACAPRRKV | SLAPALRSR,GPGPEGQSL,PEGQSLAPA,SLAPALRSRI,EGQ SLAPALR,PEGQSLAPL | ACC |
| RINT1 | c.321de|A | p.L107fs | SKMQLEEQVLTISSEIPKRIRSALK[p.L10 7fs]MQKNQSNFLISFWSRKLISSAPLTAIC* | MQKNQSNFL,KLISSAPLT,FLISFWSRK,KMQKNQSNF,RIRS ALKMQ,ISFWSRKLI,WSRKLISSA,NFLISFWSR,NQSNFLISF, KRIRSALKM,QKNQSNFLI,RKLISSAPL,ISSAPLTAI,KMQKN QSNFL,FLISFWSRKL,KLISSAPLTA,LISSAPLTAI,MQKNQSNFLI, RIRSALKMQK,SNFLISFWSR,KNQSNFLISF,NFLISFWSRK,SRKLI SSAPL,LKMQKNQSNF,NQSNFLISFW | STAD |
| RIT1 | c.270G>T | p.M90I | DDEPANLDILDTAGQAEFTAMRDQY[p.M90I]IRAGEGFIIYIRAGEGFIIYSITDRRSFHEVREFK | FTAMRDQYI,AMRDQYIRA,YIRAGEGFI,QYIRAGEGF,TAM RDQYIR,IRAGEGFII,YIRAGEGFII,QYIRAGEGFI,AMRDQYI RAG,FTAMRDQYIR,DQYIRAGEGF | LUAD |
| RIT2 | c.254G>T | p.R85L | QVRIDNEPAYLDILDTAGQAEFTAM[p.R85L]LEQYMRGGEGFIICYSVTDRQSFQEA | GQAEFTAML,TAMLEQYMR,FTAMLEQYM,AEFTAMLEQ,FTAM LEQYMR,AEFTAMLEQY | LUAD |
| RLBP1 | c.215C>T | p.A72V | KAKDELNEREETREEAVRELQEMVQ[p.A72V]VQAASGEELAVAVAERVQEKDSGFFL | RELQEMVQV,QEMVQVQAA,VQAASGEEL,LQEMVQVQAA,VQAA SGEELA,QEMVQVQAAS | CRC |
| RLBP1 | c.841G>A | p.D281N | PFLKSKLLERVFHGDDLSGFYQEI[p.D2 81N]NENILPSDFGGTLPKYDGKAVAEQLF | FYQEINENI,YQEINENIL,NENILPSDF,GFYQEINENI,FYQEI NENIL,QEINENILPS | CRC |
| RLIM | c.1502C>T | p.S501L | SPSSSSGGEESETSSDLFEGSNEGS[p.S 01L]LSSGSSGARREGRHRAPVTFDESGSL | SLSSGSSGA,FEGSNEGSL | KIRC |
| RLN2 | c.412A>T | p.S138C | QQHVPVLKDSLLFEEFKKLIRNRQ[p.S 138C]CEAADSSPSELKYLGLDTHSRKKRQL | LIRNRQCEA,RQCEAADSS,CEAADSSPS,KLIRNRQCEA,LIRN RQCEAA,RQCEAADSSP | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| RNAS ET2 | c.380C>T | p.A127V | HSFPNRSRFWKHEWEKHGTCAAQVD[p. A127V]VLNSQKKYFGRSLELYRELDLNSVLL | QVDVLNSQK,VLNSQKKYF,AQVDVLNSQK,QVDVLNSQKK | CRC |
| RNF11 | c.2313de|C | p.R771fs | HEVMQRMEVQPRRMMQHPTRAHERP[p. R771fs]HPIHIGCTQTMVMGIIFM CLRLCPHILDRLQRGLPGNWELKLE* | TMVMGIIFM,VMGIIFMCL,HIGCQTMV,RLCPHILDR,QT MVMGIIF,RGLPGNWEL,RAHERPHPI,MGIIFMCLR,CTQT MVMGI,MVMGIIFMC,CRLCPHIL,HERPHPIHI,IHIGCTQT M,IGCTQTMVM,FMCLRLCPH,LQRGLPGNW,LPGNWELK, MVMGIIFMCL,FMCLRLCPH,RLCPHILDR,VMGIIFMCLR, RGLPGNWELK,RAHERPHPIH,QTMVMGIIFM,RPHPIHI GCT,HIGCTQTMVM,TQTMVMGIIF,RLQRGLPGNW | STAD |
| RNF11 3B | c.515C>T | p.A172V | YRGIHSYLRYLKPKDTSMGNSSSGM[p.A172 V]VRKGPIRAPGHLRATVRMDYQPDICK | NSSSGMVRK,SMGNSSSGMV | CRC |
| RNF14 9 | c.25A>G | p.S9G | MAWRRREA[p.S9G]GVGARGVLALAL LALALCVPGARGRA | AWRRREAGV,MAWRRREAG,RRREAGVGAR,MAWRRRE AGV,REAGVGARGV | ACC |
| RNF15 0 | c.623C>T | p.S208L | LERNITVTMYITIGTRNLQKYVSRT[p.S2 08L]LVVFVSISFIVLMIISLAWLVFYIQ | RTLVFVSI,KYVSRTLVV,YVSRTLVVF,VSRTLVVFV,LQKYVS RTL,LVVFVSISF,QKYVSRTLV,YVSRTLVVF,NLQKYVSRTL, LQKYVSRTLV,LVVFVSISFI,KYVSRTLVVF,RTLVVFVSIS,TLV VFVSISF,QKVVSRTLVV | CRC |
| RNF150 | c.707G>A | p.R236Q | FVSISFIVLMIISLAWLVFYYIQRF[p.R23 6Q]QYANARDRNQRRLGDAAKKAISKLQI | FYYIQRFQY,YYIQRFQYA,IQRFQYANA,YIQRFQYANA,FYYI QRFQYA,YYIQRFQYAN,IQRFQYANAR,VFYYIQRFQY,FQY ANARDRN | CRC |
| RNF15 2 | c.283C>T | p.P95S | PDDPEVLAVIAIPHTSEHTPVFIKL[p.P9 5S]SSNGCYMLPLPISKERALLPGDMGCR | KLSSNGCYM,IKLSSNGCY,LSSNGCYML,KLSSNGCYML,FIK LSSNGCY,IKLSSNGCYM,SSNGCYMLPL | SKCM |
| RNF17 | c.1052C>G | p.S351C | KKYNNKKELSCYDTYPPLEKKKVDM[p.S 351C]CVLTSEAPPPLQPETNDVHLEAKNF | KKKVDMCVL | KIRC |
| RNF22 | c.397G>A | p.A133T | PLAASSPAWRPPPGQARPPGSPGQS[p. A133T]TQLPLDLLPSLPRESQIFVISRHGMP | SPGQSTQLPL,GQSTQLPLDL,TQLPLDLLPS | ACC |
| RNF39 | c.787G>T | p.G263C | HRRLLISADRRSVQLAPPGTPAPPD[p.G 263C]CPKRFPDLPAVLGAQGFGAGRHCWEV | GTPAPPDCPK | ACC |
| RNF43 | c.1976de|G | p.G659fs | PSTSSLFNLQKSSLSARFIPQRKRRG[p.G 659fs]VPPSPPLALGPRRMQLCTQLARFF PITPPVWHILGPQRHTP* | RMQLCTQLA,TQLARFFPI,RFFPITPPV,FFPITPPVW,ITPPV WHIL,RGVPPSPPL,MQLCTQLAR,HPQRKRRGV,VPPSPPL AL,RKRRGVPPS,LALGPRMQL,QLCTQLARF,FPITPPVWFI, RMQLCTQLAR,MQLCTQLARF,CTQLARFFPI,RFFPITPPVW, RGVPPSPPLA,FPITPPVWHI,SPPLALGPRM,GPRMQLCTQ L,RRGVPPSPPL,QLCTQLARFF,TQLARFFPIT,ARFFPITPPV SPRRAPPPL,RRAPPPLPV | STAD |
| RNF43 | c.348_349 insC | p.P116fs | NASDDDNLEPGFISIVKLESPRRAP[p.P116fs] PPLPVTG* | | STAD |
| RNMT | c.647C>T | p.S216L | PPAWPDYDVWIlMTVVGTIFVIILA[p.S 216L]LVLRIRCRPRFISRPDPLQQRTAWAIS | IILALVLRI,IFVIILAIV,VIIILAVLR,TIFVIILAL,FVIILA LVL,TIFVIILAV,VIILALVLRI,IFVIILALVL,LVLRIRCRPR, FVIILALVLR,IILALVLIR,LALVLRIRCR,GTIFVIILAL | CRC |
| RNMT | c.1174de|A | p.K392fs | PEFLVVFPLLNEMAKKYNMKLVYKK[p. K392fs]HFWNSTKKRLRTMKIKCS* | VYKKHFWNS,KKHFWNST,KHFWNSTK,STKKRLRTM,K KRLRTMKI,RLRTMKIKC,HFWNSTKKR,MKLVYKKHF,YKKH FWNST,STKKRLRTMK,KKHFWNSTKK,KKRLRTMKIK,RLRT MKIKCS,FWNSTKKRLR,NMKLVYKKHF,MKLVYKKHFW | STAD |
| RNPC3 | c.347de|A | p.E116fs | LVVEFAKEQDRVHSPCPTSGSEKKK[p.E 116fs]GLMTLSKMIKKKKNLVI* | GLMTLSKMI,LMTLSKMIK,MTLSKMIKK,TLSKMIKKK,LSK MIKKKK,MIKKKKNLV,KGLMTLSKM,IKKKKNLVI,KMIKKKK NLV,GLMTLSKMIK,LMTLSKMIKK,MTLSKMIKKK,TLSKMI KKKK,KKKGLMTLSK,MIKKKKKNL,SKMIKKKKNL,SEKKKG LMTL,KKGLMTLSKM | CESC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ROBO2 | c.3052G>A | p.D1018N | SQITQATPYATTQILHSNSIHELAV[p.D1 018N]NLPDPQWKSSIQQKTDLMGFGYSLPD | SIHELAVNL,HELAVNLPD,AVNLPDPQWK,NSIHELAVNL,L AVNLPDPQW,HELAVNLPDP | UCEC |
| ROBO2 | c.3238_323 9insC | p.P1080fs | KNKNSSKPQKNNGSTWANVPLPPPP[p. P1080fs]SPAPSWHGAGTLCSGTTRKWL* | TLCSGTTRK,GTLCSGTTR,SPAPSWHGA,APSWHGAGT,GT LCSGTTRK,VPLPPPSPA,SPAPSWHGAG,APSWHGAGTL | STAD |
| ROBO2 | c.3877de|A | p.K1293fs | PTSPFSTDSNTSAALSQSQRPRPTK[p.K 1293fs]NTREGGWTNNQHCLIEGKE* | WTNNQHCLI,REGGWTNNQH | STAD |
| ROCK1 | c.1552A>T | p.T518S | HRINEYQRKAEQENEKRRNVENEVS[p. T518S]SLKDQLEDLKKVSQNSQLANEKLSQL | EVSSLKDQL,NVENEVSSLK,RNVENEVSSL,NEVSSLKDQL | PRAD |
| ROR2 | c.2014G>A | p.D672N | KLLGNSLLPIRWMAPEAIMYGKFSI[p.D6 72N]NSDIWSYGVVLWEVFSYGLQPYCGYS | NSDIWSYGV,KFSINSDIW,SINSDIWSY,IMYGKFSIN,GKFSI NSDI,FSINSDIWSY,NSDIWSYGVV,IMYGKFSINS,INSDIWS YGV,GKFSINSDIW | CRC |
| RORB | c.280G>T | p.G94W | NRNRCQHCRLQKCLALGMSRDAVKF[p. G94W]WRMSKKQRDSLYAEVQKHQQRLQEQR | AVKFWRMSK,MSRDAVKFW,AVKFWRMSKK,MSRDAVKF WR,DAVKFWRMSK,GMSRDAVKFW | LUAD |
| ROS1 | c.734G>T | p.R245I | FPGGPPILGYNLRLISKNQKLDAGTQ[p.R 245I]ITSFQFYSTLPNTIYRFSIAAVNEVG | GTQITSFQF,TQITSFQFY,QKLDAGTQI,GTQITSFQFY,ITS FQFYSTL,NQKLDAGTQI,LDAGTQITSF,AGTQITSFQF | UCEC |
| RP1 | c.5312C>T | p.S1771L | WLLKENHLLRMSSENPGMCGNADTT[p. S1771L]LVDTLLDDNNSSEVPYSHFGNLAPGPT | DTTLVDTLL,GMCGNADTTL | LUSC |
| RPA1 | c.92G>A | p.R31H | SEGAIAAIMQKGDTNIKPILQVINI[p.R3 1H]PITTGNSPPRYRLLMSDGLNTLSSF | LQVINIHPL,ILQVINIHPIL,LQVINIHPIT | HNSC |
| RPL10L | c.560A>C | p.K187T | RQKIHISKKWGFTKFNADEFEDMVA[p. K187T]TKCLIPDGCGVKVPSHGPLDKWRVL | DEFEDMVAT,DEFEDMVATK,FEDMVATKCL | LUAD |
| RPL13 | c.319G>C | p.G107R | QTMRGMPPHKTKPGQAALDCLKVFD[p.G107R] RIPPPYDKKKRMVVPAALKVVRLKPA | VFDRIPPPY,RIPPPYDKK,KVFDRIPPP,KVFDRIPPPY, RIPPPYDKKK | UCS |
| RPL19 | c.451C>T | p.R151C | KVKGNVFKNKRILMEHIHKLKADKA[p. R151C]CKKLLADQAEAARRSKTKEARKRREER | KLKADKACK,KLKADKACKK | TGCT |
| RPL22 | c.44de|A | p.K15fs | MAPVKLVVKGGKK[p.K15fs]RSKF* | VVKGGKKRSK,VKGGKKRSKF | UCEC |
| RPL5 | c.172_173 de|AG | p.R58fs | KRLVIQDKNKYNTPKYRMIVRTVNR[p. R58fs]YHLSDCLCPYRGGYDSLRSVCTR TAKIWCEGWPDKLCCSILYWPAAGPQASQ* | HLSDCLCPY,RSVCTRTAK,MIVRVTNRY,IVRVTNRYH,RVTN RYHLS,RTAKIWCEG,CLCPYRGGY,DSLRSVCTR,VRVTNRY HL,KLCCSILYW,CSILYWPAA,DKLCCSILY,WPAAGPQAS,W PDKLCCSI,SLRSVCTRTA,RMIVRVTNRY,IVRVTNRYHL,RSVCTRTAKI,Y HLSDCLCPY,CPYRGGYDSL,WPDKLCCSIL,RTAKIWCEGW | TGCT |
| RPL6 | c.578T>G | p.F193C | LASGLLLVTGPLVLNRVPLRRTHQK[p.F 193C]CVIATSTKIDISNVKIPKHLTDAYFK | CVIATSTKI,RTHQKCVIA,KCVIATSTK,HQKCVIATS, RTHQKCVIAT,HQKCVIATST | CRC |
| RPRD2 | c.289C>A | p.R97S | PHRLNLPYLANDVIQNCKRKNAIIF[p.R9 7S]SESFADVLPEAAALVKDPSVKSVER | AIIFSESFA,NAIIFSESF,FSESFADVL,IIFSESFADV, IFSESFADVL,NAIIFSESFA,KNAIIFSESF | LUAD |
| RPS2 | c.598A>G | p.R200G | GKPHTVPCKVTGRCGSVLVRLIPAP[p.R 200G]GGTGIVSAPVPKKLLMMAGIDDCYTS | RLIPAPGGT,LVRLIPAPG,IPAPGGTGI,LIPAPGGTGI, IPAPGGTGIV | CLL |
| RPS6KA5 | c.496G>A | p.E166K | THLSQRERFTEHEVQIYVGEIVLAL[p. E166K]KHLHKLGIIYRDIKLENILLDSNGHV | VLALKHLHK,LALKHLHKL,VLALKHLHKL,VIALKHLHKL,ALKH LHKLGI,IVLALKHLHK,YVGEIVLALK,KHLHKLGIIY, GEIVLALKHL,LKHLHKLGII | CRC |
| RPS6KA6 | c.1181C>A | p.S394Y | ATSIAEEYKITPITSANVLPIVQIN[p. S394Y]ENAAQFGEVYELKEDIGVGSYSVCKR | ENAAQFGEV,QINENAAQF,VQINENAAQ,VQINENAAQF,EN AAQFGEVY,NENAAQFGEV,LPIVQINENA | UCEC |
| RPS6KA6 | c.327de|A | p.K109fs | KKASLKVRDRVRTKMERDILVEVNH[p. K109fs]HLLSNCTMPFRLKGNCT* | ILVEVNHHL,LLSNCTMPF,LSNCTMPFR,HHLLSNCTM,ILVEV NHHLL,LLSNCTMPFR,SNCTMPFRLK,HLLSNCTMPF, NHHLLSNCTM | STAD |
| RPSA | c.331C>G | p.Q111E | AVLKFAAATGATPIAGRFTPGTFTN[p.Q 111E]IQAAFWEPRLLVVTDPRADHQPLTE | FTNEIQAAF,TPGTFTNEI,FTPGTFTNEI,TFTNEIQAAF,EIQ AAFWEPR,NEIQAAFWEP,FTNEIQAAFW | GBM |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| RPTN | c.1090G>A | p.G364S | QSSHYGQMDRKGQCYHDQTNRQGQ[p.G364S]SSHYSQPNRQGQSSHYGQPDTQDQSS | SSHYSQPNR,TNRQGQSSHY,QQSSHYSQPN | CLL |
| RPTN | c.1614G>A | p.M538I | QTDRQGQSFHYGQPDRQGQSSHYSQ[p.M538I]IDRQGQSSHYGQTDRQGQSSHYGQTD | GQSHYSQI,SSHYSQIDR,SQIDRQGQSS,IDRQGQSSHY | TGCT |
| RPTN | c.886G>A | p.G296S | CGQSERLGQELGCGQQTDRQGQSSHY[p.G296S]SQTDRQDQSYFIYGQTDRQGQSSHYSQ | SQTDRQDQSY | PRAD |
| RRAD | c.833C>A | p.A278E | LRRDSKEANARRQAGTRRRESLGKK[p.A278E]EKRFLGRIVARNSRKMAFRAKSKSCH | KEKRFLGRI,KEKRFLGRIV | KIRC,TGCT |
| RREB1 | c.2348G>T | p.G783V | CGEDLKHYRALRIHMRTHCGRLGG[p.G783V]VHKGRKPFECKECSAAFAAKRNCIHH | GVHKGRKPF,CGRGLGGVHK | ACC |
| RRN3 | c.25C>T | p.R9C | MAAPLLHTR[p.R9C]CLPGDAAASSSAVK | MAAPLLHTC,LLHTCLPGDA,MAAPLLHTCL,HTCLPGDAAA | KIRP |
| RRN3 | c.31C>T | p.P11S | MAAPLLHTRL[p.P11S]SGDAAASSSAV KKLGASRTGISNM | HTRLSGDAA,LLHTRLSGDA,HTRLSGDAAA | KIRP |
| RRP15 | c.642G>T | p.L214F | KEAGSSMRKRAKLISTVSKKDFISV[p.L214F]FRGMDGSTNETASSRKKPKAQTEVK | SKKDFISVF,VSKKDFISVF,KDFISVFRGM | LUSC |
| RRS1 | c.135de|C | p.N45fs | QRITVHKELELQFDLGNLLASDRNP[p.N45fs]RPGCGAPDPRRRPSYRPWRGTTR NCSSTSCGSCPRSAWKR* | GSCPRSAWK,STSCGSCPR,RRRPSYRPW,SYRPWRGTT,LLA SDRNPR,APDPRRRPS,CGSCPRSAW,SSTSCGSCPR,CGSCP RSAWK,GSCPRSAWKR,RRRPSYRPWR,SYRPWRGTTR,NL LASDRNPR,APDPRRRPSY,RPSYRPWRGT,RPWRGTTRNC | STAD |
| RSBN1 | c.1714G>A | p.E572K | SPFKRRRSMNEIKNLQYLPRTSEPR[p.E572K] KVLFEDRTRAFIADHVGQGFDWQSTAA | RTSEPRKVL,RTSEPRKVLF,LPRTSEPRKV | UCEC |
| RSF1 | c.1158de|A | p.K386fs | HEITEKSTEETEKLKNDQQAKIPLK[p.K386fs]NEKLN* | QAKIPLKNEK,AKIPLKNEKL | STAD |
| RSPO2 | c.82C>T | p.R28C | FRLFSFALIILNCMDYSHCQGNRWR[p.R28C]CSKRASYVSNPICKGCLSCSKDNGCS | QGNRWRCSK,RWRCSKRAS,RCSKRASYV,WRCSKRASY,CQG NRWRCSK,RWRCSKRASY,QGNRWRCSKR | CRC |
| RTN1 | c.308C>G | p.S103W | ASTGVAGVSSAMDHTFSTTSKDGEG[p.S103W]WCYTSLSIDICYPPQEDSTYFTGILQ | EGWCYTSLI,GEGWCYTSL,TSKDGEGWCY,GEG WCYTSLI | LUAD |
| RTN2 | c.938de|C | p.P313fs | KTVPILELSPPLWTAIGWVQRGPTP[p.P313fs]LLLSSGFY* | VQRGPTPLL,PLLLSSGFY,WVQRGPTPL,TPLLLSSGF,VQRG PTPLLL,GWVQRGPTPL,TPLLLSSGFY | STAD |
| RUNX1 | c.286_287 insG | p.D96fs | LCSVLPTHWRCNKTLPIAFKVVALG[p.D96fs]GCSRWHSGHCDGW* | VVALGGCSR,VALGGCSRW,KVVALGGCSR,RWHSGHCDGW | BRCA |
| RUNX1 | c.403A>G | p.R135G | DENYSAELRNATAAMKNQVARFNDL[p.R135G]GFVGRSGRGKSFTLTITVFTNPPQVA | LGFVGRSGR,VARFNDLGF,VARFNDLG FV,RFNDLGFVGR,DLGFVGRSGR,QVARFNDLGF | LAML |
| RUNX1 | c.424_425 insA | p.R142fs | LRNATAAMKNQVARFNDLRFVCRSG[p.R142fs]KREKLHSDHHCLHKPTASRH LPQSHQNHSGWAPRTSKTSAETR* | KLHSDHHCL,CLHKPTASR,HSDHHCLHK,SGWAPRTSK,VG RSGKREK,ASRHLPQSH,RTSKTSAET,RFVGRSGKR,QNHS GWAPR,APRTSKTSA,QSHQNHSGW,HQNHSGWAP,HSGW APRTSK,RTSKTSAETR,KLHSDHHCLH,HQNHSGWAPR, HCLHKPTASR,LHKPTASRHL | BRCA |
| RUNX2 | c.1010G>T | p.R337M | SPSIHSTTPLSSTRGTGLPAITDVP[p.R337M]MRISDDDTATSDFCLMPSTLSKKSQA | AITDVPMRI,LPAITDVPM,GLPAITDVPM | LUAD |
| RUNX2 | c.1397C>A | p.P466H | STPYLYGTSSGSYQFPMVPGGDRS[p.P466H]HSRMLPPCTTTSNGSTLLNPNLPNQN | RSHSRMLPP,HSRMLPPCT,RSHSRMLPPC,HSRMLPPCTT | KIRC |
| RUNX2 | c.211C>G | p.Q71E | VAAQQQQQQQQQQQQQQQQQQQ QQQ[p.Q71E]ERAAAAAAAAAAA AAAVPRLRPP | QQQQEEAAA,QQQEEAAAA,QQEEAAAAA,QQQQEEAAA A,QQQQEEAAAAA,QQEEAAAAAA,QEEAAAAAAA | KIRP,TGCT |
| RUSC2 | c.1456de|C | p.P486fs | SSTQAAAAVGPTVLEGQVYTNTSPP[p.P486fs]TSALDVSAPAAMIAACSAALL SAWARMNVC* | AMIAACSAA,MIAACSAAL,AALLSAWAR,ALLSAWARW,N TSPPTSAL,SALDVSAPA,DVSAPAAMI,SAPAAMIAA,IAACS AALL,SAALLSAWA,LSAWARMNV,APAAMIAAC,LDVSAP | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| RUVBL1 | c.1291G>A | p.E431K | SVQLLTPANLLAKINGKDSIEKEHV[p.E4 31K]KEISELFYDAKSSAKILADQQDKYMK | AAM,CSAALLSAW,AMIAACSAAL,MIAACSAALL,LLSAWA RWNV,SAALLSAWAR,YTNTSPPTSA,TSALDVSAPA,DVSAP AAMIA,CSAALLSAWA,ALDVSAPAAM,AAMIAACSAA,ACS AALLSAW,AALLSAWARW | CRC |
| RUVBL1 | c.349C>T | p.R117C | PFCPMVGSEVYSTEIKKTEVLMENF[p.R 117C]CRAIGLRIKETKEVYEGEVTELTPCE | HVKEISELF,VKEISELFY,IEKEHVKEI,HVKEISELFY, KEHVKEISEL,KEISELFYDA VLMENFCRA,EVLMENFCR,NFCRAIGLR,LMENFCRAI,VL MENFCRAI,NFCRAIGLRI,FCRAIGLRIK,ENFCRAIGLR,EVL MENFCRA,MENFCRAIGL | CRC |
| RWDD2B | c.761G>A | p.R254H | VEGPQSACEEFWSRLRKLNWKRILI[p.R 254H]HHREDIPFDGTNDETERQRKPSIFEE | ILIHHREDI,IIHHREDIPF,KLNWKRILIH,RILIHHREDEI,NWKRI LIHHR,LIHHREDIPF | CRC |
| RXFP1 | c.668C>A | p.S223Y | HRLEWLIIEDNHLSRISPPTFYGLN[p.S2 23Y]YLILLVLMNNVLTRLPDKPLCQHMPR | GLNYLILLV,TFYGLNYLI,FYGLNYLIL,YGLNYLILL,NYLILLVL M,LNYLILLVL,YGLNYLILLV,GLNYLILLVL,TFYGLNYLIL,FYG LNYLILL,LNYLILLVLM,SPPTFYGLNY | UCEC |
| RXRA | c.1280C>A | p.S427Y | AYCKHYPEQPGRFAKLLLRLPALR[p.S 427Y]YIGLKCLEHLFFFKLIGDTPIDTFLM | LLRLPALRY,LPALRYIGL,LRYIGLKCL,RLPALRYIGL,LLRLPAL RYI,ALRYIGLKCL,YIGLKCLEHL,LLLRLPALRY | BLCA |
| RXRA | c.1280C>T | p.S427F | AYCKHYPEQPGRFAKLLLRLPALR[p.S 427F]FIGLKCLEHLFFFKLIGDTPIDTFLM | LPALRFIGL,LLRLPALRF,LRFIGLKCL,RLPALRFIGL,FIG LKCLEHL,LLRLPALRFI,LLLRLPALRF | BLCA |
| RYR1 | c.2002G>T | p.D668Y | IRPNIFVGRAEGTTQYSKWYFEVMV[p. D668Y]YEVTPFLTAQATHLRVGNALTEGYTP | MVYEVTPFL,KWYFEVMVY,VMVYEVTPF,YEVTPFLTA, FEVMVYEVT,WYPEVMVEV,VMVYEVTPFL,MVYEVTPFLT,EV MVYEVTPF,SKWYFEVMVY,YEVTPFLTAQ,FEVMVYEVTP | TGCT |
| RYR1 | c.7726G>A | p.A2576T | NRYLCLAVLPLLITKCAPLFAGTEHR[p.A2 576T]TIMVDSMLHTVYRLSRGRSLTKAQRD | RTIMVDSML,HRTIMVDSM,RTIMVDSMLH,LFAGTEHRTI, FAGTEHRTIM | UCEC |
| RYR2 | c.13002G>T | p.M4334I | ICSLLLGGSLVEGAKKIKVAELLAN[p. M4334I]IPDPTQDEVRGDGEEGERKPLEAALP | KVAELLANI,LLANIPDPT,IPDPTQDEV,NIPDPTQDEV,IKVA ELLANI,AELLANIPDP | LUAD |
| RYR2 | c.2131G>A | p.E711K | VTAEATHLRVGWASTEGYSPYPGGG[p. E711K]KEWGGNGVGDDLFSYGF DGLHLWSGC | KEWGGNGVG,SPYPGGGKEW | LUSC |
| RYR2 | c.6069A>C | p.L2023F | DFHEDLMTHCGIELDEDGSLLDGNSD[p. L2023F]FTIRGRLLSLVEKVTYLKKKQAEKPV | GSLDGNSDF,SLLDGNSDFTI,FTIRGRLLSL | TGCT |
| RYR2 | c.7239G>C | p.K2413N | IMTFYSALIDLLGRCAPEMHLIHAG[p.K 2413N]NGEAIRIRSILRSLIPLGDLVGVISI | LIHAGNGEA,IHAGNGEAI,HLIHAGNGEA,LIHAGNGEAI | LUAD |
| RYR3 | c.5008C>A | p.P1670T | DESKRHGLPGVGLRTCLKPGFRFST[p.P 1670T]TCFVVTGEDHQKQSPEIPLESLRTKA | RFSTTCFVV,GFRFSTTCF,FRFSTTCFV,GFRFSTTCFV,PGFRF STTCF,FRFSTTCFVV | LUAD |
| RYR3 | c.8114G>A | p.R2705Q | LAVGWTTVERTKEGEALVQQRENEKL[p. R2705Q]QSVSQANQGNSYSPAPLDLSNVVLSR | RENEKLQSV,RENEKLQSVS,NEKLQSVSQA | CRC |
| SACS | c.8717G>A | p.R2906Q | FHVNGHFALDSARRNLMRDDNGVGV[p. R2906Q]QSDWNNSLMTALLIAPAVELLIQLKK | QSDWNNSLM,VQSDWNNSL,VQSDWNNSLM | UCEC |
| SAFB | c.2393del|G | p.W798fs | REGQHYPERHGGSPERHGRDSRDGWG[p. W798fs]AMALTRG* | DSRDGWGAM,RDGWGAMAL,DGWGAMALTR,RDSRDG WGAM,SRDGWGAMAL | STAD |
| SAFB | c.2396G>T | p.G799V | EREGQHYPERHGGPERHGRDSRDGW[p. G799V]VGYGSDKRMSEGRGLPPPGRRDWG | DSRDGWVGY,VGYGSDKRM,RDSRDGWVGY | TGCT |
| SAGE1 | c.685C>T | p.R229C | HNVCEQKMENVQPAPDNVLLTLRPR[p. R229C]CINMTDTGISPMSTRDPYATITYNVP | TLRPRCINM,RPRCINMTDT,RCINMTDTGI | CRC |
| SAGE1 | c.894C>A | p.H298Q | STGLINVAGAGTPAISTNGLYSTV[p. H298Q]QNVCEEKMENDQPQPNNVLSTVQPVI | LYSTVPQNV,GLYSTVPQNV | LUAD |
| SALL3 | c.1777C>G | p.L593V | PGLNHYESGVSATAESPQSLLGGPP[p.L 593V]VTKAEPVSLPCTNARAGDAPVGAQAS | SLLGGPPVT,LLGGPPVTK,SLLGGPPVTKA,SLLGGPPVTK | ACC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SALL4 | c.2983de|G | p.V995fs | NQYTSMLNGGLAVKTNEISVIQSGG[p.V995fs]FLPSRFPWGPPPL* | FLPSRFPWG,GFLPSRFPW,RFPWGPPPL,ISVIQSGGF,IQSG GFLPS,SGGFLPSRF,SRFPWGPPP,FLPSRFPWGP,QSGGFL PSRF,GGFLPSRFPW,SRFPWGPPPL | STAD |
| SALL4 | c.560G>T | p.R187L | PPTPQDISYILAKGKVANTNVTLQAL[p.R187L]LGTKVAVNQRSADALPAPVPGANSIP | ALLGTKVAV,LQALLGTKV,TLQALLGTK,TLQALLGTKV,VTL QALLGTK,NTNVTLQALL,LQALLGTKVA | LUAD |
| SAMD3 | c.618G>T | p.Q206H | DMTKYLEGSLYPSTQQYNDVVNALI[p.Q206H]HAHPFLDEDGCGFFLWKRALKDRPKY | ALLHAHPFL,NALLHAHPF,VNALLHAHPF | LUSC |
| SAMD4B | c.1429C>T | p.R477W | APAPTDGSEPAPAPVADGDIPSQFT[p.R477W]WMGKVCTQLLVSRPDEENITSYLQL | SQFTWVMGK,DIPSQFTWV,IPSQFTWVM,GDIPSQFTW,S QFTWVMGKV,WVMGKVCTQL,PSQFTWVMGK,DIPSQFT WVM | UCS |
| SBF1 | c.3228de|C | p.P1076fs | SRNLVQNAKKTIGRQHVTRKKYNPP[p.P1076fs]AGSTGASRPLRTRTRTRSQCRRSW SPAR* | STGASRPLR,ASRPLRTRR,RTRRTRSQC,RTRSQCRRS,RSQC RRSWS,VTRKKYNPPA,ASRPLRTRRT,RTRRTRSACR,RTRS QCRRSW,RSQCRRSWSP,QCRRSWSPAR,RPLRTRRTRS,KK YNPPAGST,SQCRRSWSPA | STAD |
| SBNO1 | c.3415_341 6insA | p.N1139fs | EVHQQNALFQYFADTLTAVVQNAKK[p.N1139fs]KWKI* | AVVQNAKKK,VQNAKKKWK,VVQNAKKKWK | STAD |
| SBSPON | c.397G>T | p.G133W | GGAPCPPLEERAGCLEYSTPQGQDC[p.G133W]MHTYVPAFITTSAFNKERTRQATSPH | GQDCWHTYV,CWHTYVPAF,QGQDCWHTY,CWHTYVPAF I,PQGQDCWHTY,YSTPQGQDCW | LUAD |
| SCAF11 | c.624_625 insC | p.P208fs | PPPAPSSASSSPSPSPSPSSSPPPP[p.P208fs]TPTAPCTPSPTCPPIRYL* | SPSPPPTPT,TPSPTCPPI,SPTCPPIRY,CTPSPTCPPI,SPSPPP TPTA,SPTCPPIRYL | KIRC |
| SCAF8 | c.2776_277 7de|GA | p.E926fs | SSPGEKSRSQSRERESDRDGQRRER[p.E926fs]KENQKVV* | RERKENQKV,RERKENQKVV | GBM,KIRP |
| SCAF8 | c.2218G>T | p.G740C | LVQPSLSMTPETVKDVGFGSLVIPG[p.G740C]CSVASNLATSALPAGNVFNAPTKQAE | SLVIPGCSV,LVIPGCSVA,SLVIPGCSVA,IPGCSVASNL | LUAD |
| SCAPER | c.1097G>A | p.R366Q | AEKTQFTVSTLDDVKNSGSIRDNYV[p.R366Q]QTSEISAVHIDTECVSVMLQAGTPPL | VQTSEISAV,YVQTSEISAV,QTSEISAVHI,RDNYVQTSEI,VQ TSEISAVH | UCEC |
| SCARF1 | c.1841G>A | p.R614Q | SVSFARGTKFAPQSRRSSGELSSPL[p.R614Q]QKPKRLSRGAQSGPEGREAEESTGPE | LSSPLQKPK,LQKPKRLSR,SPLQKPKRL | STAD |
| SCFD2 | c.1633C>T | p.R545W | TDWDSSINLITFHKSKIAVDELFTSL[p.R545W]WDIAGARSLLKQFKSVYVPGNHT HQA | ELFTSLWDI,SLWDIAGAR,TSLWDIAGA,WDIAGARSL,FTSL WDIAGA,ELFTSLWDIA,TSLWDIAGAR,WDIAGARSLL,DEL FTSLWDI | CRC |
| SCLT1 | c.327de|A | p.K109fs | MKLQLENVIKENERLHSELKDAVEK[p.K109fs]NWRPFPWAQR* | KNWRPFPWA,AVEKNWRPF,EKNWRPFPW,NWRPFPWA QR,VEKNWRPFPW,DAVEKNWRPF | STAD |
| SCML4 | c.581G>A | p.R194Q | GKQHLRSLPVVNSIGVVLRFLAKLC[p.R194Q]QSLLCDDLFSHQPFPRGCSASEKVQE | FLAKLCQSL,FLAKLCQSLL,RPLAKLCQSL,CQSLLCDDLF | CRC |
| SCML4 | c.783G>T | p.L261F | YLVNPVGMNRYSVDTSASTFNHRGS[p.L261F]FHPSSSLYCKRQNSGDSHLGGPAAT | STFNHRGSF,SFHPSSSLY,GSFHPSSSL,STFNHRGSFH,GSFH PSSSLY,RGSFHPSSSL,ASTFNHRGSF | LUAD |
| SCN10A | c.3425G>A | p.R1142H | EGCIRHCPCCKLDTTKSPWDVGWQV[p.R1142H]HKTCYRIVEHSWPESFIIFMILLSSG | WQVHKTCYR,WQVHKTCYRI,VGWQVHKTCY,SPWDVGW QVH | MM |
| SCN10A | c.4709C>T | p.T1570M | IVVLSIASLIFSAILKSLQSYFSP[p.T157 0M]MLFRVIRLARIGRILRLIRAAKGIRT | SLQSYFSPM,LQSYFSPML,YFSPMLFRV,MLFRVIRLA,SYFSP MLFR,QSYFSPMLF,SPMLFRVIR,SLQSYFSPML, QSYFSPMLFR,MLFRVIRLAR,LQSYFSPMLF,SYFSPMLFRV, YFSPMLFRVI,KSLQSYFSPM,FSPMLFRVIR,SPMLFRVIRL | CRC |
| SCN2A | c.107G>A | p.R36K | PDSFRFTRESLAAIEQRIAEEKAK[p.R3 6K]KPKQERKDEDDENGPKPNSDLEAGKS | RIAEEKAKK,KAKKPKQER,KAKKPKQERK | BRCA |
| SCN2A | c.464C>A | p.T155K | LFNMLIMCTLLTNCVFMTMSNPPDW[p.T155K]KKNVEYTFGIYTFESLIKILARGFC | TMSNPPDWK,MSNPPDWKK,WKKNVEYTF,MTMSNPPD WK,TMSNPPDWKK,DWKKNVEYTF | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SCN7A | c.4073G>A | p.R1358H | MTVGSYLVPPSLVQLILLSRIIHML[p. R1358H]HLGKGPKVFHNLMLPLMLSLPAL LNI | IIHMLHLGK,MLHLGKGPK,LSRIIHMLH,SRIIHMLHL,HLGK GPKVF,MLHLGKGPKV,RIIHMLHLGK,HMLHLGKPK,LSRII HMLHL,LHLGKGPKVF | GBM |
| SCNN1G | c.1691G>A | p.R564H | MSCSVVCVIEIIEVFFIDFFSIIAR[p.R564 H]HQWQKAKEWWAWKQAPPCPEAP RSPQ | IIARHQWQK,IARHQWQKA,DFFSIIARH,FSIIARHQW,HQ WQKAKEW,IIARHQWQKA,SIIARHQWQK,FFSIIARHQW,I ARHQWQKAK,HQWQKAKEWW | GBM |
| SCRIB | c.995G>T | p.G332V | SLGKLTKLTNLNVDRNHLEALPPEI[p.G 332V]VGCVALSVLSLRDNRLAVLPPELAHT | IVGCVALSV,ALPPEIVGC,LEALPPEIV,PEIVG CV,ALPPEIVGCV,ALPPEIVGC,EIVGCVALSV,LPPEIVGCVA | TGCT |
| SCRT1 | c.397T>G | p.S133A | VSEGYAADAFFITDGRSRRKASNAG[p.S 133A]AAAAPSTASAAAPDGDAGGGGGAGGR | RRKASNAGA,KASNAGAAA,RKASNAGAA,KAS NAGAAAA,RKASNAGAA,AAAAPSTASA | ACC |
| SCUBE2 | c.1024G>A | p.V342M | DGKTCKDIDECQTRNGGCDHFCKNI[p. V342M]MGSFDCGCKKGFKLLTDEKSCQDVDE | FCKNIMGSF,CDHFCKNIM,IMGSFDCGCK,HPFCKNIMGSF | CRC |
| SDAD1 | c.824de1A | p.K275fs | YATGKKSSKNKKLEKAMKVLKKQK[p. K275fs]RRKNQRCLTFQPT* | KVLKKQKRR,VLKKQKRK,KQKRRKNQR,RKNQRCLTF,QR CLTFQPF,KVLKKQKRRK,AMKVLKKQKR,NQRCLTFQPF,RR KNQRCLTF | STAD |
| SDHAP1 | c.196C>T | p.H66Y | DYKVRIDEYDHSKPIQGQQKPFEE[p.H 66Y]YWRKHTLSYVDVSTGKVTVEYRPIID | YWRKHTLSY,QQKKPFEEY,EEYWRKHTL,EYWRKHTLSY,Y WRKHTLSYV,GQQKKPFEEY,QQKKPFEEYW,FEEYWRKHTL | CESC |
| SDHAP2 | c.110_111 insTT | p.S37fs | VGRPPVPLHMVSTASGQTRCWTWLS[p. S37fs]LVRHVP* | CWTWLSLVR,TRCWTWLSL,WTWLSLVRHV,QTRCWTWLSL | CESC |
| SDHAP3 | c.91C>T | p.R31C | LCPACTPVGRPPVPLHMVSTASGQT[p. R31C]CCWTWLSGQACALSIAESCRPGDKVP | SGQTCCWTW,GQTCCWTWL,TASGQTCCW | GBM,PRAD |
| SDHAP3 | c.196G>A | p.A66T | AACASVHGANRLGANSLLDLVVFGQ[p. A66T]TCALSIEESCRPGDKVPPIKPNAGEE | VVFGQTCAL,FQGTCALSI,VFGQTCALSI,LVVFGQTCAL | GBM |
| SDK1 | c.1524_1525 insC | p.K508fs | RPVDTTVTDGMTAILRCEVSGAKP[p. K508fs]RHHLEKRKPHSGQWLCPDS* | EVSGAPKPR,KRKPHSGQW,RKPHSGQWL,APKPRHHLEK, KPPRHHLEKRK,KRKPHSGQWL | KIRC |
| SDK1 | c.3542C>T | p.T1181M | PSPYSPSSRVIQTLQAPPDVAPTSV[p. T1181M]MVRTASETSLRLRWVPLPDSQYNGNP | DVAPTSVMV,MVRTASETSL,DVAPTSVMVR,APTSVMRTA | CRC |
| SDK1 | c.6437A>G | p.Y2146C | ADASESEATDSDYEDALPKHSFVNH[p. Y2146C]CMSDPTTYNSWKRRAQGRAP APHRYE | HCMSDPTTY,KHSFVNHCM,NHCMSDPTY, FVNHCMSDPT,VNHCMSDPTY | TGCT |
| SEC24D | c.150_151 insC | p.A50fs | YGHYGDPSHTASPTGMMKPAGPLGA[p. A50fs]HRH* | MKPAGPLGAH | LUAD |
| SEC31B | c.2713C>T | p.P905S | GVRPASSQPQLLGGQRVQVPNPVGF[p. P905S]SGTWPLPGSPLPMACPGIMRP GSTSL | VGFSGTWPL,NPVGFSGTW | TGCT |
| SEC61A2 | c.377G>T | p.G126V | EVGDTPKDRALFNGAQKLFGMIITI[p.G 126V]VQAIVYVMTGMYGDPAEMGAG ICLLI | ITIVQAIVY,MIITIVQAI,TIVQAIVYV,GMIITIVQA,IITIVQAIV, IVQAIVYVM,KLFGMIITIV,GMIITIVQAI,MIITIVQAIV,ITIV QAIVYVL,IITIVQAIVY,TIVQAIVYVM | LUAD |
| SECISBP2 | c.1824C>G | p.D608E | GMDELISTPSVEDKSEEPPGTELQR[p.D 608E]ETEASHLAPNHTTPKIHSRRFRD YC | LQRETEASH,RETEASHLA,TELQRETEA,LQRETEASFIL,RETE ASHLAP | KIRC |
| SELP | c.1285C>T | p.R429W | RAFQYDTNCSFRCAEGFMLRGADIV[p. R429W]WCDNLGQWTAPAPVCQALQ CQDLPVP | VWCDNLGQW,MLRGADIVW,FMLRGADIVW,IVWCDNL GQW | UCEC |
| SELP | c.889G>A | p.A297T | NMTCLHSAKFQHQSSCSFSCEEGF[p. A297T]TLVGPEVVQCTASGVWTAPAP VCKAV | FTLVGPEVV,FSCEEGFTL,FSCEEGFTLV,EGFTLVGPEV | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SEMA3A | c.241G>A | p.D81N | SYHTFLLDEERSRLYVGAKDHIFSF[p.D8 1N]NLVNIKDFQKIVWPVSTRRDECK WA | FSFNLVNIK, IFSFNLVNI, KDHIFSFNL, HIFSFNLVNI, NLVNIK DFQK, SFNLVNIKDF, KDHIFSFNLV | CRC |
| SEMA4D | c.755G>A | p.R252Q | EDDRVFFFTEVSVEYEFVFRVLIP[p.R2 52Q]QIARVCKGDQGGLRTLQKKWTSF LKA | VLIPQIARV, RVLIPQIAR, FVFRVLIPQI, RVLIPQIARV, VFRVLI PQIA | CRC |
| SEMG2 | c.874C>T | p.R292C | QHQTKNLSQDQEHGRKAHKISYPSS[p. R292C]CTEERQLHHGEKSVQKDVSKGS ISIQ | CTEERQLHH, HKISYPSSC | GBM |
| SENP7 | c.2018C>A | p.S673Y | ELELSYPLSWVQAFPLFQNLSSKES[p.S6 73Y]YFIHYYCVSTCSFPAGVAVAEEMKL K | SYFIHYYCV, SSKESYFIH, KESYFIHYY, ESYFIHYYC, QNLSSKES Y, NLSSKESYF, SKESYFIHY, NLSSKESYFI, SSKESYFIHY, FQNL SSKESY, SKESYFIHYY, ESYFIHYYCV, QNLSS KESYF, KESYFIHYYC | UCEC |
| SEPHS1 | c.1112G>A | p.R371Q | GEGHQAWIIGIVEKGNRTARIIDKP[p.R 371Q]QIIEVAPQVATQNVNPTPGATS* | QIIEVAPQV, RIIDKPQII, IIDKPQIIEV | CRC |
| SEPHS1 | c.37G>A | p.E13K | MSTRESFNPESY[p.E13K]KLDKSFRLTR FTELKGTGCKVPQDVL | ESFNPESYK, SFNPESYKL, SYKLDKSFR, ESYKLDKSF, YKLDKS FRL, KLDKSFRLTR, SYKLDKSFRL, ESYKLDKSFR, ESFNPESYKL | UCEC |
| SERPIN A12 | c.631C>G | p.R211G | HGKINNLIENIDPGTVMLLANYIFF[p.R2 11G]GARWKHEFDPNVTKEEDFFLEKN SSV | LLANYIFFG, YIFFGARWK, NYIFFGARW, FGARWKHEF, ANYI FFGAR, LANYIFFGA, MLLANYIFFG, LLANYIFFGA, LANYIFFG AR, FFGARWKHEF, ANYIFFGARW | BLCA |
| SERPIN A12 | c.757G>T | p.D253Y | FFLEKNSSVKVPMMFRSGIYQVGYD[p. D253Y]YKLSCTILEIPYQKNITAIFILPDEG | YQVGYDKL, GIYQVGYD, YDYKLSCTI, GIYQVGYDYK, IYQ VGVGYKL, SGIYQVGYDY, YDYKLSCTIL, YKLSCTILEI | LUAD |
| SERPINA3 | c.474G>C | p.K158N | LQLSMGNAMFVKEQLSLLDRFTEDA[p. K158N]NRLYGSEAFATDFQDSAAAKKL INDY | FTEDANRLY, NRLYGSEAF, RFTEDANRLY, ANRLYGSEAF | CESC |
| SERPINA4 | c.292C>T | p.R98C | HQQILETGEGSPSLKIAPANADFAF[p.R 98C]CFYYLIASETPGKNIFFSPLSISAAY | NADFAFCFY, FAFCFYYLI, DFAFCFYYL, ADFAFCFYY, ANADF AFCF, NADFAFCFYY, FAFCFYYLIA, DFAFCFYYLI, ANADFAFC FY, ADFAFCFYYL | CESC |
| SERPINA9 | c.1242G>T | p.M414I | TTKFIVRSKDGPSYFTVSFNRTFLM[p.M 414I]IITNKATDGILFLGKVENPTKS* | FLMIITNKA, TFLMIITNK, SFNRTFLMI, FNRTFLMII, FLMIITN KAT, RTFLMIITNK, VSFNRTFLMI, SFNRTFLMII | LUAD |
| SERPIN B12 | c.503del A | p.Q168fs | PICQEYILDGVIQFYHTTIESVDFQK[p.Q 168fs]TLKNPDKRLTSGLNVNPKVKSRNS SARTLMLRLCWYw* | NSSARTLLM, SVDFQKTLK, KTLKNPDKR, TSGLNVNPK, SAR TLLMLR, LMLRLCWYN, KVKSRNSSA, KSRNSSART, RNSSA RTLL, LLMLRLCWY, NVNPKVKSR, KRLTSGLNV, SRNSSARTL, SSARTLLML, IESVDFQKT, LTSGLNVNPK, SSARTLMLR, RT LLMLRLCW, LLMLRLCWYW, FQKTLKNPDK, SGLNVNPKVK, KVKSRNSSAR, KSRNSSARTL, RNSSARTLLM, SARTLLMLRL, TLLMLRLCWY, NPDKRLTSGL, IESVDFQKTL, SRNSSARTLL | STAD |
| SERPINB3 | c.626C>G | p.S209C | GQWENKFPKKENTKEEKFWPNKNTYK[p. S209C]CVQMMRQYNSFNFALLEDV QAKVLEI | KCVQMMRQY, TYKCVQMMR, NTYKCVQMM, NTYKCVQMMR, WPNKNTYKCV, NKNTYKCVQM, YKCVQMMRQY | KIRC |
| SERPINC1 | c.134G>T | p.R45L | SLLLIGFWDCVTCHGSPVDICTAKP[p.R 45L]LDIPMNPMCIYRSPEKKATEDEGS EQ | TAKPLDIPM, VDICTAKPL, CTAKPLDIPM, KPLDIPMNPM | LUAD |
| SERPINI1 | c.243del A | p.L81fs | GMMELGAQGSTQKEIRHSMGYDSLK[p. L81fs]MVKNFLS* | SLKMVKNFL, SMGYDSLKM, SMGYDSLKMV, MGYDSLKMV K, SLKMVKNFLS, HSMGYDSLKM | STAD |
| SESTD1 | c.918T>G | p.I306M | VMQVVNWLEGPGSEQLRAQWGIGDS[p.I3 06M]MRASQALQQKHEEIESQHS EWFAVTV | SMRASQALA, DSMRASQAL, AQWGIGDSM, SMRASQALQ Q, RAQWGIGDSM | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SETDB2 | c.2145de1A | p.R715fs | YGYEAGTVPEKEIFCQCGVNKCRKK[p.R715fs]YYKVTNACL* | KYYKVTNA,KCRKKYYK,GVNKCRKKY,YKVTNACL,KYYK VTNAC,YYKVTNACL,VNKCRKKYK,KCRKKYY KYY,GVNKCRKKY,KKYYKVTNA | STAD |
| SEZ6L | c.620C>T | p.S207L | VPLWLDRKESAVPTTPAPLQISPFT[p.S207L]LQPYVAHTLPQRPEPGEPDM AQEA | TLQPYVAHT,LQPYVAHTL,ISPFTLQPY,LQISPFTLQ,SPFTLQ PYV,TLQPYVAHTL,QISPFTLQPY,ISPFTLQPYV,APLQISPFT L,LQISPFTLQP,SPFTLQPYVA | CRC |
| SEZ6L2 | c.221G>C | p.R74P | EALAELLHGALLRRGPEMGYLPGSD[p.R74P]PDPTLATPPAGQTLAVPSLPRAT EPG | YLPGSDPDT,LPGSDPDTL | ACC |
| SF1 | c.763C>T | p.R255W | IETPEDQNDLRKMQLRELARLNGTL[p.R255W]WEDDNRILRPWQSETRSITN TTVCT | TLWEDDNRI,LARLNGTLW,TLWEDDNRIL | CESC |
| SF3B1 | c.1868A>G | p.Y623C | SNLAKAAGLATMISTMRPDIDNMDE[p.Y623C]CVRNTTARAFAVVASALGIPSL LPFL | CVRNTTARA,CVRNTTARAF | CLL |
| SF3B1 | c.1876A>T | p.N626Y | AKAAGLATMISTMRPDIDNMDEYVR[p.N626Y]YTTARAFAVVASALGIPSLLPFL KAV | NMDEYVRYT,YTTARAFAV,YVRYTTARA,RYTTARAFA,EYV RYTTAR,VRYTTARAF,DEYVRYTTA,NMDEYVRYTT,YTTAR AFAVV,RYTTARAFAV,YVRYTTARAF,IDNMDEYVRY,DEYV RYTTAR | CLL |
| SF3B1 | c.1996A>G | p.K666E | IPSLLPPLKAVCKSKKSWQARHTGI[p.K666E]EIVQQIAILMGCAILPHLRSLVEIIE | QARHTGIEI,EIVQQIAIL,IEIVQQIAI,WQARHTGIEI,EIVQQI AILM,IEIVQQIAIL | CLL |
| SF3B1 | c.2098A>G | p.K700E | MGCAILPHLRSLVEIIEFIGLVDEQQ[p.K700E]EVRTISALAIAALAEAATPYGIESFD | GLVDEQQEV,EVRTISALA,QEVRTISAL,DEQQEVRTI,EVRTI SALAI,QQEVRTISAL,DEQQEVRTIS,QEVRTISALA | BRCA,CLL |
| SF3B1 | c.2704G>A | p.E902K | GNLGAADIDHKLEEQLIDGILYAFQ[p.E902K]KQTTEDSVMLNGFGTVVNALGK RVKP | ILYAFQKQT,KQTTEDSVM,ILYAFQKQTT, FQKQTTEDSV,QKQTTEDSVM,KQTTEDSVML | BLCA |
| SF3B1 | c.2870G>A | p.R957Q | ICGTVLMRLNNKSAKVRQQADLIS[p.R957Q]QTAVVMKTCQEEKLMGFFIGGV VLYEYL | DLISQTAVV,ISQTAVVMK,LISQTAVVM,ADLISQTAV,LLISQ TAVVMK,QAADLISQTA,DLISQTAVVM,RQQAADLISQ | UCEC |
| SFI1 | c.2462G>A | p.R821Q | THHLQCVRKRLLHRQSTQLIAQRLS[p.R821Q]QTCFRQWRQQLAARRQEQRA TVRALW | LLAQRLSQT,SQTCFRQWR,AQRLSQTCF,LSQTCFRQW,LL AQRLSQTC,AQRLSQTCFR,LSQTCFRQWR,LAQRLSQTCF,R LSQTCFRQW | HNSC |
| SFPQ | c.1832G>A | p.R611Q | EEQMRRQREESYSRMGYMDPRERDM[p.R611Q]QMGGGGAMNMGDPYGS GGQKFPPLGG | MQMGGGGAM,DMQMGGGGAM,QMGGGGAMNM,M QMGGGGAMN | CRC |
| SFRP4 | c.695G>A | p.R232Q | QRSGCNEVTTVVDVKEIFKSSSPIP[p.R232Q]QTQVPLITNSSCQCPHILPHQDVLIM | IPQTQVPL,SSSPIPQTQV,SPIPQTQVPL | UCEC |
| SFSWAP | c.1850C>A | p.S617Y | PLEKNRVKLDDDSDDDEESKEGQES[p.S617Y]YSSAANTNPAVAPPCVVVEKK PQLT | ESKEGQESY,GQESYSSAA,YSSAANTNPA,KEGQESYSSA,EE SKEGQESY,QESYSSAANT | CRC |
| SGCG | c.659C>T | p.A220V | ESPTRSLSMDAPRGVHIQAHAGKIE[p.A220V]VLSQMDILFHSSDGMLVLDAET VCLP | EVLSQMDIL,VLSQMDILF,GKIEVLSQM,IEVLSQMDI,IQAH AGKIEV,QAHAGKIEVL,IEVLSQMDIL,EVLSQMDILF | CRC |
| SGCZ | c.123T>G | p.I41M | REQYILATQQNNLPRTENAQLYPVG[p.I41M]MYGWRKRCLYFFVLLLLVTMIVN LAM | LYPVGMYGW,MYGWRKRCL,AQLYPVGMY,GMYGWRKR CL,MYGWRKRCLY,NAQLYPVGMY,QLYPVGMYGW | CRC |
| SGIP1 | c.1505G>T | p.R502L | GVGDVSRPFSPPIHSSSPPPIAPLA[p.R502L]LAESTSSISSTNSLSAATTPTVENEQ | ALAESTSSI,ALAESTSSIS,SPPPIAPLAL,LALAESTSSI | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SGK1 | c.1100_1102 del AGA | p.K367del | AKDDFMEIKSHVFFSLINWDLLINK[p.K367del]ITPPFNPVSGPNDLRHFDPEFTEEPVP | LINKITPPF,DLINKITPPF | UCEC |
| SGK3 | c.183del A | p.L61fs | SEWFVFRRYAEFDKLYNTLKKQFPPA[p.L61fs]WP* | TLKKQFPAW | STAD |
| SGOL2 | c.1220del A | p.E407fs | KKSNKKTNEHGMKTFRKVKDSSSEK[p.E407fs]REKDQRDSLKIVQMSILGKRLKTGQKDLMSWMAKGVQKIPVLFSIMNSWLR* | LMSWMAKGV,WMAKGVQKI,SLKIVQMSI,IVQMSILGK,MSIIGKRLK,SWMAKGVQK,FSIMNSWLR,GVQKIPVLF,KDLMSWMAK,GQKDLMSWM,REKDQRDSL,RDSLKIVQM,LKIVQMSIL,KGVQKIPVL,QKIPVLFSI,KIPVLFSIM,VLFSIMNSW,DLMSWMAKGV,VLFSIMNSWL,SLKIVQMSIL,KIVQMSILGK,QMSILGKRLK,MSWMAKGVQK,SWMAKGVQKI,KGVQKIPVLF,KVKDSSSEKR,REKDQRDSLK,LGKRLKTGQK,RLKTGQKDLM,MAKGVQKIPV,IVQMSILGKR,LFSIMNSWLR,VQMSILGKRL,KRLKTGQKDL,GQKDLMSWMA,AKGVQKIPVL,VQKIPVLFSI,QKIPVLFSIM | STAD |
| SGSM1 | c.2452G>A | p.E818K | VLDAQRNTPTVLRPRDGSVDDRQSS[p.E818K]KATTSQDERAPREELAVQDSLESDLLA | SVDDRQSSK,RQSSKATTS,GSVDDRQSSK,RQSSKATTSQ | CESC |
| SGSM1 | c.3351C>A | p.F1117L | IALALVEVYRDIILENNMDFTDIIK[p.F1117L]LFNEMAERHNTKQVLKLARDLIVYKVQ | FTDIIKLFN,KLFNEMAER,DFTDIIKLF,DIIKLFNEM,MDFTDIIKL,NMDFTDIIKL,DIIKLFNEMA,MDFTDIIKLF | CRC |
| SH3KBP1 | c.1688_1689 insC | p.P563fs | ISQVSDNKASLPPKPGTMAAGGGGP[p.P563fs]SPSVLSGALPPVILFGNSWTQSQLPVSVRHGR,KTKDGACGQQPGGRGGAKDTGPRAEEHHRDHEGPAETRD* | VLSGALPPV,TQSQLPVSV,GALPPVILF,PVSVRHGRK,SVRHGRKTK,LPVSVRHGR,SPSVLSGAL,SWTQSQLPV,SQLPVSVRH,SVLSGALPPV,VLSGALPPVI,ILFGNSWTQS,WTQSQLPVSV,VSV,VSVRHGRKTK,QLPVSVRHGR,NSWTQSQLPV,SGALPPVILF,FGNSWTQSQL,SQLPVSVRHG,PPVILFGNSW | KIRC |
| SH3KBP1 | c.1720del C | p.L574fs | LPPKPGTMAAGGGGPAPLSSAAPSP[p.L574fs]CHPLWEQLDTEPTPRLCSARKENQRWSLRPAARRPWRS* | RWSLRPAAR,RPAARRPWR,CSARKENQR,WSLRPAARR,RKENQRWSL,NQRWSLRPA,QRWSLRPAA,WEQLDTEPT,APSPCHPLW,RWSLRPAARR,SLRPAARRPW,EQLDTEPTPR,SAAPSPCHPL,RPAARRPWRS,NQRWSLRPAA | STAD |
| SH3PXD2A | c.2276C>T | p.S759L | SSDLITLPATTPPCPTKKEWEGPAT[p.S759L]LYMTCSAYQKVQDSEISFPAGVEVQV | TLYMTCSAY,ATLYMTCSA,KEWEGPATL,WEGPATLYM,ATLYMTCSAY,LYMTCSAYQK,KEWEGPATLY,KKEWEGPATL,WEGPATLYMT | LUAD |
| SH3RF2 | c.952C>T | p.R318C | RKVPGGQFSITTALNTLNRMVHSPSG[p.R318C]CHMVEISTPVLISSSNPSVITQPMEK | HSPSGCHMV,VHSPSGCHM,MVHSPSGCHM,SPSGCHMVEI,RMVHSPSGCH,CHMVEISTPV | GBM |
| SH3TC2 | c.265C>T | p.R89C | RCVNGPLQEAARRLWALENEDQEV[p.R89C]CMLFKDLSARLVSIQSQRAQFLITFK | NEDQEVCML,CMLFKDLSAR,LENEDQEVCM,NEDQEVCMLF,QEVCMLFKDL | CRC |
| SHB | c.1378G>A | p.A460T | RNSQTSKHDYSLSLRSNQGFMHMKL[p.A460T]TKTKEKYVLGQNSPPFDSVPEVIHYY | FMHMKLTKT,GFMHMKLTK,KLTKTKEKY,KLTKTKEKYV,FMHMKLTKT,QGFMHMKLTK,HMKLTKTKE,LTKTKEKYV,MKLTKTKEKY | GBM |
| SHROOM4 | c.3468_3470 del AGA | p.1156_1157EE>E | EEEEEEEEEEEEEEEEEEEEAEEEEE[p.1156_1157EE>E]LPPQYFSSETSGSCALNPEEVLEQPQPL | ERAEEEEEL | PAAD |
| SI | c.3649G>T | p.V1217F | LDFYMFLGPTPEVATKQYHEVIGHP[p.V1217F]FMPAYWALGFQLCRYGYANTSEVREL | FMPAYWALG,PFMPAYWAL,IGHPFMPAY,HPFMPAYWA,YHEVIGHPF,HEVIGHPFM,FMPAYWALGF,QYHEVIGHPF,VIGHPFMPAY,EVIGHPFMPA,HPFMPAYWAL,YHEVIGHPFM,IGHPFMPAYW | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SI | c.5042T>A | p.I1681K | WFDYHTGKDIGVRGQFQTFNASYDT[p. I1681K]KNLHVRGGHILPCQEPAQNTF YSRQK | TFNASYDTK, QTFNASYDTK, ASYDTKNLHV | TGCT |
| SIGLEC1 | c.954del|C | p.P318fs | QAAWSDAGVTCQAENGVGSLVSPP[p. P318fs]SASTSSWLRSR* | SASTSSWLR, STSSWLRSR, PPSASTSSW, ASTSS WLRSR, SPPSASTSSW | STAD |
| SIGLEC10 | c.749C>T | p.T250M | SAQRTVRLRVAYAPRDLVISISRDN[p.T 250M]MPALEPQGNVPYLEAQKGQ FLRLL | ISRDNMPAL, MPALEPQPQ, SISRDNMPAL, LVISISRDNM, ISISRDNMPA, MPALEPQPG | GBM |
| SIGLEC11 | c.1088C>T | p.S363F | NRLGSQQQALLDLSVQYPPENLRVMV[p. S363F]FQANRTVLENLGNGTSLPVLEG QSLR | MVFQANRTV, RVMVFQANR, VMVFQANRTV, RVMVFQANRT, MVFQANRTVL, FQANRTVLEN | CRC |
| SIK1 | c.2032del|C | p.Q678fs | EVLEQQRLLQLQHHPAAAPGCSQAP[p. Q678fs]SRPLPRL* | QAPSRPLPR, APSRPLPRL, CSQAPSRPL, SQAPSRPLP, SQAP SRPLPR | STAD |
| SIM1 | c.637G>A | p.V213M | YLKIRQYSLDMSPFDGCYQNVGLVA[p. V213M]MGHSLPPSAVTEIKLHSNMFM FRASL | YQNVGLVAM, GLVAMGHSL, MGHSLPPSA, VAMGHSLPP, AMGHSLPPSA, CYQNVGLVAM, YQNVGLVAMG, MGHSLP PSAV | CESC |
| SIPA1 | c.3188G>A | p.R106 3Q | SETYRMPVMEYKMNEGVSYEFKFPF[p. R1063Q]QNNNKWQRNASKGPHSPQ VPSQVQSP | KPPFQNNNK, FQNNNKWQR, FPFQNNNKW, YEFKFPFQN, KPPFQNNNKW, YEFKFPFQNN | CRC |
| SIPA1 | c.3680C>A | p.S122 7Y | PSWQRSEDSIADQMAYSYRGPQDFN[p. S1227Y]YFVLEQHEYTEPTCHLPAVSK VLPAF | RGPQDFNYF, YFVLEQHEY, YRGPQDFNY, YRGPQDFNYF, SY RGPQDFNY, NYFVLEQHEY, GPQDFNYFVL | CRC |
| SIPA1 L3 | c.2330G>C | p.G777A | RVHNPCTDNVCYSMAVTRSKDAPPF[p. G777A]APPIPSGTTFRKSDVFRDFLLAK VIN | RSKDAPPFA, DAPPFAPPI, RSKDAPPFAP, APPIPSGTTF, KDA PPFAPPI | KIRC |
| SIRPA | c.387_389 del|CGA | p.D131 del | IRIGNITPADAGTYYCVKFRKGSPD[p.D 131del]VEFKSGAGTELSVRAKPSAPVV SGPAAR | KGSPDVEFK, KFRKGSPDV, RKGSPDVEF, VKFRKGSPDV, FR KGSPDVEF | KIRC |
| SIRPA | c.697G>A | p.V233I | SIHSTAKVLTREDVHSQVICEVAH[p.V 233I]ITLQGDPLRGTANLSETIRVPPTLEV | QVICEVAHI, VICEVAHITL, SQVICEVAHI | PRAD |
| SIX1 | c.571G>A | p.E191K | TQVSNWFKNRRQRDRAAEAKERENT[p. E191K]KNNNSSSNKQNQLSPLEGGK | KNNNSSSNK | UCEC |
| SIX3 | c.79A>C | p.I27L | VFRSPLDLYSSHFLLPNFADSHHRS[p.I2 7L]LLLASSGGGNGAGGGGAGGSGG PLMSSS | FADSHHRSL, FADSHHRSLL | CLL |
| SKI | c.185C>G | p.A62G | APSARWAQEAYKKESAKEAGAAAVP[p. A62G]GPVPAATEPPVLHLPAIQPPPP VLP | GAAAVPGPV, KEAGAAAVPG | KIRP |
| SKOR1 | c.2648A>G | p.Y883C | EEMVQQLQIVRDTLCNELDQERKAR[p. Y883C]CAIQQKLKEAHDALHHFSCKML TPRH | KARCAIQQK, RCAIQQKLK, QERKARCAI, KARCAIQQKL | LUAD |
| SLAMF1 | c.829del|A | p.S277fs | LIMVVILQLRRRGKTNHYQTTVEKK[p.S 277fs]ALRSMPKSRNQVLFRRNLTPSQL RTLAPPYMLLPQSLSQSLSRKQIPSQSM LV* | TLAPPYMLL, SMPKSRNQV, KQIPSQSML, QIPSQSMLV, KSR NQVLFR, SLSQSLSRK, QSLSQSLSR, RTLAPPYML, PYMLLPQ SL, KKALRSMPK, ALRSMPKSR, RSMPKSRNQ, RNLTPSQLR, QLRTLAPPY, TIVEKKALR, MPKSRNQVL, TPSQLRTLA, LPQS LSQSL, VEKKALRSM, NQVLFRRNL, RRNLTPSQL, SQLRTLAP P, LRTLAPPYM, SQSLSRKQI, RKQIPSQSM, LLPQSLSQSL, KQ IPSQSMLV, SMPKSRNQVL, KSRNQVLFRR, QSLSQSLSRK, R | BLCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SLC10A4 | c.843C>G | p.F281L | YKYSRVADYIVKVSLMWSLLVTLVVL[p.F281L]LIMTGTMLGPELLASIPAAVYVIAIF | TLAPPYMLL,KALRSMPKSR,RSMPKSRNQV,QLRTLAPPYM,SQLRTLAPPY,QTTVEKKALR,MPKSRNQVLF,PPYMLLPQS L,YQTTVEKKAL,FRRNLTPSQL,YMLLPQSLSQ,SRKQIPSQS M,RKQIPSQSML | CESC |
| SLC10A6 | c.326de|G | p.G109fs | YLLAISFSLKPVQAIAVLIMGCCPG[p.G109fs]APSLTFSPSGLMEIWISASV* | LLVTLVVLL,LLIMTGTML,VLLIMTGTM,SLLVTLVVLL,LLV TLVVLLI LIMGCCPGA,GLMEIWISA,SLITFSPSGL,FSPSGLMEI,LITFSP SGLM,MEIWISASV,CPGAPSLTF,APSLTFSPS,SPSGLMEIW, VLIMGCCPGA,GLMEIWISAS,LMEIWISASV,SLITFSPSGLM, TFSPSGLMEI,MGCCPGAPSL,SPSGLMEIWI | STAD |
| SLC10A7 | c.782C>T | p.S261L | LILFIIFSIQL[p.S261L]SFMLLTFIFSTRNN[p.S261L]LGFTPADTVAIIFCSTHKSLTLGIPM | FIFSTRNNL,STRNNLGFT,RNNLGFTPA,FSTRNNLGF,NLGF TPADTV,TFIFSTRNNL,IFSTRNNLGF | UCEC |
| SLC12A1 | c.875C>T | p.S292L | ANAVAVAMYVGFAETVDLLKESD[p.S292L]LMMVDPTNDIRIIGSITVVILLGI SV | LLKESDLMM,LLKESDLMMV,LMMVDPTNDI | CRC |
| SLC12A2 | c.2483G>A | p.R828Q | ALLHLVHDFTKNVGLMICGHVHMGP[p.R828Q]QRQAMKEMSIDQAKYQRWLIKNKMKA | MGPQRQAMK,HMGPQRQAM,PQRQAMKEM,HMGPQR QAMK,HVHMGPQRQA,GPQRQAMKEM,VHMGPQRQA M | UCEC |
| SLC12A7 | c.2056de|C | p.H686fs | WDGIRGLSLNAARYALLRVEHGPP[p.H686fs]TPRTGGPRCW* | LRVEHGPT,RVEHGPPTPR | STAD |
| SLC13A2 | c.1478_1479insG | p.L493fs | IVLLGGGYALAKGSERSGLSEWLG[p.L493fs]KQADPTAECASSSHCHHPLPPG GHLHRVH* | SGLSEWLGK,SSHCHHPLP,HPLPPGGHL,KQADPTAEC,SSS HCHHPL,SEWLGKQAD,GLSEWLGKQA,RSGLSEWLGK,KQ ADPTAECA,ASSSHCHHPL,SEWLGKQADP,LPPGGHLHRV | KIRC |
| SLC13A5 | c.818A>C | p.Q273P | VNFASWFAFAFPNMLVMLLFAWLWL[p.Q273P]PFVYMRFNFKKSWGCGLESK KNEKAA | LLFAWLWLP,FAWLWLPFVY,WLPFVYMRF,LWLPFVYM,LFAWLWLPF, AWLWLPFVY,LFAWLWLPF,LFAWLWLPFV,AWLWLPFV YM,LWLPFVYMRF,PFVYMRFNFK,WLWLPFVYMR,LPFVY MRFNF | GBM |
| SLC16A14 | c.1484G>A | p.R495Q | YDFSFYICGLLYMIGILFLLIQPCI[p.R495Q]QIIEQSRRKYMDGAHV* | LLIQPCIQI,CIQIIEQSR,FLLIQPCIQI,LLIQPCIQII, QIIEQSRRKY,CIQIIEQSRR | UCEC |
| SLC16A6 | c.293_294 insG | p.G98fs | LTFSAPLATVLSNRFGHRLVVMLGG[p.G98fs]ATCQHRDGGRLLLTRGFSYVRR HRHHLWSGILL* | LLTRGFSYV,RLVVMLGGA,LTRGFSYVR,YVRRHRHHL,RHR HHLWSG,LLLTRGFSY,GFSYVRRHR,CQHRDGGRL,GRLLLT RGF,RGFSYVRRH,RHHLWSGIL,HHLWSGILL,LLLTRGFSYV, RLLLTRGFSY,SYVRRHRHHL,LTRGFSYVRR,RGFSYVRRHR, RHRHHLWSGI,MLGGATCQHR,ATCQHRDGGR,LLTRGFSY VR,VMLGGATCQH,CQHRDGGRLL,FSVVRRHRHH,YVRRH RHHLW,HRHHLWSGIL,RHHLWSGILL | STAD |
| SLC16A9 | c.1407_1424de|CTGCGTCCTGCTGGGAGG | p.CVLL GG470 de| | LGPPIVGWFYDWTQTYDIAFYFSGF[p.CVLLGG470de|]FILLLAALPSWDTCNK QLPKPAPTTFLYKVASNV* | AFYFSGFFI,FYFSGFFIL,YFSGFFILL,YPSGFFILL,IAFYFSGFF,IAFYFSG FFI,AFYFSGFFIL,FYFSGFFILL,YPSGFFFLLL,DIAFYFSGFF | KIRC |
| SLC17A9 | c.970G>A | p.V324I | HLINQGYRAITVRKLMQGMGLGLSS[p.V324I]IFALCLGHTSSFCESVVFASASIGLQ | GMGLGLSSI,GLSSIFALC,SIFALCLGH,MGLGLSSIF,LGLSSIF AL,LSSIFALCL,GLGLSSIFAL,GLSSIFALCL,GMGLGLSSIF,QG MGLGLSSI | GBM |
| SLC1A2 | c.1044_1045 insT | p.F348fs | LIIFIGGIFLPLIYVVTRKNPFSFF[p.F348fs]CWHFPSLDHCPGHRFQCWNFACHL SLPGRKSGD* | KNPFSFFCW,PFSFFCWHF,SFFCWHFPS,FFCWHFPSL,LDH CPGHRF,GHRFQCWN,FPSLDHCPG,CPGHRFQCW,WNFACHLSL,NPFS FFCWH,FPSLDHCPG,CPGHRFQCWN,SFFCWHFPSL,FQCW NFACHL,CWNFACHLSL,FACHLSLPGR,FSFFCWHFPS,RKN PFSFFCWH,NPFSFFCWHF,SLDHCPGHRF,FPSLDHCPGH | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SLC20A1 | c.984_985delAG | p.P328fs | PLQAVVEERTVSFKLGDLEEAPERE[p.P328fs]ASQRGLERGNQHR* | LEEAPEREA,RGLERGNQHR | UCEC |
| SLC22A15 | c.602C>T | p.S201L | NGGMSLVAFVLLNECVGTAYWALAG[p.S201L]LIGGLFFAVGIAQYALLGYFIRSWRT | ALAGLIGGL,GLIGGLFPA,LIGGLFFAV,TAYWALAGL,AYWALAGLI,LAGLIGGLF,AGLIGGLFF,GLIGGLFFAV,GTAYWALAGL,ALAGLIGGLF,TAYWALAGI,LAGLIGGLFF | CRC |
| SLC22A9 | c.1220G>A | p.R407Q | LQTLFGAVILLANCVAPWALKYMNR[p.R407Q]QASQMLLMFLLAICLLAIIFVPQEMQ | YMNRQASQM,ALKYMNRQA,KYMNRQASQ,RQASQMLL,M,MNRQASQML,QASQMLLMF,LKYMNRQAS,YMNRQASQML,KYMNRQASQM,RQASQMLLMF,MNRQASQMLL,L,KYMNRQASQ,NRQASQMLLM | GBM |
| SLC24A2 | c.401C>T | p.A134V | SENSTDHAQGDYPKDIFSLEERRKG[p.A134V]VIILHVIGMIYMFIALAIVCDEFFVP | RKGVIILHV,VIILHVIGMI,SLEERRKGVI,RKGVIILHVI,EERRKGVIIL | CRC |
| SLC24A5 | c.103C>A | p.R35S | ARRALLLGILWATAHLPLSGTSLPQ[p.R35S]SLPRATGNSTQCVISPSSEFPEGFFT | SLPQSLPRA,TSLPQSLPR,LPQSLPRAT,GTSLPQSLPR | LUAD |
| SLC25A17 | c.84del|T | p.F28fs | LSYESLVHAVAGAVGSVTAMTVFFP[p.F28fs]WIQLDFDFRLMRKENPKLHTWCSWRSLKKKDSWHHIEGGFQ* | AMTVFFPWI,IQLDFDFRL,RLMRKENPK,KLHTWCSWR,CSWRSLKKK,TWCSWRSLK,TAMTVFFPW,FFPWIQLDF,PWIQLDFDF,SWHHIEGGF,LMRKENPKL,HTWCSWRSL,WIQLDFDFR,DFDFRLMRK,TVFFPWIQL,KENPKLHTW,RSLKKKDSW,KKKDSWHHI,RLMRKENPKL,HTWCSWRSLK,TWCSWRSLKK,VTAMTVFFPW,TAMTVFFPWI,VFFPWIQLDF,LMRKENPKLH,MTVFFPWIQL,IQLDFDFRLM,RKENPKLHTW,L,HTWCSWRSL,LKKKDSWHHI,FPWIQLDFDF,NPKLHTWCSW | STAD |
| SLC25A32 | c.247C>G | p.Q83E | LRPKYNGILHCLTTIWKLDGLRGLY[p.Q83E]EGVTPNIWGAGLSWGLYFFYNAIKS | GLYEGVTPN,GLRGLYEGV,LYEGVTPNI,YEGVTPNIW,GLYEGVTPN,LYEGVTPNIW | BRCA |
| SLC25A40 | c.287G>A | p.R96Q | EGGNKLWYKKPGNFQGTLDAFFKII[p.R96Q]QNEGIKSLWSGLPPTLVMAVPATVIY | IQNEGIKSL,KIIQNEGIK,FKIIQNEGI,IQNEGIKSLW | CRC |
| SLC25A45 | c.316G>T | p.G106C | LLVLTATSHQERRAQPPSYMHIFLA[p.G106C]CTGGFLQAYCLAPPDLIKVRLQNQT | FLACCTGGF,YMHIFLACC,SYMHIFLAC,YMHIFLACCT,FLACCTGGFL,SYMHIFLACC,IFLACCTGGF,CCTGGFLQAY | BRCA |
| SLC25A48 | c.199G>A | p.A67T | TLSCIRVVYRRESMFGFFKGMSFPL[p.A67T]TSIAVYNSVVFGVFSNTQRFLSQHRC | GMSFPLTSI,TSIAVYNSV,MSFPLTSIA,FPLTSIAVY,MSFPLTSIAV,GMSFPLTSIA,LTSIAVYNSV,KGMSFPLTSI,SFPLTSIAVY,SIAVYNSVV | DLBCL |
| SLC25A48 | c.301C>A | p.R101S | VFGVFSNTQRFLSQHRCGEPEASPP[p.R101S]STLSDLLLASMVAGVVSVGLGGPVDL | SPPSTLSDL,EPEASPPSTL | LUAD |
| SLC25A5 | c.235A>T | p.I79F | IIDCVVRIPKEQGVLSFWRGNLANV[p.I79F]FRYFPTQALNFAFKDKYKQIFLGGVD | NLANVFRYF,RGNLANVFR,VFRYFPTQA,GNLANVFR,WRGNLANVF,FRYFPTQAL,NVFRYFPTQA,FWRGNLANVF,VFRYFPTQAI,RGNLANVFRY,GNLANVFRYF | CESC |
| SLC25A5 | c.352G>A | p.A118T | DKYKQIFLGGVDKRTQFWLYFAGNL[p.A118T]TSGGAAGATSLCFVYPLDFARTRLAA | WLYFAGNLT,LTSGGAAGA,NLTSGGAAGA,WLYFAGNLTS | KIRC |
| SLC26A3 | c.262G>A | p.V88I | WLPAYRLKEWLLSDIVSGISTGIVA[p.V88I]ILQGLAFALLVDIPPVYGLYASFFPA | GISTGIVAI,GIVAILQGL,AILQGLAFA,ILQGLAFAL,VAILQGL,AF,ISTGIVAIL,AILQGLAFAL,ILQGLAFALL,GISTGIVAIL,GIVAILQGLA,IVAILQGLAF,SGISTGIVAI | GBM |
| SLC26A7 | c.1886del|T | p.I629fs | LAHCTASLIKAMTYYGNLDSEKPIF[p.I629fs]LNRYLLQ* | KPIFLNRYL,NLDSEKPIFL,SEKPIFLNRY,DSEKPIFLNR,KPIFLNRYLL | STAD |
| SLC27A3 | c.1927del|C | p.P643fs | VNVYGVTVPGHEGRAGMAALVLRP[p.P643fs]TLWTLCSSTPTCLRTCHLM | WQMRASTPA,ALVLRPPTL,CSSTPTCLR,LTHCTFWTR,GSRSLWPPQ,PQRPSNSRK,QMRASTPAP,RASTPAPCL,NSRKF | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SLC2A6 | c.689C>A | p.A230D | PGPDSSGSRSLWPPQRPSNSRKFGWQ MRASTPAPCLTHCTFWTRL* | GWQM, LVLRPPTLW, RKFGWQMRA, APCLTHCTF, VLRPPT LWTL, TLCSSTPTCL, GSRSLWPPQR, RSLWPPQRPS, NSRKF GWQMR, QMRASTPAPC, LTHCTFWTRL, CLTHCTFWTR, TP TCLRTCHL, GPDSSGSRSL, AALVLRPPTL, ALVLRPPTLW, PQ RPSNSRKF, SNSRKFGWQM, RKFGWQMRAS, WQMRASTP AP, MRASTPAPCL, RPSNSRKFGW, APCLTHCTFW | PRAD |
| SLC2A7 | c.193G>A | p.A65T | LIMILLLSFMPNSPRFLLSRGRDEE[p.A2 30D]DLRALAWLRGTDVDVHWEFEQI QDNV | DLRALAWLR, EEDLRALAW, DEEDLRALAW, EEDLRALAWL | CRC |
| SLC2A7 | c.804C>A | p.H268Q | YNLSVNTPHKVFKSFYNETYFERH[p.A 65T]TTFMDGKLMLLLWSCTVSMPPLG GLL | TYFERHTTF, ETYFERHTT, HTTFMDGKL, YFERHTTFM, TTF MDGKLM, TYFERHTTFM, ETYFERHTTF | CRC |
| SLC2A7 | c.804C>A | p.H268Q | LRGHTMEAELEDMRAEARAEREAEG[p. H268Q]QLSVLHLCALRSLRWQLLSIIV LMAG | RAEGQLSVL, AERAEGQLS, AEGQLSVLH, QLSVLHLCAL, AER AEGQLSV, AEGQLSVLHL, GQLSVLHLCA | TGCT |
| SLC30 A9 | c.581G>A | p.R194H | LRSDVEAKSLEVWGSPEALAREKKL[p.R 194H]HKEAEIEYRERLFRNQKILREYRD FL | LAREKKLHK, LHKEAEIEY, REKKLHKEA, ALAREKKLHK, KLHK EAEIEY | CRC |
| SLC32 A1 | c.1480G>A | p.V494I | CFLLPSLFHLRLLWRKLLWHQVFFDI[p.V 494I][IAIFVIGGICSVSGFVHSLEGLIEEAY | VFFDIAIFV, LWHQVFFDI, FFDIAIFVI, IAIFVIGGI, QVFFDI AIF, HQVFFDIAI, LLWHQVFFDI, QVFFDIAIFV, VFFDIAIFVI, DIAIFVIGGI, HQVFFDIAIF, WHQVFFDIAI | STAD |
| SLC33 A1 | c.1625C>T | p.S542L | CVFIGFGWWFPLGPKFPKKL[QDEGSSL[p. S542L]LWKCKRNN* | KLIQDEGSSL, LQDEGSSLW, KKLQDEGSSL, KLIQDEGSSLW | CRC |
| SLC35 D3 | c.1250G>C | p.*417S | VWRLVRGTRYMKKDYLIENEELPSP[p. *417S]SEGGACTYLCAYTYFIC* | PSEGGACTY, CTYLCAYTY, YLCAYTYFI, TYLCAYTYFL, GACTYL CAY, SEGGACTYL, YLCAYTYFIC, CTYLCAYTYF, TYLCAYTYFI, GGACTYLCAY, ACTYLCAYTY, SPSEGGACTY | HNSC |
| SLC35 F2 | c.838G>A | p.A280T | CNKAFVFLLSWIVLRDRFMGVRIVA[p. A280T][TILAIAGIVMMTYADGFHSHSVI GIA | FMGVRIVAT, RIVATILAI, IVATILAIA, ATILAIAGI, GVRIVATIL, TILAIAGIV, MGVRIVATI, FMGVRIVATI, RIVATILAIA, ATILAI AGIV, RFMGVRIVAT, GVRIVATILA, MGVRIVATIL, VRIVATIL AI, TILAIAGIVM | CRC |
| SLC35 G2 | c.184del A | p.K62fs | INEGYGNFMEENPKKGLLSEMKKKG[p. K62fs]ELSLEPWIPYLHQOKT* | LSLEPWIPY, SLEPWIPYL, SEMKKKGEL, MKKKGELSL, GELSL EPWI, IPYLHQQKT, LSLEPWIPYL, EMKKKGELSL, ELSLEPWI PY, KKGELSLEPW | CESC |
| SLC37 A1 | c.1582G>A | p.V528I | ACALLFLIRLIHKELSCPGSATGDQ[p.V5 28I][IPFKEQ* | ATGDQIPFK, SATGDQIPF, SATGDQIPFK, GSATGDQIPF, CP GSATGDQI | TGCT |
| SLC38 A1 | c.298G>A | p.G100R | MSVFNLSNAIMGSGILGLAFALANT[p. G100R]RILLFLVLLTSVTLLSIYSINLLLIC | ALANTRILL, RILLFLVLL, LAFALANTR, NTRILLFLV, LANTRILL F, FALANTRIL, TRILLFLVL, ALANTRILLF, NTRILLFLVL, GLAPA LANTR, LAFALANTRI, FALANTRILL | TGCT |
| SLC38 A10 | c.3213_321 5del CAT | p.1071_107 2II>I | SDLRRRRRDLGPHAEGQLAPRDGVI[p. 1071_1072II>I]GLNPLPDVQNDLRG ALDAQLRQAAGGA | APRDGVIGL, RDGVIGLNPL | PAAD |
| SLC39 A12 | c.1883G>C | p.C628S | ILMNFISSLTAFMGLYIGLSVSADP[p.C6 28S]SVQDWIFTVTAGMFLYLSLVEMLP EM | SVQDWIFTV, DPSVQDWIF, GLSVSADPSV | LUAD |
| SLC39 A6 | c.158G>T | p.R53L | AFPQTEKISPNWESGINVDLAIST[p.R 53L]LQYHLQQLFYRYGENNSLSVEGFR KL | TLQYHLQQL, AISTLQYHL, LQYHLQQLF, DLAISTLQY, LQYHL QQLFY, TLQYHLQQLF, INVDLAISTL, VDLAISTLQY, LAISTLQ YHL, STLQYHLQQL | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SLC39 A7 | c.1144C>T | p.R382C | LHEVPHEVGDPAILVQSGCSKKQAM[p. R382C]CLQLLTAVGALAGTACALLTEG GAVG | KQAMCLQLL, AMCLQLLTA, KKQAMCLQL, AMCLQLLTAV, S KQAMCLQL, KKQAMCLQLL, KQAMCLQLLT | CRC |
| SLC39 A7 | c.1367_136 8insG | p.L456fs | SVLPELLREASPLQSLLEVLGLLGG[p.L4 56fs]SYHDGADCPP* | VLGLLGGSY, LLGGSYHDGA, EVLGLLGGSY, LEVLGLLGGS | CLL |
| SLC43A1 | c.398C>T | p.P133L | LVGSACFTASCTLMALASRDVEALS[p.P 133L]LLIFLALSLNGFGGICLTFTSLTLPN | ALSLLIFLA, LLIFLALSL, EALSLLIFL, RDVEALSLL, VEALSLL LIF, LSLLIFLAL, ALSLLIFLAL, SLLIFLALSL, ASRDVEALSL, EALSLLIFLA, RDVEALSLLI, VEALSLLIFL | CRC |
| SLC43A3 | c.647G>A | p.R216H | LLYEKGISLRASFIFISVCSTWHVA[p.R21 6H]HTFLLMPRGHIPYPLPPNYSYGLCP G | STWHVAHTF, TWHVAHTFL, HVAHTFLM, WHVAHTFLL, S TWHVAHTFL, VAHTFLLMPR, CSTWHVAHTF, TWHVAHTFL L, WHVAHTFLLM | CRC |
| SLC44A5 | c.208G>T | p.V70F | KPADTPSEEEDFGDPRTYDPDFKGP[p. V70F]FANRSCTDVLCCMIFLLCIIGYIVL G | FANRSCTDV, DFKGPFANR, TYDPDFKGPF, FANRSCTDVL | KIRC |
| SLC44A5 | c.554G>A | p.R185H | CPEKFLTYVEMQLLYTKDKSYWEDY[p. R185H]HQFCKTTAKPVKSLTQLLLDDD CPTA | HQFCKTTAK, SYWEDYHQF, YHQFCKTTA, KSYWEDYH QF, SYWEDYHQFC, HQFCKTTAKP, WEDYHQFCKT | CRC |
| SLC4A3 | c.3183de|G | p.L1061fs | SQKARRLLKGSGFHLDLLLIGSLGG[p.L1 061fs]SVGCLGCPGSRLPRSAPSPMSM R* | LLIGSLGGS, LIGSLGGSV, SLLGGSVGCL, RSAPSPMSM, SAPS PMSMR, LPRSAPSPM, LLIGSLGGSV, RLPRSAPSPM, RSAPSPMS MR, GSRLPRSAPS | STAD |
| SLC4A5 | c.1597A>G | p.I533V | WFPSDFYDGFHIQSIAILFIYLGC[p.I53 3V]VTNAITPFGGLLGDATDNYQGVMES FL | ILFIYLGCV, YLGCVTNAI, GCVTNAITF, AILFIYLGCV, FIYLGCV TNA, YLGCVTNAIT, ILFIYLGCVT, IYLGCVTNAI, LGCVTNAITF | LUAD |
| SLC4A8 | c.687C>G | p.N229K | LNDSMRVKVREALLKKHHHQNEKKR[p. N229K]KNLIPIVRSFAEVGKKQSDPHL MDKH | KKRKNLIPI, KRKNLIPIV, KKRKNLIPIV, EKKRKNLIPI, HQNEK KRKNL, KNLIPIVRSF | KIRC |
| SLC52A1 | c.1108_111 0de|GGC | p.G370de| | LSLLGMLFGAYIMALAILSPCPPLV[p.G 370de|]TTAGVLVLVLSWVLCLCVFSYV KVAASS | VTTAGVLV, LVTTAGVL, LVTTAGVLIV, VTTAGVLVV, C PPLVTTAGV | KIRC |
| SLC52A2 | c.1197_1198 insG | p.G399fs | LSWVLCLGVFSYVKVAASSLLHGGG[p. G399fs]PAGIAGSRRGHPGGLSARRCC YVPPDQHLSRVPQQKGLCRPL* | SLLHGGGPA, LSARRCCYV, HLSRVPQQK, CVVPPDQHL, GSR RGHPGG, RGHPGGLSA, GLSARRCCY, QQKGLCRPL, LLHGG GPAGI, GLSARRCCYV, GSRRGHPGGL, RGHPGGLSAR, SARR CCYVPP, VPPDQHLSRV | KIRC |
| SLC5A1 | c.157G>T | p.G53W | DISIVIYFVVVMAVGLWAMFSTNR[p. G53W]WTVGGFFLAGRSMVWWPIGA SLFASN | WTVGGFFLA, WAMFSTNRW, MFSTNRWTV, RWTVGGFFL, AMFSTNRWT, TNRWTVGGF, NRWTVGGFF, AMPSTNRW TV, LWAMFSTNRW, RWTVGGFFLA, STNRWTVGGF, TNR WTVGGFF | LUAD |
| SLC5A7 | c.1006G>T | p.G336C | KTTEEADMILPIVLQCLPVVISFF[p.G3 36C]CLGAVSAAVMSSADSSILSASSMF AR | YISFFCLGA, CLGAVSAAV, ISFFCLGAV, VVISFFCL, YISFFCL GAV, FCLGAVSAAV, VYISFFCLGA, CLGAVSAAVM, CPVYISF FCL | HNSC |
| SLC5A7 | c.1325G>T | p.G442V | IFPQLLCVLFVKGTNTYGAVAGYVS[p.G 442V]VLFLRITGGEPYLYLQPLIFYPGYY P | AVAGYVSVL, YVSVLFLRI, VAGYVSVLF, GYVSVLFLR, AGVVS VLFL, AGVVSVLFLR, AVAGYVSVLF, GYVSVLFLRI, YGAVAGY VSV, GAVAGYVSVL | LUAD |
| SLC6A10P | c.264A>C | p.K88N | WSFFTPLVCMGLFIFNVVYYKPLVV[p.K 88N]NNTNVYPWWGEAMGWAFVLSS MLCMP | YYKPLVVNN, YYKPLVVNNT, KPLVYNNTNV | GBM, KIRC |
| SLC6A11 | c.896G>T | p.W299L | TLPGASEGIKFYLYPDLSRLSDPQV[p.W 299L]LVDAGTQIFFSYAICLGCLT ALGSYN | RLSDPQVLV, VLVDAGTQI, SRLSDPQVL, LVDAGTQIF, LVDA GTQIFF, VLVDAGTQIF, LSRLSDPQVL | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SLC6A14 | c.255_256 insG | p.A85fs | FPYLTYSNGGAFLIPYAIMLALAGF[p. A85fs]FTFVLSGVFTGTIC* | LALAGFTFV,ALAGFTFVL,VLSGVFTGT,MLALAGFTF,FTFVL SGVF,AIMLALAGF,MLALAGFTFV,FVLSGVFTGT,VLSGVFT GT,AIMLALAGE,ALAGFTFVLS,AGFTFVLSGV,YAIMLALA GFT,IMLALAGFTF,GFTFVLSGVF,FTFVLSGVF,LALAGFTFVL AVPSEATKK,ATKKDQNLK,ATKKDQNLKR | KIRC |
| SLC6A9 | c.281G>A | p.R94K | LLPQLMAQHSLAMAQNGAVPSEATK[p. R94K]KDQNLKRGNWGNQIEFVLTSV GYAVG | | CLL |
| SLC6A9 | c.727C>T | p.R243W | AYCNNPWNTHDCAGVLDASNLTNGS[p. R243W]WPAALPSNLSHLLNHSLQRT SPSEEY | NLTNGSWPA,WPAALPSNL,ASNLTNGSW,NLTNGSWPAA, SWPAALPSNL,LTNGSWPAAL,DASNLTNGSW | BLCA |
| SLC7A10 | c.471de|C | p.P157fs | TSLAVISMTFSNYVLQPVFPNCIPP[p. P157fs]PQPPGCCPWPA* | FPNCIPPPQ | STAD |
| SLC7A2 | c.964C>T | p.R322W | TLAGAATCFYAFVGPDCIATTGEEV[p. R322W]WNPQKAIPIGIVTSLLVCFMAYF GVS | EVVNPQKAI,EEVWNPQKA,IATTGEEVW,EEVWNPQKAI, GEEVWNPQKA | UCEC |
| SLC8A1 | c.1292G>A | p.R431H | VSKIFFEQGTYQCLENCGTVALTII[p. R431H]HRGGDLTNTVFVDFRTEDGTANA GSD | GTVALTIIH,TVALTIIH,GTVALTIIHR | CRC |
| SLC8A1 | c.1297G>T | p.G433C | KIFFEQGTYQCLENCGTVALTIIRR[p.G4 33C]CGDLTNTVFVDFRTEDGTANAGS DYE | CGDLTNTVF,RCGDLTNTVF | LUAD |
| SLC9A2 | c.2237de|C | p.T746fs | SPQSYKMEWKNEVDVDSGRDMPSTP[p. T746fs]QHPTAEKRAPRRQAYYSSPF SLKTSLAQRGKTV* | SLAQRGKTV,KTSLAQRGK,RQAYYSSPF,AYYSSPFSL,RAPR RQAYY,YYSSPFSLK,SLKTSLAQR,KRAPRRQAY,PTAEKRAP R,MPSTPQHPT,SFSLKTSL,AYYSSPFSLK,STPQHPTAEK,FS LKTSLAQR,RQAYYSSPFS,QAYYSSPFSL,KRAPRRQAYY,PT AEKRAPRR,MPSTPQHPTA,SPFSLKTSLA,RRQAYYSSPF,AE KRAPRRQA | STAD |
| SLC9A4 | c.1892G>A | p.R631H | RTLSYNKYNLKPQTSEKQAKEILIR[p.R6 31H]HQNTLRESMRKGHSLPWGKPAG TKNI | ILIRHQNTL,LIRHQNTLR,HQNTLRESM,KEILIRHQN,ILIRH QNTLR,HQNTLRESMR,EILIRHQNTL,KQAKEILIRH,RHQNT LRESM,KEILIRHQNT | GBM |
| SLC9A5 | c.1341G>C | p.L447F | TKVPAKDYFVATTIWVFFTVIVQG[p.L4 47F]FTIKPLVKWLKVKRSEHHKPTLNQE L | VIVQGFTIK,FFTVIVQGF,FTIKPLVKW,GFTIKPLVK,FTVIVQGFT, TVIVQGFTI,VQGFTIKPL,FTIKPLVKWL,TVIVQGFTIK,QGFTIK PLVK,VFFTVIVQGF,GFTIKPLVKW,FTVIVQGFTI | BLCA |
| SLC9B1 | c.1338_1339 de|GT | p.V446fs | FAGPSFKEKIPIALAWMPKATVQAV[p. V446fs]RSSGSRNSKSLRTPLGTICEGCD DSSIFSHLDHSSKWSSTYGHSGA* | HSSKWSSTY,SLRTPLGTI,RSSGSRNSK,FSHLDHSSK,GSRNSKS LR,SSKWSSTYG,NSKSLRTPL,SHLDHSSKW,SKWSSTYG H,AVRSSGSRNS,KSLRTPLGTI,IFSHLDHSSK,SSKWSSTYGH, MPKATVQAVR,RNSKSLRTPL,CEGCDDSSIF,FSHLDHSSKW | KIRC |
| SLCO2A1 | c.1437G>C | p.M479I | IFHPVCGDNGIEYLSPCHAGCSNIN[p.M 479I]ISSATSKQLIYLNCSCVTGGSASAKT | ISSATSKQL,NININSATSK,ISSATSKQLI | CESC |
| SLIT1 | c.4379G>T | p.R1460L | SGTKGAHCVCDPGFSGELCEQESEC[p. R1460L]LGDPVRDFHQVQRGYAICQTT RPLSW | ESECLGDPV,CLGDPVRDF,QESECLGDPV | LUAD |
| SLITRK1 | c.134de|A | p.K45fs | TGDVCKEKICSCNEIEGDLHVDCEK[p.K 45fs]RASQCVSVSLPRLPSFTIYFCMAIP SLDFSLMSSLTFIMRLVCTWKTMACMK SFRGLFWGCSW* | FTIYFCMAI,SLMSSLTFI,LMSSLTFIM,SLTFIMRLV,IMRLVC TWK,TMACMKSFR,QVCSVSLPR,MSSLTFIMR,VSLPRLPSF, RLPSFTIYF,YFCMAIPSL,CMAIPSLDF,FSLMSSLTF,FIMRLV CTW,KITMACMKSF,CMKSFRGLF,RGLFWGCSW,TWKTM ACMK,KSFRGLFWG,LPRLPSFTI,IPSLDFSLM,RLVCTWKT M,KRASQVCSV,ASQVCSVSL,SQVCSVSLP,LDFSLMSSL,CT WKTMACM,MKSFRGLFW,CEKRASQVC,LPSFTIYFC,SLPR | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SLITRK1 | c.155G>A | p.R52H | KICSCNEIEGDLHVDCEKKGFTSLQ[p.R52H]HFTAPTSQFYHLFLHGNSLTRLFPNE | LPSFTI,RLPSFTIYFC,SLDFSLMSSL,FSLMSSLTFL,SLMSSLTFI M,RLVCTWKTMA,LMSSLTFIMR,FIMRLVCTWK,CTWKTM ACMK,KTMACMKSFR,SQVCSVSLPR,SFTIYFCMAI,IYFCM AIPSL,FCMAIPSLDF,DFSLMSSLTF,TFIMRLVCTW,CMKSF RGLFW,SSLTFIMRLV,MAIPSLDFSL,MSSLTFIMRL,RASQV CSVSL,LPRLPSFTIY,LPSFTIYFCM,MACMKSFRGL,SVSLPRL PSF,MRLVCTWKTM,WKTMACMKSF,ACMKSFRGLF,FRGL FWGCSW,CEKRASQVCS SLQHFTAPT,KGFTSLQHF,HFTAPTSQF,FTSLQHFTA, LQHFTAPTS,HFTAPTSQFY,KKGFTSLQHF,LQHFTA PTSQ,QHFTAPTSQF | CRC |
| SLITRK3 | c.641G>T | p.R214L | PTNLFKAVSLTHLDLRGNRLKVLFY[p.R214L]LGMLDHIGRSLMELQLEENPWN CTCE | FYLGMLDHI,RLKVLFYLG,KVLFYLGML,LKVLFYLG M,LFYLGMLDHI,RLKVLFYLGM,YLGMLDHIGR, LKVLFYLGML | LUSC |
| SLITRK3 | c.893C>T | p.S298L | REIRKTELCPLLSDSEVEASLGIPH[p.S298L]LSSSKENAWPTKPSSMLSSVH FTASS | GIPHLSSSK,LSSSKENAW,LGIPHLSSSK,VEASLGIPHL,HLSS SKENAW | CRC |
| SLITRK5 | c.1403G>T | p.R468M | NRISMIQDRAFGDLTNLRRLYLNGN[p.R468M]MIERLSPELFYGLQSLQYLFLQY NLI | RLYLNGNMI,YLNGNMIER,RRLYLNGNM,YLNGNMIERL,N MIERLSPEL,LYLNGNMIER,LRRLYLNGNM,RRLYLNGNMI, MIERLSPELF | LUAD |
| SLITRK5 | c.203G>T | p.R68L | YYGEICDNACPCEEKDGILTVSCEN[p.R68L]LGIISLSEISPPRFPIYHLLLSGNLL | ILTVSCENL,TVSCENLGI,CENLGIISL,NLGIISLSEI,LTVSCENL GI,CENLGIISLS | LUAD |
| SLITRK6 | c.2223C>A | p.N741K | HLQRSLLEQENHSPLTGSNMKYKT T[p.N741K]KQSTEFLSFQDASSLYRNILEKE REL | KQSTEFLSF,SNMKYKTTK,KYKTTKQST,TTKQSTEFL,KTTKQ STEF,GSNMKYKTTK,KTTKQSTEFL,MKYKTTKQST,YKTTKQ STEF,TKQSTEFLSF | LUAD |
| SMAD2 | c.962G>A | p.R321Q | SLTVDGFTDPSNSERFCLGLLSNVN[p.R321Q]QNATVEMTRRHIGRGVRLYYIG GEVF | LLSNVNQMA,VNQNATVEM,GLLSNVNQNA,NVNQNATVEM | CRC |
| SMAD4 | c.1082G>A | p.R361H | GETFKVPSSCPIVTVDGYVDPSGGD[p.R361H]HFCLGQLSNVHRTEAIERARLHIG KG | YVDPSGGDHF,DPSGGDHFCL | CRC |
| SMAP1 | c.506del A | p.E169fs | QPLVSSPSLQAAVDKNKLEKEKEKK[p.E169fs]RKKREKRSQKSRQNHLQLKSCR RKISNWSLKKVPALKLRSPLWIF* | ALKKLRSPL,KISNWSLKK,SLKKVPALK,KLRSPLWIF,KKRKRK REK,RKREKRSQK,RSQKSRQNH,SQKSRQNHL,KSRQNHLQ L,RRKISNWSL,RKISNWSLK,KVPALKKLR,HLQLKSCRR,WSL KKVPAL,RQNHLQLKS,KKVPALKKL,LKKLRSPLW,KKLRSPL WI,KISNWSLKKV,KSRQNHLQLK,SLKKVPALKK,WSLKKVP ALK,KRKREKRSQK,RSQKSRQNFIL,HLQLKSCRRK,RRKISN WSLK,CRRKISNWSL,NWSLKKVPAL,QKSRQNHLQL,RQNH LQLKSC,LQLKSCRRKI,ALKKLRSPLW,KKLRSPLWIF | UCS |
| SMARCA4 | c.1142G>A | p.R381Q | QKPRGLDPVEILQEREYRLQARIAH[p.R381Q]QIQELENLPGSLAGDLRTKATIEL KA | LQARIAHQI,RIAHQIQEL,HQIQELENL,RLQARIAHQI, ARIAHQIQEL | CRC |
| SMARCA4 | c.2738C>T | p.P913L | NHHCKLTQVLNTHYVAPRLLLTGT[p.P913L]LLQNKLPELWALLNFLLPTIFKSC ST | RLLLTGTLL,LLQNKLPEL,LTGTLLQNK,RRLLLTGTL, TLLQNKLPEL,LLTGTLLQNK,RRLLLTGTLL | HNSC |
| SMARCA5 | c.468_471 de lAGAA | p.T156fs | KQNLLSVGDYRHRRTEQEEDEELLT[p.T156fs]APKQPMFALDLKTLHRM* | APKQPMFAL,LLTAPKQPM,LTAPKQPMF,KQPMFALDL,LD LKTLHRM,KQPMFALDLK,LTAPKQPMFA,FALDLKTLHR,TA PKQPMFAL,LLTAPKQPMF,PMFALDLKTL,QEEDEELLTA | TGCT |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SMC3 | c.2908G>C | p.E970Q | ELGSLPQEAFEKYQTLSLKQLFRKL[p.E970Q]QQCNTELKKYSHVNKKALDQFVN FSE | KLQQCNTEL, KLQQCNTELK, QQCNTELKKY, RKLQQCNTEL | TGCT |
| SMCR8 | c.523G>A | p.E175K | VRPFCMAYISADQHKIMQQFQELSA[p.E175K]KFSRASECLKTGNRKAFAGELEK KLK | ELSAKFSRA, QQFQELSAK, QFQELSAKF, AKFSRASEC, AKFSRASEC, MQQ FQELSAK, KFSRASECLK, QQFQELSAKF, AKFSRASECL, QELS AKFSRA | UCEC |
| SMG1 | c.8087C>A | p.P2696H | LICNTTVERCQELYRKYEMQYAPQP[p.P2696H]HPTVCQFITATEMTLQRYAAD INSRL | YAPQPHPTV, APQPHPTVC, QPHPTVCQF, MQYAPQPHP, Q YAPQPHPTV, YEMQYAPQPH, MQYAPQPHPT, HPTVCQFIT A, QPHPTVCQFI | TGCT |
| SMG7 | c.2536_2537 insA | p.E846fs | TQDPIKLFEPSLQPPVMQQQPLEKK[p.E846fs]NEAFSHGAI* | NEAFSHGAI, QPLEKNEAF, KKNEAFSHGA | PRAD |
| SNAPC1 | c.633de|T | p.D211fs | QNMKHVISVDKSKPDKALSLIKDDF[p.D211fs]LTILRT* | LIKDDFLTI, IKDDFLTIL, SLIKDDFLTI, ALSLIKDDFL, LIKDDFLTIL | STAD |
| SNAPC2 | c.875del|C | p.T292fs | IPAGGSLGPAAEGDGAGSKAPEETP[p.T292fs]QPPRRPSTAN* | TPQPPRRPS, TPQPPRPST | STAD |
| SND1 | c.112C>G | p.Q38E | GPAVPTVQRGIIKMVLSGCAIIVRG[p.Q38E]EPRGGPPPERQINLSNIRAGNLAR RA | AIIVRGEPR, CAIIVRGEPR | CESC |
| SND1 | c.2163de|C | p.H721fs | VQDVETGTQLEKLMENMRNDIASHP[p.H721fs]L* | RNDIASHPL, MRNDIASHPL | STAD |
| SOAT1 | c.190de|T | p.F64fs | GRIDIKQLIAKKIKLTAEAEELKPF[p.F64fs]L* | AEAEELKPFL | STAD |
| SOLH | c.2141G>A | p.R714H | GFLMGASCGGGNMKVDDSAYESLGL[p.R714H]HPRHAYSILDVRDVQGTRLLRLRNPW AQMLASGTMDAQMLASSTQDSAMLG | GLHPRHAYS, LGLHPRHAY, HPRHAYSIL, SAYESLGLH, YESL GLHPR, GLHPRHAYSI, SLGLHPRHAY, YESLGLHPRH | LIHC |
| SON | c.2723C>T | p.S908L | [p.S908L]LKSPDPYRLAQDPYRLAQDP YRLGHD | GLKSPDPYR, LGLKSPDPY, TQDSAMLGL, LKSPDPYRL, GLKS PDPYRL, TQDSAMLGLK, MLGLKSPDPY, STQDSAMLGL | LUSC |
| SON | c.4075_4098de|GTCCTGGAGTCTTCGGCTGTGACC | p.VLES SAVT13 59de| | LAESILEPPAMAAPESSAMAVLESS[p.VLESSAVT1359de|]TVTVLESSTVTVLEP SVVTVPEPPVVAEPDYVTIPVPVVSALE PSVPVL | AMAVLESST, MAVLESSTV, AMAVLESSTV, AVLESSTVTV | KIRC |
| SORBS1 | c.1710C>A | p.F570L | VLTNEKMSRDISPEEIDLKNEPWYK[p.F570L]LFSELEFGKPPPKIWDYTPGDCSIL | KNEPWYKLF, PWYKLFSEL, LKNEPWYKL, YKLFSELEF, KLFSE LEFGK, WYKLFSELEF, EPWYKLFSEL, LKNEPWYKLF | CRC |
| SORBS1 | c.3466G>A | p.V1156M | AERGAGERGPCGPKISKKSCLKPSD[p.V1156M]MVRCLSTEQRLSDLNTPEESRP GKPL | CLKPSDMVR, KPSDMVRCL, MVRCLSTEQR, KKSCLKPSDM | CRC |
| SORBS2 | c.2596C>T | p.P866S | VFEALDSALKICDQIKAEKKRGSL[p.P866S]SDNSIIHRLISELLPDVPERNSSLRA | RGSLSDNSI, LSDNSILHRL, SLSDNSILHR, RGSLSDNSIL | PAAD |
| SORBS2 | c.3472 de|G | p.E1158fs | DRIHSLSSNKPQRPVFTHENIQGGG[p.E1158fs]NRFRLCITILPGMKMSWSSEKV MSLMSWKSVMTAGLWGPQEEPNSLV LSPETTSRGCELRSLLI* | SSEKVMSLM, KMSWSSEKV, SLMSWKSVM, LMSWKSVMT, KVMSLMSWK, CITILPGMK, RFRLCITIL, ILPGMKMSW, MS LMSWKSV, MSWKSVMTA, TTSRGCELR, MTAGLWGPQ, ET TSRGCEL, GPQEEPNSL, MSWSSEKVM, NRFRLCITI, ITILPG MKM, WSSEKVMSL, EKVMSLMSW, WKSVMTAGL, KSVMT AGLM, QEEPNSLVL, SEKVMSLMS, VMSLMSWKSV, SLMS WKSVMT, LMSWKSVMTA, RLCITILPGM, GMKMSWSSEK, LVLSPETTSR, RFRLCITILP, MSLMSWKSVM, SWKSVMTAGL, | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SORCS2 | c.958C>T | p.R320W | FWSVSGVDADPDLVHVEAQDLGGDF[p.R320W]MYVTCAIHNCSEKMLTAPFAGPIDHG | NIQGGNRFR, ETTSRGCELR, WSSEKVMSLM, KMSWSSE KVM, IQGGNRFRL, NRFRLCITIL, MKMSWSSEKV, SEKVM SLMSW, MSWKSVMTAG, WKSVMTAGLW | CRC |
| SORL1 | c.614G>T | p.R205L | ADAYAQYLWITFDFCNTLQGFSIPF[p.R205L]LAADLLLHSKASNLLLGFDRSHPNKQ | DLGGDFWV, DFWYVTCAI, GDFWYVTCA, AQDLGGDFWY, GDFWYVTCAI, EAQDLGGDFW | LUAD |
| SOS1 | c.697A>T | p.N233Y | FMAEIRQYIRELNLIIKVFREPFVS[p.N233Y]YSKLFSANDVENIFSRIVDIHELSVK | LQGFSIPFL, PFLAADLLI, IPFLAADLL, TLQGFSIPFL, FLAADLL LHS, LAADLLLHSK, FSIPFLAADL, IPFLAADLLL | LUAD,UCEC |
| SOWAHA | c.371G>C | p.R124P | AAQPSKPTSTVLPRSASAPGAPPLV[p.R124P]PVPRPVEPPGDLGLPTEPQDTPGGPA | PFVSYSKLF, VFREPFVSY, VSYSKLFSA, EPFVSYSKL, REPFVSY SK, FVSYSKLFSA, KVFREPFVSY, VFREPFVSYS, REPFVSYSKL, EPFVSYSKLF | LUAD,UCEC |
| SOX17 | c.1208G>T | p.S403I | PYQGHDSGVNLPDSHGAISSVVSDA[p.S403I]ISAVYYCNYPDV* | APGAPPLVPV | ACC |
| SOX6 | c.2155C>T | p.R719W | HLEKPYNYKYKPRPKRTCIVDGKKL[p.R719W]IGEYKQLMRSRRQEMRQFFTVGQQP | VSDAISAVY, ISAVYYCNY, VVSDAISAV, ISSVVSDAI, SDAISA VYY, VVSDAISAVY, VSDAISAVYY, SVVSDAISAV, AISSVVSD AI, AISAVYYCNY | UCEC |
| SOX7 | c.925del|C | p.L309fs | RRIPHLPGHPYSPEYAPSPLHCSHP[p.L309fs]WAPWLASPPASP* | LWIGEYKQL, GKKLWIGEY, KLWIGEYKQL, LWIGEYKQLM, WIGEYKQLMR | CRC |
| SOX9 | c.223G>A | p.E75K | ENTFPKGEPDLKKESEEDKPFVCIR[p.E75K]KAVSQVLKGYDWTLVPMPVRVNGSSK | SHPWAPWPL, SPLHCSHPW, HPWAPWPLA, HCSHPWAP W, WPLASPPAS, CSHPWAPWPL, APWPLASPPA, LHCSHP WAPW, HPWAPWPLAS | STAD |
| SP4 | c.17_19 del|AGG | p.E11del | MSDQKEEEE[p.E11de]|AAAAAAAA TEGGKTSEPENNNKKPKTSG | CIRKAVSQV, RKAVSQVLK, FPVCIRKAV, IRKAVSQVL, CIRKA VSQVL, IRKAVSQVLK, KAVSQVLKGY, FPVCIRKAVS | LUAD |
| SP4 | c.19G>A | p.E7K | MSDQKK[p.E7K]KEEEEAAAAAAMATEGGKTSEPENNN | KEEEEAAAA, KEEEEAAAAA | LUSC |
| SPAG16 | c.1315G>T | p.V439L | GDTTVKLWDLCKGDCILTFEGHSRA[p.V439L]LWSCTWHSCGNFVASSSLLDKTSKIWD | KEEEEAAAA, KEEEEAAAAA | TGCT |
| SPAG16 | c.1462C>T | p.P488S | WDVNSERCRCTLYGHTDSVNSIEFF[p.P488S]SFSNTLLTSSADKTLSIWDARTGICEGQESTGQYVIDEEPTWDIMVRQSYP | ALWSCTWHS, HSRALWSCT, FEGHSRALW, SRALWSCTW, R ALWSCTWH, ALWSCTWHSC, LITPEGHSRAL, TPEGHSRALW, HSRALWSCTW | LUAD |
| SPAG17 | c.3790 de|C | p.Q1264fs | LVYTFGETVALGASGIVIWGTLSIM[p.Q1264fs]RG* | EFFSFSNTL, NSIEFFSFS, VNSIEFFSF, IEFFSFSNT, FSFSNTLLT, SVNSIEFFSF, EFFSFSNTL, IEFFSFSNTL, FSFSNTLLTS IMVRQSYPR, MVRQSYPRG, DIMVRQSYPR | SKCM |
| SPAM1 | c.1037G>A | p.R346Q | QVRAYIRHLNRIVTIIQKWWRSFLG[p.R346Q]QSMKSCLLLDNYMETILNPYIINVTL | IMQSMKSCLL, MQSMKSCLL, TLSIMQSM, GTLSIMQSM, Q SMKSCLLL, IMQSMKSCLL, SIMQSMKSCL, MQSMKSCLL, G TLSIMQSMK, WGTLSIMQSM | STAD |
| SPATA17 | c.215G>A | p.R72K | NDFKPQCKRTNLVANDGKNSCPVSS[p.R72K]KKQYQLTVQVAYYTMMMNLYNAMAVR | FLGKKQYQL, KWWRSFLGK, WWRSFLGKK, RSFLGKKQY, G KKQYQLTV, FLGKKQYQLT, SFLGKKQYQL, KWWRSFLGKK, WRSFLGKKQY, KKQYQLTVQV | GBM |
| SPATA22 | c.449C>T | p.S150L | KVCTKTMPIGPDVSLENLAAETCFF[p.S150L]VAQQQKQLRIPEPPNLSRNKETELLR | VSSVAQQQK, SVAQQQKQLR, GKNSCPVSSV | CESC |
| SPATA5L1 | c.2055 de|T | p.C685fs | KVCTKTMPIGPDVSLENLAAETCFF[p.C685fs]|LELILETSAQKLL|CWLCKKMD* | LAAETCFFL, LILETSAQK, KLLCWLCKK, ETCFFLELI, AETCFFL EL, LETSAQKLL, LELILETSA, NLAAETCFFL, FLELILETSA, LILET | CRC |
| | | | | | STAD |

TABLE 8-continued

| gene | cDNA Change | Protein Change | Mutation Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SPATA9 | c.566G>T | p.C189F | AVLKKVKNIFQEEESIRQNREESEN[p.C189F]FRKAFSEPVLSEPMFAEGEIKAKPYR | SAQKL, KLLCWLCKKM, AQKLLCWLCK, ETCFFLELIL, AETCFFLELI FRKAFSEPV, EESENFRKA, NFRKAFSEPV, RQNREESENF, EE SENFRKAF, FRKAFSEPVL, REESENFRKA | KIRC |
| SPEG | c.2831C>T | p.A944V | EAEGGLCRLRILAAERGDAGFYTCK[p.A944V]VVNEYGARQCEARLEVRAHPESRSLA | YTCKVVNEY, DAGFYTCKV, FYTCKVVNEY | CRC |
| SPEG | c.2975_2976insG | p.A992fs | AVLAPLQDVDVGAGEMALFECLVAG[p.A992fs]AH* | FECLVAGAH, ALFECLVAGA | KIRC |
| SPEN | c.2407_2408de|GA | p.E803fs | RLERYTKNEKTDKERTFDPERVERE[p.E803fs]TLNTEGKSGKGQN* | TLNTEGKSGK | GBM |
| SPESP1 | c.363C>G | p.F121L | EETTFPTGGFTPEIGKKKHTESTPL[p.F121L]LWSIKPNNVSIVLHAEEPYIENEEPE | KKHTESTPL, KHTESTPLW, TESTPLWSI, KKKHTESTPL, KKHT ESTPLW | BLCA |
| SPG20 | c.696de|T | p.F232fs | QPPPLETLGLDADELLIPNGVQIF[p.F232fs]L* | IPNGVQIFL, LIPNGVQIFL | STAD |
| SPIN2B | c.448A>G | p.M150V | ANTIIGKAVEHMFEGEHGSKDEWRG[p.M150V]VVLAQAPIMKAWFYITYEKDPVLYMY | KDEWRGVVL, VVLAQAPIM, DEWRGVVLA, VVLAQAPIMK, SKDEWRGVVL, RGVVLAQAPI, DEWRGVVLAQ | TGCT |
| SPIN4 | c.512A>G | p.Y171C | PVMDTWFYITYEKDPVLYMYTLLDD[p.Y171C]CKDGDLRIIPDSNYYFPTAEQEPGEV | YMYTLLDDC, YMYTLLDDCK | LUAD |
| SPINT1 | c.947C>T | p.A316V | LREEECILACRGVQQGPLRGSSGAQ[p.A316V]VTFPQGPSMERRHPVCSGTCQPTQFR | VTFPQGPSM, GSSGAQVTF, RGSSGAQVTF, AQVTFPQGPS | GBM |
| SPOP | c.148G>A | p.E50K | TQIKVVKFSYMWTINNFSFCREEMG[p.E50K]KVIKSSTFSSGANDKLKWCLRVNPKG | KVIKSSTFS, GKVIKSSTF, FSFCREEMGK, MGKVIKSSTF | UCEC |
| SPOP | c.304T>G | p.F102V | DEESKDYLSLYLLLVSCPKSEVRAK[p.F102V]VKFSILNAKGEETKAMESQRAYRFVQ | KSEVRAKVK, RAKVKFSIL, KVKFSILNA, SEVR AKVKF, KVKFSILNAK, RAKVKFSILN, EVRAKVKFSI, KSE VRAKVKF, VRAKVKFSIL, AKVKFSILNA, CPKSEVRAKV | PRAD |
| SPOP | c.305T>G | p.F102C | DEESKDYLSLYLLLVSCPKSEVRAK[p.F102C]CKFSILNAKGEETKAMESQRAYRFVQ | KSEVRAKCK, RAKCKFSIL, KCKFSILNA, SEVRAKCKF, RAKCKFSILN, KCKFSILNAK, EVRAKCKFSI, KSEVRAKCKF, VRAKCKFSIL | PRAD |
| SPOP | c.391T>G | p.W131G | ILNAKGEETKAMESQRAYRFVQGKD[p.W131G]GGFKKFIRRDFLLDEANGLLPDDKLT | QGKDGGFKK, GGFKKFIRR, GKDGGFKKF, RFVQGKDGGF | PRAD |
| SPOP | c.397T>A | p.F133I | NAKGEETKAMESQRAYRFVQGKDWG[p.F133I]IKKFIRRDFLLDEANGLLPDDKLTLF | FVQGKDWGI, DWGIKKFIR, WGIKKFIRR, GKDWGIKKF, RFV QGKDWGI, DWGIKKFIRR | PRAD |
| SPOP | c.397T>G | p.F133V | NAKGEETKAMESQRAYRFVQGKDWG[p.F133V]VKKFIRRDFLLDEANGLLPDDKLTLF | FVQGKDWGV, DWGVKKFIR, GKDWGVKKF, DWGVKKFIRR | PRAD |
| SPOP | c.398T>G | p.F133C | NAKGEETKAMESQRAYRFVQGKDWG[p.F133C]CKKFIRRDFLLDEANGLLPDDKLTLF | DWGCKKFIR, GKDWGCKKF, DWGCKKFIRR | PRAD |
| SPOP | c.399C>G | p.F133L | NAKGEETKAMESQRAYRFVQGKDWG[p.F133L]LKKFIRRDFLLDEANGLLPDDKLTLF | FVQGKDWGL, DWGLKKFIR, GKDWGLKKF, LKKFIRRDF, FV QGKDWGLK, RFVQGKDWGL, DWGLKKFIRR | PRAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SPTA1 | c.5195A>C | p.K1732T | EKLKEAVALFQFFQDLDDESWIEE[p.K1732T]TLIRVSSQDYGRDLQGVQNLLK KHKR | WIEETLIRV,EESWIEETL,SWIEETLIRV,TLIRVSSQDY,ESWIE ETLIR,DEESWIEETL,EESWIEETLI | STAD |
| SPTA1 | c.6032C>T | p.A2011V | PEITDLKDKLISAQHNQSKAIEERY[p.A2 011V]VALLKRWEQLLEASAVHRQKLLE KQL | RYVALLKRW,AIEERYVAL,KAIEERYVA,IEERYVALL,AIEERY VALL,KAIEERYVAL | GBM |
| SPTA1 | c.6727G>T | p.D2243Y | DLGDNLEDALILDIKYSTIGLAQQW[p.D 2243Y]YQLYQLGLRMQHNLEQQIQAK DIKGV | LAQQWYQLY,GLAQQWYQL,QOWYQLYQL,WYQLYQLGL, AQQWYQLYQ,STIGLAQQWY,AQQWYALYQL,QWYQLYQ LGL,GLAQQWYQLY,WYQLYQLGLR,YQLYQLGLRM | LUAD |
| SPTA1 | c.7099G>T | p.G2367C | FLIDKESENIKSSDEIENAFQALAE[p.G2 367C]CKSYITKEDMKQALTPEQVSFCA THM | ALAECKSYI,QALAECKSY,ALAECKSYIT,NAFQALAECK,FQA LAECKSY,CKSYITKEDM | LUAD |
| SPTB | c.256C>T | p.R86C | KWVNSHLARVSCRITDLYKDLRDGR[p. R86C]LLIKLLEVLSGEMLPKPTGKMRI HC | RLLIKLLEVL,LLIKLLEVL,RDGRLLIKL,RLLIKLLEVL,DLRDGRLL IK | CRC |
| SPTB | c.5591C>T | p.T1864I | APERELHLLGVGVQQFQDVATRLQT[p. T1864I]VAGEKAEAIQNKEQEVSAAW QALLD | ATRLQTVVA,VATRLQTVY,DVATRLQTV,RLQTVYAGEK,VY AGEKAEAI,ATRLQTVYAG,TVYAGEKAEA,DVATRLQTVY,L QTVYAGEKA | KIRC |
| SPTBN4 | c.5978C>T | p.A1993V | ADKPRDVSSVEVLMNVHQGLKTELE[p. A1993V]VRVPELTTCQELGRSLLLNKSA MADE | ELEVRVPEL,TELEVRVPE,GLKTELEVRV,HQGLKTELEV,TEL EVRVPEL,LEVRVPELTT | CRC |
| SPTLC3 | c.290G>A | p.R97K | IGTLFGVLRDFLRNWGIEKCNAAVE[p.R 97K]KKEQKDFVPLYQDFENFYTRNLYM RI | KKEQKDFVPL | SKCM |
| SPTY2D1 | c.1454del|C | p.P485fs | GSSRGPGRPVSSPHELRRPVSGLGP[p.P 485fs]RGGLSVALGDP* | GPRGGLSVA,GLGPRGGLSV,GPRGGLSVAL | STAD |
| SRCAP | c.5625_562 6insC | p.Q1875fs | RSGPPSPPSTATSFGGPRPRRQPPP[p. Q1875fs]TTSFPFLSGLPGGKAEAAAV* | GLPGGKAEA,RQPPPTSF,TSFPFLSGL,RPRRQPPT,PPFLS GLPG,FLSGLPGGA,GLPGGKAEAA,TTSFPFLSGL,RPRRQP PPTT,QPPPTTSPPF,RRQPPPTTSF,PPFLSGLPGG | KIRP |
| SRCAP | c.5626_562 7insC | p.P1876fs | RSGPPSPPSTATSFGGPRPRRQPPP[p.P 1876fs]TTSFPFLSGLPGGKAEA AAV* | GLPGGKAEA,RQPPPTSF,TSFPFLSGL,RPRRQPPT,PPFLS GLPG,FLSGLPGGA,GLPGGKAEAA,TTSFPFLSGL,RPRRQP PPPT,QPPPTTSPPF,RRQPPPTTSF,PPFLSGLPGG | STAD |
| SRCIN1 | c.2595del|C | p.P865fs | LSQSPKKVTAETDFNKSVDFEMPPP[p. P865fs]APR* | FEMPPPAPR,VDFEMPPPA,DFEMPPPAPR | STAD |
| SREBF2 | c.2289del|C | p.H763fs | LSRAQSLCGPEHSAVPDSLRWLCHP[p. H763fs]WARSFSWSGAGL* | RWLCHPWAR,RSFSWSGAG,HPWARSFSW,SLRWLCHPW,LCH PWARSF,SLRWLCHPWA,CHPWARSFSW,RW LCHPWARS,WARSFSWSGA,RSFSWSGAGL,HPWARSFSWS, WLCHPWARSF,DSLRWLCHPW | STAD |
| SRGAP1 | c.182C>T | p.T61M | EQQTEMRVQLIQDLQDFFRKKAEIE[p. T61M]MEYSRNLEKLAERFMAKTRSTK DHQQ | MEYSRNLEK,KKAEIEMEY,IEMEYSRNL,RKKAEIEMEY,MEY SRNLEKL | MM |
| SRPRB | c.40G>A | p.G14S | MASADSRRVADGG[p.G14S]SAGGTF QPYLDTLRQELQQTDPTLLS | SAGGTFQPY,GSAGGTFQPY,ADGGSAGGTF | BLCA |
| SRRM2 | c.6769G>T | p.A2257S | IPAASAAMNLASARTPAIPTAVNL[p. A2257S]SDSRTPAAAAMNLASPRTAV APSAV | NLSDSRTPA,NLSDSRTPAA | TGCT |
| SRSF11 | c.51_52ins G | p.G17fs | MSNTTVVPSTAGPGPSGG[p.G17fs]A RWRWWWRRRRRHRGNPGD* | RWRRWWWRR,RWWWRRRRR,GARWRRWWWR,RWR RWWWRRR,RWWWRRRRRH,WWWRRRRRHR | PRAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SSPO | c.12593del C | p.S4198fs | PRGQQSRFRSSTSGSWAPECREEQS[p. S4198fs]RASPALSPRAHPCACRALAPA PWGTAGCRGSASGAPAPRRV* | ALAPAPWGT, ALSPRAHPC, RASPALSPR, SASGAPAPR, QSR ASPALS, RAHPCACRA, RGSASGAPA, SPALSPRAH, SPRAHP CAC, APAPWGTAG, EQSRASPAL, CRALAPAPW, EEQSRASP A, ALAPAPWGTA, ALSPRAHPCA, GSASGAPAPR, RASPALSPRA, RAHPCACRAL, REEQSRASPA, EEQSRAS PAL, ACRALAPAPW | PRAD |
| ST18 | c.2334C>A | p.H778Q | KTLKSLMAANSQELKCPTPGCDGSG[p. H778Q]QVTGNYASHRSLSGCPRARKG GVKMT | GSQVTGNY, GQVTGNYAS, QVTGNYASHR, GQVTGNYAS H | LUAD |
| ST6GA LNAC1 | c.1061G>A | p.S354N | ELNYSLVQKVVTRFPPVPQQQLLLA[p. S354N]NLPAGSLRCITCAVVGNGGILNN SHM | LLANLPAGS, QQQLLLANL, LANLPAGSL, LLANLPAGSL, NLPAGSLRCI, LANLPAGSLR, QQLLLANLPA | TGCT |
| STAB1 | c.3358_335 9insC | p.P1120fs | ASVDVADLLATNGVLHILSQVLLPP[p.P 1120fs]PRGCARWAGVAAAAGLGACL QPLPGIAAAPWVGAPD* | GLGACLQPL, RGCARWAGV, CARWAGVAA, RWAGVAAAA, IAAAPWVGA, QPLPGIAAA, ARWAGVAAA, LQPLPGIAA, LPGIAAAPW, GIAAAPWVGA, RGCARWAGVA, CAR WAGVAAA, LLPPPRGCAR, ARWAGVAAAA, AAAAGLGACL, AGLGACLQPL, LQPLPGIAAA, LPPPRGCARW, LPGIAAAPWV | STAD |
| STAC3 | c.349G>T | p.G117W | FKDHFFKKPKFCDVCARMIVLNNKF[p. G117W]WLRCKNCKTNIHEHCQSVTE MQRCFG | VLNNKFWLR, WLRCKNCKT, IVLNNKFWLR, RMIVLNNKFW, KFWLRCKNCK, MIVLNNKFWL | LUAD |
| STAM | c.427T>C | p.Y143H | TDELKNDLLLKKVNVEYQEYLQSKNK[p.Y 143H]HKAEILKKLEHQRLIEAERKRIAQ MR | KHKAEILKK, YLQSKNKHKA, KNKHKAEILK, SKNKHKAEIL | TGCT |
| STARD8 | c.1985G>C | p.G662A | RRNKTPDYRGQHVFGVPPLIHVQRT[p. G662A]AQPLPQSIQQAMRYLRSQCLD QVGIF | HVQRTAQPL, RTAQPLPQSI, IHVQRTAQPL | TGCT |
| STAT2 | c.1466_146 7insC | p.P489fs | AWASVLWFNLLSPNLQNQQFFSNPP[p. P489fs]NGPLELAGPCSQLAVLLLCWP RPQLRPAEHAEKQAVRAEL* | LLCWPRPQL, AVILLLCWPR, FSNPPNGPL, ELAGPCSQL, NPP NGPLEL, WPRPQLRPA, RPQLRPAEH, QQFFSNPPN, AEHAE KQAV, LLLCWPRPQL, QLRPAEHAEK, SQLAVLLLCW, LAVLL LCWPR, LLCWPRPQLR, ELAGPCSQLA, WPRPQLRPAE, RPQ LRPAEHA, RPAEHAEKQA, QQFFSNPPNG, FFSNPPNGPL, LE LAGPCSQL, AEKQAVRAEL | STAD |
| STAT3 | c.1982A>T | p.D661V | SVEPYTKQQLNNMSPAEIIMGYKIM[p. D661V]VATNILVSPLIVYLYPDIPKEEAFG KY | IIMGYKIMV, IMGYKIMVA, IMVATNILV, KIMVATNIL, YKIM VATNI, IIMGYKIMVA, KIMVATNILV, IMGYKIMVAT, GYKIM VATNI, EIIMGYKIMV, YKIMVATNIL, IMVATNILVS, VATNILVSPL | HNSC |
| STAT5B | c.1101_110 2insC | p.P367fs | KTQTKFAATVRLLVGGKLNVHMNPP[p. P367fs]PGEGHHHQ* | HMNPPPGEGH | STAD |
| STAT6 | c.1061_106 2insC | p.P354fs | QVLKTQTKFQAGVRFLLGLRFLGAP[p.P 354fs]SQASAGQGRHGDREAGAGAEC ASGSWGWSRKHWRNHQQHCALGEQ HSWELLLCPVQEPASQEDQAV* | LLCPVQEPA, ASGSWGWSR, SGSWGWSRK, SWGWSRKH W, RFLGAPSQA, WSRKHWRNH, WGWSRKHWR, REAGAG AEC, RNHQQHCAL, CALGEQHSW, GEQHSWELL, EQHSWE LLL, WELLLCPVQ, FLGAPSQASA, ALGEQHSWEL, HSWELLLCPV, LLLCPVQEPA, CASGSWGWSR, ASGSWGWSRK, HWR NHQQHCA, SWGWSRKHW, LRFLGAPSQA, SQASAGQGRL H, REAGAGAECA, AGABCASGSW, WRNHQQHCAL, WRNHQQHCA, WRNHQQHCAL, QQHCALGE QH, GEQHSWELL | KIRC |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| STAT6 | c.1402G>C | p.D468H | LGPGKLPIQLQALSLPLVIVHGNQ[p.D468H]HNNAKATILWDNAFSEMDRVPFVVAE | HGNQHNNAK, NQHNNAKAT, NQHNNAKATI | DLBCL |
| STK11 | c.837del|C | p.G279fs | EGDNIYKLFENIGKGSYAIPGDCGP[p.G279fs]RSLTC* | YAIPGDCGPR, IPGDCGPRSL | LUSC |
| STK11IP | c.464C>A | p.A155E | PLHCLHGLRGIYSQLETLICSRSLQ[p.A155E]ELEELLSACGDFCSALPWLALLSAN | SLQELELL, QELEELLSA, LICSRSLQEL, RSLQELEELL, LQELEE LLSA, QELEELLSAC | KIRC |
| STK19 | c.265G>A | p.D89N | RGARPGGDAGTPGETVRHCSAPE[p.D89N]NPIFRFSSLHSYPPPGTIKSRDMSWK | SAPENPIFR, NPIFRFSSL, CSAPENPIF, CSAPENPIFR, SAPEN PIFRF, RHCSAPENPI, HCSAPENPIF, NPIFRFSSLH | SKCM |
| STK19 | c.52_53ins G | p.R18fs | MQKWFSAPDDAIIQRQW R[p.R18fs]GKPLPGRGRCELHEGG* | IIQRQWRGK, LPCRGRCEL, QROWRGKPL, RQWRGKPLP, AI IQRQWRGK, QWRGKPLPGR, RGKPLPGRGR, IQRQWRGKP L, RQWRGKPLPG | PRAD |
| STOML3 | c.256G>T | p.D86Y | VVFRLGRIQADKAKGPGLILVLPCI[p.D86Y]VFVKVDLRTVTCNIPPQEILTRDSV | ILVLPCIYV, VLPCIYVFV, YVFVKVDLR, LVLPCIYVF, IYVFVKV DL, LILVLPCIY, LILVLPCIYV, LVLPCIYVFV, VLPCIYVFVK, ILVL PCIYVF, GLILVLPCIY, IYVFVKVDLR, LPCIYVFVKV | LUAD |
| STON1-GTF2A 1L | c.1352A>G | p.N451S | KVTKEGKFVESAVITQIYCLCFVNG[p.N451S]LECFLTLNDLELPKRDESYYEKDS E | CLCFVNGSL, FVNGSLECF, GSLECFLTL, FVNGSLECFL, CFVN GSLECF | TGCT |
| STRA6 | c.203A>G | p.Q68R | QPAGNQTSPGATEDYSYGSWYIDEP[p.Q68R]RGGEELQPEGEVPSCHTSIPPGLYHA | GSWYIDEPR | BRCA |
| STRADA | c.997del|C | p.R333fs | EELTMSPSRSVANSGLSDSLLTTSTP[p.R333fs]GPPTVTRPPTPTTEPSPPTSTTLWSSAFSATRMPGPVPAPS* | TLWSSAFSA, WSSAFSATR, VTRPPTPTT, ATRMPGPVP, TTL WSSAFS, STTLWSSAF, SSAFSATRM, TRMPGPVPA, MPGPV PAPS, SPPTSTTLW, TLWSSAFSAT, FSATRMPGPV, TTLWSS AFSA, AtRMPGPVPA, STPGPPTVTR, LWSSAFSATR, TTSTP GPPTV, EPSPPTSTTL, TSTTLWSSAF, WSSAFSATRM | STAD |
| STRN3 | c.654G>T | p.K218N | LDVRSRQRVRSLLGLSNSEPNGSVET[p.K218N]NNLEQILNGGESPKQKGQEIKRSSGD | ETNNLEQIL, VETNNLEQI, VETNNLEQIL | UCEC |
| STT3B | c.1747G>T | p.D583Y | TSNAYSSPSVVLASYNHDGTRNILD[p.D583Y]YFREAYFWLRQNTDEHARVMSWWDYG | ILDYFREAY, NILDYFREA, DYFREAYFW, YFREAYF WL, GTRNILDYF, LDYFREAYF, GTRNILDYFR, DYFREAYFWL, YFREAYFWLR, NILDYFREAY, ILDYFREAYF | CRC |
| STX2 | c.320G>T | p.R107L | KKTANKIRAKLKAIEQSFDQDESGN[p.R107L]LTSVDLRIRRTQHSVLSRKFVEAM AE | DESGNLTSV, LTSVDLRIRR | LUAD |
| STX2 | c.756del|A | p.K252fs | MINNIERNVMNATDYVEHAKEETKK[p.K252fs]LSNIRARQEGKSG* | NIRARQEGK, ETKKLSNIR | STAD |
| STXBP6 | c.274G>A | p.D92N | QFEGSTSFVRRSQWMLEQLRQVNGI[p.D92N]NPNGDSAEFDLLFENAFDQMVASTAS | RQVNGINPN, NPNGDSAEF, RQVNGINPNG | UCEC |
| SULT1C4 | c.254G>A | p.R85Q | WTQEIVELIQNEGDVEKSKRAPTHQ[p.R85Q]QFPPLEMKIPSLGSSLEQAHAMPSPR | QQFPPLEMK, QPPFLEMKI, APTHQQPPF, HQQFPFLEM, KR APTHQQF, HQQFPFLEMK, RAPTHQQF PF, KSKRAPTHQQ, APTHQQPPFL, SKRAPTHQQF, THQQPPFL EM, QQFPPLEMKI | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SULT1E1 | c.230G>A | p.R77Q | WVSEIVMIYKEGDVEKCKEDVIFN[p.R77Q]QIPFLECRKENLMNGVKQLDEMNSPR | VIFNQIPFL,DVIFNQIPF,KEDVIFNQI,DVIFNQIPFL | UCEC |
| SUMF2 | c.329G>A | p.G110E | IFPVTNKDFRDFVREKKYRTEAEMF[p.G110E]EWSFVFEDFVSDELRNKATQPMKSVL | EMFEWSFVF,EWSFVFEDF,AEMFEWSFV,FEWSFVFED,EAEMFEWSF,TEAEMFEWS,AEMFEWSFVF,EAEMFEWSFV,TEAEMFEWSF,FEWSFVFEDF | LUAD |
| SUN3 | c.1016C>A | p.P339Q | TFELQHAVSEYLLCVKLNIFSNWGH[p.P339Q]QKYTCLYRFRVHGTPGKHI* | FSNWGHQKY,IFSNWGHQK,HQKYTCLYR,GHQKYTCLY,W GHQKYTCLQKYTCLYRF,NIFSNWGHQ,HQKYTCLYRF,IFSNWG HQKY,WGHQKYTCLY | LUAD |
| SUN3 | c.370C>A | p.L124I | LRMPKEQLELLKKESQNLENNFRQI[p.L124I]IFLIEQIDVLKALLRDMKDGMDNNHN | QIIFLIEQI,NFRQIIFLI,LENNFRQI,RQIIFLIEQ,RQIIFLIEQI,IFLIEQIDVL,LENNFRQIIF | UCEC |
| SUN3 | c.382G>A | p.E128K | KEQLELLKKESQNLENNFRQILFLI[p.E128K]KQIDVLKALLRDMKDGMDNNHNWNTH | FLIKQIDVL,KQIDVLKAL,LIKQIDVLK,LLFLIKQIDV,KQIDVLKALL,RQIIFLIKQI,FLIKQIDVLK,NFRQILFLIK,IKQIDVLKAL | CRC |
| SUPT6H | c.2869G>A | p.A957T | SSDEDILCLKFHPLQEHVVKEELLN[p.A957T]TLYCEFINRVNEVGVDVNRAIAHPYS | TLYCEFINR,LLNTLYCEF,VKEELLNTL,KEELLNTLY,LLNTLYC EFI,TLYCEFINRV,NTLYCEFIN,ELLNTLYCEF,VKEELLNTLY | CRC |
| SUSD1 | c.1027C>T | p.R343C | SRRINPKISVVISIKGQRLDPMESV[p.R343C]CEETVNLTTDSRTPEVCLALYPGTNY | MESVCEETV,CEETVNLTT | UCEC |
| SUSD5 | c.1538C>T | p.T513M | YELTSSTLEILTVNTVKQTPNHIPS[p.T513M]MIMATTQPPVETTVPEIQDSPFYLLS | TPNHIPSMI,SMIMATTQP,MIMATTQPF,IPSMIMATT,MI MATTQPPV,KQTPNHIPSM,QTPNHIPSMI,TPNHIPSMIM,SMIMATTQPP | GBM |
| SV2A | c.412del|G | p.E138fs | MADGAPLAGVRGGLSDGEGPPGGRG[p.E138fs]RHNDGKNEKNWPNSMKPSYGSVATAASSGHCILCLVWR* | SMKPSYGSV,KPSYGSVAT,WPNSMKPSY,NEKNWPNSM,MKPSYGSVA,AASSGHCIL,SMKPSYGSVA,GGRGRHNDGK,NWPNSMKPSY,NSMKPSYGSV,KPSYGSVATA,KNEKNWPNSM,MKPSYGSVAT,TAASSGHCIL,SGHCILCLVW | STAD |
| SV2C | c.179C>A | p.P60Q | DRAQDEYTQRSYSRFQDEEDDDYY[p.P60Q]QAGETYNGFANDDEGSSEATEGHDED | YYQAGETYNG,DDYYQAGETY | LUAD |
| SVIL | c.278T>C | p.M93T | EKQTRSKYCTETSGVHGDSPYGSGT[p.M93T]TDTHSLESKAERIARYKAERRRQLAE | TTDTHSLESK | KIRC |
| SVIL | c.5586del|G | p.G1862fs | ERGAQVQVLQCKEPPCFLQCFQGG[p.G1862fs]WMCTRGGGKRKKMCKVSGGCTACVERCPWKGICWKWPVTVAA* | KGICWKWPV,PWKGICWKW,CTRGGGKRK,RGGGKRKKK,CWKWPVTVA,FQGGWWCTR,LQCFQGGWW,CKVSGGCTA,WKWPVTVAA,VERCPWKGI,KVSGGCTACV,GICWKWP VTV,TACVERCPWK,CFLQCFQGGW,GWWCTRGGGK,CTRGGGKRKK,GGKRKKKMCK,CWKWPVTVAA,CFQGGWWC TR,CPWKGICWKW | STAD |
| SYCP2 | c.1422A>T | p.K474N | KPSKYIKNSDKGNRNNSQLEKTTPS[p.K474N]NRKMSEASMIVSGADRYTMRSPVLFS | KTTPSNRKM,NRKMSEASM,TPSNRKMSEA,SQLEKTTPSN,SNRKMSEASM | HNSC |
| SYMPK | c.1007C>G | p.A336G | HPASLEFQAQITTLLVDLGTPQAEI[p.A336G]GRNMPSSKDTRKRPRDDSDSTLKKMK | IGRNMPSSK,PQAEIGRNM,AEIGRNMPS,TPQAEIGRNM,AEIGRNMPSS | TGCT |
| SYN2 | c.99_101del AGC | p.A34del | LSDSSFIANLPNGYMTDLQRPEPQQ[p.A34del]PTPPPGPGAASAAAPPTASPGPERTPP | LQRPEPQQPT | BLCA,KIRP,PRAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| SYNDIG1 | c.403G>T | p.D135Y | CCETTFIEDRSPTKDSLEYPDGKFI[p.D135Y]YLSADDIKIHTLSVDEEEEFQELE | YLSADDIKI,FIYLSADDI,YPDGKFIYL,FIYLSADDIK,EYPDG KFIYL,KFIYLSADDI,IYLSADDIKI,LEYPDGKFIY | LUAD |
| SYNE2 | c.9309G>T | p.K3103N | ESRRLNAQILSQRIEKAKCLCDEII[p.K3103N]NKLLNENKTFDDSFKEKEILQIKLNAE | CLCDEIINK,IINKLNENK,NKLNENKTF,CLCDEINKL | CRC |
| SYNGR4 | c.506G>A | p.R169Q | QAAIAFTFFSIILVWIFOAYLARQDL[p.R169Q]QNDAPVPYKRFLDEGMVLTTLPLPS | LQNDAPVPY,FQDLQNDAPV,LQNDAPVPYK,DLQNDAPVPY | CRC |
| SYNJ1 | c.2041A>T | p.I681F | KTISRDNKYVLLASEQLVGVCLFVF[p.I681F]FRPQHAPFIRDVAVDTVKTGMGGATG | FVFFRPQHA,GVCLFVFFR,VGVCLFVFF,FFRPQHAPF,VFFR PQHAPF,FFRPQHAPFI,VGVCLFVFFR | CLL |
| SYNJ2 | c.2495A>C | p.K832T | WRKKHPPDKTAGELNLLLDSDLLDVDT[p.K832T]TVRHTWSPGALQYYGRAELQASDHRP | TVRHTWSPG,TVRHTWSPGA | KIRC |
| SYNJ2 | c.3331_3332insC | p.P1111fs | HRSPSRSLSVPNRPRPPQPPQRPPP[p.P1111fs]SNRPNGEKVGFRCVHLLRHPWTVFNFADGKTSTRSTSATSQGSDWNK* | HLLRHPWTV,TVFNFADGK,TSQGSDWNK,RFNGEKVGF,RH PWTVFNF,KVGFRCVHL,GFRCVHLLR,KTSTRSTSA,STRST SATS,LLRHPWTVF,CVHLLRHPW,HPWTVFNFA,GEKVGFR CV,VGFRCVHLLR,WTVFNFADGK,ATSQGSDWNK,HLLRH PWTVF,LRHPWTVFNF,KVGFRCVHLL,GFRCVHLLRH, KTSTRSTSAT,STRSTSATSQ,RFNGEKVGFR,NFADGKT STR,PQRPPPSNRF,NRFNGEKVGF,RCVHLLRHPW TIQTKPEEK,IQTKPEEKM,RNRPETIQTK,IQTKPEKMF | STAD |
| SYNM | c.1547G>A | p.R516Q | RTVILGKKTEVKATRQERNRPETI[p.R516Q]QTKPEEKMFDSKEKASEERNLRWEEL | GQPQIHVYF,MARRGQPQI,RGGPQIHVY,QPQIHVFR,AQ GDPESRL,SMARRGQPQI,RGGPQIHVYF,MARRGQPIH,R RGQPQIHVY | UCEC |
| SYNPO | c.1856_1857insC | p.G619fs | SSHLKGQAVPASKTGILEESMARRG[p.G619fs]QPQIHVYPRGEAQGDPESRLAGSGTDSG* | | KIRC |
| SYT4 | c.1de|A | p.M1fs | [p.M1fs]MLRSPPAGKNLMKSPQWWGSSVHLAWSSQSLSLHGSAVRENHPSLTRLLHTSLCMCLRELIFTLKT* | HLAWSSQSL,SLSLHGSAV,CLRELIFTL,LLHTSLCMC,SLCMC LREL,WLRSPPAGK,HTSLCMCLR,QWWGSSVHL,AVRENH PSL,LTRLLHTSL,LSLHGSAVR,SPPAGKNLM,SPQWWGSSV, RLLHTSLCM,KNLMKSPQW,PQWWGSSVH,WGSSVHLA W,AWSSQSLSL,CMCLRELIF,RELIFTLKT,SLTRLLHTSL,LLHT SLCMCL,SLCMCLRELI,CLRELIFTLK,WWGSSVHLAW,KSPQ WWGSSV,AVRENHPSLT,SLSLHGSAVR,HPSLTRLLHT,LA WSSQSLSL,SQSLSLHGSA,GKNLMKSPQW,PQWWGSSVHL,VHLAWSSQ SL,SQSLSLHGSA,SAVRENHPSL,RENHPSLTRL,TRLLHTSLC M,LCMCLRELIF,SPQWWGSSVH | STAD |
| SYT7 | c.1046C>T | p.T349M | TMKRNLNPIFNESFAFDIPTEKLRE[p.T349M]MTIIITVMDKDLSRNDVIGKIYLSW | KLREMTIII,IPTEKLREM,REMTIIITV,EMTIIITVM,MTIIITV MDK,KLREMTIIIT,REMTIIITVM | CRC |
| SYT8 | c.1117C>T | p.R373W | GARASGQPLQHWADMLAHARRPIAQ[p.R373W]WHPLRPAREVDRMLALQPRLRLRLPL | QWHPLRPAR,PIAQWHPLR,RPIAQWHPL,HARRPIAQW,A QWHPLRPA,HARRPIAQWH,RPIAQWHPLR,AHARRPIAQ W,RRPIAQWHPL | ACC |
| SYTL2 | c.1320C>G | p.I440M | FPINGLHSHSEVLTARPQSMENSPT[p.I440M]MNEPKDKSSELTRLESVLPRSPADEL | QSMENSPTM,PQSMENSPTM | BLCA |
| TAB3 | c.632G>C | p.R211T | HIPRYSTNPITVTVSQNLPSGQTVP[p.R211T]TALQILPQIPSNLYGSPGSIYIRQTS | QTVPTALQI,LPSGQTVPT,TALQILPQI,GQTVPTALQI,LPSG QTVPTA | BLCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TADA2B | c.199G>A | p.E67K | IGHHRYHGYQLVDGGRFTLWGPEAp.E67K]KGGWTSREEQLLLDAIEQFGFGNWED | FTLWGPEAK,EAKGGWTSR,RFTLWGPEAK | CESC |
| TAF1 | c.2527C>T | p.R843W | SKDRPRRIRMEDIKKAFPSHSESSI[p.R843W]WKRLKLCADFKRTGMDSNWWVLKSDF | IWKRLKLCA,HSESSIWKR,SESSIWKRL,FPSHSESSIW,WKRLKLCADF | UCEC |
| TAF1A | c.514_515CG>AT | p.R172M | HGMLKDAKRNLSEAETWRHGENTSS[p.R172M]MEILINLIQAYKGLLQYYTWSEKKMEL | SSMEILINL,SMEILINLI,NTSSMEILI,RHGENTSSM,GENTSSMEI,MEILINLIQ,SSMEILINLI,WRHGENTSSM,GENTSSMEIL,MEILINLIQA | SKCM |
| TAF1B | c.874C>T | p.R292C | GIESWPDYEDIYKKTVEVGTFLDLP[p.R292C]CFPDITEDCYLHPNILCMKYLMEVNL | GTFLDLPCF,LDLPCFPDI,FLDLPCFPDI,VGTFLDLPCF | BLCA |
| TAF1L | c.2553de|A | p.K851fs | QVFIYRLFWKSKDRPRRIMEDIKK[p.K851fs]PFLPIQKAASGRG* | DIKKPFLPI,RMEDIKKPF,MEDIKKPFL,KPFLPIQKAA,IRMEDIKKPF,RMEDIKKPFL | STAD |
| TAF5 | c.388T>G | p.S130A | RQSKLREAEEALRREAGLLEEAVAG[p.S130A]AGAPGEVDSAGAEVTSALLSRVTASA | LLEEAVAGA,EEAVAGAGA,GLLEEAVAGA,LEEAVAGAGA | ACC |
| TANK | c.1139C>T | p.S380L | LDSPGKAIRGPQQPIWKPFPNQDSD[p.S380L]LVVLSGTDSELHIPRVCEFCQAVFPP | NQDSDLVVL,FPNQDSDLV,KPFPNQDSDL,FPNQDSDLVV | CRC |
| TAOK2 | c.2696_2697insG | p.Q899fs | QRVEEELLALQTGRSERIRSLLERQ[p.Q899fs]GP* | RIRSLLERQG | KIRC |
| TARBP1 | c.2344C>G | p.L782V | VLTELINLHLKVGWKRGNPIWRVIS[p.L782V]VLKNASIQHLQEMDSGQEPTVGSAIQ | RVISVLKNA,IWRVISVLK,NPIWRVISV,VLKNASIQHL,PIWRVISVLK,NPIWRVISVL | LUSC |
| TARS2 | c.595G>A | p.E199K | RGSELPVLERICQELTAAARPFRRL[p.E199K]KASRDQLRQLFKDNPFKLHLIEEKVT | AARPFRRLK,RLKASRDQL,RPFRRLKAS,AAARPFRRLK,AARPFRRLKA,RPFRRLKASR,RLKASRDQLR,RRLKASRDQL | LUAD |
| TARSL2 | c.1097G>A | p.G366D | KGPHVRHTGKIKTIKIFKNSSTYWE[p.G366D]DNPEMETLQRIYGISFPDNKMM | TYWEDNPEM,STYWEDNPEM,WEDNPEMETL | GBM |
| TAS1R2 | c.808C>T | p.R270C | PNQNMTSEERQRLVTIVDKLQQSTA[p.R270C]CVVVVFSPDLTLYHFFNEVLRQNFTG | KLQQSTACV,LQQSTACVV,STACVVVV,QSTACVVVV,QQSTACVVV,KLQQSTACVV,QQSTACVVVV,STACVVVVFS,LQQSTACVVV,QSTACVVVVF | CRC |
| TAS1R3 | c.1573G>A | p.E525K | SRQCQEGQVRRVKGPHSCCYDCVDC[p.E525K]KAGSYRQNPDDIACTFCGQDEWSPER | CVDCKAGSY,CVDCKAGSYR | BLCA |
| TAS2R1 | c.549C>A | p.F183L | KFFSQNATIQKEDTLAIQIFSFVAE[p.F183L]LSVPLLIFLFAVLLLIFSLGRHTRQM | QIFSFVAEL,FVAELSVPL,FSFVAELSVP,LL,IFSFVAELSV,SF,VAELSVPL,LSVPLLIFLF,ELSVPLLIFL,FSFVAELSVP,AELSVPLLIF | CRC |
| TAS2R16 | c.531G>T | p.Q177H | IQLLTMEHLPRNSTVDKLENFHQY[p.Q177H]HFQAHTVALVIPFILFLASTIFLMAS | QYHFQAHTV,HFQAHTVAL,LENFHQYHF,FHQYHFQAH,HQYHFQAHT,YHFQAFITVA,HQYHFQAHTV,KLENFHQYHF,YHFQAHTVAL | LUAD |
| TAS2R16 | c.691G>A | p.V231I | QIQHHSTGHCNPSMKARFTALRSLA[p.V231I]ILFIVFTSYFLTLITIIGTLFDKRC | RSLAILFIV,FTALRSLAI,ILFIVFTSY,SLAILFIV,ALRSLAILF,ALRSLAIL,ALRSLAILFI,FTALRSLAIL,SLAILFIVFT,RFTALRSLAI,TALRSLAILF,RSLAILFIVF,ILFIVFTSYF,AILFIVFTSY,T MM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TAS2R30 | c.707_708 insT | p.L236fs | HGKGSQDPSTKVHIKALQTVTSFLL[p.L 236fs]VMCHLLSVHDHISL* | FLLVMCHLL,LVMCHLLSV,HLLSVHDHI,SFLLVMCHL,QTVT SFLLV,TVTSFLLVM,VMCHLLSVH,LSVHDHISL,LIVMCHLL SV,LLSVHDHISL,SFLLVMCHLL,QTVTSFLLVM,LVMCHLLS VH,LQTVTSFLLV,TSFLLVMCHL | KICH |
| TAS2R38 | c.932T>C | p.I311T | MAACPSGHAAILISGNAKLRRAVMT[p. I311T]TLLWAQSSLKVRADHKADSRTL C* | AVMTTLLWA,TLLWAQSSL,RAVMTTLLW,KLRRAVMTT,L RRAVMTTLL,RRAVMTTLL,KLRRAVMTTL,TLLWAQSSLK,RR AVMTTLLW,RAVMTTLLWA,TLLLWAQSSL,LRRAVMTTLL | KIRC |
| TAS2R41 | c.763G>A | p.A255T | TRALKSLISFLLIYALSFLSLLIIDA[p.A 255T]TKFISMQNDFYWPWQIAVVLCISVHP | FLSLIIDAT,LIIDATKFI,LSLIIDATKF,SLIIDATKF,IDATKFISM,S LIIDATKFI,LSLIIDATKF,IIDATKFISM,TKFISMQNDF | GBM |
| TAS2R8 | c.294G>C | p.W98C | PDVYTKNKQQIVIFFTWTFANYLNM[p. W98C]CITTCLNVFYFLKIASSSHPLFLW LK | YLNMCITTC,FANYLNMCI,LNMCITTCL,CITTCLNVF,YLN MCITTCL,NMCITTCLNV,TFANYLNMCI,CITTCLNVFY, MCITTCLNVF | TGCT |
| TAS2R9 | c.487G>C | p.E163Q | FLISLIISVPKNDDMWYHLFKVSHE[p.E1 63Q]QNITWKFKVSKIPGTFKQLTLNLG VM | HEQNITWKF,FKVSHEQNI,VSHEQNITW,VSHEQNITWK,K VSHEQNITW,SHEQNITWKF | BLCA |
| TAT | c.1100G>A | p.R367H | TLSFLKSNADLCYGALAAIPGLRPV[p.R 367H]HPSGAMYLMVGIEMEHFPEFEND VEF | GLRPVHPSG,PVHPSGAMY,RPVHPSGAM,HPSGAMYLM, GLRPVHPSGA,RPVHPSGAMY,HPSGAMYLMV,AAIPGLRP VH,LRPVHPSGAM | GBM |
| TBC1D1 | c.212C>T | p.S71F | EVRRLSRQSTRKEPVTKQVRLCVSP[p.S 71F]FGLRCEPEPGRSQQWDPLIYSSIFEC | RLCVSPFGL,QVRLCVSPF,RLCVSPFGLR,KQVRLCVSPF,QV RLCVSPFG,VRLCVSPFGL | BLCA |
| TBC1D1 | c.830A>G | p.H277R | DGGLRSSGFFSSFEESDIENHLISG[p.H2 77R]RNIVQPTDIEENRTMLFTIGQSEVYL | HLISGRNIV,DIENHLISGR | KIRC |
| TBC1D12 | c.1823T>A | p.F608Y | PDVGYVQGMSFIAAVLILNLEEADA[p.F 608Y]YIAFANLLNKPCQLAFFRVDHSM MLK | NLEEADAYI,AYIAFANLL,EADAYIAFA,DAYIAFANL,EEADA YIAF,LNLEEADAY,LEEADAYIA,YIAFANLLNK,IINLEEADAY, DAYIAFANLL,LEEADAYIAF,EEADAYIAFA,ADAYIAFANL | KIRC |
| TBC1D2B | c.2759G>A | p.R920Q | ILDARKLISISFGDLNPFPLRQIRN[p.R92 0Q]QRAYHLEKVRLELTELEAIREDFLRE | QIRNQRAYH,NQRAYHLEK,RQIRNQRAY,IRNQRAYHL,RQI RNQRAYH,QIRNQRAYH,RNQRAYHLEK,LRQIRNQRAY, NQRAYHLEKV | BLCA,KIRP, PRAD |
| TBC1 D9 | c.3697C>A | p.P123 3T | DWAITFEQFLASLLTEPALVKYFDK[p.P 1233T]TVCMMARITSAKNIRMMGKPL TSASD | ALVKYFDKT,KTVCMMARI,KYFDKTVCM,YFDKTVCMM,AL VKYFDKTV,KYFDKTVCMM,VKYFDKTVCM | PRAD |
| TBCD | c.1426C>T | p.R476C | DEKRGACSVGTNVRDAACYVCWAFA[p. R476C]CAYEPQELKPFVTAISSALVIA AVFD | YVCWAFACA,CAYEPQELK,VCWAFACAY,YVCWAFACAY,F ACAYEPQEL | LUSC |
| TBL1X R1 | c.377de lA | p.N126fs | DKLAQQOAAAAAAAAAAAASQQCSAK[p. N126fs]MEKTQQMGRRMEHIL* | QMGRRMEHI,KTQQMGRRM,MGRRMEHIL,ASQQGSAK M,AKMEKTQQM,QQMGRRMEH,QQMGRRMEHI,SQQG SAKMEK,AASQQGSAKM,QQMGRRMEH | STAD |
| TBX3 | c.559C>T | p.H187Y | RYKFHNSRWMVAGKADPEMPKRMYI[p. H187Y]YPDSPATGEQWMSKVVTFH KLKLTNN | YIYPDSPAT,EMPKRMYIY,MYIYPDSPA,RMYIYPDSP,RMYI YPDSPA,PEMPKRMYIY | BRCA |
| TBX4 | c.1109de lC | p.S370fs | LDLPCKRSYLEAPSSVGEDHYFRSP[p.S 370fs]LPTTSKC* | RSPLPTTSK,GEDHYFRSPL | STAD |
| TCEB3 C | c.922G>A | p.E308K | DLLSAFEAMTSQANPEALSAPALQE[p. E308K]KAAFPGRRVNAKMPVYSGSRP ACQLQ | LSAPALQEK,KAAFPGRRV,LQEKAAFPG,ALSAPALQEK,AP ALQEKAAF | SKCM |
| TCF7 | c.419A>C | p.H140P | GMYKEFVYSAFNLLMHYPPPSGAGQ[p. H140P]PPQPQPPLHKANQPPHGVPQ LSLYEH | QPPQPQPPL,GQPPQPQPPL | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TCHP | c.515del A | p.E172fs | KLREMELDLHQKHVVNSWEMQKEEK[p. E172fs]NSKKPPQSKRTNGMKMNM KGPEGRR* | MQKEEKNSK,NSKKPPQSK,QSKRTNGMK,RTNGMKMNM, KMNMKGPEG,MNMKGPEGR,NMKGPEGRR,SKRTNGM KM,RTNGMKMNMK,MQKEEKNSKK,KNSKKPPQSK,KMN MKGPEGR,NSKKPPQSKR,MNMKGPEGRR,KRTNGMKMN M,MKMNMKGPEG | STAD |
| TCOF1 | c.4084_4086 del AAG | p.K1366del | GWESRKRKLSGDQPAARTPRSKKKK[p. K1366del]LGAGEGEASVSPEKTSTTS KGKAKRDK | RSKKKKLGA,TPRSKKKKL,RSKKKKLGAG | PRAD |
| TCOF1 | c.791A>G | p.K264R | APAPGKVGDVTPQVKGGALPPAKRA[p. K264R]RKPEEESESSEEGSESEEEAPAG TRS | ALPPAKRARK | LUAD |
| TCTE1 | c.380G>T | p.S127I | PEHQQKVLNHLSPDLPLAVTANLID[p.S 127I]IENYWLRCCMHRWPVCHVAHH GGSWK | NLIDIENYWL,IENYWLRCCM,TANLIDIENY | LUAD |
| TCTEX 1D2 | c.221C>T | p.S74L | HAVLKEELANAEYSPEMPQLTKHL[p.S 74L]LENIKDKLKEMGFPDRYKMVQVVI GE | MPQLTKHLL,QLTKHLLENI,LTKHLLENIK | CESC |
| TDO2 | c.591G>C | p.Q197H | RVPYNRRHYRDNFKGEENELLLKSE[p. Q197H]HEKTLLELVEAWLERTPGLEPH GFNF | LLLKSEHEK,LKSEHEKTL,NELLLKSEH,HEKTLLELIV,LKSE HEKTLL,SEHEKTLLEL | LUAD |
| TDRD 10 | c.828G>T | p.W276C | CLAEYHLGDYGHAWNRCWVLDRVDT[p. W276C]CAVVMFIDFGQLATIPVQSL RSLDSD | DTCAVVMFI,RVDTCAVVM,CAVVMFIDF,VLDRVDTCAV,R VDTCAVVMF | KIRC |
| TDRD 10 | c.965C>T | p.S322L | SLDSDDFWTIPPLTQPFMLEKDILS[p.S 22L]LYEVVHRILKGKITGALNSAVTAPA S | MLEKDILSL,SLYEVVHRI,LYEVVHRIL,LEKDILSLY,DILSLYEV V,KDILSLYEV,MLEKDILSLY,FMLEKDILSL,SLYEVVHRIL, ILSLYEVVHR,KDILSLYEVV | CRC |
| TEAD2 | c.894_895 insC | p.P298fs | DVRQIYDKFPEKKGGLRELYDRGP[p.P 298fs]PCLLPGQVLGGPELGPKW* | GQVLGGPEL,VLGGPELGPK,RELYDRGPPP | STAD |
| TECTB | c.85C>A | p.L29I | KAFVLLAIFAEASAKSCAPNKADVI[p.L2 9I]IVFCYPKTIITKIPECPYGWEVHQLA | VIIVFCYPK,APNKADVII,NKADVIIVF,IVFCYPKTI,KADVIIVF CY,DVIIVFCYPK,APNKADVIIV,IVFCYPKTII | CRC |
| TEDD M1 | c.498G>A | p.M166I | LLVLITAELWAPNMCHLQLMETFLIL[p. M166I]IMGSWLMQAGFIIYRPVSGYP WQDDD | LMETFLILI,ILIMGSWLM,IMGSWLMQA,METFLILIM,FLILI MGSW,QLMETFLILI,FLILIMGSWL,LIMGSWLMQA,TFLILI MGSW,ETFLILIMGS,LMETFLILIM,LILIMGSWLM | CESC |
| TEKT5 | c.1202G>A | p.R401H | LLERSIMAKEGPLKVAQTRLECRTR[p.R 401H]HPNMELCRDIPQLKLVNEVFTID DTL | RTRHPNMEL,RTRHPNMELC,LECRTRHPNM,HPNMELCR DI | CRC |
| TET1 | c.4415C>G | p.T1472S | AAVREIMENRYGQKGNAIRIEIVVY[p.T 1472S]SGKEGKSSHGCPIAKWVLRRSS DEEK | VVYSGKEGK,RIEIVVYSGK,IVVYSGKEGK | TGCT |
| TEX15 | c.4954G>C | p.E1652Q | ASSLQILQEETKVCLNILPLFVEAF[p.E16 52Q]QRKQECSVEQILISRELLVDQNLW NN | FQRKQECSV | CESC |
| TFE3 | c.1444_144 5insG | p.G482fs | SLKPEQLDIEEEGRPGAATFHVGG[p. G482fs]TCPECSPSAAPCTALRCPSGPA LSQRPPGGPGRPLPPGAGGHSDGGGG GGGGRTVGGCPVPTAGCLRSPALFSVP CCLQGGQPPQQLQHGRGVLIRPHPSP GTFPPRKGGPVRMRPRLFPHPPMRLPC PGILGEEM* | ALFSVPCCL,ALRCPSGPA,RMRPRLFPH,RLFPHPPMR,SAA PCTALR,LFPHPPMRL,LIRPHPSPG,PPGGPGRPL,CPVPTAG CL,SPALFSVPC,RPHPSPGTF,FPPRKGGPV,GPVRMRPRL,R PRLFPHP,LRCPSGPAL,SQRPPGGPG,GCLRSPALF,LRSPA LFSV,QQLQHGRGV,LQHGRGVLI,MRLPCPGIL,HPSPGTFP P,CLRSPALFSV,RLFPHPPMRL,ALRCPSGPAL,SQRPPGGPG R,KGGPVRMRPR,RMRPRLFPH,RPRLFPHPM,HPSPGTF | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TFG | c.1145C>T | p.A382V | YQPRPGFTSLPGSTMTPPPSGPNPY[p.A382V]VRNRPPFGQGYTQPGPGYR* | PPR, SPSAAPCTAL, RPPGGPGRPL, PPRKGGPVRM, GPVRM RPRLF, FPHPPMRLPC, AGCLRSPALF, LQGQOPPQQL, GQQ PPQQLQH, QQLQHGRGVL, IRPHPSPGTF, CPGILGEEEM PYVRNRPPF, YVRNRPPFG, NPYVRNRPPF | CLL |
| TFPI2 | c.616C>T | p.R206C | RTCDAFTYTGCGNDNNFVSREDCK[p.R206C]CACAKALKKKKKMPKLRFASRIR KIR | CACAKALKK, KCACAKALK, CKCACAKAL, REDCKCACA, CAC AKALKKK, KCACAKALKK | GBM |
| TFPI2 | c.664C>T | p.R222C | NFVSREDCKRACAKALKKKKKMPKL[p.R222C]CFASRIRKIRKKQF* | LCFASRIRK, CFASRIRKI, MPKLCFASR, KLCFASRIR, KKKMPK LCF, KKMPKLCFA, KLCFASRIRK, KKKMPKLCFA, KMPKLCFA SR, CFASRIRKIR, MPKLCFASRI, KKKMPKLCF, KMPKLCFAS | BLCA |
| TFPT | c.755C>G | p.S252C | EALDSSWVSRGPDKLLPYPTLASPA[p.S252C]CD* | YPTLASPAC | BRCA |
| TGFBR1 | c.722C>T | p.S241L | FGEVWRGKWRGEEVAVKIFSSREER[p.S241L]LWFREAEIYQTVMLRHENILGFI AAD | RLWFREAEI, LWFREAEIY, SSREERLWF, EERLWFREA, FSSR EERLW, SSREERLWFR, IFSSREERLW, KIFSSREERL, RLWFRE AEIY, FSSREERLWF, REERLWFREA | CRC |
| TGM6 | c.1073delC | p.T358fs | WNESWFARQDLGPSYNGWQVLDATP[p.T358fs]RRRVKVCSGAAQPQSPPSA RVMCTWLTMAPSCLRRSTPTTSPGCGT RMRAGSVYTQTRRRLGDASAPRRWAV TPAWTSLTSTSIRKGPGKRGRCTARR* | RVMCTWLTM, VMCTWLTMA, WLTMAPSCL, LTMAPSCLR, TMAPSCLRR, SVYTQTRRR, SLTSTSIRK, RLGDASAPR, TSLTS TSIRK, TSIRKGPGK, RVKVCSGAA, SARVMCTWL, GTRMRAGSV, RMRAGSVYT, QTRRRLGDA, ASAPRRWAV, SIRKGPGKR, QVLDATPRR, TTSPGCGTR, WTSLTSTSI, APSCLRRST, AVTP AWTSL, TPRRRVKVC, AQPQSPPSA, TRMRAGSVY, RRWAV TPAW, TPAWTSLTS, RVMCTWLTMA, LTMAPSCLRR, TSLTS TSIRK, STSIRKGPGK, TWLTMAPSCL, RVKVCSGAAQ, SARV MCTWLT, GTRMRAGSVY, RMRAGSVYTQ, RAGSVYTQTR, SVYTQT RRRL, QVLDATPRRR, WLTMAPSCLR, WTSLTSTSIR, TSIRKGPGKR, DASAPRRWAV, WAVTPAWTSL, RLGDASAPRR, QPQSPPSARV, APR RWAVTPA, TPAWTSLTST, RRVKVCSGAA, PQSPPSARVM, ARVMCTWLTM, AWTSLTSTSI, PPSARVMCTW | STAD |
| THADA | c.5822C>T | p.S1941L | RLLAFLEGKEGEDTLVLSVWDSYAE[p.S1941L]LRQLTLPRTEAAC* | SVWDSYAEL, ELRQLTLPR, YAELRQLTL, SVWDSYAELR, SYA ELRQLTL, LSVWDSYAEL | UCEC |
| THAP5 | c.860C>A | p.S287Y | EELNTNKESVIAIFVPAENSKPSVN[p.S287Y]YFISAQKETTEMEDTDIEDSLYKDVD | VNYFISAQK, NSKPSVNYF, SVNYFISAQK, NSKPSVNYFI, KPS VNYFISA, AENSKPSVNY | CRC |
| THEM4 | c.50T>G | p.L17R | MLRSCAARLRTLGALC[p.L17R]RPPVG RRLPGSEPRPELRSFSSEEVI | ALCRPPVGR, TLGALCRPPV, RLRTLGALCR, RPPVGRRLPG | ACC |
| THRAP3 | c.1652A>G | p.K551R | YKAVQEKSSSPPPRKTSESRDKLGA[p.K551R]RGDFPTGKSSFSITREAQVNVRM DSF | ESRDKLGAR, GARGDFPTGK | KIRC |
| THSD7B | c.268C>T | p.R90C | VCDWHSDLFQWEVSDWHHCVLVPYA[p.R90C]CGEVKPRTAECVTAQHGLQH RMVRCI | LVPYACGEV, VLVPYACGEV | GBM |
| THSD7B | c.269G>A | p.R90H | VCDWHSDLFQWEVSDWHHCVLVPYA[p.R90H]HGEVKPRTAECVTAQHGLQH RMVRCI | LVPYAHGEV, YAHGEVKPR, VLVPYAHGEV | CRC |
| THSD7B | c.376G>A | p.E126K | VTAQHGLQHRMVRCIQKLNRTVVAN[p.E126K]KICEHFALQPPTEQACLIPCPR DCVV | LNRTVVANK, VANKICEHF, NKICEHFAL, KLNRTVVANK, VV ANKICEHF | SKCM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TIAM1 | c.739_740 GG>AT | p.G247 M | QLSTCQRANSLGDLYAQKNSGVTAN[p. G247M]MGPGSKFAGYCRNLVSDIPNL ANHKMP | TANMGPGSK,KNSGVTANM,ANMGPGSKF,VTANMGPGS K,MGPGSKFAGY,QKNSGVTANM,TANMGPGSKF | TGCT |
| TIFAB | c.129C>A | p.D43E | GPSAFANVPPRLQHDTSPLLLGRGQ[p. D43E]EAHLQLQLPRLSRRHLSLEPYLEK GS | LLLGRGQEA,RGQEAHLQL,QEAHLQLQL,LLGRGQEAHL,E AHLQLQLPR,GQEAHLQLQL | LUAD |
| TIGD4 | c.935C>T | p.S312F | VESFPAHPEVNLKSIELAFFPSCL[p.S3 12F]FSKCIAMKQGVIKSLKIKYRHCLIKK | CLFSKCIAM,LFSKCIAMK,LAFFPSCLF,FPSCLFSKC,AFFPSC LFSK,CLFSKCIAMK,ElAFFPSCLF,SCLFSKCIAM,FPSCLFSKC I | LUAD |
| TIMD4 | c.455_457 de\|CAA | p.T152de\| | VRLNLQRASTTTHRTATTTTRRTTT[p.T 152de\|]SPTTTRQMTTTPAALPTTVVTT PDLTTG | RTTTSPTTTR,TTRRTTTSPT | PRAD |
| TIMM 44 | c.249de\|A | p.K83fs | GFLSGLLDNVKQELAKNKEMKESIK[p.K 83fs]NSVTRPEG* | ESIKNSVTR,KESIKNSV,EMKESIKNSV,KEMKESIKNS | STAD |
| TIMP3 | c.596_597 insC | p.A199fs | YQSKHYACIRQKGGYCSWYRGWA PP[p.A199fs]G* | SWYRGWAPPG | STAD |
| TINAG | c.1207G>A | p.E403K | MQVREDFFHYKTGIYRHVTSTNKES[p. E403K]KKYRKLQTHAVKLTGWGTLRG AQGQK | VTSTNKESK,STNKESKKY,KKYRKLQTH,VTSTNKESKK,STN KESKKYR,HVTSTNKESK,KKYRKLQTHA | MM |
| TLL1 | c.158C>A | p.P53Q | CAGLDYDYTFDGNEEDKTETIDYKD[p.P 53Q]QCKAAVFWGDIALDDEDLNIFQID RT | KDQCKAAVF,YKDQCKAAVF | LUAD |
| TLL1 | c.458C>T | p.T153M | VKGKVPLQFSGQNEKNRVPRAATSR[p. T153M]MERIWPGGVIPYVIGGNFTGS QRAMF | RAATSRMER,VPRAATSRM,MERIWPGGV,RMERIWPGGV, RVPRAATSRM,RAATSRMER,MERIWPGGVI | CRC |
| TLL2 | c.2615C>T | p.S872L | LGRFCGSKKPDPTVASGSSMFLRFY[p.S 872L]LDASVQRKGFQAVHSTECCGRLK AEV | FLRFYLDAS,SSMFLRFYL,FYLDASVQR,LRFYLDASV,SMFLR FYLDA,FLRFYLDASV,RFYLDASVQR | CRC |
| TLN2 | c.623C>T | p.S208L | REQGVDENETLLLRRKFFYSDQNVD[p. S208L]LRDPVQLNLLYVQARDDILNGS HPVS | FFYSDQNVDL | UCEC |
| TLR2 | c.980A>T | p.D327V | RVIDPGKVETLTIRRLHIPRFYLFY[p.D32 7V]VLSTLYISLTERVKRITVENSKVFLVP | YLFYVLSTL,YVLSTLYSL,VLsTLYSLT,FYLFYVLST,LFYVLSTLY, IPRFYLFYV,HIPRFYLFYV,YLFYVLSTLY,FYLFYVLSTL,FYVLS TLYSL,RFYLFYVLST,IPRFYLFYVL | CLL |
| TLR4 | c.1492T>G | p.L498V | LEVLKMAGNSPQENFLPDIFTELRN[p.L 498V]VTFLDLSQCQLEQLSPTAFNSLSS LQ | DIFTELRNV,FTELRNVTF,TELRNVTFL,LRNVTFLDL,IFTELR NVTF,ELRNVTFLDL | STAD |
| TM6S F1 | c.44C>G | p.S15W | MSASAATGVFVLSL[p.S15W]WAIPVT YVFNHLAAQHDSWTIVGVAA | VLSLWAIPV,VFVLSLWAI,WAIPVTYV,SLWAIPVTY,GVFV LSLWAI,FVLSLWAIPV,VLSLWAIPVT,SLWAIPVTYV,LWAIP VTYVF,LSLWAIPVTY | BLCA |
| TM9S F2 | c.272G>A | p.R91H | RLDSVESVLPYEYTAFDFCQASEGK[p.R 91H]HPSENLGQVLFGERIEPSYKFTFN K | HPSENLGQV,HPSENLGQVL,SEGKHPSENL | CRC |
| TMC5 | c.826C>T | p.R276C | DYGSSETPKMTRGVLSRTSSIQPSF[p.R 276C]CHRSDDPVGSLWGENDYPEGIE MASM | SIQPSFCHR,SSIQPSFCHR,RTSSIQPSFC | SKCM |
| TMCC 3 | c.329G>A | p.R110H | EQTSRDGNVAEYLKLVNNADKQQAG[p. R110H]HIKQVFEKKNQKSAHSIAQLQ KKLEQ | QQAGHIKQV,HIKQVFEKK,QAGHIKQVF,AGHIKQVFEK,Q QAGHIKQVF,KQQAGHIKQV | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TMCO2 | c.43_44del|TC | p.S15fs | MSTSSSSWDNLLESLS[p.S15fs]QHS MELDTSKFFGRD* | SLSQHSML,HSMELDTSK,MELDTSKFF,LESLSQHSM,SQH SMELDT,SMELDTSKF,ELDTSKFFGR,ESLSQHSMEL,HSME LDTSKF,LLESLSQHSM,SQHSMELDTS,SMELDTSKFF,MEL DTSKFFG | BLCA |
| TMEM102 | c.328G>C | p.A110P | AELLLRGGIREGSLDLGHAPLGPY[p.A1 10P]PRGPHYDAGFTLLVPMFSLDGTEL QL | HAPLGPYPR,YPRGPHYDA,GPYPRGPHY,LGPYPRGPHY,YP RGPHYDAG | KIRC |
| TMEM121 | c.879_881 de|GCC | p.P299del | FPPPALSLELQPPPQRNSVPPPPL[p.P 299del]LHGPPGRPHMSSPTRDPLDT* | NSVPPPPPL,RNSVPPPPL | PRAD |
| TMEM131 | c.3955G>C | p.E1319Q | AHSPLEQHPQPLPPPVPQPQEPQP[p.E1319Q]QRLSPAPLAHPSHPERASSAR HSSED | PQRLSPAPL,QPQEPQPQRL,EPQPQRLSPA,QPQRLSPAPL | CESC |
| TMEM132A | c.1441C>T | p.R481C | EACDAVFVAGKESRGARGVRVDFWW[p. R481C]CRLRASLRLITVWAPLLPLRIEL TDTT | RVDFWWCRLR,FWWCRLRASL,GVRVDFWWCR, WWCRLRASLR,WCRLRASLRL,VRVDFWWCRL | CRC |
| TMEM132D | c.1732C>T | p.R578W | GDSEEEEDDERRGRGCTLQYQHAMV[p. R578W]WVLTQFVAEAAGPGGHLA HLLGSDWQ | YQHAMVVL,MVWVLTQFV,AMVWVLTQF,LQYQHAMV W,QYQHAMVW,LQYQHAMVV,YQHAMVVLT,AM VVVLTQFV,MVWVLTQFVA,WVLTQFVAEA,QYQHAMV WVL,HAMVWVLTQF,TLQYQHAMVW | CRC |
| TMEM132D | c.618del|C | p.P206fs | SCRLQGDLGLCVAELELLSSWFSPP[p.P 206fs]RWLPGGGSPWTSRRGPPWSST TPCTQGVREGTASGKTRGEAMGSGQA TVTSMSPGPPCRGSGASSFIRHTGNPP* | AMGSGQATV,STTPCTQGV,LSSWFSPPR,SMSPGPPCR,GS GASSFIR,SWFSPPRWL,TSRRGPPWS,GVREGTASG,KTRGE AMGS,RGSGASSFI,SGKTRGEAM,SSWFSPPRW,WLPGGG SPW,WTSRRGPPW,SGQATVTSM,CRGSGASSF,GEAMGS GQA,WLPGGGSPWT,LLSSWFSPPR,GVREGTASGK,TSMS PGPPCR,RWLPGGGSPW,KTRGEAMGSG,RGSGASSFIR,ST TPCTQGVR,SSTTPCTQGV,EAMGSGQATV,SPWTSRRGPP, LSSWFSPPRW,SWFSPPRWL,ASGKTRGEAM,GEAMGSG QAT,GSGQATVTSM | STAD |
| TMEM147 | c.275C>T | p.A92V | FIGEFMKASVDVADLIGLNLVMSRN[p. A92V]VGKGEYKIMVAALGWATAELIM SRCI | LVMSRNVGK,SRNVGKGEY,GLNLVMSRNV,MSRNVGKGE Y | GBM |
| TMEM156 | c.241C>T | p.R81C | SFVTFLQPVRETQIIMRIFLNPSNF[p.R8 1C]CNFTRTCQDITGEFKMCSSCLVCES K | PSNFCNFTR,FLNPSNFCNF,NPSNFCNFTR | GBM |
| TMEM161B | c.425T>C | p.L142P | VYLVTEVYYNFMKPTQEMNISLVWC[p. L142P]PLVLSFAIKVLFSLTTHYFKVEDG GE | ISLVWCPLV,SLVWCPLVL,VWCPLVLSF,NISLVWCPL,CPLIV LSFAI,NISLVWCPLV,ISLVWCPLVL,LVWCPLVLSF,MNISLV WCPL | KIRC |
| TMEM161B | c.944G>A | p.R315Q | KDYIMNPPLGKESIPLMTEATFDTL[p.R 315Q]QLWLILLLCALRLAMMRSHLQAY LNL | TLQLWLIIL,LQLWLIILL,EATFDTLQL,ATFDTLQLW,TLQLW LIIIL,QLWLIILLCA,ATFDTLQLWI,TFDTLQLWLI,TEATFDTL QL,EATFDTLQW | UCEC |
| TMEM19 | c.993del|T | p.G331fs | LDNNAVNLFSSVLIALLLPTAAWGF[p.G 331fs]GPGGELYFISTG* | GFGPGGELY,WGFGPGGEL,GELYFISTG,GFGPGGELYF,W GFGPGGELY | BLCA |
| TMEM230 | c.419A>G | p.D140G | LFLIGAFLIIIGSLLLSGYISKGGA[p.D140 G]GRAVPVLIGILVFLPGFYHLRIAYY | ISKGGAGRA,AGRAVPVLI,YISKGGAGR,SKGGAGRAV,YISK GGAGRA,AGRAVPLII | KIRC |
| TMEM247 | c.382C>G | p.Q128E | EMELEKVRMEFELTRLKYLHEKNQR[p. Q128E]ERQHEVVMEQLQRERQHEVV MEQLQQ | NQRERQHEV,YLHEKNQRER,NQRERQHEVV | ACC |
| TMEM41A | c.467del|T | p.F156fs | VVSYFPDKVALLQRKVEENRNSLFF[p.F 156fs]SYCF* | NSLFFSYCF,NRNSLFFSY,RNSLFFSYCF,ENRNSLFFSY | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TME M41B | c.690del|T | p.F230fs | RITPFLPNWFINITSPVINVPLKVF|p. F230fs|LLVLF* | NVPLKVFLL,LKVFLLVLF,VPLKVFLLV,NVPLKVFLLV,VPLKV FLLVL | STAD |
| TME M47 | c.259G>A | p.G87S | ASLDIWHCESTLSSDWQIATLALLL|p.G 87S|SGAAILIIAFLVGLISICVGSRRRFY | TLALLLSGA,ALLLSGAAI,LLLSGAAII,LLLSGAAIL,ALLLSGAAI I,LLLSGAAIIL,TLALLLSGAA,SGAAIILIAF,LALLL SGAAI | KIRC |
| TME M55A | c.566G>A | p.R189Q | MELRFNTLAKCPHCKKISSVGSALP|p.R 189Q|QRRCCAYITIGMICIFIGVGLTVG TP | SVGSALPQR,LPQRRCCAY,SSVGSALPQR,ALPQRRCCAY,L PQRRCCAYI | CRC |
| TME M60 | c.231del|A | p.K77fs | LIVKMAGRCKSGFDPRHGSHNIKKK|p. K77fs]PGTSLQCYIN* | IKKKKPGTSL,NIKKKKPGTSL,KKPGTSLQCY | KIRP |
| TME M71 | c.188G>A | p.R63Q | DSLDGYHSFECGSIDPLTGSHYTCR|p.R 63Q|QSPRLLTNGYYIWTEDSFLCDKDG NI | HYTCRQSPR,RQSPRLLTN,SHYTCRQSPR,QSPRLLTNGY,R QSPRLLTNG | BRCA |
| TME M74 | c.374G>A | p.R125Q | CNCCSQELETSFTYVDKNINLEQRN|p.R 125Q|QSSPSAKGHNHPGELGWENPN EWSQE | RNQSSPSAK,EQRNQSSPSA | CRC |
| TME M79 | c.481_482 insC | p.P161fs | ERQPQEDLIVRCEAGEGECRTFMPP|p. P161fs|PGHPPRPH* | RTFMPPPGH,MPPPGHPPR,RTFMPPPGHP,FMPPPGHPP R,GECRTFMPPP | STAD |
| TMPR SS11A | c.863C>T | p.S288L | IHEKYRSAAREYDIAVVQVSSRVTF|p.S2 88L|LDDIRQICLPEASASFQPNLTVHITG | QVSSRVTFL,FLDDIRQICL,VQVSSRVTFL,SSRVTFLDDI | CRC |
| TMPR SS11E | c.775G>T | p.G259C | FTTYKNPARWTASFGVTIKPSKMKR|p. G259C|CLRRIIVHEKYKHPSHDYDISLAE LS | KMKRCLRRI,PSKMKRCLR,KPSKMKRCL,MKRCLRRII,CLRRI IVHEK,KMKRCLRRI,SKMKRCLRRI,MKRCLRRIIV | LUAD |
| TMPR SS11F | c.821G>A | p.R274Q | CFWKNKDPTQWIATFGATITPPAVK|p. R274Q|QNVRKIILHENYHRETNENDIAL VQL | KQNVRKIIL,TPPAVKQNV,KQNVRKIILH,ITPPAVKQNV,VK QNVRKIIL | LUSC |
| TMPR SS3 | c.47G>A | p.R16Q | MGENDPPAVEAPFSF|p.R16Q|QSLFG LDDLKISPVAPDADAVAAQIL | FSFQSLFGL,EAPFSFQSL,APFSFQSLF,VEAPFSFQS,QSLFGL DDLK,VEAPFSFQSL,FQSLFGLDDL | UCEC |
| TMPR SS6 | c.904G>A | p.V302I | ITSVYGCSRQPEVVEVLASGAIMAV|p.V 302I|IWKKGLHSYYDPFVLSVQPVVFQ ACE | AIMAVIWKK,GAIMAVIWK,IWKKGLHSY,SGAIMAVIW,IM AVIWKKGL,SGAIMAVIWK,GAIMAVIWKK,VIWKKGLHSY,I WKKGLHSYY,LASGAIMAVI,ASGAIMAVIW | GBM |
| TMTC 2 | c.1226C>G | p.T409R | RTQLPSTENIVVLSLSLLIIPFVPA|p. T409R|RNLFFYVGFVIAERVLYIPSM GFCLL | LIIPFVPAR,PFVPARNLF,FVPARNLFF,RNLFFYVGF,PARNL FFYV,VPARNLFFY,IPFVPARNL,FVPARNLFFY,PFVPARNLF F,RNLFFYVGFV,LIIPFVPA,VPARNLFFYV,IPFVPARNL,A RNLFFYVGF | HNSC |
| TMTC 4 | c.1831C>T | p.R611C | EAAEQSYRTAIKHRRKYPDCYNLG|p.R 611C|CLYADLNRHVDALNAWRNATVL KPEH | CYNLGCLY,CLYADLNRHV | STAD |
| TMX3 | c.451C>T | p.R151C | AHRVSGALIRPLPSQQMFEHMQKRH|p. R151C|CVFFVYVGGESPLKEKYIDAASE LIV | HMQKRHCVF,MQKRHCVFF,KRHCVFFVY,EHMQKRHCV, MQKRHCVFFV,HMQKRHCVFF,KRHCVFFVYV,QKRHCVFF VY,EHMQKRHCVF,FEHMQKRHCV | LUAD |
| TNF | c.139C>T | p.L47F | GGPQGSRRCLFLSLFSFLIVAGATT|p.L4 7F|FFCLLHFGVIGPQREEFPRDLSLISP | ATTFFCLLH,IVAGATTF,TTFFCLLHF,LIVAGATTF,TFFCLLH FGV,FLIVAGATTF,ATTFFCLLHF,FFCLLHFGVI, LIVAGATTFF | DLBCL |
| TNFSF 9 | c.694G>A | p.A232T | SAGQRLGVHLHTEARARHAWQLTQG|p. A232T|TTVLGLFRVTPEIPAGLPSPRS E* | WQLTQGTTV,QLTQGTTVL,GTTVLGLFR,TTVLG LFRV,TQGTTVLGL,TQGTTVLGLF,WQLTQGTTVL | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TNIP2 | c.217C>G | p.R73G | LRARLAALEGDAAPSLVDALLEQVA[p.R 73G]GFREQLRRQEGGAARAQMRQEIE RLT | ALLEQVAGF,QVAGFREQL,ALLEQVAGFR,QVAGFREQLR,E QVAGFREQL,DALLEQVAGF | ACC |
| TNIP2 | c.415G>A | p.A139T | QPQHEREKEVLLRRSMAEGERARA[p. A139T]TSDVLCRSLANETHQLRRTLTAT AHM | RARATSDVL,AEGERARAT,RARATSDVLC,GERARATSDV | CRC |
| TNK2 | c.1894_189 5insC | p.P632fs | PTRALPRPLHPTPVVDWDARPLPPP[p. P632fs]ARL* | RPLPPPARL,DARPLPPPAR | STAD |
| TNKS2 | c.1856_185 7insA | p.T619fs | HEAAAKGKYEICKLLLQHGADPTKK[p.T 619fs]KQGWKYSFGSC* | PTKKKQGWK,KKQGWKYSF,PTKKKQGWKY,KKKQGWKYS | CESC,CLL |
| TNR | c.2074C>A | p.L692I | SAVMNSQQSVPATMNARTELDSPRD[p. L692I]IMVTASSETSISLIWTKASGPI DHYR | IMVTASSET,SPRDIMVTA,TELDSPRDI,DSPRDIMVTA,SPR DIMVTAS,TELDSPRDIM,IMVTASSETS | LUAD |
| TNS1 | c.547C>T | p.P183S | GQPSQRRYVHYPSGLLSGSIKMNNK[p. P183S]SLFLHHVIMHGIPNFESKGGCRP FLR | KMNNKSLFL,KSLFLHHVI,SIKMNNKSL,SLFLHHVIM,IKMN NKSLF,KMNNKSLFLH,SIKMNNKSLF,KSLFLHHVIM,IKMN NKSLFL,NKSLFLHHVI,SLFLHHVIMH | TGCT |
| TNXB | c.2116_211 7de\|GT | p.V706fs | EEPPASACPGGCGPRELCRAGQCVC[p. V706fs]RGLLPRP* | RAGQCVCRGL | ACC |
| TOP2 A | c.2207G>T | p.R736L | NERSIPSMVDGLKPGQRKVLFTCFK[p.R 736L]LNDKREVKVAQLAGSVAEMSSY HHGE | KVLFTCFKL,KLNDKREVK,FTCFKLNDK,KLNDKREVKV,FTCF KLNDKR,RKVLFTCFKL | LUAD |
| TOP2 A | c.3595A>G | p.K1199E | FIEELEAVEAKEKQDEQVGLPGKGG[p.K 1199E]EAKGKKTQMAEVLPSPRGQRVI PRIT | KGGEAKGKK,GEAKGKKTQM | THCA |
| TOP2 B | c.1967G>A | p.R656H | IKYYKGLGTSTAKEAKEYFADMERH[p. R656H]HILFRYAGPEDDAAITLAFSK KKIDD | DMERHHILF,MERHHILFR,RHHILFRYA,ADMERHHIL,FAD MERHHI,YFADMERHHI,MERHHILFRY,DMERHHILFR,FA DMERHHI,ADMERHHILF | CRC |
| TOPB P1 | c.4141de\|A | p.I1381fs | ILDVLTGINVQQRRLALAAMEWRKK[p. I1381fs]SSKDKNLALLREHLVGGRLFY MWISLEKQASNAFFSQEEQRCYLVLYL YLKRPHIFFLT* | FSQEEQRCY,LVGGRLFYM,RLFYMWISL,YLVLYLYL,YLYLK RPHI,NLALLREHL,HLVGGRLFY,LVILYLYLK,FYMWISLEK,VI LYLYLKR,VGGRLFYMW,CYLVLYLYL,YLKRPHIF,YLKRPHIF F,KSSKDKNLA,SSKDKNLAL,GGRLFYMWI,AFFSQEEQR,A MRWRKKKS,EQRCYLVIL,LKRPHIFFL,LEKQASNAF,REHLV GGRL,EKQASNAFF,KQASNQFFS,SQEEQRCYL,RCYLVILYL, EEQRCYLVI,QEEQRCYLV,NLALLREHLV,HLVGGRLFYM,Y MWISLEKQA,YLKRPHIFFL,AMRWRKKSSK,LFYMWISLEK, YLVILYLYLK,LVGGRLFYMW,CYLVILYLYL,LYLYLKRPH,YLY LKRPHIF,LYLKRPHIFF,RWRKKSSKDK,SSKDKNLALL,EQRC YLVILY,RCYLVILYLY,LLREHLVGGR,NAFFSQEEQR,LVILYLY LKR,SLEKQASNAF,LEKQASNAFF,KSSKDKNLAL,KNLALLRE HL,REFILVGGRLF,GRLFYMVVISL,KQASNAFFSQ,ILYLYLKR PH,EEQRCYLVIL,QEEQRCYLVI | STAD |
| TOR1 AIP2 | c.436G>A | p.G146R | PSDKVGRADAHLGSSSVALPKEASD[p. G146R]RTGASQEPPTTDSQEAQSPGH SSAGQ | KEASDRTGA | TGCT |
| TOR3 A | c.37T>C | p.F13L | MLRGPWRQLWLF[p.F13L]LLLLLPGAP EPRGASRPWEGTDEPGS | RQLWLFLLL,QLWLFLLLL,FLLLLLPGA,PWRQLWLFL,LWLF LLLLL,RQLWLFLLLL,QLWLFLLLLL,PWRQLWLFLL,GPWRQ LWLFL | ACC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TOX | c.1061C>T | p.S354L | RASLVSKSYSEPVDVKTSQPPQLIN[p.S354L]LKPSVFHGPSQAHSALYLSSHYHQQP | QLINLKPSV, LINLKPSVF, SQPPQLINL, SQPPQLINLK, QLINLKPSVF | CRC |
| TP53 | c.1010G>T | p.R337L | TSSSPQPKKKPLDGEYFTLQIRGRE[p.R337L]LFEMPRELNEFALELKDAQAGKEPGGS | ELFEMFREL, LQIRGRELF, RGRELFEMF, TLQIRGREL, IRGRELFEM, RGRELFEMFR, TLQIRGRELF, IRGRELFEMF, RELFEMFREL | LUAD, LUSC |
| TP53 | c.173del C | p.P58fs | SPLPSQAMDDLMLSPDDIEQWFTED[p.P58fs]QVQMKLPECQRLLPPWPLHQQLLHRRPLHQPPPGPCHLLSLPRKPTRAATVSVWASCILGQPSL* | KLPECQRLL, SLPRKPTRA, RLLPPWPLH, LSLPRKPTR, PTRAATVSV, RAATVSVWA, QMKLPECQR, TVSVWASCI, LPRKPTRAA, QQLLHRRPL, MKLPECQRL, QRLLPPWPL, TRAATVSVW, VSVWASCIL, WPLHQQLLH, TEDQVQMKL, SLPRKPTRAA, C QRLLPPWPL, LLSLPRKPTR, ATVSVWASCI, TVSVWASCIL, L PPWPLHQQL, LPRKPTRAAT, KPTRAATVSV, HQQLLHRRPL, QWFTEDQVQM, MKLPECQRLL, QQLLHRRPLH, HQPPPGP CHL, ASCILGQPSL, IEQWFTEDQV | HNSC |
| TP53 | c.216del C | p.P72fs | DDIEQWFTEDPGPDEAPRMPEAAPP[p.P72fs]WPLHQQLLHRRPLHQPPPGPCHLLSLPRKPTRAATVSVWASCILGQPSL* | SLPRKPTRA, RMPEAAPPW, LSLPRKPTR, PTRAATVSV, RAA TVSVWA, TVSVWASCI, LPRKPTRAA, QQLLHRRPL, TRAATV SVW, VSVWASCIL, WPLHQQLLH, PEAAPPWPL, SLPRKPTR AA, LLSLPRKPTR, ATVSVWASCI, TVSVWASCIL, MPEAAPP WPL, APPWPLHQQL, LPRKPTRAAT, KPTRAATVSV, HQQL HRRPL, QQLLHRRPLH, HQPPPGPCHL, ASCILGQPSL | LUAD |
| TP53 | c.313G>T | p.G105C | PTPAAPAPAPSWPLSSSVPSQKTYQ[p.G105C]CSYGFRLGFLHSGTAKSVTCTYSPAL | YQCSYGFRL, KTYQCSYGF, CSYGFRLGF, SQKTYQCSY, TYQCSYGFR, KTYQCSYGFR, TYQCSYGFRL, PSQKTY QCSY, QKTYQCSYGF, YQCSYGFRLG, CSYGFRLGFL | LUAD |
| TP53 | c.323del G | p.G108fs | AAPAPAPSWPLSSSVPSQKTYQGSY[p.G108fs]VSVWASCILGQPSL* | YVSVWASCI, TYQGSYVSV, YQGSYVSVW, SYVSVWASC, KT YQGSYVS, VSVWASCIL, KTYQGSYVSV, YQGSYVSVWA, SQ KTYQGSYV, YVSVWASCIL, TYQGSYVSVW, SYVSVWASCI, A SCILGQPSL | BRCA |
| TP53 | c.328del C | p.R110fs | PAPAPSWPLSSSVPSQKTYQGSYGF[p.R110fs]VWASCILGQPSL* | TYQGSYGFV, YQGSYGFVW, SYGFVWASC, YGFVWASCI, KTYQGSY GFV, YQGSYGFVWA, TYQGSYGFVW, SYGFVWASCI, YGFVWASCIL, ASCILGQPSL | BRCA |
| TP53 | c.329G>T | p.R110L | PAPAPSWPLSSSVPSQKTYQGSYGF[p.R110L]LLGFLHSGTAKSVTCTYSPALNKMFC | YQGSYGFLL, FLLGFLHSG, TYQGSYGFL, SYGFLLGFL, GSYGFLLGF, FLLGFLHSGT, KTYQGSYGFL, LLGFLHSGTA, TYQGSYGFLL, YQGSYGFLLG, QGSYGFLLGF | HNSC, LUAD |
| TP53 | c.396G>C | p.K132N | YGFRLGFLHSGTAKSVTCTYSPALN[p.K132N]NMFCQLAKTCPVQLMVDSTPPPGTRV | ALNNMFCQL, NMFCQLAKT, TYSPALNNM, YSPALNNMF, A LNNMFCQLA, TYSPALNNMF, CTYSPALNNM | BLCA, BRCA |
| TP53 | c.396G>T | p.K132N | YGFRLGFLHSGTAKSVTCTYSPALN[p.K132N]NMFCQLAKTCPVQLMVDSTPPPGTRV | ALNNMFCQL, NMFCQLAKT, TYSPALNNM, YSPALNNMF, A LNNMFCQLAT, XSPALNNMF, CTYSPALNNM | OV |
| TP53 | c.421T>G | p.C141G | SGTAKSVTCTYSPALNKMFCQLAKT[p.C141G]GPVQLMVDSTPPPGTRVRAMAIYKQS | CQLAKTGPV, KTGPVQLMV, AKTGPVQLW, QLAKTGPVQL, KMFCQLAKTG, LAKTGPVQLW | PRAD |
| TP53 | c.422G>A | p.C141Y | SGTAKSVTCTYSPALNKMFCQLAKT[p.C141Y]YPVQLMVDSTPPPGTRVRAMAIYKQS | CQLAKTYPV, KTYPVQLWV, MFCQLAKTY, LAKTYPVQL, AKT YPVQLW, QLAKTYPVQL, KMFCQLAKTY, LAKTYPVQLW, YP VQLMVDST | BRCA |
| TP53 | c.427G>A | p.V143M | TAKSVTCTYSPALNKMFCQLAKTCP[p.V143M]MQLMVDSTPPPGTRVRAMAIYKQSQH | KTCPMQLMV, CQLAKTCPM, AKTCPMQLMV, MQLMVDST P, QLAKTCPMQL, FCQLAKTCPM, LAKTCPMQLW, MQLWV DSTPP, CPMQLMVDST | HNSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TP53 | c.451C>A | p.P151T | YSPALNKMFCQLAKTCPVQLWDST[p.P151T]TPPGTRVRAMAIYKQSQHMTEVVRRC | STPPGTR,VQLWDSTT,STPPGTRVR,TPPGTRVRAM,VQLWDSTTP | HNSC |
| TP53 | c.455de|C | p.P152fs | SPALNKMFCQLAKTCPVQLWDSTP[p.P152fs]RPAPASAPWPSTSSHST* | QLWDSTPR,TPRPAPASA,RPAPASAPW,APWPSTSSH,W PSTSSHST,STRPAPASA,TPRPAPASAP,APASAPWPST | STAD |
| TP53 | c.461G>T | p.G154V | ALNKMFCQLAKTCPVQLWDSTPPP[p.G154V]VTRVRAMAIYKQSQHMTEVV RRCPHH | WDSTPPPV,VTRVRAMAI,DSTPPPVTR,STPPPVTRV,PPV TRVRAM,VTRVRAMAIY,DSTPPPVTRV,LWDSTPPPV | LUAD |
| TP53 | c.464C>A | p.T155N | LNKMFCQLAKTCPVQLWDSTPPPG[p.T155N]NRVRAMAIYKQSQHMTEVVR RCPHHE | STPPPGNRV,PPGNRVRAM,GNRVRAMAI,NRVRAMAIY,G NRVRAMAIY,DSTPPPGNRV | GBM |
| TP53 | c.469G>T | p.V157F | KMFCQLAKTCPVQLWDSTPPPGTR[p.V157F]FRAMAIYKQSQHMTEVVRRCP HHERC | RFRAMAIYK,GTRFRAMAI,TRFRAMAIY,PPGTRFRAM,TRF RAMAIYK,GTRFRAMAIY,RFRAMAIYKQ,STPPPGTRFR | HNSQ,LIHC, LUAD,LUSC,OV |
| TP53 | c.473G>A | p.R158H | MFCQLAKTCPVQLWDSTPPPGTRV[p.R158H]HAMAIYKQSQHMTEVVRRCP HHERCS | RVHAMAIYK,GTRVHAMAI,PPGTRVHAM,TRVHAMAIY,G TRVHAMAIY | GBM,LIHC |
| TP53 | c.473G>T | p.R158L | MFCQLAKTCPVQLWDSTPPPGTRV[p.R158L]LAMAIYKQSQHMTEVVRRCPH HERCS | RVLAMAIYK,GTRVLAMAI,TPPPGTRVL,PPGTRVLAM,TRV LAMAIY,GTRVLAMAIY | LUAD,LUSC |
| TP53 | c.475G>C | p.A159P | FCQLAKTCPVQLWDSTPPPGTRVR[p.A159P]PMAIYKQSQHMTEVVRRCPHH ERCSD | RVRPMAIYK,GTRVRPMAI,PPGTRVRPM,TRVRPMAIY,GT RVRPMAIY,RVRPMAIYKQ | LUAD |
| TP53 | c.476C>T | p.A159V | FCQLAKTCPVQLWDSTPPPGTRVR[p.A159V]VMAIYKQSQHMTEVVRRCPH HERCSD | RVRVMAIYK,GTRVRVMAI,RVMAIYKQS,TRVRVMAIY,GT RVRVMAIY,RVRVMAIYKQ,VMAIYKQSQH | BLCA,OV |
| TP53 | c.488A>G | p.Y163C | AKTCPVQLWDSTPPPGTRVRAMAI[p.Y163C]CKQSQHMTEVVRRCPHHERCS DSDGL | RVRAMAICK,AICKQSQHM,GTRVRAMAIC,RVRAMAICKQ, MAICKQSQHM | BRCA,HNSQ, LUAD,LUSC,OV |
| TP53 | c.517G>A | p.V173M | DSTPPPGTRVRAMAIYKQSQHMTEV[p.V173M]MRRCPHHERCSDSDGLAPPQ HLIRVE | MRRCPHHER,QSQHMTEVM,VMRRCPHHER,KQSQHMT EVM | BRCA,HNSC |
| TP53 | c.517G>T | p.V173L | DSTPPPGTRVRAMAIYKQSQHMTEV[p.V173L]LRRCPHHERCSDSDGLAPPQH LIRVE | VLRRCPHHER,QSQHMTEVLR,KQSQHMTEVL | BRCA,HNSC |
| TP53 | c.523C>G | p.R175G | TPPPGTRVRAMAIYKQSQHMTEVVR[p.R175G]GCPHHERCSDSDGLAPPQHLI RVEGN | TEVVRGCPH,VVRGCPHHER | LUSC |
| TP53 | c.523C>T | p.R175C | TPPPGTRVRAMAIYKQSQHMTEVVR[p.R175C]CCPHHERCSDSDGLAPPQHLIR VEGN | TEVVRCCPH,VVRCCPHHER | CRC |
| TP53 | c.524G>A | p.R175H | TPPPGTRVRAMAIYKQSQHMTEVVR[p.R175H]HCPHHERCSDSDGLAPPQHLI RVEGN | TEVVRHCPH,VVRHCPHHER,SQHMTEVVRH | BLCA,BRCA, CLL,CRC, GBM,HNSC, LUAD,OV, PAAD,PRAD, STAD,UCS |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TP53 | c.527G>A | p.C176Y | PPPGTRVRAMAIYKQSQHMTEVVRR[p.C176Y]YPHHERCSDSDGLAPPQHLIRVEGNL | HMTEVVRRY,TEVVRRYPH,VVRRYPHHER,QHMTEVVRRY | OV |
| TP53 | c.527G>T | p.C176F | PPPGTRVRAMAIYKQSQHMTEVVRR[p.C176F]FPHHERCSDSDGLAPPQHLIRVEGNL | HMTEVVRRF,TEVVRRFPH,VVRRFPHHER,QHMTEVVRRF | BRCA,LUAD,STAD |
| TP53 | c.535C>T | p.H179Y | GTRVRAMAIYKQSQHMTEVVRRCPH[p.H179Y]YERCSDSDGLAPPQHLIRVEGNLRVE | VVRRCPHYE,EVVRRCPHY,VVRRCPHY,TEVVRRCPHY,YERCSDSDGL | HNSC |
| TP53 | c.536A>G | p.H179R | GTRVRAMAIYKQSQHMTEVVRRCPH[p.H179R]RERCSDSDGLAPPQHLIRVEGNLRVE | EVVRRCPHR,VVRRCPHRER,RERCSDSDGL | BRCA,GBM,HNSC,OV,UCS |
| TP53 | c.536A>T | p.H179L | GTRVRAMAIYKQSQHMTEVVRRCPH[p.H179L]LERCSDSDGLAPPQHLIRVEGNLRVE | EVVRRCPHL,VVRRCPHLER,TEVVRRCPHL,LERCSDSDGL | LUSC |
| TP53 | c.572_574 del CTC | p.P191del | SQHMTEVVRRCPHHERCSDSDGLAP[p.P191del]QHLIRVEGNLRVEYLDDRNTFRHSVVVP | GLAPQHLIR,GLAPQHLIRV | OV |
| TP53 | c.577C>T | p.H193Y | HMTEVVRRCPHHERCSDSDGLAPPQ[p.H193Y]YLIRVEGNLRVEYLDDRNTFRHSVVV | GLAPPQYLI,YLIRVEGNL,DSDGLAPPQY,GLAPPQYLIR,QYLIRVEGNL,YLIRVEGNLR | BRCA |
| TP53 | c.578A>G | p.H193R | HMTEVVRRCPHHERCSDSDGLAPPQ[p.H193R]RLIRVEGNLRVEYLDDRNTFRHSVVV | GLAPPQRLI,RLIRVEGNL,RLIRVEGNLR | BRCA,LIHC,OV,UCS |
| TP53 | c.578A>T | p.H193L | HMTEVVRRCPHHERCSDSDGLAPPQ[p.H193L]LLIRVEGNLRVEYLDDRNTFRHSVVV | GLAPPQLLI,LLIRVEGNL,GLAPPQLLIR,LLIRVEGNLR | BRCA,HNSC,LUSC |
| TP53 | c.581T>G | p.L194R | MTEVVRRCPHHERCSDSDGLAPPQH[p.L194R]RIRVEGNLRVEYLDDRNTFRHSVVVP | GLAPPQHRI,RIRVEGNLR,APPQHRIRV,RIRVEGNLRV | BRCA,OV |
| TP53 | c.584T>C | p.I195T | TEVVRRCPHHERCSDSDGLAPPQHL[p.I195T]TRVEGNLRVEYLDDRNTFRHSVVVPY | GLAPPQHLT,LTRVEGNLR,GLAPPQHLTR,LTRVEGNLRV,HLTRVEGNLR | BRCA,OV |
| TP53 | c.587G>C | p.R196P | EVVRRCPHHERCSDSDGLAPPQHLI[p.R196P]PVEGNLRVEYLDDRNTFRHSVVVPYE | HLIPVEGNL,APPQHLIPV,IPVEGNLRV,HLIPVEGNLR,LAPPQHLIPV | HNSC |
| TP53 | c.596G>T | p.G199V | RRCPHHERCSDSDGLAPPQHLIRVE[p.G199V]VNLRVEYLDDRNTFRHSVVVPYEPPE | HLIRVEVNL,LIRVEVNLR,EVNLRVEYL,VEVNLRVEY,LIRVEVNLRV,RVEVNLRVEY,HLIRVEVNLR,VEVNLRVEYL | BRCA |
| TP53 | c.614A>G | p.Y205C | ERCSDSDGLAPPQHLIRVEGNLRVE[p.Y205C]CLDDRNTFRHSVVVPYEPPEVGSDCT | CLDDRNTFR,ECLDDRNTFR,VECLDDRNTF,VEGNLRVECL | OV |
| TP53 | c.626_627 del GA | p.R209fs | DSDGLAPPQHLIRVEGNLRVEYLDD[p.R209fs]KHFST* | YLDDKHFST,VEYLDDKHF,RVEYLDDKHF | BRCA |
| TP53 | c.641A>G | p.H214R | APPQHLIRVEGNLRVEYLDDRNTFR[p.H214R]RSVVVPYEPPEVGSDCTTIHYNYMCN | NTFRRSVVV,FRRSVVVPY,TFRRSVVVPY,YLDDRNTFRR | LUSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TP53 | c.644G>T | p.S215I | PPQHLIRVEGNLRVEYLDDRNTFRH[p.S215I]IVVVPYEPPEVGSDCTTIHYNYMCNS | NTFRHIVVV, RNTFRHIVV, FRHIVVVPY, FRHIVVVPY | LUAD |
| TP53 | c.645T>G | p.S215R | PPQHLIRVEGNLRVEYLDDRNTFRH[p.S215R]RVVVPYEPPEVGSDCTTIHYNYMCNS | NTFRHRVVV, RHRVVVPYE, FRHRVVVPY, TFRHRVVVPY | OV |
| TP53 | c.646G>A | p.V216M | PQHLIRVEGNLRVEYLDDRNTFRHS[p.V216M]MVVPYEPPEVGSDCTTIHYNYMCNSS | NTFRHSMVV, DRNTFRHSM, FRHSMVVPY, MVVPYEPPEV, TFRHSMVVPY | BRCA, GBM, OV |
| TP53 | c.659A>C | p.Y220S | IRVEGNLRVEYLDDRNTFRHSVVVP[p.Y220S]SEPPEVGSDCTTIHYNYMCNSSCMGG | VVPSEPPEV, VVVPSEPPEV | BRCA |
| TP53 | c.659A>G | p.Y220C | IRVEGNLRVEYLDDRNTFRHSVVVP[p.Y220C]CEPPEVGSDCTTIHYNYMCNSSCMGG | VVPCEPPEV, VVVPCEPPEV | BRCA, GBM, HNSC, LUSC, OV, UCEC |
| TP53 | c.701A>G | p.Y234C | RNTFRHSVVVPYEPPEVGSDCTTIH[p.Y234C]CNYMCNSSCMGGMNRRPILTIITLED | CTTIHCNYM, TTIHCNYMC, CNYMCNSSCM | BRCA, GBM, LUSC, OV |
| TP53 | c.706T>G | p.Y236D | TFRHSVVVPYEPPEVGSDCTTIHYN[p.Y236D]DMCNSSCMGGMNRRPILTIITLEDSS | NDMCNSSCM | HNSC |
| TP53 | c.707A>G | p.Y236C | TFRHSVVVPYEPPEVGSDCTTIHYN[p.Y236C]CMCNSSCMGGMNRRPILTIITLEDSS | YNMCMCNSSCM | HNSC, OV |
| TP53 | c.711G>A | p.M237I | FRHSVVVPYEPPEVGSDCTTIHYNY[p.M237I]ICNSSCMGGMNRRPILTIITLEDSSG | CTTIHYNYI, YNYICNSSCM | HNSC |
| TP53 | c.711G>C | p.M237I | FRHSVVVPYEPPEVGSDCTTIHYNY[p.M237I]ICNSSCMGGMNRRPILTIITLEDSSG | CTTIHYNYI, YNYICNSSCM | LUAD |
| TP53 | c.713G>A | p.C238Y | RHSVVVPYEPPEVGSDCTTIHYNYM[p.C238Y]YNSSCMGGMNRRPILTIITLEDSSGN | TTIHYNYMY, YMYNSSCMG, YNYMYNSSC, CTTIHYNYMY, Y MYNSSCMGG, YNYMYNSSCM, IHYNYMYNSS, MYNSSCMGGM | BRCA, GBM |
| TP53 | c.713G>T | p.C238F | RHSVVVPYEPPEVGSDCTTIHYNYM[p.C238F]FNSSCMGGMNRRPILTIITLEDSSGN | YMFNSSCMG, TTIHYNYMF, NYMFNSSCM, YNYMFNSSC, Y MFNSSCMGG, CTTIFIYNYMF, YNYMFNSSCM, IHYNYMFNSS, MFNSSCMGGM | BRCA, GBM, HNSC |
| TP53 | c.722C>A | p.S241Y | VVVPYEPPEVGSDCTTIHYNYMCNS[p.S241Y]YCMGGMNRRPILTIITLEDSSGNLLG | NYMCNSYCM, HYNYMCNSY, SYCMGGMNR, NSYCMGGM NR, IHYNYMCNSY, SYCMGGMNRR, YNYMCNSYCM, MCN SYCMGGM | UCS |
| TP53 | c.722C>T | p.S241F | VVVPYEPPEVGSDCTTIHYNYMCNS[p.S241F]FCMGGMNRRPILTIITLEDSSGNLLG | HYNYMCNSF, NYMCNSFCM, SFCMGGMNR, YMCNSFCM G, NSFCMGGMNR, IHYNYMCNSF, SFCMGGMNRR, YNYM CNSFCM | OV |
| TP53 | c.723del C | p.S241fs | VVVPYEPPEVGSDCTTIHYNYMCNSS[p.S241fs]AWAA* | YMCNSSAWA, NVMCNSSAW, YNYMCNSSA, YMCNSSAW AA, HYNYMCNSSA, YNYMCNSSAW | BRCA |
| TP53 | c.725G>T | p.C242F | VVPYEPPEVGSDCTTIHYNYMCNSS[p.C242F]FMGGMNRRPILTIITLEDSSGNLLGR | SSFMGGMNR, YNYMCNSSF, NYMCNSSFM, SFMGGMNR R, YMCNSSFMG, FMGGMNRRPI, SSFMGGMNRR, HYNYM CNSSF, NSSFMGGMNR, YNYMCNSSFM, YMCNSSFMGG, MCNSSFMGGM | CLL, HNSC, LUSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TP53 | c.730G>T | p.G244C | PYEPPEVGSDCTTIHYNYMCNSSCM[p.G244C]CGMNRPILTIITLEDSSGNLLGRNS | YMCNSSCMC, SSCMCGMNR, CGMNRRPIL, SSCMCGMNR, R, NSSCMCGMNR, MCNSSCMCGM, CMCGMNRRPI | OV |
| TP53 | c.731G>A | p.G244D | PYEPPEVGSDCTTIHYNYMCNSSCM[p.G244D]DGMNRPILTIITLEDSSGNLLGRNS | SSCMDGMNR, DGMNRRPIL, NSSCMDGMNR, CMDGIVINRRPI | CRC |
| TP53 | c.733G>A | p.G245S | YEPPEVGSDCTTIHYNYMCNSSCMG[p.G245S]SMNRRPILTIITLEDSSGNLLGRNSF | SSCMGSMNR, GSMNRRPIL, MGSMNRRPI, CNSSCMGSM, SMNRRPILTI, SSCMGSMNR, NSSCMGSMNR, MGSMNR RPIL, MCNSSCMGSM, CMGSMNRRPI | CRC, GBM, HNSC, OV, PRAD |
| TP53 | c.734G>A | p.G245D | YEPPEVGSDCTTIHYNYMCNSSCMG[p.G245D]DMNRRPILTIITLEDSSGNLLGRNSF | SSCMGDMNR, NSSCMGDMNR, CMGDMNRRPI | OV |
| TP53 | c.734G>T | p.G245V | YEPPEVGSDCTTIHYNYMCNSSCMG[p.G245V]VMNRRPILTIITLEDSSGNLLGRNSF | SSCMGVMNR, GVMNRRPIL, SCMGVMNRR, MGVMNRRP I, CNSSCMGVM, YMCNSSCMGV, VMNRRPILTI, SSCMGVM NRR, NSSCMGVMNR, MGVMNRRPIL, MCNSSCMGVM, C MGVMNRRPI | HNSC, LUSC, OV |
| TP53 | c.742C>T | p.R248W | PEVGSDCTTIHYNYMCNSSCMGGMN[p.R248W]WRPILTIITLEDSSGNLLGRNSFEVR | NWRPILTII, SSCMGGMNW, MGGMNWRPI, MNWRPILTI, CMGGMNWRPI, GMNWRPILTI, SSCMGGMNWR, MNWR PILTII, NSSCMGGMNW | BLCA, BRCA, CLL, CRC, GBM, HNSC, OV, PAAD, UCEC |
| TP53 | c.743G>A | p.R248Q | PEVGSDCTTIHYNYMCNSSCMGGMN[p.R248Q]QRPILTIITLEDSSGNLLGRNSFEVR | MNQRPILTII, NQRPILTII, CMGGMNQRPI, GMNQRPILTI, SS CMGGMNQR, NQRPILTIIT | BLCA, BRCA, CLL, GBM, HNSC, OV, PRAD, STAD, UCEC, UCS |
| TP53 | c.743G>C | p.R248P | PEVGSDCTTIHYNYMCNSSCMGGMN[p.R248P]PRPILTIITLEDSSGNLLGRNSFEVR | SCMGGMNPR, NPRPILTII, GMNPRPILTI, CMGGMNPRPI, S SCMGGMNPR, NPRPILTIIT | LUAD |
| TP53 | c.745A>G | p.R249G | EVGSDCTTIHYNYMCNSSCMGGMNR[p.R249G]GPILTIITLEDSSGNLLGRNSFEVRV | GPILTMTL, MNRGPILTI, GMNRGPILTI, CMGGMNRGPI, MN RGPILTII | LUAD |
| TP53 | c.746G>T | p.R249M | EVGSDCTTIHYNYMCNSSCMGGMNR[p.R249M]MPILTIITLEDSSGNLLGRNSFEVRV | MNRMPILTI, MPILTIITL, MGGMNRMPI, SCMGGMNRM, N RMPILTII, CMGGMNRMPI, GMNRMPILTI, RMPILTIITL, M NRMPILTII, SSCMGGMNRM, MPILTIITLE | LUAD |
| TP53 | c.747G>T | p.R249S | EVGSDCTTIHYNYMCNSSCMGGMNR[p.R249S]SPILTIITLEDSSGNLLGRNSFEVRV | MNRSPILTI, SPILTIITL, MGGMNRSPI, GMNRSPILTI, CMGG MNRSPI, RSPILTIITL, MNRSPILTII | HNSC, LIHC, LUAD |
| TP53 | c.749C>T | p.P250L | VGSDCTTIHYNYMCNSSCMGGMNRR[p.P250L]LILTIITLEDSSGNLLGRNSFEVRVC | RLILTIITL, GMNRRLILT, MNRRLILTI, GGMNRRLIL, GMNRR LILTI, MNRRLILTII, RRLILTIITL | OV |
| TP53 | c.763A>T | p.I255F | TTIHYNYMCNSSCMGGMNRRPILTI[p.I255F]FTLEDSSGNLLGRNSFEVRVCACPGR | RPILTIFTL, NRRPILTIF, FTLEDSSGNL, MNRRPILTIF, RRPILTI FTL | LUAD |
| TP53 | c.775G>T | p.D259Y | YNYMCNSSCMGGMNRRPILTIITLE[p.D259Y]YSSGNLLGRNSFEVRVCACPGRDRRT | ILTIITLEY, LEYSSGNLL, PILTIITLEY, EYSSGNLLGR, LEYSSGNLLG | OV |
| TP53 | c.785G>T | p.G262V | MCNSSCMGGMNRRPILTIITLEDSS[p.G262V]VNLLGRNSFEVRVCACPGRDRRTEEE | IITLEDSSV, DSSVNLLGR, LEDSSVNLL, VNLLGRNSF, MTLEDSSV, TLEDSSVNLL, SVNLLGRNSF | HNSC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TP53 | c.796G>A | p.G266R | SCMGGMNRRPILTIITLEDSSGNLL[p.G266R]RRNSFEVRVCACPGRDRRTEEENLRK | LLRRNSFEV,DSSGNLLRR,GNLLRRNSF,NLLRRNSFEV,LLRR NSFEVR,SGNLLRRNSF | OV |
| TP53 | c.797G>A | p.G266E | SCMGGMNRRPILTIITLEDSSGNLL[p.G266E]ERNSFEVRVCACPGRDRRTEEENLRK | LLERNSFEV,DSSGNLLER,GNLLERNSF,NLLERNSFEV,SGNL LERNSF,LERNSFEVRV | BRCA,HNSC |
| TP53 | c.797G>T | p.G266V | SCMGGMNRRPILTIITLEDSSGNLL[p.G266V]VRNSFEVRVCACPGRDRRTEEENLRK | LLVRNSFEV,LVRNSFEVR,GNLLVRNSF,NLLVRNSFEV,LVR NSFEVRV,SGNLLVRNSF,LEDSSGNLLV | OV |
| TP53 | c.800G>C | p.R267P | CMGGMNRRPILTIITLEDSSGNLLG[p.R267P]PNSFEVRVCACPGRDRRTEEENLRKK | LLGPNSFEV,GNLLGPNSF,NLLGPNSFEV,SGNLLGPNSF | LUSC |
| TP53 | c.811G>A | p.E271K | MNRRPILTIITLEDSSGNLLGRNSF[p.E271K]KVRVCACPGRDRRTEEENLRKKGEPH | LLGRNSFKV,NLLGRNSFK,LGRNSFKVR,KVRVCACPG,NSFK VRVCA,SFKVRVCAC,NLLGRNSFKV,GNLLGRNSFK,KVRVC ACPGR | BLCA,LUSC |
| TP53 | c.814G>A | p.V272M | NRRPILTIITLEDSSGNLLGRNSFE[p.V272M]MRVCACPGRDRRTEEENLRKKGEPHH | LLGRNSFEM,LGRNSFEMR,NSFEMRVCA,FEMRVCACPG,NL LGRNSFEM,EMRVCACPGR,FEMRVCACPG | BRCA,OV |
| TP53 | c.817C>T | p.R273C | RRPILTIITLEDSSGNLLGRNSFEV[p.R273C]CVCACPGRDRRTEEENLRKKGEPHHE | NSFEVCVCA,EVCVCACPGR,FEVCVCACPG | BLCA,BRCA, CRC,HNSC,OV, STAD,UCEC |
| TP53 | c.818G>A | p.R273H | RRPILTIITLEDSSGNLLGRNSFEV[p.R273H]HVCACPGRDRRTEEENLRKKGEPHHE | NSFEVHVCA,LGRNSFEVH,EVHVCACPGR,HVCACPGRDR, FEVHVCACPG | BRCA,CLL, CRC,GBM, HNSC,LUAD, OV,STAD, UCEC,UCS |
| TP53 | c.818G>T | p.R273L | RRPILTIITLEDSSGNLLGRNSFEV[p.R273L]LVCACPGRDRRTEEENLRKKGEPHH E | NSFEVLVCA,LGRNSFEVL,LLGRNSFEVL,EVLVCACPGR,FE VLVCACPG | LUAD,LUSC,OV |
| TP53 | c.820G>T | p.V274F | RPILTIITLEDSSGNLLGRNSFEVR[p.V274F]FCACPGRDRRTEEENLRKKGEPHHE L | NSFEVRFCA,GRNSFEVRF,EVRFCACPGR,LGRNSFEVRF,FE VRFCACPG | LUAD |
| TP53 | c.824G>A | p.C275Y | PILTIITLEDSSGNLLGRNSFEVRV[p.C275Y]YACPGRDRRTEEENLRKKGEPHHEL | RNSFEVRVY,YACPGRDRR,NSFEVRVYA,RVYACPGRDR,EV RVYACPGR,GRNSFEVRVY,FEVRVYACPG | OV |
| TP53 | c.824G>T | p.C275F | PILTIITLEDSSGNLLGRNSFEVRV[p.C275F]FACPGRDRRTEEENLRKKGEPHHEL P | FACPGRDRR,NSFEVRVFA,RNSFEVRVF,FEVRVFACP,RVF ACPGRDR,EVRVFACPGR,VFACPGRDRR,GRNSFEVRVF,FE VRVFACPG | HNSC,LUAD |
| TP53 | c.830G>T | p.C277F | LTIITLEDSSGNLLGRNSFEVRVCA[p.C277F]FPGRDRRTEEENLRKKGEPHHELP PG | CAPPGRDRR,SFEVRVCAF,EVRVCAPPGR,NSFEVRVCAF,F EVRVCAPPG | LUAD |
| TP53 | c.832C>T | p.P278S | TIITLEDSSGNLLGRNSFEVRVCAC[p.P278S]SGRDRRTEEENLRKKGEPHHELPP GS | CACSGRDRR,FEVRVCACS,EVRVCACSGR,FEVR VCACSG | HNSC |
| TP53 | c.841G>A | p.D281N | TLEDSSGNLLGRNSFEVRVCACPGR[p.D281N]NRRTEEENLRKKGEPHHELPPG STKR | CACPGRNRR,RVCACPGRNR | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TP53 | c.844C>T | p.R282W | LEDSSGNLLGRNSFEVRVCACPGRD[p.R282W]WRTEEENLRKKGEPHHELPPG STKRA | CACPGRDWR,RDWRTEEENL | BRCA,CRC,GBM, HNSC,OV,STAD |
| TP53 | c.853G>A | p.E285K | SSGNLLGRNSFEVRVCACPGRDRRT[p.E285K]KEENLRKKGEPHHELPPGSTKR ALPN | RTKEENLRK,RTKEENLRKK | BLCA,CESC, HNSC,LUAD |
| TP53 | c.856G>A | p.E286K | SGNLLGRNSFEVRVCACPGRDRRTE[p.E286K]KENLRKKGEPHHELPPGSTKRAL PNN | RTEKENLRK,RTEKENLRKK | BRCA,STAD |
| TP53 | c.945_946 de\|TC | p.S315fs | KGEPHHELPPGSTKRALPNNTSSSP[p.S315fs]AKEETTGWRIFHPSDPWA* | KEETTGWRI,RIFHPSDPW,EETTGWRIF,RIFHPSDPWA,LP NNTSSSPA,KEETTGWRIF,WRIFHPSDPW,EETTGWRIFH,S PAKEETTGW | OV |
| TP53R K | c.520de\|C | p.L174fs | VLARMHDEDLIHGDLTTSNMLLKPP[p.L174fs]WNS* | SNMLLKPPW | STAD |
| TPO | c.1193G>C | p.S398T | AACAPEPGIPGETRGPCFLAGDGRA[p.S398T]TEVPSLTALHTLWLREHNRLAA ALKA | FLAGDGRAT,GRATEVPSL,TEVPSLTAL,TEVPSLTALH | ACC |
| TPO | c.1672G>A | p.E558K | GGLDPLIRGLLARPAKLQVQDQLMN[p.E558K]KELTERLFVLSNSSTLDLASINLQ RG | QVQDQLMNK,KELTERLFV,LMNKELTERL,QLMNKELTER, VQDQLMNKEL,MNKELTERLF,KELTERLFVL | LUAD |
| TPO | c.2476G>A | p.A826T | ADGAHPPCHASARCRNTKGGFQCLC[p.A826T]TDPYELGDDGRTCVDSGRLPR VTWIS | CLCTDPYEL,FQCLCTDPY,GFQCLCTDPY | CRC |
| TPPP | c.89G>A | p.R30K | AKPAKAANRTPPKSPGDPSKDRAAK[p.R30K]KLSLESEGAGEGAAASPELSALEE AF | KLSLESEGA,PSKDRAAKK,DRAAKKLSL | KIRP |
| TPR | c.6464C>T | p.S2155L | EDRTVPSTPTLVVPHRTDGFAEAIH[p.S2155L]LPQVAGVPRFRFGPPEDMPQT SSSHS | AEAIHLPQV,FAEAIHLPQV,AIHLPQVAGV,HLPQVAGVP R,LPQVAGVPRF,AEAIHLPQVA | CRC |
| TPRX1 | c.598T>C | p.S200P | NPGPIPGPNPGPIPGPISGPIPGPI[p.S200P]PVPIPGPIPGPISGPNPGPIPG | GPIPGPIPV,IPGPIPVPI,IPVPIPGPI | TGCT |
| TPTE | c.1268C>T | p.S423L | AQVKHLYNWNLPPRRLFIKHFIIYL[p.S423L]LIPRYVRDLKIQIEMEKKVFSTISL | FIKHFIIYL,IIYLIPRYV,FIIYLIPRY,HFIIYLIPR,IYLIPRYV R,IKHFIIYLI,FIKHFIIYLI,FIIYLIPRYV,YLIPRYVRDL,IIYL IPRYVR,LIPRYVRDLK,LFIKHFIIYL,KHFIIYLIPR,HFIIYLIPRY VEILFGEKI,GEKITSSDVV,VEILFGEKIT | CRC,UCEC |
| TPTE2 | c.1623G>A | p.M541I | DNLHKQKARRIYPSDFAVEILFGEK[p.M541I]ITSSDVVAGSD* | KHQNHYRVY,QNHYRVINL,KKHQNHYRV,FLDKKHQNHY, HQNHYRVYNL,KKHQNHYRVI | LUSC |
| TPTE2 | c.773G>A | p.R258Q | FPSSGRQSFYRNPIEEVVRFLDKKH[p.R258Q]QNHYRVYNLCSERAYDPKHFHN RVSR | | CRC |
| TRAF3 | c.26C>T | p.S9F | MESSKKMD[p.S9F]FPGALQTNPPLKL HTDRSAGTPVFVP | MESSKKMDF,KKMDFPGAL,SSKKMDFPGA,SKKMDFPGAL | CESC |
| TRAF7 | c.32G>A | p.R11H | MSSGKSARYN[p.R11H]HFSGGPSNLP TPDVTTGTRMETTFGP | KSARYNHFS,SARYNHFSG,GKSARYNHF,KSARYNH FSG,SARYNHFSGG,SGKSARYNHF,NHFSGGPSNL | DLBCL |
| TRAK1 | c.1879G>A | p.D627N | DPRPGVVTKGFRTLDVDLDEVYCLN[p.D627N]NFEEDTGDHISLPRLATSTPV QHPE | DEVYCLNNF | CRC |
| TRAM 1 | c.121G>C | p.E41Q | HEFVLQNHADIVSCVAMVFLLGLMF[p.E41Q]ITAKASIIFVTLQVNVTLPATEE QA | FLLGLMFQI,LMFQITAKA,FQITAKASI,GLMFQITAK,FLLGL MFQIT,GLMFQITAKA,FQITAKASII,LGLMFQITAK,VFLLGL MFQI,MFQITAKASI,LMFQITAKAS,QITAKASIIF | BLCA |

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TRAM1L1 | c.1033de|A | p.R345fs | LQRWVEDSNIQASCMKKKRSRSSKK[p. R345fs]EQKTEWEWKLQIE* | SKKEQKTEW,TEMEWKLQI,KEQKTEWEW,RSRSSKKEQK | STAD |
| TRANK1 | c.2536G>A | p.E846K | YNISRRLSKLRVLPWSIHELYGDEI[p.E8 46K]KDFTQAELALLMKCINDPNSMFLT GD | LYGDEIKDF,IKDFTQAEL,DEIKDFTQA,EIKDFTQAEL,KDFT QAELAL,DEIKDFTQAE | UCEC |
| TRAPPC10 | c.399_400 insA | p.K133fs | WQNVLKAHSSVDWLIVIVENDAKKK[p. K133fs]KQNQHPSPNLYCGQNKK* | NLYCGQNKK,NQHPSPNLY,KQNQHPSPN,KQNQHPSPNL, QNQHPSPNLY | GBM |
| TRAPPC11 | c.1703G>A | p.R568Q | MNESPDPEPDCDILAVKTAQKLWAD[p. R568Q]QISLAGSNIFTIGVQDFVPFVQ CKAK | KLWADQISL,AQKLWADQI,KLWADQISLA,QISLAGSNIF,Q KLWADQISL,DQISLAGSNI | CRC |
| TRDN | c.2190A>C | p.*730Y | PFTPADRPGESSGQANSPGQKQQGQ[p. *730Y]YTHMYDPYKCFKILKM* | YTHMYDPYK,MYDPYKCFK,QQGQYTHMY,KQQGQYTHM, HMYDPYKCF,QKQQGQYTH,GQYTHMYDP,YKCFKILKM, DPYKCFKIL,HMYDPYKCFK,MYDPYKCFKI,KQQGQYTHMY, GQYTHMYDPY,QQKQQGQYTH,QKQQGQYTHM,THMY DPYKCF,SPGQKQQGQY | KIRC |
| TRIM23 | c.1187G>A | p.R396Q | QQQFTEVADHIQLDASIPVTFTKDN[p. R396Q]QVHIGPKMEIRVVTLGLDGAG KTTIL | FTKDNQVHI,NQVHIGPKM,KDNQVHIGPK | CRC |
| TRIM23 | c.866G>A | p.R289Q | IVEDGIGMAHTEHVPGTAENARSCI[p. R289Q]QAYFYDLHETLCRQEEMALSVV DAHV | RSCIQAYFY,CIQAYFYDL,NARSCIQAY,ARSCIQAYF, IQAYFYDLH,ARSCIQAYFY,ENARSCIQAY,NARSCIQAYF, AENARSCIQA | CRC |
| TRIM4 | c.1193G>T | p.R398L | NVFTSGKHYWEVESRDSLEVAVGVC[p. R398L]LEDVMGITDRSKMSPDVGIWAI YWSA | LEVAVGVCL | LUAD |
| TRIM42 | c.379C>A | p.Q127K | TFHKGRLRSIHTSSKTALRTGSSDT[p.Q1 27K]KVDEVKSIPANSHLVNHLNCPMCS RL | ALRTGSSDTK | LUAD |
| TRIM48 | c.278C>A | p.A93D | CFECIKTIQQRNLKTNIRLKKMASL[p.A9 3D]DRKASLWLFLSSEEQMCGIHRETKK M | RLKKMASLD,KMASLDRKA,RLKKMASLDR,MASLDRKASL, KKMASLDRKA,ASLDRKASLW,LDRKASLWLF | LUAD |
| TRIM61 | c.294G>C | p.K98N | SLTEIAKQLQIRSKKKRRQEEKHVC[p.K9 8N]NKHNQVLTFFCQKDLELLCPRCSLS T | NKHNQVLTF,RQEEKHVCNK,CNKHNQVLTF,KHNQVLTF F | CESC |
| TRIM7 | c.994C>A | p.L332I | MKNKVWNVSLKTFVLKGMLKKFKED[p. L332I]IRGELEKEEKVELTLDPDTANPRL IL | MLKKFKEDI,KFKEDIRGEL,MLKKFKEDIR | LUSC |
| TRIM9 | c.1009C>A | p.R337S | FEACLVAQCDALIDALNRRKAQLLA[p.R 337S]SVNKEHEFIKLKVVRDQISHCTVK LRQ | AQLLASVNK,SVNKEHEHK,RKAQLLASV,KAQLLASVN K,ASVNKEHEHK,RRKAQLLASV | LUAD |
| TRIML1 | c.1197C>A | p.H399Q | DLFSLIGLKIGDDYSLMVSSPLKGQ[p.H 399Q]QVREPVCKVGVFLDYESGHIAFY NGT | LKGQQVREPV | LUAD |
| TRIO | c.1981C>T | p.R661W | QTGECDPEEIYQAAHQLEDRIQDFV[p. R661W]WRVEQRKILLDMSVSFHTHVK ELWTW | RIQDFVWRV,FVWRVEQRK,DFVWRVEQR,WRVEQRKIL, DFVWRVEQRK,WRVEQRKILL | CRC |
| TRIOBP | c.3899A>G | p.H1300R | DLPPPRRLAQRQPGPQAQCSSGGRT[p. H1300R]RSPGRAEVERLFGQERRKSEA AGAFQ | GGRTRSPGR,RTRSPGRAE,GGRTRSPGRA,RTRSPGRAEV | ACC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TRIP11 | c.1622de|A | p.K541fs | DQLSKQQNEGDSIISKLKQDLNDEK[p.K541fs]REFINLKMIKWTLLKS* | KMIKWTLLK,EFINLKMIK,NLKMIKWTL,LKMIKWTLL,KREFINLKM,REFINLKMI,DEKREFINL,NLKMIKWTLL,EKREFINLKM,KMIKWTLLKS | STAD |
| TRIP12 | c.5324T>C | p.L1775P | KLMAKAIMDFRLVDLPLGLPFYKWM[p.L1775P]PRQETSLTSHDLFDIDPVVARSVYHL | WMPRQETSL,KWMPRQETS,LPFYKWMPR,MPRQETSLT,YKWMPRQET,KWMPRQETSL,GLPFYKWMPR,MPRQETSLTS,YKWMPRQETS | MM |
| TRMT61A | c.731G>T | p.S244I | ALAARGFSELSTLEVLPQVYNVRTV[p.S244I]ILPPPDLGTGTDGPAGSDTSPFRSGT | VYNVRTVI,QVYNVRTVI,PQVYNVRTVI,QVYNVRTVIL | TGCT |
| TRPA1 | c.162G>T | p.K54N | TEDFKESLKVVPEGSAYGLQNFNKQ[p.K54N]NKLKRCDDMDTFFLHYAAAEGQIELM | NFNKQNKLKR,LQNFNKQNKL | CRC |
| TRPA1 | c.2017de|A | p.T673fs | DKSCRDYYIEYNFKYLQCPLEFTKK[p.T673fs]HLHRMLYMNRLQPSTQWYKITA* | YMNRLQPST,RLQPSTQWY,LQPSTQWYK,LHRMLYMNR,STQWYKITA,KKHLHRMLY,EFTKKHLHR,FTKKHLHRM,LEFTKKHLH,KHLHRMLYM,HRMLYMNRL,QPSTQWYKI,MLYMNRLQPS,HLHRMLYMNR,RLQPSTQWYK,LQPSTQWYKI,KKHLHRMLY,FTKKHLHRML,TKKHLHRMLY,RMLYMNRLQP,YMNRLQPSTQ,MNRLQPSTQW,CPLEFTKKHL | STAD |
| TRPC5 | c.1469C>T | p.S490L | PREEWEMWHPTLIAEALFAISNILS[p.S490L]LLRLILSLFTANSHLGPLQISLGRML | FAISNILSL,AISNILSLL,ISNILSLLR,SLLRLISLF,LSLLRLISL,FAISNILSLL,ILSLLRLISL,LLRLISLFTA,AISNILSLLR,LFAISNILSL,LSLLRLISLF,ISNILSLLRL | CRC, UCEC |
| TRPM3 | c.1285C>T | p.R429W | TRTQAQHLFIILMECMKKKELITVF[p.R429W]WMGSEGHQDIDLAILTALLKGANASA | KELITVFWM,WMGSEGHQDI,KKKELITVFW,KKELITVFWM,KELITVFWMG | UCEC |
| TRPM3 | c.892G>T | p.G298W | QTMSNPMSKLTVLNSMHSHFILADN[p.G298W]WTTGKYGAEVKLRRQLEKHISLQKIN | FILADNWTT,LADNWTTGK,ADNWTTGKY,SHFILADNW,LADNWTTGKY,ILADNWTTGK,WTTGKYGAEV,HSHFILADNW | LUAD |
| TRPM6 | c.2984G>A | p.R995H | IAKMTANMFYIVIIMAIVLLSFGVA[p.R995H]HKAILSPKEPPSWSLARDIVFEPYWM | LLSFGVAHK,SFGVAHKAI,AHKAILSPK,LSFGVAHKA,VLLSFGVAH,LLSFGVAHKA,VLLSFGVAHK,V AHKAILSPK,LSFGVAHKAI | CRC |
| TRPM7 | c.2528G>A | p.R843Q | VRILDSNEGKNEMEIQMKSKKLPIT[p.R843Q]QKFYAFYHAPIVKFWFNTLAYLGFLM | ITQKFYAFY,KSKKLPITQ,KLPITQKFY,KKLPITQKF,TQKFYAF YH,QKFYAFYHA,LPITQKFYA,KLPITQKFYA,KSKKLPITQK,IT QKFYAFYH,TQKFYAFYHA,KKLPITQKFY,PITQKFYAFY,LPIT QKFYAF,SKKLPITQKF,QKFYAFYHAP | CRC |
| TRPM7 | c.5584C>T | p.R1862C | PQDEPSDLNLQPGNSTKESESTNSV[p.R1862C]CLML* | SESTNSVCL,KESESTNSVC,SESTNSVCLM | CRC |
| TRPM8 | c.2295_2296insC | p.H765fs | VFYIAFILLFAVLLMDFHSVPHPP[p.H765fs]RAGPVLAGLCPLL* | VLAGLCPLL,HSVPHPPRA,HPPRAGPVL,RAGPVLAGL,DFH SVPHPPR,VPHPPRAGPV,GPVLAGLCPL | STAD |
| TRPS1 | c.3373C>T | p.R1125W | IEKYQYPLFGLPFVHNDFQSEADWL[p.R1125W]WFWSKYKLSVPGNPHYLSHVPGLPNP | WLWFWSKYK,FQSEADWLW,SEADWLWFW,LWFWSKYK L,WLWFWSKYKL,EADWLWFWSK,DFQSEADWLW,FQSE ADWLWF,WFWSKYKLSV,DWLWFWSKYK,ADWLWFWSK Y,SEADWLWFWS | CRC |
| TRPV2 | c.1865_1867de|TGC | p.L627 de| | KFTIGMGELAFQEQLHFRGMVLLLL[p.L627de|]AVVLLTYILLLNMLIALMSETVNSVATD | MVLLLLAYV,VLLLLAYVL,RGMVLLLLA,GMVLLLLAY,GMVL LLLAYV,MVLLLLAYVL,VLLLLAYVLL,RGMVLLLLAY | CLL |
| TRPV3 | c.653C>A | p.A218E | FAEENDILGRFINAEYTEEAYEGQT[p.A218E]ELNIAIERRQGDIAALLIAAGADVNA | GQTELNIAI,ELNIAIERR,EAYEGQTEL,YEGQTELNI,AYEGQ TELNI,QTELNIAIER,EEAYEGQTEL,YEGQTELNIA | KIRP |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TRPV5 | c.1475G>A | p.R492H | YFTRGFQMLGPFTIMIQKMIFGDLM[p.R492H]HFCWLMAVVILGFASAFYIIFQTEDP | LMHFCWLMA,MHFCWLMAV,KMIFGDLMH, F,DLMHFCWLM,GDLMHFCWL,MIFGDLMHF,LMHFCW LMAV,KMIFGDLMHF,IFGDLMHFCW,HFCWLMAVVI,MH FCWLMAVV,GDLMHFCWLM | CRC |
| TRRAP | c.10543C>T | p.R3515W | THYYIKIARFMPRVEIVQKHNTAAR[p.R3515W]WLYIRGHNGKIYPYLVMNDACLTESR | TAARWLYIR,AARWLYIRG,HNTAARWLY,NTAARWLYI,QK HNTAARW,KHNTAARWL,WLYIRGHNGK,NTAARWLYIR, AARWLYIRGH,RWLYIRGHNG,KHNTAARWLY,VQKHNTA ARW,QKHNTAARWL | CRC |
| TRRAP | c.2917G>T | p.A973S | DCLKSANTEPYYRRQ[p.A973S]WEVIKCFLV[p.A973S]SMMSLEDNKHALYQLLAHPNFTEKTI | SMMSLEDNK,CFLVSMMSL,VIKCFLVSM,IKCFLVSMM,VS MMSLEDNK,EVIKCFLVSM,KCFLVSMMSL,SMMSLEDNKH, WEVIKCFLVS | KICH |
| TSC1 | c.1132G>T | p.G378C | CGMTTPPTSPGNVPPDLSHPYISKVF[p.G378C]CTTAGGKGTPLGTPATSPPPAPLCHS | KVFCTTAGG,YSKVFCTTA,SKVFCTTAG,KVFCTTAGGK, HPYSKVFCTT | LUAD |
| TSC22D2 | c.1255G>A | p.A419T | AQPSSTGAAASPATAATLPVGTGQN[p.A419T]TSSVGAQLMGASSQPSEAMAPRTGPA | NTSSVGAQL,GQNTSSVGA,NTSSVGAQLM | ACC |
| TSG101 | c.794A>G | p.K265R | WRMKEEMDRAQAELNALKRTEEDLK[p.K265R]RGHQKLEEMVTRLDQEVAEVDKNIEL | DLKRGHQKL,RGHQKLEEM | THCA |
| TSG101 | c.826C>A | p.R276S | AELNALKRTEEDLKKGHQKLEEMVT[p.R276S]SLDQEVAEVDKNIELLKKKDEELSSA | KLEEMVTSL,SLDQEVAEV,MVTSLDQEV,EMVTSLDQEV,TS LDQEVAEV,QKLEEMVTSL | LUAD |
| TSHZ1 | c.1503G>C | p.K501N | EDSLEKFEPSTLYPYLREEDLDDSP[p.K501N]NGGLDILKSLENTVSTAISKAQNGAP | SPNGGLDIL | LUAD |
| TSHZ1 | c.2642G>T | p.R881M | QAQFASSLRETTEGKYIMSDLGPQE[p.R881M]MVHISKFTGLSMTTISHWLANVKYQL | MSDLGPQEM,QEMVHISKF,MSDLGPQEMV,IMSDLGPQE M,MVHISKFTGL,PQEMVHISKF,QEMVHISKFT | CRC |
| TSHZ2 | c.664G>A | p.A222T | LYRQSSKMCGTVFTGASRFRCRQCS[p.A222T]TAYDTLVELTVHMNETGHYQDDNRKK | RFRCRQCST,RCRQCSTAY,CSTAYDTLV,TAYDTLVEL,RQCS TAYDT,STAYDTLVEL,RFRCRQCSTA,FRCRQCSTAY,RQCST AYDTL | GBM |
| TSHZ3 | c.2030G>T | p.G677V | EPIKMEASSDGGFRSQENSPSPPRD[p.G677V]VCKDGSPLAEPVENGKELVKPLASSL | RDVCKDGSPL | LUAD |
| TSKS | c.1537G>A | p.E513K | CPSCQRLHKKILELERQALAKHVRA[p.E513K]KALSSTLRLAQDEALRAKNLLLTDKM | ALAKHVRAK,LAKHVRAKA,HVRAKALSS,RAKALSSTL,KALS STLRL,AKHVRAKAL,ALAKHVRAKA,QALAKHVRAK, HVRAKALSST,RAKALSSTLR,KALSSTLRLA,LAKHVRAKAL, VRAKALSSTL,AKALSSTLRL | BLCA |
| TSPAN4 | c.274C>G | p.L92V | IGFVGCLGAIKENKCLLLTFFLLL[p.L92V]VFLLEATIAILFFAYTDKIDRYAQQ | LTFFLLLIV,FLLLLVFL,LLLLVVFLL,LLVVFLLEA,FFLLLVVF, LLTFFLLLIV,LTFFLLLIVV,FLLLLVVFLL,LLLVVFLLEA,TFFLLL LVVF,FFLLLVVFL | PRAD,CT |
| TSSK1B | c.901G>A | p.E301K | ARGSPSVAINKEGESSRGTEPLWTP[p.E301K]KPGSDKKSATKLEPEGEAQPQAQPET | GTEPLWTPK,RGTEPLWTPK | UCEC |
| TTBK2 | c.249T>G | p.C83W | KQVLKMEVAVLKKLQGKDHVCRFIG[p.C83W]WGRNDRFNYVVMQLQGRNLADLRRSQ | WGRNDRFNY,VCRFIGWGR,FIGWGRNDR,IGWGRNDRF, HVCRFIGWGR,GWGRNDRFNY,RFIGWGRNDR,FIGWGR NDRF | KIRP |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TTC21A | c.809C>A | p.S270Y | ESNIDACQILTVHELAREGNMTTVSl[p.S270Y]YLKTQKATNHVRNLIKALETREPENP | NMTTVSYLK,TVSYLKTQK,EGNMTTVSY,GNMTTVSYL,RLSKGH,RLSKGH, GN MTTVSYLK,TTVSYLKTQK,REGNMTTVSY | CRC |
| TTF1 | c.1007 de|A | p.K336fs | RPAVGLHGETAGIPAPAYKNKSKKK[p.K336fs]RKKSPITRNLRQWPCLRASRVHTLKDHRWAVRLGLWKAVQLLKGSRNPTVQRRSLRKGSLRLSKGHECLVMIFQCPVRTLRAHSLIQ* | TLKDHRWAV,GLWKAVQLL,LVMIFQCPV,SLRKGSLRL,RLSKGH ECL,RASRVHTLK,TVQRRSLRK,WAVRLGLWK,LWKAV QLLK,RSLRKGSLR,RWAVRLGLW,IFQCPVRTL,RTLRAHSLI, KNKSKKKRK,KKRKSPITR,KSPITRNLR,RNLRQWPCL,CLRAS RVHT,RVHTLKDHR,HTLKDHRWA,AVRLGLWKA,GSRNPT VQR,NLRQWPCLR,QWPCLRASR,PTVQRRSLR,VMIFQCP VR,FQCPVRTLR,WPCLRASRV,NPTVQRRSL,SKKKRKSPI,LRA SRVHTL,RKSPITRNL,RQWPCLRAS,HRWAVRLGL,SKGH ECLVM,GHECLVMIF,VRTLRAHSL,CPVRTLRAH,KDHRWA VRL,RLSKGHECLV,CLVMIFQCPV,MIFQCPVRTL,CLRASRV HTL,LLKGSRNPTV,GLWKAVQLLK,RWAVRLGLWK,LVMIF QCPVR,KSKKKRKSPI,KKKRKSPITR,KRKSPITRNL,ITRNLRQ WPC,RNLRQWPCLR,RQWPCLRASR,HTLKDHRWAV, TLKDHRWAVR,AVRLGLWKAV,GSRNPTVQRR,RSLRKGSLRL, SLRKGSLRLS,RTLRAHSLIQ,IFQCPVRTLR,LSKGHECLVM, RVHTLKDHRW,HRWAVRLGLW,LRLSKGHECL,KG HECLVMIF,FQCPVRTLRA,SPITRNLRQW | STAD |
| TTF1 | c.1589A>G | p.Q530R | IKDRATSTIKRMYRDDLERFKEFKA[p.Q530R]RGVAIKFGKFSVKENKQLEKNVEDFL | RGVAIKFGK,RFKEFKARG,KARGVAIKF,EFKARGVAI,KEFKA RGVA,RPKEFKARGV,EFKARGVAIK,KARGVAIKFG,KEFKAR GVAI,FKARGVAIKF,RGVAIKFGKF | TGCT |
| TTF2 | c.2281C>A | p.R761S | LDEAHNVKNPRVQTSIAVCKLQACA[p.R761S]SWAVTGTPIQNNLLDMYSLLKFLRCS | KLQACASWA,LQACASWAV,CKLQACASW,SWAVTGTPI,KLQA CASWAV,LQACASWAVT,ASWAVTGTPI | LUAD |
| TTI1 | c.2120G>A | p.R707H | CGYDSLQHLINQNSDYLVNGISLNL[p.R707H]HHLALHPHTPKVLEVMLRNSDANLLP | SLNLHHLAL,GISLNLHHL,LHHLALHPH,GISLNLHHLA,ISLNL HHLAL | STAD |
| TTLL11 | c.367_368 insAGG CCA | p.122_123insKA | SELAARWEAEAVAAAKAAAAKAEAEA[p.122_123insKA]KATAETVAEQVRVDAGAAGEPECKAGEEQPK | AAKAEAEAK,EAKATAETV,ARAEAKATA,AKATAETVA,AEA KATAET,AAAKAEAEAK,AEAKATAETV | ACC |
| TTLL7 | c.2252G>A | p.R751H | LIKLDSVKQRKVLDIVKTSIRTVLP[p.R751H]IHWKVPDVEEVNLYRIFNRVFNRLLW | TVLPHIWKV,SIRTVLPHI,RTVLPHIWK,TSIRTVLPH,KTISIRT VLPH,RTVLPHIWKV,TSIRTVLPHI,SIRTVLPHIW,LPHIWKV PDV | UCEC |
| TUBA1C | c.436C>T | p.L146F | EDGVVGLNYSCGNLGRRVNGELQLG[p.L146F]FLAIIN* | LQLGFLAII,ELQLGFLAI,VNGELQLGF,GELQLGFLA,RVNGE LQLGF,GELQLGFLAI | ACC, GCT |
| TUBA3C | c.526_527 insC | p.Q176fs | SLLMERLSVDYGKKSKLEFAIYPAP[p.Q176fs]PGLHGRGGAlQLHPDHPDPGTF* | AIYPAPPGL,GLHGRGGAL,HGRGGALQL,LQLHPDHPH,FAI YPAPPGL,AIYPAPPGLH,LEFAIYPAPP,LHGRGGALQL | LUAD |
| TUBA3D | c.728G>A | p.R243Q | DIERPTYTNLNRLIGQIVSSITASL[p.R243Q]QFDGALNVDLTEFQTNLVPYPRIHFP | LQFDGALNV,SSITASLQF,ASLQFDGAL,SLQFDGALNV,ITA SLQFDGA,VSSITASLQF,LQFDGALNVD | CRC |
| TUBB P5 | c.304G>A | p.V102M | TYHGDSHLQLERINVHHHEASGGRY[p.V102M]MPRAVLVDLEPGTMDSVRSGPFGQVL | ASGGRYMPR,RYMPRAVLV,GGRYMPRAV,MPRAVLVDL, HEASGGRYM,GRYMPRAVL,YMPRAVLVDL,EASGGRYMP R,HHEASGGRYM | GBM |
| TUBB P5 | c.356G>A | p.R119H | HEASGGRYVPRAVLVDLEPGTMDSV[p.R119H]HSGPFGQVLRPDNFIFGELRARTGVR | MDSVHSGPF,HSGPFGQVL,SVHSGPFGQV,HSGPFGQVLR, TMDSVHSGPF,VHSGPFGQVL | UCS |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| TUBD1 | c.599C>T | p.A200V | YGTGEVIVQNYNSILTLSHLYRSSD[p.A200V]VLLLHENDAIHKICAKLMNIKQISFS KSQQRKVRQMIEQLQNSKAVIQSKD[p.A340T]TTIQELKEKIAYLEAENLEMHDR MEH | HLYRSSDVL,RSSDVLLLH,LYRSSDVLL,YRSSDVLLL,HLYRSS DVLL,VLLLHENDAI,LYRSSDVLL,SHLYRSSDVL | BRCA |
| TUFT1 | c.1018G>A | p.A340T | | TTIQELKEK,SKDTTIQEL,AVIQSKDTTI | CRC |
| TUFT1 | c.303G>C | p.L101F | HSAGHSLASELVESHDGHEEIIKVY[p.L101F]FKGRSGDKMIHEKNINQLKSEVQY IQ | IIKVYFKGR,KVYFKGRSG,YFKGRSGDK,FKGRSGDKM,HEEIIKVYF, VYFKGRSGDK,EIIKVYFKGR | CESC |
| TWIST NB | c.918T>A | p.H306Q | KKKHQEVQDQDPVFQGSDSSGYQSD[p.H306Q]QKKKKKKKRKHSEEAEFTPLK CSPKR | SSGYQSDQK | CLL |
| TXND C15 | c.1028G>A | p.R343Q | LIKSVDWLLVFSLFFLLISFIMYATI[p.R343Q]QTESIRWLIPGQEQEHVE* | FIMYATIQT,IQTESIRWL,QTESIRWLI,YATIQTESI,IMYATIQ TE,IQTESIRWLI,IMYATIQTES,MYATIQTESI | CRC |
| TXNL1 | c.700C>T | p.R234C | AERSEPTQALELTEDDIKEDGIVPL[p.R234C]CYVKFQNVNSVTIFVQSNQGEEET TR | GIVPLCYVK,IVPLCYVKF,DGIVPLCYV,KEDGIVPLCY,GIVPL CYVKF | UCEC |
| TYRP1 | c.1054_1057delACAA | p.T352fs | PEPQDVAQCLEVGLPDTPPFYSNST[p.T352fs]VSETQWKVTVTPRESMTLLFEVF TIWLIYS* | TVSETQWKV,ESMTLLFEV,TLLFEVFTI,STVSETQWK,SMTL LFEVF,EVFTIWLIY,QWKVTVTPR,MTLLFEVFT,TPRESMTLL, SETQWKVTV,TQWKVTVTP,LLFEVFTIW,FEVFTIWLI,MTL LFEVFTL,LLFEVFTIWL,STVSETQWKV,TQWKVTVTPR,ESM TLLFEVF,TLLFEVFTIW,LFEVFTIWLI,KVTVTPRESM,EVFTI WLIYS,TPRESMTLLF,RESMTLLFEV,FEVFTIWLIY,SETQWK VTVT,TPPFYSNSTV | GBM |
| U2AF1 | c.101C>A | p.S34Y | FGTEKDKVNCSFYFKIGACRHGDRC[p.S34Y]YRLHNKPTFSQTIALLNIYRNPQNS | YRLHNKPTF,CYRLHNKPTF,GDRCYRLHNK,GACRHGDRCY | LAML |
| U2AF1 | c.101C>T | p.S34F | FGTEKDKVNCSFYFKIGACRHGDRC[p.S34F]FRLHNKPTFSQTIALLNIYRNPQNS | FRLHNKPTF,CFRLHNKPTF,ACRHGDRCFR,GDRCFRLHNK, GACRHGDRCF | CESC, LAML, LUAD, UCS |
| UBC | c.2051del G | p.G684fs | EDGRTLSDYNIQKESTLHLVLRLRG[p.G684fs]VSKFPPLLRFQQISLHFPFNKVVAF | SLHFPFNKV,HVLRLRGV,LLRFQQISL,VLRLRGVSK,GVSKF PLLR,ISLHFPFNK,RFQQISLHF,QQISLHFPF,RLRGVSKFP,R GVSKFPLL,FPLLRFQQI,FPFNKVVAF,LRLRGVSKF,LRGVSK FPL,VSKFPLLRF,LHFPFNKVV,RLRLRGVSK,KFPPLLRFQQI,FQQISLHFPF,HF PFNKVVAF,RGVSKFPLLR,ISLHFPFNKV,VLRLRGVSKF,GVS KFPLLRF,LRFQQISLHF,LHFPFNKVVA,FPLLRFQQIS | STAD |
| UBC | c.572T>C | p.I191T | TLEVEPSDTIENVKAKIQDKEGIPP[p.I191T]TSRGSSLQASSWKMAVLFLTTTSRR S | TSRGSSLQA,PPTSRGSSL,IPPTSRGSSL,IQDKEGIPPT | PRAD |
| UBE2J2 | c.577G>T | p.G193W | KQKQKAQDELSSRPQTLPLPDVVPD[p.G193W]METHLVQNGIQLLNGHAPGA VPNLAG | VPDWETHLV,VVPDWETHL,DVVPDWETHL,WETH LVQNGI,LPLPDVVPDW | LUAD |
| UBE2M | c.392G>A | p.G131D | LEGNVCLNILREDWKPVLTINSIIY[p.G131D]DLQYLFLEPNPEDPLNKEAAEVLQ NN | NSIIYDLQY,SIIYDLQYLF,TINSIIYDL,IIYDLQYLF,IYDLQYL- FL,I IYDLQYLFL,SIIYDLQYLF,INSIIYDLQY,LTINSIIYDL,NSIIYDL QYL | TGCT |
| UBE2 NL | c.257G>T | p.R86I | EEYPMAAPKVRFMTKIYHPNVDKLE[p.R86I]IISLDILKDKWSPALQIRTVLLSIQA | EIISLDIIK,HPNVDKLEI,LEIISLDIL,HPNVDKLEII | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| UBE2O | c.3354_3355insG | p.R1118fs | YENSRCVNEMALIRVVQSMTQLVRR[p.R1118fs]APRGL* | SMTQLVRRA, TQLVRRAPR, LVRRAPRGL, MTQLVRRAPR | KIRC |
| UBIAD1 | c.289G>A | p.A97T | AYRSHGVLDPRLLVGCAVAVLAVHG[p.A97T]TGNLVNTYDFSKGIDHKKSDDRTLV | GTNLVNTY, AVHGTGNLV, TGNLVNTY, GTGNLVNTYY, V LAVHGTGNL, HGTGNLVNTY, LAVHGTGNLV | CRC |
| UBOX5 | c.1250C>T | p.S417L | LPTTSEHTAKKMKATNEPSLTHMDC[p.S417L]LTGPLSHEQKLSQSLEIALASTLGSM | HMDCLTGPL, LTGPLSHEQK, THMDCLTGPL | BLCA |
| UBQLN2 | c.1568de|C | p.A523fs | PIGPIVPFTPIGPIGPIGPTGPAAP[p.A523fs]LAPPALIVAPRGLLCPALIHLVKPRVLHQNLDPTSSSFSKWCRPWLEQMLHSCRIQKSDFSNNWNSSTQWGS* | GLLCPALHL, LLCPALHLV, ALHLVKPRV, ALVAPRGLL, VLHQNLDPT, MLHSCRIQK, SSSFSKWCR, SFSKWCRPW, APRGLLCPA, KPRVLHQNL, EQMLHSCRI, NLDPTSSSF, WCRPWLEQM, QKSDFSNNW, NWWNSSTQW, APLAPPALV, GLLCPALHLV, LLCPALHLVK, QMLHSCRIQK, TSSSFSKWCR, SFSKWCRPW L, KWCRPWLEQM, LAPPALVAPR, GPAAPLAPPA, APLAPPA LVA, APRGLLCPAL, IQKSDFSNNW, RGLLCPALHL, HQNLDP TSSS, QNLDPTSSSF, SSFSKWCRPW, LEQMLHSCRI, HSCRIQ KSDF, SNNWNSSTQW, DPTSSSFSKW | STAD |
| UBR1 | c.4939G>T | p.G1647W | KHPVLCLFCGAILCSQNICCQEIVN[p.G1647W]WEEVGACIFHALHCGAGVCIFLKIRE | WEEVGACIF, QEIVNWEEV, WEEVGACIFH | LUAD |
| UBR4 | c.8406de|C | p.P2802fs | TAENVNGNPSPLEALLAGAEGFPP[p.P2802fs]CWTSHLMQMTRPWLN* | LMQMTRPWL, TSHLMQMTR, CWTSHLMQM, FPPCWTSH L, HLMQMTRPW, AEGFPPCWT, HLMQMTRPWL, WTSHL MQMTR, GFPPCWTSHL, FPPCWTSHLM, SHLMQMTRPW, AEGFPPCWTS | STAD |
| UBR5 | c.6360de|A | p.K2120fs | EVLPTKMSYAANLKNVMNMQNRQKK[p.K2120fs]KGKNSPCCQKKLRVQNQGHLLMILLHN* | KNSPCCQKK, KLRVQNQGH, RVQNQGHLL, VQNQGHLLM, LRVQNQGHL, NQGHLLMIL, MQNRQKKGK, KGKNSPCCQ K, KLRVQNQGHL, RVQNQGHLLM, LRVQNQGHLL, VQNQG HLLMI, NQGHLLMILL | KICH |
| UBR5 | c.7551G>T | p.R2517S | LDDTDDGDDNAPLFYQPGKRGFYTP[p.R2517S]SPGKNTEARLNCFPRNIGRILGLCLLQ | GFYTPSPGK, RGFYTPSPG, RGFYTPSPGK, SPGKNTEARL | TGCT |
| UBXN7 | c.827C>T | p.A276V | LDQVTGFLGEHGQLDGLSSSPPKKC[p.A276V]VRSESLIDASEDSQLEAAIRASLQET | KKCVRSESL | CLL |
| UGP2 | c.784G>C | p.D262H | ASFYNSGLLDTPIGEGKEYIFVSNI[p.D262H]HNLGATVDLYILNHLMNPPNGKRCEF | NIHNLGATV, IFVSNIHNL, IFVSNIHNLA, HNLGATVDLY, KEYIFVSNIH | BLCA |
| UGT1A1 | c.10A>G | p.T4A | MAR[p.T4A]AGWTSPIPLCVSLLLTCGFAEAGKLL | ARAGWTSPI, AGWTSPIPL, MARAGWTSPI, RAGWTSPIPL | KIRP |
| UGT2A1 | c.290de|A | p.N97fs | EIYRVPFGKERIEGVIKDFVLTWLE[p.N97fs]IDHLLQPFGDSIRRWPK* | LLQPFGDSI, DFVLTWLEI, TWLEIDHLL, LEIDHLLQP, VLTWL EIDHL, HLLQPFGDSI, LEIDHLLQPF, KDFVLTWLEI, QPFGDSI RRW | CRC |
| UGT2B11 | c.1340G>T | p.R447I | STDLLNALKTVINDPLYKENIMKLS[p.R447I]IQHDQPVKPLDRAVFWIEFVMPHKG | KENIMKLSI, IMKLSIIQH, YKENIMKLSI, KENIMKLSII | TGCT |
| UGT2B28 | c.866C>A | p.P289H | FQFPHPFLPNIDFVGGLHCKPAKPL[p.P289H]HKEMEEFVQSSGENGVVVFSLGSVIS | HCKPAKPLHK, KPAKPLHKEM | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| UGT2B7 | c.642G>A | p.M214I | FPPSYVPVVMSELTDQMTFMERVKN[p.M214I][IIYVLYFDFWFEIFDMKKWDQFYSEV | RVKNIIYVL,TFMERVKNI,KNIIYVLYF,IIYVLYFDF,VKNIIYVL Y,MERVKNIIY,FMERVKNII,FMERVKNII,RVKNIIYVLY,TF MERVKNI,NIIYVLYFD,IIYVLYFDW,MTFMERVKNI,MERV KNIIYV,VKNIIYVLYF | LUAD |
| UGT8 | c.304G>A | p.E102K | FNSTTSDAFLQSKMRNIFSGRLTAI[p.E102K]KLFDILDHYTKNCDLMVGNHALIQGL | KLFDILDHY,FSGRLTAIK,SGRLTAIKL,TAIKLFDIL,GRLTAIKL F,RLTAIKLFDI,KLFDILDHYT,IFSGRLTAIK,SGRLTAIKLF,IKLF DILDHY | CRC, UCEC |
| UHRF1BP1 | c.3990de|C | p.I1330fs | EIPVVVPMQIELLNSSITLKDDIPP[p.I1330fs]SIQHLQAPSPSLWPWNMLC* | HLQAPSPSL,SLWPWNMLC,IQHLQAPSP,LQAPSPSLW,AP SPSLWPW,SPSLWPWNM,TLKDDIPPSI,SPSLWPWNML,IQHLQAPS PS,QHLQAPSPSL,HLQAPSPSLW,IPPSIQHLQA | STAD |
| UMODL1 | c.1677G>A | p.M559I | CQCRTTRDATPSRAGRACEGDLVSP[p.M559I]IGGGLSAATGVTVPGLGTCTAALGLE | LVSPIGGGL,SPIGGGLSA,CEGDLVSPI,SPIGGGLSAA | TGCT |
| UNC93A | c.1334_1335TC>CG | p.V445A | LTMVAYGLVECVESKNPIRPHAPGQ[p.V445A]ANQAEDEEIQTKM* | RPHAPGQAN | TGCT |
| UNC93B1 | c.1492G>A | p.V498M | YHWWQAVAIFTVYLGSSLHMKAKLA[p.V498M]MLLVTLVAAAVSYLRMEQKLRRGVAP | KLAMLLVTL,LAMLLVTLV,AMLLVTLVA,MLLVTLVAA,HMK AKLAML,KAKLAMLL,LHMKAKLAM,MKAKLAMLL,AKLA MLLVT,KLAMLLVTLV,AMLLVTLVAA,MLLVTLVAAA,HMK AKLAMLL,KAKLAMLLVT,SLHMKAKLAM,LHMKAKLAML, MKAKLAMLLV,AKLAMLLVTL,LAMLLVTLVA | CESC |
| UPK2 | c.145de|C | p.P49fs | DFNISSLSGLLSPALTESLLVALPP[p.P49fs]VTSQEAMPH* | SLLVALPPV,ALPPVTSQEA,ESLLVALPPV,LPPVTSQEAM | STAD |
| UPK3A | c.816_817insC | p.G272fs | QITQEAVPKSLGASESSYTSVNRGP[p.G272fs]ATGQG* | YTSVNRGPA | KIRC |
| UQCRFS1 | c.16T>G | p.S6A | MLSVA[p.S6A]ARSGPFAPVLSATSRGVAGALRPLVQ | SVAARSGPF,ARSGPFAPV,SVAARSGPFA, AARSGPFAPV,LSVAARSGPF,ARSGPFAPVL | ACC |
| UQCRFS1 | c.247A>G | p.I83V | QAVRRPLVASVGLNVPASVCYSHTD[p.I83V]VKVPDFSEYRRLEVLDSTKSSRESSE | VKVPDFSEY,SVCYSHTDVK,DVKVPDFSEY,SHTDVKVPDF | KIRC |
| URGCP | c.1916_1917insG | p.G639fs | HFLREMGQFYEAESCLVEAGRLPAG[p.G639fs]PEAFCPLPRLGLGAAADRAAS GANRWEHAEHARPLGHRAPEGAARPT GETVKAGGSVNRGARHGQVHTPQH HVWAAVCHREELRSSRGLHAAHHSG* | HVWAAVCHR,RLPAGPEAF,HARPLGHRA,AARPTGETV,RS SRGLHAA,SSRGLHAAH,AVCHREELR,EAFCPLPRL,ETVKA GGS,QVHTPQHHV,HTPQHHVWA,LPRLGLGAA,RPLGHR APE,APEGAARPT,TPQHHVWAA,RAASGANRW,AEHARPL GH,RGARHGQVH,GQVHTPQHH,EELRSSRGL,GQVHTPQ HHV,AGRLPAGPEA,AARPTGETVK,TVKAGGSVNR,RSSRG LHAAH,SSRGLHAAHH,HTPQHHVWAA,LPRLGLGAAA,RP LGHRAPEG,TPQHHVWAAV,ELRSSRGLHA,GRLPAG PEAF,WEHAEHARPL,QVHTPQHHVW,WAAVCHREEL,REELRSS RGL,LRSSRGLHAA,PEAFCPLPRL,GETVKAGGSV,CPLPRLGLGA | KICH |
| URI1 | c.39_40insC | p.S13fs | MEAPTVETPDDPSPP[p.S13fs]FGPGPCPGSVARPGCGAAARGAGKGGH* | GAAARGAGK,VARPGCGAA,CGAAARGAGK,SVARPGCGAA RPGCGAAA,CGAAARGAGK,SVARPGCGAA | HNSC |
| USF1 | c.155G>A | p.R52Q | DPTSVAIASIQSAATFPDPNVKYVF[p.R52Q]QTENGGQVMYRVIQVSEGQLDGQTEG | FQTENGGQV,QTENGGQVM,VARPGCGAA,SVARPGCGAA FQTENGGQV,QTENGGQVMY,FQTENGGQVM | UCEC |
| USH2A | c.11156G>A | p.R3719H | NSTTVELYWSLLPEKPNGLVSQYQLS[p.R3719H]HNGNLLFLGGSEEQNFTDKNLEPNSR | YQLSHNGNL,QLSHNGNLL,LSHNGNLLF,SQYQLSHNG,SH NGNLLFL,YQLSHNGNLL,QYQLSHNGNL,QLSHNGNLLF,SQ YQLSHNGN,LSHNGNLLFL | GBM |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| USH2A | c.7107C>A | p.F2369L | KAHVRWEAPFRPNGLLTHSVLFTGI[p.F2369L]LYVDPVGNNYTLLNVTKVMYSG EETN | VLFTGILYV, SVLFTGILY, TGILYVDPV, HSVLFTGIL, HSVLFTGILY, SVLFTGILY, FTGILYVDPV, LYVDPVGNNY | CRC |
| USP11 | c.856G>A | p.A286T | VLDAALETGQLIIMETRKKDGTWPS[p.A286T]TQLHVMNNNMSEEDEDFKGQ PGICGL | GTWPSTQLH, TWPSTQLHV, WPSTQLHVM, TWPSTQLHV M, TQLHVMNNNM | CRC |
| USP15 | c.2344de|A | p.K782fs | KKRYFDENAAEDFEKHESVEYKPPK[p.K782fs]NPL* | VEYKPPKNPL | STAD |
| USP16 | c.1364G>A | p.R455Q | DIPSGTSKHLQKKAKKQAKKQAKNQ[p.R455Q]QRQQKIQGKVLHLNDICTIDHP EDSE | QAKNQQRQQK, QQRQQKIQGK, AKNQQRQQKI | UCEC |
| USP25 | c.2618G>A | p.R873H | FKAIKLEYARLVKLAQEDTPPETDY[p.R873H]HLHHVVVYFIQNQAPKKIIEKTLLE Q | ETDYHLHHV, HLHHVVVYF, YHLHHVVVY, TDYHLHHVV, ET DYHLHHVV, HLHHVVVYFI, YHLHHVVVYF, DTPPETDYH L, TDYHLHHVV | UCEC |
| USP25 | c.3356G>A | p.R1119Q | EPPKLPSYSTHELCERFARIMLSLS[p.R1119Q]QTPADGR* | MLSLSQTPA, RIMLSLSQT, IMLSLSQTP, IMLSLSQTPA | CRC |
| USP26 | c.2582G>A | p.R861Q | TLKSGHYICDAYDFEKQIWFTYDDM[p.R861Q]QVLGIQEAQMQEDRRCTGYIF FYMHN | FTYDDMQVL, MQVLGIQEA, TYDDMQVLGI, MQVLGIQEAQ | CRC |
| USP29 | c.243C>A | p.F81L | NIRSVLRHCKKRQSHLRLTLKNNV[p.F81L]LLFIDKLSYRDAKQLNMFLDIIHQN K | LLFIDKLSY, TLKNNVLLF, RLTLKNNVL, LKNNVLLFI, TLLKNNV LLFI, LLFIDKLSYR, LTLKNNVLLF, KNNVLLFIDK, VLLFIDKLSY, LRLTLKNNVL, RLTLKNNVL | CRC |
| USP31 | c.1171G>A | p.D391N | LTEMYDGFHRSFCDTDDLETVHES[p.D391N]NCIFAFETPEIFRPEGIlSQRGIH LN | ETVHESNCI, TVHESNCIF, HESNCIFAF, TVHESNCIFA, ESNCI FAFET, VHESNCIFAF | CRC |
| USP33 | c.107G>A | p.R36Q | LTLKVLPHFESLGKQEKIPNKMSAF[p.R36Q]QNHCPHLDSVGEITKEDLIQKSLG TC | KMSAFQNHC, SAFQNHCPH, MSAFQNHCPH, SAFQNHCP HL | UCEC |
| USP4 | c.775C>G | p.L259V | STAPSRNFTTSPKSSASPYSSVSAS[p.L259V]VIANGDSTSTCGMHSSGVSRGGS GFS | YSSVSASVI, PYSSVSASVI, SPYSVSVASV, YSSVSASVIA | CESC |
| USP40 | c.2552C>T | p.S851L | DSYTLKEAELKMGSSLGLCLGKAPS[p.S851L]LSQLFLFFAMGSDVQPGTEMEIV VEE | KAPSLSQLF, PSLSQLFLF, SLSQLFLFF, APSLSQLFLF, GKAPSLS QL, SLSQLFLFFA, PSLSQLFLFF, KAPSLSQLFL, LGKAPSLSQL, GKAPSLSQLF, APSLSQLFLF, LSQLFLFFAM | CRC |
| USP42 | c.2336G>C | p.R779P | SPAAESLEEPDAAAGLSSTKKAPP[p.R779P]PDPGTPATKEGAWEAMAVAPEE | STKKAPPP, STKKAPPPPD | ACC |
| USP46 | c.410A>G | p.Q137R | LFDNYMQQDAHEFLNVILLNTIADIL[p.Q137R]REEKKQEKQNGKLKNGNMNE PAENNK | TIADILREEK, ILREEKKQEK, LLNTIADILR | TGCT |
| UTP14A | c.442G>A | p.V148I | EEIERIHREVAFNKTAQVLSKWDPV[p.V148I]ILKNRQAEQLVFPLEKEEPAIAPIE H | VLSKWDPVI, VLSKWDPVIL, ILKNRQAEQL, LSKWDPVILK | CRC |
| UTP3 | c.226_228 de|GAG | p.E81de| | SRAALAKGWNEVQSGDEEDGEEEE[p.E81de|]VLALDMDDEDDEDGGNAGEE EEEENADD | GEEEEEVLAL | PRAD |
| UTS2R | c.866C>A | p.A289E | VLLFWACFLPFWLWQLLAQYHQAPL[p.A289E]EPRTARIVNYLTTCLTYGNSCA NPFL | LEPRTARIV, APLEPRTARI, AQYHQAPLEP, HQAPLEPRTA, E PRTARIVNY | KIRP |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| UXS1 | c.298G>C | p.V100L | QKYPPVKFLSEKDRKRILITGGAGF[p.V100L]LGSHLTDKLMMDGHEVTVVDNFFTGR | LIITGGAGFL, ILITGGAGFL, FLGSHLTDKL | OV |
| VARS | c.151_152C>AG | p.P51S | EAGEGPGWGGAHPRICLQPPPTSRT[p.P51S]SFPPPRLPALEQPGGLWVVGATAVAQ | TSRTSFPPP, RTSFPPPRL, SRTSFPPPR, SFPPPRLPAL, TSFPPPRLPA, QPPPTSRTSF | ACC |
| VASH1 | c.7de|G | p.G3fs | MPGG[p.G3fs]RRWLGVAAAVPLQRPLRPPPLGSGVWRPAKEPQPREMRSQKRKGKRTCETEASPSLSTGVGYLWMRPPGKGCGNTWPRSTPMERRWRNGSVGPQTCPRSPYRVCLRSSRLHLSLSAWKLCSATSESCSTITQGHSSLKLRRADL* | SLSTGVGYL, HLsLSAWKL, LSAWKLCSA, ATSESCSTI, YLWMRPPGK, ITQGHSSLK, VAAAVPLQR, GGSGVWRPAK, SVGPQTCPR, QTCPRSPYR, RWLGVAAAV, GGRRWLGVA, AVPLQRPLR, RSQKRKGK, RWRNGSVGP, RSPYRVCLR, RVCLRSSRL, CLRSSRLHL, RSSRLHLSL, TGVGYLWMR, NTWPRSTPM, RPLRPPPL, CPRSPYRVC, ERRWRNGSV, SLKLRRADL, RLHLSLSAW, GRRWLGVAA, RRWLGVAAA, LGVAAAVPL, AAVPLQRPL, LQRPLRPPP, AKEPQPREM, CETEASPSL, LSTGVGYLW, RSTPMERRW, RWRNGSVG, PQTCPRSPY, SRLHL SLSA, TQGHSSLKL, TEASPSLST, WLGVAAAVPL, SLSAWKLC SA, RLHLSLSAWK, TITQGHSSLK, GVAAAVPLQR, STGVGYL WMR, GSVGPQTCPR, GGRRWLGVAA, LGSGVWRPAK, EM RSQKRKGK, KGKRTCETEA, GYLWMRPPGK, RSTPMERRW R, RWRNGSVGPQ, RVCLRSSRLH, CLRSSRLHLS, RSSRLHLSL S, SSRLHLSLSA, TWPRSTPMER, EASPSLSTGV, QTCP RSPYRV, STITQGHSSL, MPGGRRWLGV, RPPPLGSGV, CPR SPYRVCL, MERRWRNGSV, SPSLSTGVGY, RRWLGVAAAV, AAAVP LQRPL, LQRPLRPPP, SLSTGVGYLW, LSTGVGYLWM, GNT WPRSTPM, GPQTCPRSPY, YRVCLRSSRL, LRSSRLHLSL, SRL HLSLSAW, LHLSLSAWKL, SATSESCSTI | STAD |
| VAV3 | c.2053G>A | p.E685K | CVPKPVDYSCQPWYAGAMERLQAET[p.E685K]KLINRVNSTYLVRHRTKESGEYAISI | RLQAETKLI, KLINRVNST, AETKLINRV, KLINRVNSTY, AMER LQAETK, MERLQAETKL | CRC |
| VCAN | c.3374G>A | p.R1125H | HSVSYPPGAVTEHKVKTDEVVTLTP[p.R1125H]HIGPKVSLSPGPEQKYETEGSSTTGF | TLTPHIGPK, EVVTLTPHI, LTPHIGPKV, DEVVTLTPH, T LTPHIGPKV, VTLTPHIGPK, TPHIGPKVSL, DEVVTLTPHI | CRC |
| VCAN | c.3923C>G | p.S1308C | SSPPATQPTRPPTVEDKEAFGPQAL[p.S1308C]CTPQPPASTKFHPDINVYIIEVRENK | ALCTPQPPA, CTPQPPASTK, KEAFGPQALC | CESC |
| VEZF1 | c.1063_1064insACA | p.355_356insN | ETSNQKQQQQQQQQQQQQQQQQH[p.355_356insN]NVTSWPGKQVETLRLWEEAVKARKKEAA | HNVTSWPGK, QQQQHNVTS, QQQQHNVTS W, NVTSWPGKQV, QQQQQQQHNV, QQQQQHNVT, QQQQH NVTSW, QQHNVTSWPG | STAD |
| VHL | c.115G>A | p.G39S | GAEEAGVEEYGPEEDGGEESGAEES[p.G39S]SPEESGPEELGAEEEMEAGRPRPVLR | SPEESGPEEL | KIRC |
| VHL | c.134C>T | p.P45L | VEEYGPEEDGGEESGAEESGPEESG[p.P45L]LEELGAEEEMEAGRPRPVLRSVNSRE | PEESGLEEL, LEELGAEEEM, EESGPEESGL | KIRC |
| VHL | c.194C>T | p.S65L | PEESGPEELGAEEEMEAGRPRPVLR[p.S65L]LVNSREPSQVIFCNRSPRWLPVWLN | RPRPVLRLV, PVLRLVNSR, LVNSREPSQV, AGRPRPVLRL, RPRPVLRLVN | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| VHL | c.221T>A | p.V74D | GAEEMEAGRPRPVLRSVNSREPSQ[p.V74D]DIFCNRSPRVLPVWLNFDGEPQPYP | PSQDIFCNR,DIFCNRSPR,SREPSQDIF,DIFCNRSPRV,NSREPSQDIF | KIRC |
| VHL | c.232A>G | p.N78D | EMEAGRPRPVLRSVNSREPSQVIFC[p.N78D]DRSPRVVLPVWLNFDGEPQPYPTLPP | VIFCDRSPR,VIFCDRSPRV,QVIFCDRSPR | KIRC |
| VHL | c.236G>C | p.R79P | MEAGRPRPVLRSVNSREPSQVIFCN[p.R79P]PSPRVVLPVWLNFDGEPQPYPTLPPG | VIFCNPSPR,SQVIFCNPS,VIFCNPSPRV,QVIFCNPSPR,NPSPRVVLPV,SQVIFCNPSP,FCNPSPRVVL | KIRC |
| VHL | c.245G>C | p.R82P | GRPRPVLRSVNSREPSQVIFCNRSP[p.R82P]PVVLPVWLNFDGEPQPYPTLPPGTGR | RSPPVVLPV,SPPVVLPVW,VIFCNRSPPV,RSPPVVLPVW | KIRC |
| VHL | c.263G>T | p.W88L | LRSVNSREPSQVIFCNRSPRVVLPV[p.W88L]LLNFDGEPQPYPTLPPGTGRRIHSYR | VVLPVLLNF,SPRVVLPVL,RVVLPVLLNF,SPRVVLPVLL,RSPRVVLPVL | KIRC |
| VHL | c.266T>A | p.L89H | RSVNSREPSQVIFCNRSPRVVLPVW[p.L89H]HNFDGEPQPYPTLPPGTGRRIHSYRG | VVLPVWHNF,RVVLPVWHNF,HNFDGEPQPY | KIRC |
| VHL | c.266T>C | p.L89P | RSVNSREPSQVIFCNRSPRVVLPVW[p.L89P]PNFDGEPQPYPTLPPGTGRRIHSYRG | VVLPVWPNF,WPNFDGEPQ,RVVLPVWPNF | KIRC |
| VHL | c.320G>C | p.R107P | RVVLPVWLNFDGEPQPYPTLPPGTG[p.R107P]PRIHSYRGHLWLFRDAGTHDGLLVNQ | GTGPRIHSY,TLPPGTGPR,TGPRIHSYR,LPPGTGPRI,TLPPGTGPRI,GTGPRIHSYR | KIRC |
| VHL | c.332G>A | p.S111N | PVWLNFDGEPQPYPTLPPGTGRRIH[p.S111N]NYRGHLWLFRDAGTHDGLLVNQTELF | NYRGHLWLF,TGRRIHNYR,RIHNYRGHL,GTGRRIHNY,IHNYRGHLW,HNYRGHLWL,GTGRRIHNYR,HNYRGHLWLF,RIHNYRGHL,HNYRGHLWL | KIRC |
| VHL | c.333C>A | p.S111R | PVWLNFDGEPQPYPTLPPGTGRRIH[p.S111R]RYRGHLWLFRDAGTHDGLLVNQTELF | RYRGHLWLF,TGRRIHRYR,RIHRYRGHL,GTGRRIHRY,IHRYRGHLW,HRYRGHLWL,GTGRRIHRYR,HRYRGHLWLF,RIHRYRGHL,IHRYRGHLWL | KIRC |
| VHL | c.343C>A | p.H115N | NFDGEPQPYPTLPPGTGRRIHSYRG[p.H115N]NLWLFRDAGTHDGLLVNQTELFVPSL | SYRGNLWLF,RIHSYRGNL,HSYRGNLWL,IHSYRGNLW,HSYRGNLWLF,RIHSYRGNLW,SYRGNLWLFR,RIHSYRGNL,IHSYRGNLWL | KIRC |
| VHL | c.347delT | p.L116fs | DGEPQPYPTLPPGTGRRIHSYRGHL[p.L116fs]GSSEMQGHTMGFWLTKLNYLCHLSMLTDSLFLPISHCQCIL* | LTDSLFLPI,TMGFWLTKL,YLCHLSMLT,SMLTDSLFL,HLSMLTDSL,SLFLPISHC,FLPISHCQC,HTMGFWLTK,FWLTKLNYL,NYLCHLSML,RGHLGSSEM,GFWLTKLNY,EMQGHTMGF,LSMLTDSLF,LNYLCHLSM,SSEMQGHTM,SEMQGHTMG,MQGHTMGFW,TKLNYLCHL,LPISHCQCI,KLNYLCHLSM,MLTDSLFLPI,FLPISHCQCI,HTMGFWLTKL,GFWLTKLNYL,RIHSY RGHLG,LTKLNYLCHL,MGFWLTKLNY,LPISHCQCIL,SEMQGHTMGF,HLSMLTDSLF,HSYRGHLGSS,YRGHLGSSEM,GSSEMQGHTM,MQGHTMGFWL,LNYLCHLSML,CHLSMLTDSL,LSMLTDSLFL | KIRC |
| VHL | c.361G>T | p.D121Y | QPYPTLPPGTGRRIHSYRGHLWLFR[p.D121Y]YAGTHDGLLVNQTELFVPSLNVDGQP | RYAGTHDGL,RGHLWLFRY,WLFRYAGTH,RYAGTHDGLL,RGHLWLFRYA,YRGHLWLFRY,FRYAGTHDGL | KIRC |
| VHL | c.367delG | p.G123fs | PTLPPGTGRRIHSYRGHLWLFRDAG[p.G123fs]HTMGFWLTKLNYLCHLSMLTDSLFLPISHCQCIL* | LTDSLFLPI,TMGFWLTKL,YLCHLSMLT,SMLTDSLFL,WLFRDAGHT,HLSMLTDSL,SLFLPISHC,FLPISHCQC,HTMGFWLTK,FWLTKLNYL,NYLCHLSML,GFWLTKLNY,LSMLTDSLF,LFRDAGHTM,LNYLCHLSM,RDAGHTMGF,TKLNYLCHL,LPIS | KIRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| VHL | c.383T>A | p.L128H | PGTGRRIHSYRGHLWLFRDAGTHDG[p.L128H]HLVNQTELFVPSLNVDGQPIFANITL | HCQCI, WLFRDAGHTM, KLNYLCHLSM, MLTDSLFLPI, FLPIS HCQCI, HTMGFWLTKL, GFWLITKLNYL, LTKLNYLCHL, MGF WLTKLNY, LPISHCQCI1, HLSMLTDSLF, FRDAGHTMGF, RD AGHTMGFW, LNYLCHLSML, CHLSMLTDSL, LSMLTDSLFL HLVNQTELF, GHLVNQTEL, HLVNQTELFV, GHLVNQTELF | KIRC |
| VHL | c.405A>T | p.L135F | HSYRGHLWLFRDAGTHDGLLVNQTE[p.L135F]FFVPSLNVDGQPIFANITLPVYTLKE | LIVNQTEFFV, EFFVPSLNV, GLLIVNQTEFF, LLVNQTEFF, NQTE FFVPS, LLVNQTEFFV, NQTEFFVPSL, GLLVNQTEFF, TEFFVP SLNV | KIRC |
| VHL | c.452T>C | p.I151T | DGLLVNQTELFVPSLNVDGQPIFAN[p.I151T]TTLPVYTLKERCLQVVRSLVKPEN YR | FANTTLPVY, TTLPVYTLK, IFANTTLPV, NTTLPVYTL, QPIFAN M, PIFANTTLPV, NTTLPVYTLK, IFANTTLPVY, GQPIFANTT L | KIRC |
| VHL | c.458T>C | p.L153P | LLVNQTELFVPSLNVDGQPIFANIT[p.L153P]PVYTLKERCLQVVRSLVKPENYRR L | IFANITPPV, ITPPVYTLK, FANITPPVY, NLIPPVYTL, PIFANITP PV, NITPPVYTLK, IFANITPPVY, ANITPVYTL | KIRC |
| VHL | c.472C>G | p.L158V | TELFVPSLNVDGQPIFANITLPVYT[p.L158V]VKERCLQVVRSLVKPENYRRLDIVR S | NITLPVYTV, ITLPVYTVK, TVKERCLQV, YTVKERCLQV, NITLP VYTVK, TVKERCLQVV | KIRC |
| VHL | c.473T>C | p.L158P | TELFVPSLNVDGQPIFANITLPVYT[p.L158P]KERCLQVVRSLVKPENYRRLDIVR S | ITLPVYTPK, TPKERCLQV, NITLPVYTPK, YTPKERCLQV, TPKE RCLQVV | KIRC |
| VHL | c.492del G | p.Q164fs | LNVDGQPIFANITLPVYTLKERCLQ[p.Q164fs]LSGA* | TLKERCLQL, KERCLQLSGA | KIRC |
| VHL | c.506T>C | p.L169P | GQPIFANITLPVYTLKERCLQWRS[p.L169P]PVKPENYRRLDIVRSLYEDLEDHPN V | CLQVVRSPV, LQVVRSPVK, RSPVKPENY, PVKPENYRR, CLQ VVRSPVK, VRSPVKPENY | KIRC |
| VHL | c.551T>C | p.L184P | KERCLQVVRSLVKPENYRRLDIVRS[p.L184P]PYEDLEDHPNVQKDLERLTQERIA HQ | RLLDIVRSPY, SPYEDLEDH, RRLDIVRSPY | KIRC |
| VHL | c.563T>C | p.L188P | LQVVRSLVKPENYRRLLDIVRSLYED[p.L188P]PEDHPNVQKDLERLTQERIAHQR MGD | YEDPEDHPNV | KIRC |
| VLDLR | c.692G>A | p.R231H | IPISWCDDDADCSDQSDESLEQCG[p.R231H]HQPVIHTKCPASEIQCGSGECIH KKW | LEQCGHQPV, EQCGHQPVI, SLEQCGHQPV, CGHQPVIHTK, LEQCGHQPVI | BRCA |
| VMP1 | c.1105G>C | p.E369Q | AQRQKLHHKSEMGTPQGENWLSWM F[p.E369Q]QKLVVVMVCYFILSIINSMA QSYAKR | WLSWMFQKL, WMFQKLVVV, FQKLVVVMV, NWLSWMF QK, SWMFQKLVV, MFQKLVVVM, WLSWMFQKLV, WMFQ KLVVVM, NWLSWMFQKL, SWMFQKLVVV, MFQKLVVVM V, ENWLSWMFQK, LSWMFQKLVV, QKLVVVMVCY | LUAD |
| VPRBP | c.2405G>A | p.R802Q | ARLQKADVVAQSRISFPEKELLLLI[p.R802Q]QNHLLISKGLGETATVLTKEADLPM TA | LLLLIQNHL, LLLIQNHLI, LIQNHLISK, KELLLLIQN, LLLLIQNHL L, IQNHLISKGL, LLIQNHLISK | UCEC |
| VPRB P | c.2817de A | p.K939fs | CNGRKIRVLRQKSDHGAYSQSPAIK[p.K939fs]NSWTDIFLPHLRWTV* | WTDIFLPHL, FLPHLRWTV, AIKNSWTDI, SWTDIFLPH, IKNS WTDIF, WTDIFLPHLR, SWTDIFLPHL, IFLPHLRWTV, AIKNS WTDIF, SQSPAIKNSW, IKNSWTDIFL | STAD |
| VPS 13A | c.8647de T | p.F2883fs | ILGLDVLGNPFGLIREFSEGVEAFF[p.F2883fs]MNLTREPSRVLKSLMKEWH* | NLTREPSRV, LTREPSRVL, EAFFMNLTR, MNLTREPSR, EPSR VLKSL, SEGVEAFFM, FMNLTREPS, VLKSLMKEW, VEAFFM NLT, FSEGVEAFFM, LTREPSRVLK, RVLKSLMKEW, PSRVLKS | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| VPS13B | c.2075G>A | p.R692Q | IMGEKNSSNFMNTTNFQSLRPLPSI[p.R692Q]QILVDKINLEHSVPMYAEQLVHVVSS | LWK,FMNLTREPSR,EGVEAFFMNL,REPSRVLKSL,EPSRVLKSLW RPLPSIQIL,SLRPLPSIQI,RPLPSIQILV,IQILVDKINL | UCEC |
| VPS13B | c.7723G>T | p.G2575W | AQADCKLLECRNVTMQSVVKPFSIF[p.G2575W]WQMAVSSDVVEKLLDCTVIVDSVFVN | FSIFWQMAV,WQMAVSSDV,KPFSIFWQM,WQMAVSSD VV,FSIFWQMAVS,VKPFSIFWQM,KPFSIFWQMA | LUAD |
| VPS13C | c.4075G>T | p.D1359Y | SWYHKVPVVEIKGHLDSMNVSLNQE[p.D1359Y]YLNLLFRILTENLCEGTEDLDKVKPR | SLNQEYLNL,YLNLLFRIL,EYLNLLFRI,MNVSLNQEY,NVSLNQEYL,NQEYLNLLF,SLNQEYLNLL,YLNLLFRILT,EYLNLLFRIL,SMNVSLNQEY,MNVSLNQEYL,LNQEYLNLLF,QEYLNLLFRI | CRC |
| VWA2 | c.950G>A | p.G317D | RTTCPGPCDSQPCQNGGTCVPEGLD[p.G317D]DYQCLCPLAFGGEANCALKLSLECRV | DDYQCLCPL,DYQCLCPLAF | TGCT |
| VWA3A | c.2863G>A | p.V955I | LEKVLRRYVQRLQWLLSGSRRLFGT[p.V955I]ILESKVCILLDTSGSMGPYLQQVKTE | RLFGTILES,ILESKVCIL,GSRRLFGTI,SRRLFGTIL,ILESKVCILL,RLFGTILESK,GSRRLFGTIL | BRCA |
| VWA3B | c.1670G>T | p.R557L | QFIQEQLKYKSKFNFVKFDGQQAVAW[p.R557L]LEQLAEVNEDNLEQAQSWIRDIKIGS | QAVAWLEQL,VAWLEQLAEV,CQAVAWLEQL | LUAD |
| VWA7 | c.2375T>G | p.V792G | FSLTSNLSRAHLELNESAWGRLWLE[p.V792G]GPDSAAPDSVVMVTVTAGREANPVP | RLWLEGPDSA | TGCT |
| VWF | c.5160A>T | p.K1720N | LLDGSSSFPASYFDEMKSFAKAFIS[p.K1720N]MANIGPRLTQVSVLQYGSITTIDVPW | FAKAFISNA,ISNANIGPR,KAFISNANI,KSFAKAFISN,SFAKAFISNA,FISNANIGPR,AKAFISNANI,ISNANIGPRL | BRCA |
| WAPAL | c.1564delA | p.R522fs | GFDDLSESEDEDDCQVERKTSKK[p.R522fs]ELKQLHHPPCSLPQKAMIPRTVSLVLTMQRTCLVCLKV* | MIIPRTVSL,IIPRTVSLV,LTMQRTCLV,QLHHPPCSL,SLPQKAMI,MQRTCLVCL,VSLVLTMQR,KAMIIPRTV,RTVSLVLTM,IPRTVSLVL,KQLHHPPCSL,AMIIPRTVSL,MIIPRTVSLV,VLTMQRTCLV,MQRTCLVCLK,TVSLVLTMQR,VERKTSKKEL, TMQRTCLVCL,KELKQLHHPP | STAD |
| WASF3 | c.913_914insC | p.P305fs | EHEYRPPSASARHMALNRPQQPPPP[p.P305fs]ASPSGPRGVPGLCTDGSSRLRDAPSADN* | SSRLRDAPS,RPQQPPPPA,GLCTDGSSRL,SSRLRDAPSA,RPQQPPPPAS,SPSGPRGVPG | STAD |
| WASH3P | c.523G>A | p.G175S | APREVDPSGGRATLLESIRQAGGI[p.G175S]SKAKLRSMKERKLEKKQQKEQQVRA | RQAGGISKA,ISKAKLRSM,SIRQAGGISK,RQAGGISKAK,ISKAKLRSMK | GBM,KIRC,PRAD,SKCM |
| WASH3P | c.559C>G | p.L187V | ATLLESIRQAGGIGKAKLRSMKERK[p.L187V]VEKKQQKEQEQVRATSQGGHLMSDLF | SMKERKVEK,RSMKERKVEK,SMKERKVEKK,KLRSMKERKV | PRAD,TGCT |
| WBP1 | c.412_413insC | p.P138fs | LRFLSTFKPPAYEDVVHRPGTPPPP[p.P138fs]LYCGPRPPLDCFQ* | LYCGPRPPL,RPGTPPPPL,GPRPPLDCF | STAD |
| WBSCR17 | c.682C>T | p.R228C | LEEYVHKRYPGLVKVVRNQKREGLI[p.R228C]CARIEGWKVATGQVTGFFDAHVEFTA | REGLICARI,LICARIEGWK | CRC |
| WDFY3 | c.5525delT | p.L1842fs | FIFGVPASSGTWSSIHNVCTEAVFY[p.L1842fs]YYWECSAAC* | CTEAVFYYW,YYWECSAAC,EAVFYYWEC,FYYWECSAA,AVFYYWECSA,HNVCTEAVFY,TEAVFYYWEC | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| WDR17 | c.832C>T | p.P278S | SESLSCITTFNLPSAAASVQCLAWV[p.P278S]SSAPGMFITGDSQVGVLRIWNVSRTT | AWVSSAPGM,WVSSAPGMF,WVSSAPGMFI,AWVSSAPG MF,LAWVSSAPGM,VQCLAWVSSA | CESC |
| WDR3 | c.2521G>A | p.E841K | KSSELEESLLVLPFSVVPDILKLFN[p.E841K]FIQLGSDVELICRCLFFLLRIHFGQ | KLFNKFIQL,LKLFNKFIQL | CRC |
| WDR34 | c.178T>G | p.W60G | PGPLQDETLGVASVPSQWRAVQGIR[p.W60G]GETKSCQTASIATASASAQARNHVDA | GETKSCQTA,AVQGIRGETK | ACC |
| WDR5 | c.642del C | p.N214fs | DGLCRIWDTASGQCLKTLIDDDNPP[p.N214fs]CLL* | TLIDDDNPPC | STAD |
| WDR59 | c.2509C>A | p.R837S | EHLSSPWGESSPEELRFGSLTYSDP[p.R837S]SERERDQHDKNKRLLDPANTQQFDDF | LTYSDPSER | LUAD |
| WDR59 | c.479del A | p.N160fs | IKDTRKPTVALSAVAGASQVKWNK[p.N160fs]MLTALPPAMTAMCGYGIRGNPVQQWNI* | KMLTALPPA,MLTALPPAM,ALPPAMTAM,KWNKKMLTA, PAMTAMCGY,TAMCGYGIR,MTAMCGYGI,WNKKMLTAL, SQVKWNKKM,KKMLTALPP,KMLTALPPAM,AMTAMCGY GI,MLTALPPAMT,ALPPAMTAMC,MTAMCGYGIR,KWNK KMLTAL,LTALPPAMTA,TALPPAMTAM,SQVKWNKKML,V KWNKKMLTA,KKMLTALPPA,PPAMTAMCGY | STAD |
| WDR60 | c.1235del A | p.Q412fs | DGDDDESSNEPESREKLEELPLAQK[p.Q412fs]RKYKKFKELLMQRMKGLASYL* | LLMQKMKGL,KMKGLASYL,KYKKFKELL,LAQKRKYKK,KFK ELLMQK,QKMKGLASY,RKYKKFKEL,MQKMKGLAS,AQKR KYKKF,YKKFKELLM,FKELLMQKM,LPLAQKRKY,LLMQKM KGLA,KYKKFKELLM,AQKRKYKKFK,KFKELLMQKM,MQK MKGLASY,LAQKRKYKKF,RKYKKFKELL,QKMKGLASYL | STAD |
| WDR7 | c.784del G | p.G262fs | RVFDAGDYSLLCSGPSENGQTWTGG[p.G262fs]TLSHQIKSSFGQKMGKVIFTNYLPVAFQLVIHSAVMWGRQLKI* | FTNYLPVAF,VIFTNYLPV,YLPVAFQLV,FQLVIHSAV,VMWG RQLKI,QIKSSFGQK,SSFGQKMGK,AVMWGRQLK,NYLPVA FQL,MGKVIFTNY,LPVAFQLVI,LSHQIKSSF,QLVIHSAVM,G QTWTGGTL,HQIKSSFGQ,IKSSFGQKM,GQKMGKVIF,GKV IFTNYL,LVIHSAVMW,SAVMWGRQL,KVIFTNYLPV,VIFTN YLPVA,YLPVAFQLVI,HQIKSSFGQK,KSSFGQKMGK,KMGK VIFTNY,VIHSAVMWGR,SAVMWGRQLK,IFTNYLPVAF,NY LPVAFQLV,MGKVIFTNYL,AVMWGRQLKI,WTGGTLS HQI,SSFGQKMGKV,TLSHQIKSSF,FQLVIHSAVM,FGQKM GKVIF,VAFQLVIFSA,HSAVMWGRQL,LPVAFQLVIH | STAD |
| WDR73 | c.944_961 de ATGGAACACGGAGCCAAG | p.DGTRSQ315 de | CLAISGFPDGTVQVYDATSWDGTRSQ[p.DGTRSQ315de ]VEPLFTHRGHIFLDGNGMDPAPLVTTHTWHPCRPRTLLSATND | TSWDGTRSQV | KIRC |
| WDR75 | c.860C>A | p.P287Q | SLLSGGRESVLVEWRDATEKNKEFL[p.P287Q]QRLGATIEHISVSPAGDLFCTSHSDN | FLQRLGATI,KEFLQRLGA,EFLQRLGATI,KEFLQRLGAT, LQRLGATIEH | LUAD |
| WDR78 | c.330T>A | p.N110K | NQSRMAVSKTVLIPPELKTVEKPNP[p.N110K]KIKTTQVFDINGTDVTPRPLYHPDPL | KTVEKPNPK,KIKTTQVFD,NPKIKTTQV,PKIKTTQVF,KIKTT QVFDI,NPKIKTTQVF | CLL |
| WDR88 | c.298G>T | p.G100W | KHQVPEKLIWGDQDPLSKIPFKILS[p.G100W]WHEHAVSTCHFCVDDTKLLSGSYDCT | KILSWHEHA,ILSWHEHAV,KIPFKILSW,FKILSWHEH,KILS WHEHAV,SKIPFKILSW,FKILSWHEHA | LUAD |
| WDTC1 | c.861_862 insG | p.M287fs | RLRVLVATYVTFSPNGTELLVNMGG[p.M287fs]GTGLFV* | NMGGGTGLF,VNMGGGTGL,NMGGGTGLFV,VNMGGGT GLF | STAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| WHSC1L1 | c.1254_1255insA | p.K418fs | YIDKQPEEALSQAKKSVASKTEVKK[p.K418fs]NPTTKICAEYSARTDQCRGGGLLTLKY* | PTTKICAEY, KICAEYSAR, RGGGLLTLK, GGGLLTLKY, CRGGG LLTL, TTKICAEYSA, RGGGLLTLKY, EYSARTDQCR, NPTTKICA EY, AEYSARTDQC | STAD |
| WNK4 | c.1816del|G | p.G606fs | CETDGYLSSSGFLDASDPALQPPGG[p.G606fs|CHPAWLSPISACPRLLPYPFHV LALEVTFPPGTAMPQMQLQALAMWE KGWDK* | RLLPYPFHV, LLPYPFHVL, AMPQMQLQA, AMWEKGWDK, S ACPRLLPY, LQALAMWEK, PYPFHVLAL, HVLALEVTF, MQLQ ALAMW, EVTFPPGTA, SPISACPRL, CPRLLPYPF, MPQMQL QAL, VTFPPGTAM, QMQLQALAM, HPAWLSPIS, LPYPFHVL A, LEVTFPPGT, ISACPRLLPY, RLLPYPFHVL, LLPYPFHVLA, A MPQMQLQAL, QLQALAMWEK, LAMWEKGWDK, WLSPIS ACPR, YPFHVLALEV, EVTFPPGTAM, HPAWLSPISA, SPISAC PRLL, LPYPFHVLAL, FPPGTAMPQM, MPQMQLQALA, LQP PGGCHPA, FHVLALEVTF, LEVTFPPGTA, PQMQLQALAM, Q MQLQALAMW, QPPGGCHPAW, QALAMWEKGW | STAD |
| WNT1 | c.500del|G | p.W167fs | SEGSISCTCDYRRRGPGGPDWHWG[p.W167fs]AAATTLTSAASSAGSSWTPG RRGGTCASS* | TLTSAASSA, GPDWHWGAA, WHWGAAATT, HWGAAATT L, AASSAGSSW, SAGSSWTPGR, TTLTSAASSA, GPD WHWGAAA, SAASSAGSSW, WHWGAAATTL, AAATTLTSAA | STAD |
| WNT11 | c.1031G>A | p.C344Y | NPYTDRVERCHCKYHWCCYVTCRR[p.C344Y]YERTVERYVCK* | CCYVTCRRY, RYERTVERY, YVTCRRYER, YERTVERYVC RYV, RRYERTVERY, CYVTCRRYER, YERTVERYVCK | OV |
| WNT16 | c.494del|G | p.W165fs | GNMTECSCDTTLQNGSSASEGWHWG[p.W165fs]AAPMMSSMACGSAESS* | MMSSMACGS, SMACGSAES, MSSMACGSA, APMMSSMA C, GAAPMMSSM, SEGWHWGAA, GWHWGAAPM, MHW GAAPMM, WGAAPMMSSM, GNHWGAAPMM, SMACGSAESS | STAD |
| WNT5B | c.979A>G | p.K327E | RLCNKTSEGMDGCELMCCGRGYNQF[p.K327E]ESVQVERCHCKFHWCCFVRC KKCTEI | RGYNQFES, QFESVQVER, NQFESVQVE, NQFESVQVER | TGCT |
| WT1 | c.1142_1143insCGGTC | p.S381fs | HTHGVFRGIQDVRRVPGVAPTLVRS[p.S381fs|GRHLRPVRNAPSCVLTQAAIRD ILSCPTYRCTAGSTLVRNHTSVTSRTVNE GFLVQTSSKDTKGDIQV* | TLVRNHTSV, CTAGSTLVR, LVRSGRHLR, RSGRHLRPV, SGRH LRPVR, LVRNHTSVT, RNHTSVTSR, HTSVTSRTV, GFLVQTS SK, RDILSCPTY, CVLTQAAIR, DILSCPTYR, RPVRNAPSC, TLVRSGRH L, VRNAPSCVL, TQAAIRDIL, YRCTAGSTL, TSRTVNEGF, LVQTSS KDTK, TYRCTAGSTL, RSGRHLRPVR, HLRPVRNAPS, STLVR NHTSV, TSRTVNEGFL, TLVRSGRHLR, RPVRNAPSCV, APSCV LTQAA, IRDILSCPTY, VTSRTVNEGF | LAML |
| WWP2 | c.1373G>C | p.G458A | EDPRTQCMIQEPALPGWEMKYTSE[p.G458A]AVRYFVDHNTRTTTFKDPRPG FESGT | EMKYTSEAV, KYTSEAVRY, YTSEAVRYF, TSEAVRYFV, WEMKYTSEA, YTSEAVRYFV, KYTSEAVRYF, MKYTSEAVRY, EMKY TSEAVR, WEMKYTSEAV, SEAVRYFVDH | KIRC |
| XAB2 | c.2344G>A | p.E782K | SDLAPGQSGMDDMKLLEQRAEQLAA[p.E782K]KAERDQPLRAQSKILFVRSDA SREEL | EQLAAKAER, AKAERDQPL, EQRAEQLAAK | BLCA |
| XDH | c.1228C>T | p.P410S | MDHTFPGVYRKTLLSPEEILLSIEI[p.P410S]SYSREGEYFSAFKQASREDDIAKVT | ISYSREGEY, LSIEISYSR, SYSREGEYF, LLSIEISY, IEISYSREG, IS YSREGEYF, LLSIEISYSR, EILLSIEIS | TGCT |
| XIRP2 | c.7315G>A | p.D2439N | GKTGVLPPPTLPKPKLPKHIKDNKN[p.D2439N]NFSPKVELATSLSDMECKITTSK DQK | KDNKNNFSPK, KHIKDNKNNF | SKCM |
| XIRP2 | c.9023T>A | p.V3008E | IPGWLISEDKREYAVHIAMENNLEK[p.V3008E]EKEEITHIKTQAEDMLVSYENIIQ TA | KEKEEITHI | CLL |
| XKR6 | c.803G>A | p.R268Q | SVIHLLQMGQVWRYIRTMYLGIQSQ[p.R268Q]QRKEHQRRFYWAMMYEYAD VNMLRLL | MYLGIQSQQR, QQRKEHQRRF | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| XPO1 | c.1711G>A | p.E571K | QYPRFLRAHWKFLKTWNKLFEFMH[p.E571K]KTHDGVQDMACDTFIKIAQKCRRHFV | KLFEFMHKT, FMHKTHDGV, KTHDGVQDM, KLFEFMKTH, VNKLFEFMHK, KTHDGVQDMA, EFMHKTHDGV, FMHKTHDGVQ, HKTHDGVQDM | BRCA, CLL |
| XPOT | c.1621C>T | p.R541W | EPQHIPCVLMAFLDHRGLRHSSAKV[p.R541W]WSRTAYLFSRFVKSLNKQMNPFIEDI | KVWSRTAYL, HSSAKVWSR, VWSRTAYLF, SAKVWSRTA, W SRTAYLFS, AKVWSRTAY, LRHSSAKVW, KVWSRTAYLF, SAKVWS RTAY, WSRTAYLFSR, GLRHSSAKVW, AKVWSRTAYL | CRC |
| XYLB | c.260C>T | p.S87F | TSPVLMWVQALDIILEKMKASGFDF[p.S87F]FQVLALSGAGQQHGSIYWKAGAQQAL | FQVLALSGA, MKASGFDFF, SGFDFFQVL, FDFFQVLAL, KAS GFDFFQV, KMKASGFDFF, FQVLALSGAG | BLCA |
| XYLT2 | c.1578del|C | p.Y526fs | RKFESTVNQEVLEILDFHLYGSYPP[p.Y526fs]ARQPSRPTGRTPTTRLMAPVGSVMSCSLLTQPSPASACTMPPLLHPQWAPHSAGLSPGACRPACTCISMTTISRATW* | HLYGSYPPA, RLMAPVGSV, SLLTQPSPA, LMAPVGSVM, CIS MTTISR, RTPTTRLMA, TRLMAPVG, ASACTMPPL, ISMTTI SRA, LYGSYPPAR, PTTRLMAPV, HSAGLSPGA, RPTGRTPTT, HPQWAPHSA, SPGACRPAC, RPACTCISM, LLHPQWAPH, G SVMSCSLL, MTTISRATW, MPPLLHPQW, RLMAPVGSVM, L LTQPSPASA, GLSPGACRPA, HLYGSYPPAR, TMPPLLHPQW, TGRTPTTRLM, ASACTMPPLL, SYPPARQPSR, TCISMTTISR, TPTTRLMAPV, QPSPASACTM, HPQWAPHSAG, APHSAGLS PG, RPACTCISMT, FHLYGSYPPA, PQWAPHSAGL, SMTTISR ATW, MPPLLHPQWA | STAD |
| YBX1 | c.749C>T | p.P250L | GAGEQGRPVRQNMYRGVRPRFRRGP[p.P250L]LRQRQPREDGNEEDKENQGDETQGGQ | RPFRRGPLRQ, RPRFRRGPL, RPRFRRGPLR, RPRRGPLRQR | KIRP |
| YBX2 | c.677del|C | p.P226fs | SAGTGPGSKGERAEDSGQRPRRWCP[p.P226fs]HPSSTDGGLCEAPGLPTSSSL* | RWMCPHPSST, HPSSTDGGL, CEAPGLPTS, GQRPRRWCPH, R PRRWCPHPS, APGLPTSSSL, RRWCPHPSST, CEAPGLPTSS | STAD |
| YIF1A | c.391del|C | p.R131fs | LGLLVFPYTHQNWEVQYSRDAPLPP[p.R131fs]GKTSTPLTSISPRWPSLLTCSWLGWHWAFRKGSPRRCWACVQAQRWGW* | KTSTPLTSI, SISPRWPSL, LGWHWAFRK, WLGWHWAFR, IS PRWPSLL, SWLGWHWAF, AFRKGSPRR, KGSPRRCWA, TPL TSISPR, WAFRKGSPR, CWACVQAQR, PPGKTSTPL, SPRWP SLLT, SPRRCWACV, LLTCSWLGW, RKGSPRRCW, VQAQRW CGW, WPSLLTCSW, WACVQAQRW, SISPRWPSLL, WLGW HWAFRK, STPLTSISPR, SWLGWHWAFR, RWPSLLTCSW, SL LTCSWLGW, CSWLGWHWAF, CWACVQAQRW, TSISPRW PSL, HWAFRKGSPR, WAFRKGSPRR, APLPGKTST, LPPGKT STPL, SPRWPSLLTC, WPSLLTCSWL, GKTSTPLTSI, TPLTSISP RW | STAD |
| YLPM1 | c.3533del|A | p.E1178fs | RGLGRSDFGRDRGPRPEPGDGGEK[p.E1178fs]CIHITGMSLLGLHGTMEKSEGMKSFH* | LGLHGTMEK, TMEKSEGMK, CIHITGMSLL, IHITGMSLL, SLLG LHGTM, EKSEGMKSF, CIHITGMSLLL, HITGMSLLGL, GMSLL GLHGT, LLGLHGTMEK, GTMEKSEGMK, MEKSEGMKSF, MS LLGLHGTM, GEKCIHITGM, KCIHITGMSL | STAD |
| YTHDC2 | c.1900G>A | p.E634K | IMHLLYNICHSCDAGAVLIFLPGYD[p.E634K]IVGLRDRILFDDKRFADSTHRYQVF | FLPGYDKIV, LIFLPGYDK, IFLPGYDKI, VLIFLPGYDK, LPGYDKI VGL | CRC |
| YTHDC2 | c.553G>A | p.E185K | NREMSKTSGRLNNGIPQIPVKRGES[p.E185K]KFDSFRQSLPVFEKQEEIVKIIKENK | RGESKFDSF, IPVKRGESKF, KRGESKFDSF, SKFDSFRQSL | UCEC |
| ZAR1 | c.126G>C | p.Q42H | CPPCSYRYPYPAATKGKGAAGGSWQ[p.Q42H]HRGRGCLPASSPCSAGAASLSFPGCG | WQHRGRGCL, WQHRGRGCLP | ACC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZBBX | c.1787G>T | p.R596I | TKSSLLQEIACRSKPITKQYQGLEI[p.R596I]LFFIFDTNERLNLLPSHRLECNNSST | YQGLEIFFI, KQYQGLEIF, QYQGLEIFF, QGLEIFIFF, TKQ YQGLEI, LEIFFIFDT, KQYQGLEIFF, QYQGLEIFFI, YQGL EIFFIF, ITKQYQGLEI, IFFIFDTNER, TKQYQGLEIF | CRC |
| ZBBX | c.453_455 delAGA | p.E151del | KPKINGKVCGQCENKAALLVCLECG[p.E151del]DYCSGCFAKVHQKGALKLHRT TLLQAKS | LVCLECGDY, LLVCLECGDY | STAD |
| ZBED4 | c.1154C>T | p.S385L | PSLLPPEGELSVSSSPVKPVRESP[p.S385L]LASSSPDRLTEDLQSHLNPGDGLMED | RESPLASSS, RESPLASSSP | CESC |
| ZBTB20 | c.2075delC | p.P692fs | CKKKFSHKTLLERHVALHSASNGTP[p.P692fs]LQAHPQVPALAPQAWWPARR GPLTSAPSAQQSLITKSSSSTTT* | APQAWWPAR, HSASNGTPL, LAPQAHPQV, TPLQAHPQV, WPARRGPLT, WPARRGPL, LQAHPQVPA, QAHPQVPAL, VPALAPQAW, LQAHPQVPAL, ALAPQAWWPA, AWWPAR RGPL, LAPQAWWPAR, APQAWWPARR, WPARRGPLTS, LH SASNGTPL, TSAPSAQQSL, AQQSLITKSSS, VPALAPQAWW | STAD |
| ZBTB24 | c.1819C>A | p.L607I | QNMTADQAANLTLLTQQPEQLQNLI[p.L607I]ISAQQEQTEHIQSLNMIESQMG PSQT | QLQNLIISA, LQNLIISAQ, EQLQNLIISA, QPEQLQNLII | CRC |
| ZBTB40 | c.786_787insA | p.L262fs | QLNFLLENEGVFSDALMVTQDVLKK[p.L262fs]TRNVFRN* | VLKKTRNVF, VLKKTRNVFR, VTQDVLKKTR | STAD |
| ZBTB7C | c.1025_1026 insG | p.G342fs | ELPPPPPPFPNDFFKDMFPDLPGG[p.G342fs]ASGTHQGGERLRCLSQLPECH PPGRPLPTLAPGRRAQAEAQGLSAVPH LPQSHGGREAAAAHEDPYRGEAIHVH HLRGPLHQAGQAENPHAEAHRGAALP VHPLQRQVRAQLRPQEPHAHPHGRAA LPVRVLLQELHAL* | VLLQELHAL, HLRGPLHQA, RLRCLSQLP, HVHHLRGPL, QLR PQEPHA, HAHPHGRAA, HGRAALPVR, AALPVRVLL, RVLLQ ELHA, AAAAHEDPY, EAIHVHHLR, HPPGRPLPT, RPLPTLAPG, HAEAHRGAA, HPLQRQVRA, AEAQGLSAV, AQGLSAVPFI, SHH LPECHPP, RAQAEAQGL, RAQAEAQGL, AEAQGLSAV, AQGLSAVPFI, SHH GGREAA, GEAIHVHHL, AENPHAEAH, AEAHRGAAL, AHRG AALPV, GAALPVHPL, RQVRAQLRP, AQLRPQEPH, FPDLPG GAS, DPYRGEAIH, DMPPDLPGGA, TLAPGRRAQA, AQAEA QGLSA, GQAENPHAEA, AAAAHEDPYR, AALPVHPLQR, RLR CLSQLPE, HVHHLRGPLH, LQRQVRAQLR, HAHPHGRAAL, H GRAALPVRV, RAALPVRVLL, RVLLQE LHAL, HLPQSHHGGR, EAHRGAALPV, HPPGRPLPTL, APG RRAQAEA, HAEAHRGAAL, LPVHPLQRQV, RPQEPHAHPH, HPHGRAALPV, LPVRVLLQEL, EAAAAHEDPY, HQGGERLRCL, GERLRCLSQL, SQLPECHPPG, RRAQAEAQGL, AQGLSAVPHL, HEDPYRGEAI, IHVHHLRGPL, HQAGQAENPH, AHRGAAL PVH, RGAALPVHPL, RQVRAQLRPQ, AQLRPQEPHA, GRAALPVRVL, FPDLPGGASG, AEAQGLSAVP, DPYRGEAIHV TMMTRRTLL, SLTPSRLAV, CLTPRTSAA, KMMMMRRTK, M MMMMRRTKR, MMMRRTKRR, MTRRTLLTK, GTGGRRMTR, TTTKMMMMR, TTKMMMMR, SAATKALPR, RMTRRTMT T, MTRRTMTTT, TRRTMTTTK, RTMTTTKMM, MMRRTKRR R, RTKRRRRKR, RRRMTMMTR, MTMMTRRTL, RTSAATKAL, MTTTKMMMM, QTISQRRPI, RRKRRRMTM, TLLTKKTCL, I QTPPGTSL, RRTMTTTKM, TMTTTKMMM, RKRRRMTMM, TKALPRQTI, SQRRPIQTP, SRLAVLAIW, TMMTRRTLLT, CLT PRTSAAT, SLTPSRLAVL, MTRRTMTTTK, KMMMMRRTKR, MMMMRRTKRR, MMMMRRTKR, MMMRRTKR, MMMRRTLLTK, MTRRT LLTKK, MTTKMMMMR, TTTKMMMMR, LTPRTSAATK, T SAATKALPR, RTMTTTKMMM, MMRRTKRRR, MRRTKRRR | STAD |
| ZBTB7C | c.460delG | p.D154fs | ILNAARMLEIQCIVNVCLEIMEPGG[p.D154fs]TGGRRMTRRTMTTTKMMMM RRTKRRRKRRRMTMMTRRTLLTKKTC LTPRTSAATKALPRQTISQRRPIQTPPGT SLTPSRLAVLAIWG* | | STAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZBTB7C | c.469de|G | p.E157fs | AARMLEIQCIVNVCLEIMEPGDGG[p. E157fs]RRMTRRTMTTTKMMMRRT KRRRRKRRRMTMMTRRTLLTKKTCLTP RTSAATKALPRQTISQRRPIQTPPGTSLT PSRLAVLAIWG* | RRK,RTKRRRKRR,RRRKRRRMTM,KRRRMTMMTR,RRR MTMMTRR,RMTMMTRRTL,MTMMTRRTLL,RTLLTKKTCL, LTKKTCLTPR,KTCLTPRTSA,ATKALPRQTI,RQTISQRRPI,TP RTSAATKA,TPSRLAVLAI,RRKRRRMTM,RMTRRTMTTT, TRRTMTTTKM,RTMTTTKMM,TMTTTKMMMM,SQRRP IQTPP,IQTPPGTSLT TMMTRRTLL,SLTPSRLAV,CLTPRTSAA,KMMMMRRTK,M MMMRRTKR,MMMRRTKRR,MTRRTLLTK,TTTKMMMM R,TKMMMMRR,SAATKALPR,RMTRRTMTT,MTRRTMTTT,TR RTMTTTK,RTMTTTKMM,MMRRTKRRR,RTKRRRRKR,RRR MTMMTTR,MTMMTRRTL,RTSAATKAL,MTTTKMMMM,QTISQRR PI,RRKRRRMTM,TLLLTKKTCL,IQTPPGTSL,RRTMTTTKM, TMTTTKMMM,RKRRRMTMM,TKALPRQTI,SQRRPIQTP, SRLAVLAIW,TMMTRRTLLT,CLTPRTSAAT,SLTPSRLAVL, MTRRTMTTTK,KMMMMRRTKR,MMMMRRTKRR, MMMRRTKRRR,MMTRRTLLTK,MTRRTLLLTK,MTTTKMMMM R,TTTKMMMMR,MMRRTKRRRR,MRRRTKRRRK,RTKRRR RKRR,RRKRRRRMTM,KRRRMTMMTR,RRRMTMMTR,R MTMMTRRTL,MTMMTRRTLL,RTLLTKKTCL,LTKKTCLTPR, KTCLTPRTSA,ATKALPRQTI,RQTISQRRPI,TPRTSAATKA, TPSRLAVLAI,RRKRRRMTMM,RMTRRTMTTT,TRRTMTTTK M,RTMTTTKMM,TMTTTKMMMM,SQRRPIQTPP,IQTP PGTSLT | STAD |
| ZC3H12D | c.1213C>T | p.P405S | SAGGRVPGPLSLPSPESQFSPGDLL[p.P 405S]SPPGLQLQPRGEHRPRDLHGDLL SPR | LPSPPGLQL,SQFSPGDLPS | ACC |
| ZC3H13 | c.3018de|A | p.K1006fs | NIETTSEDGQVFSPKKGQKKKSIEK[p.K1 006fs]NVKNPKVILIFLMKKQPSKVRRK EAHGLPL* | LMKKQPSKV,KVILIFLMK,VILIFLMKK,FLMKKQPSK,KNPK VILIF,KQPSKVRRK,KVRRKEAHG,RKEAHGLPL,FLMKKQPS KV,KVILIFLMCK,SIEKNVKNPK,IFLMKKQPSK,LMKKQPSKV R,KVRRKEAHGL,QPSKVRRKEA,VKNPKVILI F,NPKVILIFLM,IEKNVKNPKV | STAD |
| ZC3H18 | c.2102_2103 insC | p.T701fs | PVPEPTKPGDPREARRKERPARTPP[p.T 701fs]QEADAKRQRQWQW* | AKRQRQWQW,RTPPQEADAK,RPARTPPQEA | STAD |
| ZC3H18 | c.2473de|C | p.P825fs | PKSAKPPAGGKSSQQPSTPQQAPPG[p. P825fs]SPSRAHLWPTRRSS* | RAHLWPTRR,QQAPPGSPS,PSRAHLWPTR,RAHLWPTRRS, SPSRAHLWPT | STAD |
| ZC3H4 | c.2392G>A | p.E798K | IQQKQQEEEERARRLAESSKQDREN[p. E798K]KEGDTGNWYSSDEDEGGSSVT SILKT | SSKQDRENK,KEGDTGNWY | BLCA |
| ZC3H7A | c.1724G>C | p.C575S | NGKINLTVFKLLQEHLGEFIFLCEK[p.C5 75S]SFDHKPRMISKRNKDNSTACSHPV TK | KSFDHKPRM,FIFLCEKSF,EFIFLCEKSF,KSFDHKPRMI,GEFI FLCEKS | TGCT |
| ZCCHC6 | c.2811A>T | p.K937N | GKHVERALLVELNKISLKEENVCEE[p.K9 37N]NNSPVDQSDFFYEFSKLIFTKGKSP T | NVCEENNSPV | KIRC |
| ZCRB1 | c.228A>T | p.L76F | KGVAFILFLDKDSAQNCTRAINNKQ[p.L 76F]FFGRVIKASIAIDNGRAAEFIRRRNY | KQFFGRVIK,RAINNKQFF,INNKQFFGR,NKQFFGRVI,AINNKQ FFGR,FFGRVIKASI,RAINNKQFFG,KQFFGRVIKA,CTRAI NNKQF | CLL |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZCWPW2 | c.430G>A | p.D144N | DRFKGKVTYDPDGNVEEYHIEFLG[p.D144N]NPHSRSWIKATFVGHYSITLKPEK CK | EFLGNPHSR,LGNPHSRSW,IEFLGNPHS,YHIEFLGNPH,FLG NPHSRSW | CRC |
| ZDHHC11 | c.750C>G | p.H250Q | PVQVQTLIVLIVIGMLVLLLDFLGLV[p.H250Q]QLGQLLIFHIYLKAKKMTTFEYLIN N | GLVQLGQLL,VQLGQLLIF,LDFLGLVQL,LLDFLGLVQL, FLGLVQLGQL,QLGQLLIFHI,GLVQLGQLLI,LVQLGQLLIF | TGCT |
| ZDHHC4 | c.899G>A | p.R300H | LFVLYLAATNQTTNEWYRGDWAWCQ[p.R300H]HCPLVAWPPSAEPQVHRNIH SHGLRS | WAWCQHCPL,CQHCPLVAW,WAWCQHCPLV | GBM |
| ZDHHC5 | c.1947_1949 de|AGA | p.E651de| | PTAPYLGRSMSYSSSQAPGVSETE[p.E651de|]VALQPLLTPKDEVQLKTTYSKS NGQPKS | ETEVALQPL,TEVALQPLL,AQPGVSETEV,ETEVALQPLL,SET EVALQPL,TEVALQPLLT | STAD |
| ZDHHC7 | c.948de|C | p.P316fs | LKSEKPTWERRLRWEGMKSVFGGPP[p.P316fs]HSSG* | KSVFGGPPH,MKSVFGGPPH | STAD |
| ZEB2 | c.3280G>A | p.E1094K | SYSQHMNHRYSYCKREABERFAAER[p.E1094K]KAREKGHLEPTELLMNRAYLQ SITPQ | KAREKGHLE,KAREKGHLEP | CESC |
| ZEB2 | c.467G>A | p.R156H | NNGTVKNANCTSDFEEYFAKRKLEE[p.R156H]HDGHAVSIEEYLQRSDTAIIYPE APE | LEEHDGHAV,EEHDGHAVS,KLEEHDGHAV,EEHDGHAVSI | CRC |
| ZFAND2B | c.446T>C | p.I149T | IKHRHPLDHDCSGEGHPTSRAGLAA[p.I149T]TSRAQAVASTSTVPSPSQTMPSC TSP | TSRAGLAAT,RAGLAATSR,ATSRAQAVA,GLAATS RAQA,TSRAQAVAST,LAATSRAQAV | KIRC |
| ZFC3H1 | c.1155de|A | p.K385fs | KKLGEDEEELSELQLRLLALQSASK[p.K385fs]NGMKNSR* | QSASKNGNK,LQSASKNGNK | STAD |
| ZFHX3 | c.2287de|G | p.E763fs | KGNLSIHMQSDKHLNNMQNLQNGG[p.E763fs]SRSSATLPGRRRRRWLRRRR QPISVAPAGPPRRPNQKPNPDGGARCV IMRPTWPGTSAFT* | RQPISVAPA,RSSATLPGR,SSATLPGRR,SVAPAGPPR,ATLP GRRRR,RRRRRWLRR,RRRRQPISV,IMRPTWPGT,TLPGRR RRR,WLRRRRQPI,RPNQKPNP,RPTWPGTSA,LQNGGGSRS, RRRQPISVA,RCVIMRPTW,PTWPGTSAF,QPISVAPAG, RSSATLPGRR,ISVAPAGPPR,SVAPAGPPRR,RWLRRRRQPI, GSRSSATLPG,ATLPGRRRRR,RRRRRWLRRR,RRRRQPISVA, AGPPRRPNQK,IMRPTWPGTS,LPGRRRRRWL,RPNQKPN PPG,RPTWPGTSAF,WLRRRRQPIS,LRRRRQPISV,LQNGG GSRSS,RRQPISVAPA | STAD |
| ZFHX3 | c.2330_2332 de|TGG | p.V777de| | NNMQNLQNGGEQVFSHTAGAAAAA[p.V777de|]AAAAAANISSSCGAPSPT KPKTKPTWR | HTAGAAAAA | PAAD |
| ZFHX3 | c.5677_5678 de|AG | p.R1893fs | LQPSQHPEKKNKLVIKEKEKESQRE[p.R1893fs]GQRRGGRGQHRSEGNTARCL EGQREERVGTRGWF* | TARCLEGQR,SEGNTARCL,EERVGTRGW,NTARCLEGQR,G QRRGGRGQH,GQHRSEGNTA,REERVGTRGW,EERVGTRG WF | STAD,UCEC |
| ZFHX4 | c.1224_1225 insG | p.L408fs | ASTSSSAEQPLGITQMPKAEVNLGG[p.L408fs]AV* | AEVNLGGAV | STAD |
| ZFHX4 | c.2433G>T | p.L811F | MTSEKHMHNMMLLQQNMKQIQHNL H[p.L811F]FGLAPAEAELYQYYLAQNIG LTGMKL | IQHNLHFGL,NLHFGLAPA,KQIQHNLHF,MKQIQHNLHF,K QIQHNLHFG,IQHNLHFGLA,LHFGLAPAEA | LUAD |
| ZFHX4 | c.4988C>A | p.T1663N | IAANVNSPGQGMLDSMSLAAVNSKD[p.T1663N]NHLDAKELNKKQTPDLISAQ PAHHPP | NSKDNHLDAK | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZFHX4 | c.7533C>A | p.H2511Q | LPPQLLQYQCDQCTVAFPTLELWQE[p. H2511Q]QQHMHFLAAQNQPLHSPPLE RPMDMP | QQHMHFLAA, ELWQEQQHM, WQEQQHMHF, QEQQHM HFL, LWQEQQHMHF, LELWQEQQHM, WQEQQHMHFL, E QQHMHFLAA, QQHMHFLAAQ, QEQQMHFLA | LUAD |
| ZFP14 | c.1156C>T | p.R386C | SIHTGEKPYECKECGKTFRLRQQLV[p. 386C]CHQRIHTREKPYECMECWKTFSS YSQ | RLRQQLVCH, QQLVCHQRI, RQQLVCHQRI, LVCHQRIHTR, QQLVCHQRIH | CRC |
| ZFP14 | c.50A>T | p.Q17L | MAHGSVTFRDVAIDFS[p.Q17L]LEEW EFLDPAQRDLYRDVMWENYSNF | DFSLEEWEF, RDVAIDFSL, VAIDFSLEEW, IDFSLEEWEF, LEE WEFLDPA | LUAD |
| ZFP2 | c.449G>T | p.R150I | TGEKPYKCNVCGKHFIERSSLTVHQ[p.R 150I]IIHTGEKPYKCNECGKAFSQSMNL TV | RSSLTVHQI, SSLTVHQII, RSSLTVHQII | CRC |
| ZFP3 | c.818G>T | p.R273I | TGEKPYECNECGKTFRVSSQLIQHQ[p.R 273I]IIHTEERYHECNECGKAFKHSSGLI R | QIHTEERY, HQIIHTEER, IQHQIIHTE, HQIIHTEERY | CRC |
| ZFP36L2 | c.718G>A | p.D240N | IHNADERRPAPSGGASGDLRAFGTR[p. D240N]NALHLGFPREPRPKLHHSLSFS GFPS | RAFGTRNAL, GTRNALHLG, NALHLGFPR, TRNALHLGF, RAF GTRNALH, GTRNALHLGF, RNALHLGFPR, LRAFGTRNAL | LUSC |
| ZFP42 | c.679G>A | p.V227I | RAALRKHLLIHGPRDHVCAECCKAF[p. V227I]IESSKLKRHFLVHTGEKPRCTFE GC | AFIESSKLK, KAFIESSKL, KAFIESSKLK, CGKAFIESSK, AFIESSK LKR, GKAFIESKL, IESSKLKRHF, AECGKAFIES | GBM |
| ZFP42 | c.791C>T | p.T264M | HTGEKPPRCTFEGCGKRFSLDFNLR[p.T 264M]MHVRIHTGEKRFVCPFQGCNRR FIQS | RMHVRIHTG, DFNLRMHVR, FSLDFNLRM, SLDFNLRMHV, RFSLDFNLRM, RMHVRIHTGE, NLRMHVRIHT | GBM |
| ZFP90 | c.1772_177 3insA | p.R591fs | IQHERTHTGEKPYECNECGRAFRKK[p.R 591fs]NQPA* | AFRKKNQPA, RAFRKKNQPA | PRAD |
| ZFPM1 | c.1330_133 1delGA | p.E444fs | GLAPTPSGLDRKALAEATNGEARA[p. E444fs]ASGPEWRQQRAPGGPQQHQ GGGGAGGGGPHPGHPPRAWAPGV ADAVAAQPRPGQGQGRAVQPHAGLQ PGARRAGPGRGPVPSAVRVRARRGAP RLGDPGQDVRAGAQPAAAGRGRGRR RRADRALPRGPQGRYVLRVRDHLQQR QQLLRAQAPLLFRPPCARGRACRAQAQ GAPRGPRAPRPARRTRRAALVPGPRS ARGGGWGRGHARGRRGRPGPGQP EPG* | QLLRAQAPL, RLGDPGQDV, LLRAQAPLL, ALVPGPRSA, RAQ APLLFR, LLFRPPCAR, RAQAQGAPR, RAALVPGPR, RAWAP GPVA, QGRAVQPHA, GARRAGPGR, RAGPGPGPV, SAVRV RARR, AVRVRARRG, RVRARRGAP, RARRGAPRL, RAGAQP AAA, AGRGRGRR, RGRGRRRRA, RGRRRRADR, RALPRGP QG, QGRYVLRVR, RVRDHLQQR, CARGRACRA, RGRACRAQ A, RTRRAALVP, SARGGWGR, RGHARGRRG, RGRRGRPG Q, SGPEWRQQR, HAGLQPGAR, LVPGPRSAR, HPGPRRAW A, GPRRAWAPG, APGPVADAV, RPGQQGRA, RAVQPHA GL, VPSAVRVRA, RRRRADRAL, RPPCARGRA, APRPGPRAP, RPARRTRRA, ARRTRRAAL, RPGQRGQPE, HLQQRQQLL, AR AASGPEW, RRAWAPGPV, GQGRAVPQH, RQQLLRAQA, LR AQAPLLF, GPVADAVAA, LPRGPQGRY, QLLRAQAPLL, RVR ARRGAPR, RSARGGWGR, RYVLRVRDHL, AVRVRARRGA, RARRGAPRLG, AGRGRGRRR, RGRRRRADRA, RRRADRAL PR, RALPRGPQGR, RVRDHLQQRQ, LLRAQAPLLF, LFRPPCA RGR, RGRACRAQAQ, RAPRPARRTR, RTRRAALVPG, RGHA RGRRGR, RGRRGRPGQP, ALPRGPQGRY, HAGLQPGARR, H LQQRQQLLR, WAPGPVADAV, GPHPGPRAW, RPGQGQG RAV, LPRGPQGRYV, RPPCARGRAC, RPGPRAPRPA, RPARR TRRAA, PARRTRRAAL, GPRSARGGGW, QQLLRAQAPL, RQ QRAPGGPQ, RRAWAPGPVA, GQGRAVQPHA, RRAGPGRG PV, VRARRGAPRL, RDHLQQRQQL, LQQRQQLLRA, RQQLL RAQAP, AQAPLLFRPP, AQAQGAPRPG | ACC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|------|-------------|----------------|-------------------------------------------------------------------------------------|-----------------------------------------------------------------------|--------------------|
| ZFPM1 | c.1335del|T | p.P445fs | APTPSPGLDRKALAEATNGEARAEP[p.P445fs]WPRMEAAASPRRPPGASRWR RWRSRRRPPSWAPESLGPRPRGRRR RAAPPRPGSRPSCPAPRRAPARCPASW AWPGPCSFRSTCSGPTRRPPPRRSWPR CPSWCTAGCSRARARAPAARRPGSSPGP PRALRASSARSPSATSTTTTCTSASTVQ AAVRPRTRLPRAGPRRPARPARPPAS PPNPTRARPRAPERARRGLGARPRPR TARAAGAARARARVAPWTTRRTTPA ARCARPATSASAATRPTPCTSGTTAPRA TTRRRADRPRPRDPLGRPRPPLPPRL CARADAASSTSCTRPAPRPRPATPPR PSRRGPEAEAEAAPASPLRARPAPRPTA PST* | RMEAAASPR, RVAPWTRR, STCSGPTRR, RALRASSAR, TV QAAVRPR, ATSASAATR, CTSGTTAPR, TTAPRATTR, TSCTRP APR, WAWGPCSF, RSWPRCPSW, ASRWRRWS, RWR WRSRR, RWRSRRRPP, RSRRRPPSW, RPRRGRRRR, RGRRR RAAP, RERRAAPPR, RSTCSGPTR, PTRRPPPRR, RARARAPA A, RARAPAARR, ALRASSARS, RASSARSPS, ASSARSPSA, AV RPRTRLP, RPRTRLPRA, RTRLPRAGP, RLPRAGPRR, RAGPRR PPA, PARPARPPA, PTRRARPRA, RARPRAPER, RARRGLGAR, GARPRPRTA, RPRPRTARA, RTARAAGAA, TARAAGAAR, A AGAARAAR, RARAARARV, AARARVAPW, RARVAPWTT, TT RRTTPAA, RTTPAARCA, AARCARPAT, ATRPTPCTS, ATTRR RADR, RPRPPLPPR, CTRPAPRPP, RPAPRPPR, PLRARPAPR, RARPAPRPT, EARAEPWPR, GASRWRRWR, ESLGPRPPR, S WCTAGCSR, CTAGCSRAR, QAAVRPRTR, TTPAARCAR, EAA PASPLR, TTCTSASTV, CTSASTVQA, SASTVQAAV, WTTRRT TPA, EPWPRMEAA, WPRMEAAAS, SPRRPPGAS, CPAPRRA PA, APARCPASW, APAARRPGS, RPARPPASP, APERARRGL, RPRTARAAG, RAAGAARAA, APWTTRRTT, RPATSASAA, RP TPCTSGT, RPRRPPPLP, RPRPPRRPA, RPATPPRPS, RPSRRG PEA, RPAPRPTAP, APRPTAPST, ARAEPWPRM, RRAPARCP A, ARCPASWAW, AAVRPRTRL, AEAAPASPL, CPASWAWPG, AEAEAAPAS, AEPWPRMEA, LPPRLCARA, STVQAAVRPR, R TARAAGAAR, RTTPAARCAR, GTTAPRATTR, TTAPRATTRR, STSCTRPAPR, SWAWPGPCSF, RMEAAASPRR, AASPRRP GA, ASRWRRWRSR, RWRRWRSRRR, RWR.SRRRPPS, RSRR RPPSWA, RGRRRRAAPP, RAAPPRPGSR, GSRPSCPAPR, SFR STCSGPT, RSTCSGPTRR, SGPTRRPPPR, RSWPRCPSWC, CS RARARAP, RARAPAARR, RARAPAARRP, AARRPGSSPG, RALRASSARS, RASSARSPSA, AVRPRTRLPR, RTRLPRAGPR, RAGPRRPPAR, RARPRAPERA, RPRAPERAR, RARRGLGAR P, RGLGARPRPR, GARPRPRTAR, TARAAGAARA, RAAGAAR AAR, AARAARARVA, AARARVAPWT, RARVAPWTTR, TTRR TTPAAR, AARCARPATS, CARPATSASA, ATRPTPCTSG, RATT RRRADR, TTRRRADRPR, RRRADRPRPR, RPRPRDPLGR, RPR DPLGRPR, LGRPRPRPPL, RPRPPLPPRL, CTRPAPRPPR, RAR PAPRPTA, SWAPESLGPR, CPAPRRAPAR, WAWPGPCSFR, R PPPRRSWPR, TAGCSRARAR, SASTVQAAVR, DAASSTSCTR, SPLRARPAPR, CTAGCSRARA, TTTCTSASTV, CTSASTVQAA, TSASTVQAAV, WTTRRTTPAA, CTSGTTAPRA, EAEAAPASP L, EAAPASPLRA, WPRMEAAASP, RPPSWAPESL, RPRRGRR RRA, RPGSRPSCPA, RPSCPAPRRA, APARCPASWA, WPRCP SWCTA, APAARRPGSS, PPRALRASSA, RPRTRLPRAG, LPRA GPRRPP, GPRRPPARPA, RPARPPASPP, RPRPRTARAA, RPR TARAAGA, APWTTRRTTP, TPAARCARPA, RPATSASAAT, R PTPCTSGT, APRATTRRRA, RPRPRPPLPP, RPPLPPRLCA, A PRPPRRPAT, RPAPRPTAPS, WRSRRRPPSW, RAPARCPAS W, RRSWPRCPSW, ARAAGAARAA, RAARARVAPW, EPWP RMEAA, AEPWPRMEAA, AEAEAAPASP, PEAEAEAAPA | ACC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZFR2 | c.319T>A | p.Y107N | TTMATYQDSYGQSAAARSYEDRP[p.Y107N]NFQSAALQSGRMTAADSGQPGTQEAC | RSYEDRPNF, RPNFQSAAL, ARSYEDRPNF, YEDRPNFQSA | KIRC |
| ZFYVE1 | c.797G>A | p.R266Q | GATVNLSQRTRLLLKVLAISDLVIY[p.R266Q]QTHADRLHNDLFKFLGDASFAYLKHF | IYQTHADRL, VIYQTHADR, YQTHADRLH, AISDLVIYQT, LVIYQTHADR, VIYQTHADRL | UCEC |
| ZFYVE9 | c.3441G>C | p.M1147I | VVQGLVVDMEVRKTSIKIPSNRYNE[p.M1147I]IMKAMNKSNEHVLAGGACFNEKADSH | SNRYNEIMK, IPSNRYNEI, RYNEIMKAM, IPSNRYNEIM, NRYNEIMKAM | CESC |
| ZHX3 | c.747C>A | p.N249K | EVREGDHSFINGAVPVSQASASSAK[p.N249K]KPHAANGPLIGTVPVLPAGIAQFLSL | QASASSAKK, ASSAKKPHA, KPHAANGPL, SQASASSAKK, KPHAANGPLI, KKPHAANGPL | STAD |
| ZIC1 | c.335C>A | p.A112E | GSYSSAAFNSTRDFLFRNRGFGDAA[p.A112E]EAASAQHSLFAASAGGFGGPHGHTDA | EAASAQHSL, AEAASAQHS, EAASAQHSLF, RGFGDAAEAA, AEAASAQHSL | LUAD |
| ZIC4 | c.914C>T | p.S305L | GEKPFRCEFEGCERRFANSSDRKKH[p.S305L]LHVHTSDKPYTCKVRGCDKCYTHPSS | HLHVHTSDK, KKHLHVHTS, KHLHVHTSDK, LHVHTSDKPY | CRC |
| ZIM3 | c.1054G>A | p.D352N | RIHTGEKPYKCSICEKAFSQKSNVI[p.D352N]NHEKIHTGKRAYECDLCGNTFIQKKN | KSNVINHEK, SQKSNVINH, KSNVINHEKI, INHEKIHTGK | CRC |
| ZIM3 | c.1150de|A | p.I384fs | GKRAYECDLCGNTFIQKKNLIQHKK[p.I384fs]SILGKSPMNVTDVEKPSFRSQTFIAIRKLIAERGPIDVVNVEKPSSGN* | ILGKSPMNV, FIAIRKLIA, KLIAERGPI, SQTFIAIRK, RSQTFIAIR, TFIAIRKLI, QHKKSILGK, KSILGKSPM, SFRSQTFIA, AIRKLIAER, KPSFRSQTF, NLIQHKKSI, LIQHKKSIL, FRSQTFIAI, AERGPIDVV, SILGKSPMNV, LIAERGPIDV, IQHKKSILGK, RSQTFIAIRK, SFRSQTFIAI, IAIRKLIAER, QTFIAIRKLI, KPSFRSQTFI, NLIQHKKSIL, KKSILGKSPM, SQTFIAIRKL, RKLIAERGPI, NVTDVEKPSF | STAD |
| ZKSCAN1 | c.1621_1622de|AG | p.R541fs | KCTKCGKAFTRSSTLTLHHRIHARE[p.R541fs]SL* | HRIHARESL, HHRIHARESL | UCEC |
| ZKSCAN3 | c.598_599A>GC | p.K200A | VGSQPLQDRVLQVPVLAHGGCCRED[p.K200A]AVVASRLTPESQGLLKVEDVALTLTPE | REDAVVASRL | TGCT |
| ZKSCAN4 | c.956G>A | p.R319Q | IPTHAERAGEQEGRLQRKQKNAIGSR[p.R319Q]QHYCHECGKSFAQSSGLTKHRIHTG | NAIGSRQHY, RQHYCHECG, RQHYCHECGK, KNAIGSRQHY | CRC |
| ZKSCAN5 | c.39de|C | p.D13fs | MIMTESREVIDLDP[p.D13fs]QLRLPRS*RKTFS | QLRLPRSRK, EVIDLDPQL, RLPRSRKTF, EVIDLDPQLR, DLDPQLRLPR, REVIDLDPQL, LRLPRSRKTF | STAD |
| ZMIZ1 | c.3144de|C | p.D1048fs | MPEPSLDLLPELTNPDELLSYLDPP[p.D1048fs]TCRAIVTMTSCLYLRTTEGHPVGAIPPHSASYPTYPTHFSTWEPVPSDRPAPEPRAVGRGALPRCSPLRTEG* | IVTMTSCLY, YLDPPTCRA, AIVTMTSCL, TMTSCLYLR, AVGRGALPR, SYPTYPTHF, TYPTHFSTW, VTMTSCLYL, AIPPHSASY, SYPTYPTCR, SASYPTYPT, RPAPEPRAV, EPRAVGRGA, GALPRCSPL, RAIVTMTSC, ASYPTYPTH, THFSTWEPV, HPVGAIPPH, YPTYPTHFS, EPVPSDRPA, TEGHPVGAI, YLDPPTCRAI, YLRTTEGHPV, VTMTSCLYLR, LSYLDPPTCR, AIVTMTSCLY, STWEPVPSDR, RAVGRGALPR, ASYPTYPTHF, PTYPTHFSTW, RAIVTMTSCL, RTTEGHPVGA, RGALPRCSPL, GALPRCSPLR, GAIPPHSASY, HSASYPTYPT, YPTYPTHFST, RPAPEPRAVG, EPRAVGRGAL, PPHSASYPTY, WEPVPSDRPA | PRAD |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZMIZ2 | c.457_501 del GT GGCTG CTGCGGCA GCCACTGC CACCGCCA CAGCCACA GCCACC | p.VAAA AATAT ATATA T153de | LGLPSHAARPSTDFTQAAAAAVAAL PVAAAATATATATAT153de LQEKQS QELSQYGAMGAGQSFNSQFLQHGGP RGPSVPAGMNPTGIGGVMGPSGLSPL AMNPTRAAGMTPL | AAAAAVAAL, AAVAALQEK, AAVAALQEK, AAAAAVAAL | PAAD |
| ZMYM4 | c.1033de A | p.K345fs | SSGMNKMLPSVPATAVRVSCSGCKK p. K345fs SSRRGKLLIRGKLLSYSAPHCA SLDIQFHLPAHRLLSPRKLVQVAQKTF* | LLIRGKLL, YSAPHCASL, KSSRRGKLL, SSRRGKLLI, RGKLLIR GK, RGKGLLSYS, AHRLLSPRK, RLLSPRKLV, IRGKGLLSY, CSG CKKSSR, IQFHLPAHR, PAHRLLSPR, APHCASLDI, LPAHRLLSP, SP RKLVQVA, LVQVAQKTF, GLLSYSAPH, HCASLDIQF, ASL DIQFHL, LDIQFHLPA, FHLPAHRL, SLDIQFHLPA, IQFHLPAHRL, LLSPRKLVQV, LLSYSAPHCA, SYSAPHCASL, GCKKSSRR GK, KSSRRGKLLI, SSRRGKLLIR, RGKGLLSYSA, PAHRLLSPRK, LIRGKGLLSY, DIQFHLPAHR, LPAHRLLSPR, KLVQV AQKTF, KKSSRRGKLL, LDIQFHLPAH | STAD |
| ZMYM4 | c.1100C>T | p.T367I | SGCKKILQKGQTAYQRKGSTQLFCS p.T 367I ILCLTGYTVPPARPPPLTKKTCSS C | CSILCLTGY, QLFCSILCL, ILCLTGYTV, GSTQLFCSI, TQLFCSIL CL, QLFCSILCLT, SILCLTGYTV, KGSTQLFCSI, GSTQLFCSIL, FCSILCLTGY | TGCT |
| ZMYM4 | c.4337G>A | p.R1446Q | TYLRFPPLQKQESEPDKLTVGKRK p.R 1446Q QNEDDEVPVGVEMAENTDNP LRCPVR | KQNEDDEVPV | CRC |
| ZNF11 | c.554G>T | p.R185I | TGEKPYKCKECGKAFNQTSHLIRHK p.R 185I IIHTEEKPYKCEECGKAFNQSSTLI T | QTSHLIRHKI | CRC |
| ZNF124 | c.1015de A | p.T339fs | GEKPYECQKCGKAFSRASTLMKHKK p. T339fs LILEKSPINVKKCKGFNHYSFCQ KHEQSHT* | KLILEKSPI, ILEKSPINV, KHKKLILEK, KGFNHYSFC, FNHYSFC QK, KKCKGFNHY, LWKHKKLIL, CKGFNHYSF, LILEKSPINV, IL EKSPINVK, GFNHYSFCQK, KSPINVKKCK, TLWKHKKLIL, KKL ILEKSPI, VKKCKGFNHY, KCKGFNHYSF | STAD |
| ZNF154 | c.1223C>A | p.T408N | RPYECSECGKSFTQNSGLIKHRRVH p.T 408N NGEKPYECTECGKSFSHNSSLIKH QR | HRRVHNGEK, KHRRVHNGEK, RRVHNGEKPY | LUAD |
| ZNF16 | c.1354C>T | p.R452W | HTGEKPYKCSDCGKAFSQSSSLIQH p.R 452W WRIHTGEKPHVCNVCGKAFSYS SVLR | QSSSLIQHW, QSSSLIQHWR, SQSSSLIQHW | CESC |
| ZNF167 | c.2048G>T | p.R683I | TGEKPYECNECCKVFSYSSSLMVHQ p. R683I ITHTGEKPYKCNDCGKAFSDSSQ LIV | LMVHQITHT, SLMVHQITH, SLMVHQITHT, YSSSLMVHQI | CRC |
| ZNF174 | c.1057C>A | p.P353T | CDDCGKSFTWNSELKRHKRVHTGER p. P353T TYTCGECGNCFGRQSTLKLHQR IHTG | RVHTGERTY, RVHTGERTYT, KRVHTGERTY | TGCT |
| ZNF180 | c.1202G>T | p.R401I | TGEKPYECSECGKSFSRSSHLVSHQ p.R 401I THTGEKPYRCNQCGKSFSQSYVL VV | HLVSHQITH, HLVSHQITHT, ITHTGEKPYR, RSSHLVSHQI | CRC |
| ZNF180 | c.1706G>T | p.R569I | TGEKPYECSECGKSFNRSSHLVMHQ p. R569I IIHTGEKPYECNQCGKSFSQSYVL VV | SHLVMHQII, RSSHLVMHQI, SSHLVMHQII | UCEC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF180 | c.1874G>T | p.R625I | TGEKPYECSQCGKSFRQSSCLTQHQ[p.R625I]ITHTGEKPFECNQCGKTFSLSARLIV | ITHTGEKPF,TQHQITHTG,QITHTGEKPF | UCEC |
| ZNF19 | c.1046G>T | p.R349I | TGEKPYSCKVCGQAFNFHTKLTRHQ[p.R349I]IIHSEEKPFDCVDCGKAFSAQEQLKR | HTKLTRHQI,HQIIHSEEK,TKLTRHQII,IIHSEEKPF,HTKLTRHQII,RHQIIHSEEK,QIIHSEEKPF | CRC |
| ZNF195 | c.176G>A | p.R59Q | LENYRNLFSVGLTVCKPGLITCLEQ[p.R59Q]QKEPWNVKRQEAADGHPEMGFHHATQ | QQKEPWNVK,QQKEPWNVKR,LEQQKEPWNV | UCEC |
| ZNF205 | c.1150C>T | p.R384C | TGEKPYTCPACRKSFSHHSTLIQHQ[p.R384C]CIHTGEKPYVCDRCAKRFTRRSDLVT | HQCIHTGEK,IQHQCIHTG,CIHTGEKPYV,QCIHTGEKPY | CRC |
| ZNF223 | c.67G>T | p.G23W | MTMSKEAVTFKDVAVVFTEEEL[p.G23W]WLLDLAQRKLYRDVMLENFRNLLSVG | FTEEELWLL,EELWLLDLA,EEELWLLDL,VVFTEEELW,WLLDLAQRKL,VFTEEELWLL,ELWLLDLAQR,TEEELWLLDL,EELWLLDLAQ,EEELWLLDLA | LUAD |
| ZNF23 | c.366del T | p.F122fs | NIKKEKSNTIDGTVKDETSPVEECF[p.F122fs]LVKVQTHISVIPSLESSPLGVQDWGNPSALIQNS* | FLVKVQTHI,KVQTHISVI,SLESSPLGV,IPSLESSPL,VKVQTHISV,THISVIPSL,KVQTHISVI,VQDWGNPSA,QDWGNPSAL,VEECFLVKV,SPVEECFLV,VQDWGNPSAL,VIPSLESSPL,CFLVKVQTHI,LVKVQTHISV,QTHISVIPSL,ETSPVEECFL,TSPVEECFLV,VKVQTHISVI,QLMGEPGLA,AQQLMGEPG,QQLMGEPGL,LMGEPGLAP,AQQLMGEPGL | STAD |
| ZNF236 | c.4229C>T | p.T1410M | NITLQIDPSILQQTLQQGNLLAQQL[p.T1410M]MGEPGLAPQNSSLQTSDSTVPASVVI | | STAD |
| ZNF236 | c.4439C>T | p.S1480L | GPLSEQDSVLTTNSSGTQDLTQVMT[p.S1480L]LQGLVSPSGGPHEITLTINNSSLSOV | TQVMTLQGL,QVMTLQGLV,TQVMTLQGLV,MTLQGLVSP,S,TQDLTQVMTL | CRC |
| ZNF248 | c.1703G>T | p.R568I | TGEKPYECNACGKTFSQRSVLTKHQ[p.R568I]IIHTRVKALSTS* | HQIIHTRVK,SVLTKHQII,IIHTRVKAL,RSVLTKHQI,LTKHQIIHTR,KHQIIHTRVK,RSVLTKHQII,HQIIHTRVKA | CRC |
| ZNF254 | c.537G>T | p.K179N | FQCDKYLKVFYKFLNSNRPKIRHTE[p.K179N]NKSFKCKKRVKLFCMLSHKTQHKSIY | KIRHTENKS,RHTENKSFK,IRHTENKSF,HTENKSFKCK,RPKIRHTENK,KIRHTENKSF | UCEC |
| ZNF257 | c.1175G>T | p.R392I | TKEKPYKCEECGKAFNRSSHLTKHK[p.R392I]IIHTREKAYKCDEYCKAFNWSSALIT | IIHTREKAY,IIHTREKAYK,KIIHTREKAY,RSSHLTKHKI | UCEC |
| ZNF259 | c.521G>T | p.R174I | LITRAISGLEQDQPARRANKDATAE[p.R174I]IIDEFIVKLKELKQVASPFTLIIDDP | IIDEFIVKL,ATAEIIDEF,AEIIDEFIV,ATAEIIDEFI,IIDEFIVKLK,EIIDEFIVKL,RANKDATAEI | CRC |
| ZNF263 | c.1529G>T | p.R510I | TGEKPYKCPECGEIFAHSSNLLRHQ[p.R510I]IIHTGERPYKCPECGKSFSRSSHLVI | SNLLRHQII | UCEC |
| ZNF266 | c.1031G>A | p.R344Q | TAKDPFECKICGKSFRNSSCLSDHF[p.R344Q]IHTGIKPYKCKDCGKAFTQNSDLTK | HFQIHTGIK,FQIHTGIKP,CLSDHFQIHT,QIHTGIKPYK,FQIHTGIKPY | CRC |
| ZNF266 | c.1535G>A | p.R512Q | TGEKPYKCKQCGKSFSYSNSFQLHE[p.R512Q]QTHTGEKPYECKECGKAFSSSSSFRN | FQLHEQTHT,EQTHTGEKPY,FQLHEQTHTG | CRC |
| ZNF268 | c.2700_2702del CTT | p.F901del | NSQLIVHQRTHSGEKPYGCNECGKT[p.F901del]SQKSILSAHQRTHTGEKPCKCTECGKAF | KTSQKSILS,KTSQKSILSA | BRCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF273 | c.957T>A | p.N319K | DCGKVFSVFSVLTKHKIIHTGTKPY[p.N319K]KCEECGKGFSIFSTLTKHKIIHTGEK | IIHTGTKPYK | KIRC |
| ZNF280B | c.1087G>A | p.E363K | SWENHTCQHCHRQFPTPFQLQCHI[p.E363K]KNVHTAQEPSTVCKICELSFETDQVL | QLQCHIKNV, LQCHIKNVH, CHIKNVHTA, FQLQCHIKNV | CRC |
| ZNF280B | c.1198G>A | p.E400K | CKICELSFETDQVLLQHMKDHHKPG[p.E400K]KMPYVCQVCHYRSSVFADVETHFRTC | HHKPGKMPY, GKMPYVCQV, HMKDHHKPGK, MKDHHKP GKM, GKMPYVCQVC | GBM |
| ZNF283 | c.1175G>A | p.R392Q | KIHTGKKPYECKICGKAFCWGYQLT[p.R392Q]QHQIFHTGEKPYECKECGKAFNCGSS | GYQLTQHQI, YQLTQHQIF, TQHQIFHTG, GYQLTQHQIF, W GYQLTQHQI, YQLTQHQIFH | CRC |
| ZNF32 | c.185C>T | p.S62L | EATGSSSWDIQNSFRREKLEQKSPD[p.S62L]LKTLQEDSPGVRQRVYECQECGKSFR | KLEQKSPDLK | CRC |
| ZNF322 | c.318G>T | p.K106N | VQSSDLTSHQRIHNYEKPYKCSKCE[p.K106N]NSFWHHLVLSGHQRTHAGKKFYTCDI | ENSFWHHLV, NSFWHHLVL, KCSKCENSF, CENSFWHHL, YK CSKCENSF, CENSFWHHLV | LUAD |
| ZNF333 | c.1661G>A | p.R554Q | TGEKLYECATCGQVLSRLSTLKSHM[p.R554Q]QTHTGEKPYVCQECGRAFSEPSSLRK | HMQTHTGEK, KSHMQTHTG, SHMQTHTGEK, MQTHTGEK PY, QTHTGEKPYV | UCEC |
| ZNF334 | c.1278de|A | p.K426fs | ECKECGKTFFCQSALTAHQRIHTGE[p.K426fs]NPMNVVNVRKPSFVNLPSMCIEEVIQERSPMNAVNVENFYVRNQPSLHIR* | AVNVENFYV, FVNLPSMCI, FVYRNQPSL, RIHTGENPM, HTG ENPMNV, EVIQERSPM, NAVNVENFY, VVNVRKPSF, VRKPS FVNL, PSFVNLPSM, QERSPMNAV, MNAVNVENF, VRNQPS LHI, LPSMCIEEV, NLPSMCIEEV, VVNVRKPSFV, AVNVENFY VR, SFVNLPSMCI, NVRKPSFVNL, YVRNQPSLHI, MNQVNVE NFY, HTGENPMNVV, NAVNVENFYV, KPSFVNLPSM, NFYV RNQPSL, QRIHTGENPM, GENPMNVVNV, NVNVRKPSF, E EVIQERSPM, IQERSPMNAV, PMNAVNVENF, LPSMCIEEVI | STAD |
| ZNF354B | c.1205G>T | p.R402I | TGEKPFKCSECGRAFSQSASLIQHE[p.R402I]IIHTGEKPYRCNECGKGFTSISRLNR | SASLIQHEI, IQHEIIHTG, SLIQHEIIHT, QSASLIQHEI | UCEC |
| ZNF354B | c.1825G>A | p.D609N | GKLFSQRSSLTNHYKIHIEEDSLKA[p.D609N]NLHV* | EEDSLKANL, IEEDSLKANL | UCEC |
| ZNF358 | c.389de|C | p.T130fs | DPNSDTLSPGDPKVDPISSGLTATP[p.T130fs]RSWPPAPRCSPPPPARPGPSPARIAGEPSAAAPG* | RIAGEPSAA, SSGLTATPR, ATPRSWPPA, RPGPSPARI, GLTA TPRSW, ARIAGEPSA, RIAGEPSAAA, ISSGLTATPR, PARPGP SPAR, TPRSWPPAPR, APRCSPPPPA, RPGPSPARIA, SGLTAT PRSW, ARIAGEPSAA | STAD |
| ZNF382 | c.558T>A | p.H186Q | FGDSTGWEKSLLNTKHEKIHPAVNL[p.H186Q]QKQTERVLSGKQELIQHQKVQAPEQP | NLQKQTERV, LQKQTERVL, KIHPAVNLQK | CLL |
| ZNF385D | c.677C>G | p.T226S | KRLLYCSLCKVAVNSASQLEAHNSG[p.T226S]SKHKTMLEARNGSGTIKAPPRAGVKG | SKHKTMLEA, GSKHKTMLEA, SQLEAHNSGS, LEAHNSGSKH | LUAD |
| ZNF43 | c.752de|A | p.N251fs | GEKPYTCEECGKVFNWSSRLTTHKK[p.N251fs]IILDTNSTNVKNVAKLLTSPQSLLPIR* | ILDTNSTNV, KLLTSPQSL, LLTSPQSLL, IILDTNSTNV, KLLTSP QSLL, ILDTNSTNVK, SRLTTHKKI, DTNSTNVKNV, LTSPQSL LPI, RLTTHKKIIL, AKLLTSPQSL | STAD |
| ZNF43 | c.838C>T | p.R280C | YKLYKCEECGKAFNKSSILTTHKII[p.R280C]CTGEKFYKCKECAKAFNQSSNLTEHK | IICTGEKFY, KIICTGEKF, IICTGEKFYK, CTGEKFYKCK, THKIICT GEK, KIICTGEKFY, HKIICTGEKF | UCEC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF434 | c.916C>T | p.R306C | QNSQIYRAMAEGLWEQFLRTPEQC[p.R306C]CTKFKSLQLSYRKVRRGRVPEPCIFY | RTPEQCCTK,CTKFKSLQL,TPEQCCTKF,RTPEQCCTKF | CRC |
| ZNF439 | c.785G>T | p.R262I | TGEKPYECKQCCGKSFSYASATHRIHE[p.R262I]ITHIGEKPYECQECGKAFHSPRSCHR | ITHIGEKPY,HRIHEITHI,YSATHRIHEI | CRC |
| ZNF442 | c.926G>A | p.R309Q | ERTHTGEKPYKCKRCGRAFSVSSSL[p.R309Q]QIHERTHTGEKPYECKQCGKAFHHLG | SSSLQIHER,FSVSSSLQI,VSSSLQIHER,RAFSVSSSLQ,FSVSSSLQIH | UCEC |
| ZNF443 | c.902G>T | p.R301I | TGEKPYKCKQCSKAPDSSSCLIHE[p.R301I]THTGEKPYTCKQCGKAFSVSGSLQR | CLIHEITHT,SSSCLIHEI,DSSSCLIHEI,EITHTGEKPY | CRC |
| ZNF445 | c.2044C>A | p.L682M | ECREGFRQSPDCSQPQGAPAVEKTF[p.L682M]MCQQCGKTFTRKKTLVDHQRIHTGEK | TFMCQQCGK,KTFMCQQCG,APAVEKTFM,MCQQCGKTF,KTFMCQQCGK,FMCQQCGKTF | CRC |
| ZNF454 | c.1127G>T | p.R376I | TGEKPFECNECCGKAFRVNSSLTEHQ[p.R376I]IIHTGEKPYKCNECGKAFRDNSSFAR | SSLTEHQII,TEHQIIHTG,SLTEHQIIHT | UCEC |
| ZNF454 | c.569G>T | p.S190I | SDQSQGFQPSKNAFECSECGKVFSK[p.S190I]ISTLNKHQKIHNEKNANQKIHIKEKR | KVFSKISTL,FSKISTLNK,ISTLNKHQK,VFSKISTLNK,KISTLNKHQK,GKVFSKISTL,SECGKVFSKI | LUAD |
| ZNF462 | c.1948T>A | p.S650T | FCDNLPKFEGQPSSLPLENETDSHP[p.S650T]TSSNTVKKSQTSILGLSSKNNFVAKA | PTSSNTVKK,DSHPTSSNTV,LENETDSHPT | KIRC |
| ZNF470 | c.1922G>T | p.R641I | TGEKPYECNVCGKAFSHRKSLTLHQ[p.R641I]IIHTGEKPYECKECSKAFSQVAHLTL | KSLTLHQII,RKSLTLHQI,KSLTLHQIIH,RKSLTLHQII | CRC |
| ZNF471 | c.845G>T | p.R282I | TGEKLFECKECRKAFKQSEHLIQHQ[p.R282I]IIHTGEKPYKCKECRKAFRQPAHLAQ | SEHLIQHQI,SEHLIQHQII | CRC |
| ZNF48 | c.704G>A | p.R235H | HQRTHTGEKPYKCGICGKGFGDSSA[p.R235H]HIKHARTHRGEQPPRPVVPRRQPSRA | SSAHIKHQR,HIKHQRTHR,KGFGDSSAH,AHIKHQRTH,DSSAHIKHQR,KGFGDSSAHI | LUSC |
| ZNF48 | c.739del|C | p.P247fs | ICGKGFGDSSARIKHQRTHRGEQPP[p.P247fs]DQWCPDGSHLGQPRQLPRDRRPRTSHISALIAARGLCSAAS* | RTSHISALI,HISALIAAR,RPRTSHISA,AARGLCSAA,LPRDRR,PRT,SHISALIAA,LIAARGLCSA,RQLPRDRRPR,RTSHISALIA,TSHISALIA,AARGLCSAAA,HLGQPRQLPR,SHISALIAAR,LPRDRRPRTS,RPRTSHISAL,DQWCPDGSHL,IAARGLCSAA | STAD |
| ZNF484 | c.412C>T | p.R138C | SILEELWKDDEHTRKCGENQNKPLS[p.R138C]CVVFINKKTLANDSIFEYKDIGEIVH | NQNKPLSCV,LSCVVFINK,NKPLSCVVF,KPLSCVVFI,NQNKPLSCVV,PLSCVV,PLSCVVFINK,LSCVVFINKK,QNKPLSCVVF | CRC |
| ZNF485 | c.1121G>T | p.R374I | SGNKPYQCRDCGKAFTKSSLTGHQ[p.R374I]IIHTGEKPYHCKKCGKAFRHSSGLVE | KSSTLTGHQI | UCEC |
| ZNF488 | c.617G>A | p.R206Q | PAGESADALGELSGLLNTTDLACWG[p.R206Q]QLSTPKLLVGDLWNLQALPQNAPLCS | QLSTPKLLV,GQLSTPKLL,CWGQLSTPKLL,GQLSTPKLLV | UCEC |
| ZNF491 | c.1028G>A | p.R343Q | ERTHTGEKPFDGCKQCGKAFRSAKYI[p.R343Q]QIHGRTHTGEKPYECKQCGKAFHCVS | SAKYIQIHG,RSAKYIQI,FRSAKYIQI,IQIHGRTHT,APRSAKYIQI,SAKYIQIHGR,IQIHGRTHTG | CRC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF492 | c.1175C>A | p.P392H | CEVCSKAFSRFSHLTTHKRIHTGEK[p.P392H]HYKCEECGKAFNLSSQLTTHKIIHTG | RIHTGEKHY, RIHTGEKHYK, KRIHTGEKHY | LUAD |
| ZNF514 | c.242T>G | p.V81G | PGEEGTTNSFLKARPRDLMTFEDVA[p.V81G]GEFSQWEWGQLNPAQKDLYREVMLEN | MTFEDVAGE, MTFEDVAGEF, VAGEFSQWEW | KIRP |
| ZNF519 | c.1291C>T | p.H431Y | CKECGKAFNRASHLTQHQRIHTGEK[p.H431Y]YFKCKECGKAFNRGSHLTRHQRIHTG | YFKCKECGK, QRIHTGEKY, RIHTGEKYF, RIHTGEKYFK, HTGEKYFKCK, KYFKCKECGK, HQRIHTGEKY, QRIHTGEKYF | KIRC |
| ZNF521 | c.1918G>T | p.G640C | TSLKMMQAVGGAPARPTGEYICNQC[p.G640C]CAKYTSLDSFQTHLKTHLDTVLPKLT | ICNQCCAKY, GEYICNQCC, YICNQCCAKY, CAKYTSLDSF, NQCCAKYTSL, GEYICNQCCA | LUAD |
| ZNF521 | c.809C>A | p.P270H | TQKCSQCEEGFDFPEDLQKHIAECH[p.P270H]HECSPNEDRAALQCVYCHELFVEETS | LQKHIAECHH | LUAD |
| ZNF528 | c.836G>A | p.R279Q | SNLSQHQRIHTGEKPYKCHECDKVF[p.R279Q]QSSSKLLAQHQRIHTGEKPYKCHECDK | KVFQSSSKL, FQSSSKLAQ, KVFQSSSKLA, FQSSSKLAQH, HECDKVFQSS | CRC |
| ZNF534 | c.1749T>A | p.N583K | TGEKPYSCNECGKVFSRNSHLARHR[p.N583K]KIHTGEKPHSCNECGKVFSRNSHLAR | RKIHTGEKPH | GBM |
| ZNF536 | c.1987G>T | p.G663W | RVFRTYHQVVVHSRVHKRDRKGEED[p.G663W]WLHVGLDERRGSGSDQESQSVSRSTT | EEDWLHVGL, DWLHVGLDER, GEEDWLHVGL | LUAD |
| ZNF536 | c.556G>T | p.G186C | PYCDHRAAQKGNLKIHLRTHKLGNL[p.G186C]CKGRGRVREENRLLHELERAILRDK | RTHKLGNLC, RTHKLGNLCK, NLCKGRGRVR | LUAD |
| ZNF559 | c.850G>A | p.E284K | PSSSHLRECVRIYGGERPYTHKEYV[p.E284K]KTFSHSTALFVHMQTQDGEKPYECKA | KTFSHSTAL, THKEYVKTFSH, KEYVKTFSH, VKTFSHSTA, Y VKTFSHSTA, KTFSHSTALF, YTHKEYVKTF, RPYTHKE YVK, VKTFSHSTAL, KEYVKTFSHS | UCEC |
| ZNF563 | c.622del|T | p.W208fs | NLRRHMVVQGGNRPYKCKLCGKAFF[p.W208fs]GPVYYVCMKELTLERNRMNVSSVLKPPLFTVPIEDMRECTLGRNRMNVSSVLKPCLIPVPI* | AFFGPVYYV, VLKPFLFTV, KAFFGPVYY, CMKELTLER, FFGPV YYVC, VYYVCMKEL, SSVLKPFLF, CGKAFFGPV, GKAFFGPVY, FTVPIEDMR, KPPLFTVPI, NVSSVLKPF, KAFFGPVYYV, SVLK PFLFTV, FLFTVPIEDM, FFGPVYYVCM, YYVCMKELTL, VSSV LKPFLF, CGKAFFGPVY, GKAFFGPVYY, NVSSVLKPFL, MNVS SVLKPF, KELTLERNRM, LKPFLFTVPI | GBM |
| ZNF563 | c.78G>T | p.K26N | MDAVAFEDVAVNFTQEEWALLGPSCTI[p.K26N]NNLYRYVMQETIRNLDCIRMIWEEQN | PSQNNLYRY, LLGPSQNNL, SQNNLYRYV, LGPSQNN LY, QNNLYRYVM, ALLGPSQNNL, LLGPSQNNLY, SQNN LYRYVM, GPSQNNLYRY | CRC |
| ZNF573 | c.1049G>T | p.R350I | TGKKPYECKECGKGYTTASFLLHQ[p.R350I]IIHKGGKPYECKECKKTFLYRNLTR | FLLHQIIHK, SYFLLHQII, HQIIHKGGK, IIHKGGKPY, ASYFLLH QI, QIIHKGGKPY, TASYFLLHQI, ASYFLLHQII | CRC |
| ZNF578 | c.931G>A | p.G311S | PYKCNECGKSFSYKSSLTCHRRCHT[p.G311S]SEKPYKCNECGKSFSYKSSLTCHRC | CHRRCHTSEK | CLL |
| ZNF583 | c.1031G>T | p.R344I | TGERPFECIECGKAFSNGSFLAQHQ[p.R344I]IIHTGEKPYVCNVCGKAFSHRGYLIV | SFLAQHQII, GSFLAQHQI, FLAQHQIIH, FLAQHQIIHT, GSFL AQHQII | CRC |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF585A | c.1473G>T | p.E491D | YMCNKCGKAFTNRSNLITHQKTHTG[p. E491D]DKSYICSKCCGKAFTQRSDLITHQ RIH | HQKTHTGDK, KTHTGDKSY, KTHTGDKSYI, QKTHTGDKSY | CRC |
| ZNF585A | c.1912G>A | p.E638K | KSFTSKSQLLVHQPVHTGEKPYVCA[p.E 638K]KCGKAFSGRSNLSKHQKTHTGEK PYI | VCAKCGKAF, KPYVCAKCGK, YVCAKCGKAF, G EKPYVCAKC | CRC |
| ZNF592 | c.1498C>A | p.P500T | PGSQTGKKQQSTALQASTLAPANLL[p. P500T]TKAVHLANLNLVPHSVAASVTA KSSV | LLTKAVHLA, NLLTKAVHL, TKAVHLANL, NLLTKAVHLA, TLA PANLLTK, LTKAVHLANL, APANLLTKAV | TGCT |
| ZNF592 | c.970A>C | p.K324Q | VTKEDQPGHTKDLSGPTKESSKGSP[p.K 324Q]QMPKSPKSPRSPLEATRKSIKPSD SP | SSKGSPQMPK, QMPKSPKSPR, KESSKGSPQM | TGCT |
| ZNF594 | c.860G>T | p.R287I | TGEKPYECYDCGQMFSQSSHLVPHQ[p. R287I]IIHTGEKPLKCNECEKAFRQHSH LTE | HLVPHQIIH, IIHTGEKPLK, SSHLVPHQII | UCEC |
| ZNF598 | c.74A>G | p.E25G | MAAAGGAEGRRADMEAEAAAAPER[p. E25G]GGGSCVLCCGDLEATALGRCDH PVCY | AEAAAAPERG | ACC, KIRP |
| ZNF608 | c.1393del G | p.A465fs | SAAAAPGSEASFTESRGLQNKNRGG[p. A465fs]PMGKGGGAASMPADEGHPQI VLLRISKPALPPPTKGKTSLQWSWT* | QIVLLRISK, KNRGGPMGK, LLRISKPAL, KPALPPPTK, GPMG KGGGA, PPTKGKTSL, GKKGGAASM, TKGKTSLQW, GKTSL QWSW, DEGHPQIVL, MPADEGHPQ, HPQIVLLRI, VLLRISKP AL, ISKPALPPPT, EGHPQIVLLR, MPADEGHPQI, GPMG KGGGAA, MGKGGGAASM, LQNKNRGGPM, KGKTS LQWSW, DEGHPQIVLL | STAD |
| ZNF611 | c.1169G>T | p.R390I | TGEKPYKCEECDKVFSRKSTIETHK[p.R 390I]IIHTGEKPYRCKVCDTAFTWHSQLA R | RKSTIETHKI | UCEC |
| ZNF625 | c.704G>A | p.R235Q | TGEKPYECSECGKAFHSSTCLHAHK[p.R 235Q]KTHTGEKPYECKQCGKAFVSFNS VRY | STCLHAHKK, SSTCLHAHKK, AHKKTHTGEK | CRC |
| ZNF626 | c.1418A>G | p.K473R | TGEKPYKCEECGKAFKCSSNLTTHK[p.K 473R]RIHTGERPYKCEECGKAFNQSSIL TT | CSSNLTTHKR | LUSC |
| ZNF638 | c.1198G>A | p.D400N | SQADIPIRSPPGIVKASWLPKFSHA[p.D 400N]NAQKMKRLPTPSMMNDYYAAS PRIFP | KPFSHANAQK, HANAQKMKR, FSHANAQKM, WLPKFSHAN A, FSHANAQKMK, KFSHANAQKM | LIHC |
| ZNF644 | c.61G>T | p.G21W | MRSFLQQDVNKTKSRLNVLN[p.G21 W]WLANNMDDLKINTDITGAKEELLDD N | RLNVLNWLA, WLANNMDDL, VLNWLANNM, KSRLNVLN W, SRLNVLNWL, WLANNMDDLK, KSRLNVLNWL, NVLNWL ANNM, TKSRLNVLNW | LUAD |
| ZNF645 | c.460C>T | p.R154C | SLQAHIKRRHKRARKQVTSASLEKV[p.R 154C]CPHIAPPQTEISDIPKRLQDRDHL SY | SLEKVCPHI, LEKVCPHIA | UCEC |
| ZNF649 | c.593G>T | p.R198I | NIEKAHECTDCGKAFLKKSQLTEHK[p.R 198I]IIHTGKKPHVCSLCGKAFYKKYRLT E | SQLTEHKII, IIHTGKKPHV, KKSQLTEHKI, SQLTEHKIIH | UCEC |
| ZNF652 | c.981G>T | p.K327N | VSCNKSFKKLWSLHEHIKIVHGYAE[p.K 327N]NKFSCEICEKKFYTMAHVRKHM VAHT | IVHGYAENK, AENKFSCEI, KIVHGYAENK, IVHGYAENKF, AENKFSCEIC | CRC |

TABLE 8-continued

| gene | cDNA Change | Protein Change | Mutation_Context Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF674 | c.1214G>T | p.R405I | TKENIYECSKCGKSFRGKSHLSVHQ[p.R405I]IHTGEKPYECSICGKTFSGKSHLSV | SHLSVHQI,KSHLSVHQI,KSHLSVHQII,GKSHLSVHQI | UCEC |
| ZNF675 | c.659G>T | p.R220I | TKVNFCKCEECEKAVNQSSKLTKHK[p.R220I]IYTCEKLYKCQECDRTFNQFSNLTE | KLTKHKIY,IIYTCEKLY,SSKLTKHKI,IIYTCEKLYK,SSKLTKHKII,KHKIIYTCEK,KIIYTCEKLY,SKLTKHKIIY,HKIIYTCEKL | UCEC |
| ZNF676 | c.127C>A | p.P43T | PDLIIFLEQGKEPWNMKRHEMVEEP[p.P43T]TVICSHFSQEFWPEQIEDSFQKMIL | HEMVEEPTV,EPTVICSHF,HEMVEEPTVI,EPTVICSHFE | LUSC |
| ZNF677 | c.1352G>T | p.R451I | PGEKPHKCNVCGRAFIQSSSLVEHQ[p.R451I]IHTGEKPYKCNKCDKAFIKRSHLWG | SSLVEHQII,VEHQIIHTG,SLVEHQIIHT | CRC |
| ZNF677 | c.392G>C | p.R131T | FDSLWDYDVKNYKGMPLTCNKNLTH[p.R131T]TKDQQHNKSSIHFSLKQSVSIRDSAH | HTKDQQHNK,CNKNLTHTK | CESC |
| ZNF680 | c.1501C>T | p.R501W | TLANHKRIHAREKPYKCEECGKAFN[p.R501W]WSSHLTRHKKIHTGEKLYKPEKCDNN | FNWSSHLTR,WSSHLTRHKK,AFNWSSHLTR,FNWSSHLTRH | TGCT |
| ZNF687 | c.2573T>G | p.F858C | DTVFTHKPLLSSHFDQHLLPQRVSV[p.F858C]CKCPSCPLLFAQKRTMLEHLKNTHQS | LLPQRVSVC,CKCPSCPLLF | KIRC |
| ZNF699 | c.122G>T | p.R41I | QDSVVFEDVAVDFTQEEWALLDLAQ[p.R41I]INLYRDVMLENFQNLASLGYPLHTPH | LLDLAQINL,DLAQINLYR,LDLAQINLY,AQINLYRDV,QINLYRDVM,WALLDLAQI,LLDLAQINLY,ALLDLAQINL,AQINLYRDVM | CRC |
| ZNF7 | c.1010G>T | p.R337I | TGEKPYRCEECGKAFGQSSSLIHHQ[p.R337I]IIHTGERPYGCRECGKAFSQQSQLVR | SSSLIHHQI,SSLIHHQII,SLIHHQIIHT,QSSSLIHHQI | CRC |
| ZNF70 | c.731G>T | p.R244I | TGKRPYECRECGKDFSRSSSLRKHE[p.R244I]IIHTGERPYQCKECGKSFNQSSGLSQ | SLRKHEIIH,RSSSLRKHEI,EIIHTGERPY | CRC |
| ZNF700 | c.1946C>G | p.S649C | NLRKHGRTHTGEKPYECKQCGKAFR[p.S649C]CASNLQMHERTHTGEKPYECKECEKA | KAFRCASNL,FRCASNLQM,CASNLQMHER,AFRCASNLQM,GKAFRCASNL | CLL |
| ZNF700 | c.1954A>C | p.N652H | KHGRTHTGEKPYECKQCGKAFRSAS[p.N652H]HLQMHERTHTGEKPYECKECEKAFCK | ASHLQMHER,AFRSASHLQ,RSASHLQMH,FRSASHLQM,SASHLQMHER,AFRSASHLQM | CLL |
| ZNF700 | c.1961A>G | p.Q654R | GRTHTGEKPYECKQCGKAFRSASNL[p.Q654R]RMHERTHTGEKPYECKECEKAFCKFS | ASNLRMHER,AFRSASNLR,FRSASNLRM,KAFRSASNLR,SASNLRMHER,AFRSASNLRM | CLL |
| ZNF705A | c.892G>A | p.D298N | GNKIIHTGEKPHACLLCGKAFSLSS[p.D298N]NLR* | AFSLSSNLR,KAFSLSSNLR | CLL |
| ZNF706 | c.23T>A | p.I8N | MARGQQK[p.I8N]NQSQQKNAKKQAGQKKKQGHDQKAAA | QQKNQSQQK,KNQSQQKNAK | BLCA |
| ZNF709 | c.1403G>T | p.R468I | TGEKPYECKQCGKAFSCSSSFRMHE[p.R468I]IIHTGEKPYECKQCGKAFSFSSSFRM | RMHEIIHTG,SFRMHEIIH,SSFRMHEII,SFRMHEIIHT,CSSSFRMHEI,SSFRMHEIIH | UCEC |
| ZNF71 | c.1231G>T | p.V411L | ICKKHFTGRSSLIVHQIVHTGEKPY[p.V411L]LCGECGKAFSQSAYLIEHQRIHTGEK | YLCGECGKA,LCGECGKAF,YLCGECGKAF,GEKPYLCGEC | LUAD |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF711 | c.2211del A | p.L737fs | SVHTKDQPLKCKCRKRGFRQQNELKP.L737fs]NI* | RQQNELKNI | STAD |
| ZNF716 | c.788A>T | p.H263L | EKPYRCECGKAFSWSASLTKHKRI[p.H263L]LTGEKPYTCEERGKVFSRSTLTNYKR | LTKHKRILT, SLTKHKRIL, KHKRILTGEK | LUAD |
| ZNF717 | c.1781A>T | p.N594I | GKSFHCKSFLTIHQRTHAGKKPYEC[p.N594I]IECEKTFINKLNLGIHKRTHTGERPY | YECIECEKTF | MM |
| ZNF717 | c.2530T>A | p.C844S | CRKTFSQKSKLFVHHRTHTGEKPFR[p.C844S]SNECRKTFSQKSGLSIHQRTHTGEKP | RSNECRKTF, KPFRSNECRK, RSNECRKTFS, FRSNECRKTF | MM |
| ZNF717 | c.945G>C | p.W315C | KPSISKSDLMLQCKMPTEEKPYACN[p.W315C]CCEKLFSYKSSLLIHQRIHTGEKPYG | KPYACNCCEK, YACNCCEKLF | MM |
| ZNF750 | c.287_288del CT | p.S96fs | LDPKQTNQPDATAKPASSKSVANGL[p.S96fs]CLRLEASAQLCQGRHQGKPGAASPGNPQVPGTEASPPQGITLQEPSSGSRPRCPACSGRRSSAFCICSSRRAQTQGARQRRGARDTGFTQPHCQGRVFPHQVGLPHSWLPLESRLTFPSTRVST* | RVFPHQVGL, GLPHSWLPL, RLTFPSTRV, SVANGLCLR, SAFCICSSR, HSWLPLESR, SWLPLESRL, GSRPRCPAC, SGRRSSAFC, GARQRRGAR, AFCICSSRR, QTQGARQRR, FTQPHCQGR, PRCPACSG, QPHCQGRVF, FPHQVGLPH, LPLESRLTF, CSGRRSSAF, KSVANGLCL, LRLEASAQL, HQGKPGAAS, RRGARDTGF, HQVGLPHSW, TEASPPQGI, LESRLTFPS, SVANGLCLRL, GLCLRLEASA, CLRLEASAQL, FTQPHCQGRV, KSVANGLCLR, SSAFCICSSR, SAFCICSSRR, MLPLESRLTF, SSGSRPRCPA, GSRPRCPACS, RPRCPACSGR, SGRRSSAFCI, SRRAQTQGA, RAQTQGARQR, RVFPHQVGLP, EASAQLCQGR, TLQEPSSGS R, ESRLTFPSTR, EASPPQGITL, SKSVANGLCL, HQGKPGAAS P, ACSGRRSSAF, RQRGARDTG, QRRGARDTGF, TQPHCQ GRVF, GRVFPHQVGL, HQVGLPHSWL, VGLPHSWLPL, HSW LPLESRL, LESRLTFPST | HNSC |
| ZNF765 | c.761C>T | p.S254L | LLRKHQLIHLGEKQYKCDICGKVFN[p.S254L]LKRYVARHRCHTGEKPYKCNECGKT | KVFNLKRYV, FNLKRYVAR, GKVFNLKRY, KVFNLKRYVA, CG KVFNLKRY, DICGKVFNLK, VFNLKRYVAR, NLKRYVARHR | UCEC |
| ZNF774 | c.1268G>A | p.R423Q | TGERPYKCGECGKSFNQSSHFITHQ[p.R423Q]IHLGDRPYRCPECGKTFNQRSHFLT | FITHQQIHL, QIHLGDRPY, SHFITHQQI, SSHFITHQQI, QQIH LGDRPY, QIHLGDRPYR, SHFITHQQIH | CRC |
| ZNF780A | c.1397G>A | p.R466Q | SNEKPVCRECEMAFRYHCQLIEHS[p.R466Q]QIHTGDKPFECQDCGKAFNRGSSLVQ | HSQIHTGDK, QIHTGDKPF, CQLIEHSQI, QLIEHSQIH, QLIEH SQIHT, SQIHTGDKPF, CQLIEHSQIH | UCEC |
| ZNF782 | c.1450G>T | p.G484W | FNYKSLLIVHQRTHTGEKPFECNEC[p.G484W]WKSFSHMSGLRNHRRTHTGERPYKCD | NECWKSFSH, KPFECNECW, CWKSFSHMSG, FECNECWKSF, NECWKSFSHM, WKSFSHMSGL | LUAD |
| ZNF782 | c.434G>T | p.C145F | KPHNRDINIFRARMMPCKCDIAGSA[p.C145F]FQGLSLMAPHCQYSKEKAHERNVCDK | SAFQGLSLM, KCDIAGSAF, IAGSAFQGL, GSAFQGLSL, FQG LSLMAP, DIAGSAFQGL, CKCDIAGSAF, AGSAFQGLSL, GSAF QGLSLM, SAFQGLSLMA, FQGLSLMAPH | TGCT |
| ZNF782 | c.740A>C | p.K247T | KAFLEKAALVTSNSTHPKGKSYNFN[p.K247T]TFGENKYDKSTFIIPQNMNPEKSHYE | KGKSYNFNT, KSYNFNTFG, GKSYNFNTF, FNTFGENKY, NTF GENKYDK, KGKSYNFNTF | CRC |
| ZNF799 | c.121T>G | p.W41G | IRVDAGHKPHEYQEYGEKRNTRKQF[p.W41G]KTFSYCHSFQTHKISHTGHKPYDCK | KQFGKTFSY, RNTRKQFGK, TRKQFGKTF, KRNTRKQFGK, RK QFGKTFSY, KQFGKTFSYC, GKTFSYCHSF | BLCA |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF799 | c.127A>G | p.T43A | VDAGHKPHEYQEYGEKRNTRKQFWK[p.T43A]APSYCHSFQTHKISHTGHKPYDCKEC | KQFWKAFSY,KAFSYCHSF,NTRKQFWKA,TRKQFWKAF,KAFSYCHSFQ,RKQFWKAFSY,NTRKQFWKAF,WKAFSYCHSF,KQFWKAFSYC | BLCA |
| ZNF799 | c.1357T>C | p.C453R | KAYRISSSLRRHETTHTGEKPYKCK[p.C453R]RGKAFIDFYSFQNHKTTHAGEKPYEC | KPYKCKRGK,KCKRGKAFI,RGKAFIDFY,YCCKRGKAF,KRGKAFIDF,RGKAFIDFYS,KRGKAFIDFY,KPYYCKRGKA,CKRGKAFIDF | TGCT |
| ZNF804B | c.1930_1931 CC>AG | p.P644S | NDIDEDLSFPSYISRFKKHKLIPCS[p.P644S]SHLEFEDERQFNCKSSPCTVGGHSDHG | KLIPCSSHL,IPCSSHLEF,HKLIPCSSH,LIPCSSHLEF,HKLIPCSS,HL | TGCT |
| ZNF814 | c.959_960 GG>AA | p.G320E | KHECGECGKSFSKYVSFSNHQRVHT[p.G320E]EKRPYECGECGKSFSKYASFSNHQRVH | HQRVHTEKR,RVHTEKRPY,RVHTEKRPYE,QRVHTEKRPY | KIRP |
| ZNF814 | c.968C>A | p.P323H | CGECGKSFSKVVSFSNHQRVHTGKR[p.P323H]HYECGECGKSFSKYASFSNHQRVHTE | RVHTGKRHY,RVHTGKRHYE,HQRVHTGKRH,QRVHTGKRHY | KIRP |
| ZNF814 | c.970T>C | p.Y324H | GECGKSFSKVVSFSNHQRVHTGKRP[p.Y324H]HECGECGKSFSKYASFSNHQRVHTEK | RVHTGKRPH,RVHTGKRPHE | TGCT |
| ZNF823 | c.1640G>T | p.R547I | SGEKPYECKECGKAFSMLTCLLRHE[p.R547I]IIHTGEKPYECLQCGKAFTRSRFLRG | WLTCLLRHEI | UCEC |
| ZNF831 | c.146_147 insC | p.A49fs | PGGQASPHLTLGTLGPVLLPPEQGLAPP[p.A49fs]HCVPEGPAHPTVPHGASRGPPAPRPASDGQPRWGQRALHTQPCAAA* | ALHTQPCAA,HGASRGPPA,ASRGPPAPR,RALHTQPCA,DGQPRWGQR,QPRWGQRAL,ALHTQPCAA,RALHTQPCAA,VPEGPAHPTV,GQPRWGQRAL,GQRALHTQPC,RPASDGQPRW | STAD |
| ZNF831 | c.1849C>A | p.Q617K | AREAMAGKGRAGGRKCGQRRLKMFS[p.Q617K]KEKWQVYGDETFKRIYQKMKASPHGG | RLKMFSKEK,MFSKEKWQV,QRRLKMFSK,FSKEKWQVY,LKMFSKEKW,KMFSKEKWQV,GQRRLKMFSK,RRLKMFSKEK,MFSKEKWQVY,RLKMFSKEKW | LUAD |
| ZNF831 | c.2847G>T | p.E949D | QAPRVLSALADNAFSPKYLLRLPQA[p.E949D]DTPLPLPIPWGPRHSQDSLCSSGWPE | RLPQADTPL,PQADTPLPL,LPQADTPLPL,LRLPQADTPL | CRC |
| ZNF831 | c.4178G>A | p.R1393Q | EGDCRQTLGTLSLGTSSRIVREMDK[p.R1393Q]QTVKDISPSAGEHGDCTTHSTAATSG | REMDKQTVK,QTVKDISPSA | SKCM |
| ZNF836 | c.1712T>A | p.I571N | RIHTGEQPYKCNVCGKVFNYSGNLS[p.I571N]NHKRIHTGEKPFQCNECGTVFRNYSC | YSGNLSNHK,FNYSGNLSNH | CLL |
| ZNF836 | c.1822A>C | p.K608Q | QCNECGTVFRNYSCLARHLRIHTGQ[p.K608Q]QPYKCNVCGKVFNDSGNLSNHKRIHT | RIHTGQQPY,GQQPYKCNV,RIHTGQQPYK,LRIHTGQQPY | CLL |
| ZNF836 | c.1889G>T | p.R630I | TGQKPYKCNVCGKVFNDSGNLSNH[p.R630I]IIHTGEKPFQCNECGKVFSYYSCLAR | KIIHTGEKPF | UCEC |
| ZNF836 | c.2561G>T | p.R854I | TGDKPYKCNECGKAFIERSKLVYH[p.R854I]INHTGEKPYKCIECGKAFGRFSCLNK | KLVYHQINH,HQINHTGEK,RSKLVYHQI,INHTGEKPY,KLVYHQINHT,RSKLVYHQIN,INHTGEKPYK,QINHTGEKPY | UCEC |
| ZNF841 | c.2270G>T | p.R757I | TGEMPYKCIECGKVFNSTTTLARH[p.R757I]IIHTGEKPYKCNECGKVFRYRSGLAR | TTTLARHRI | UCEC |

TABLE 8-continued

| gene | cDNA Change | Protein Change | Mutation_Context_Sequence (SEQ ID NOS 81-3798, respectively, in order of appearance) | Peptides (SEQ ID NOS 3799-33502, respectively, in order of appearance) | Exemplary Diseases |
|---|---|---|---|---|---|
| ZNF845 | c.1269G>A | p.M423I | LTRHRRLHTGEKPYKCNDCGKTFSQ[p.M423I]ISSLVYHRRLHTGEKPYKCEECDEAF | FSQISSLVY,KTFSQISSL,QISSLVHR,ISSLVYHR,TFSQISSLV,SQISSLVYH,KTFSQISSLV,SQISSLVHR,QISSLVYHRR,TFSQISSLVY,GKTFSQISSL | CLL |
| ZNF845 | c.2774G>A | p.R925H | AHLACHHRIHTGEKPYKCNECGKTF[p.R925H]HHNSVLVIHKTIHTGEKPYKCNECGK | KTFHHNSVL,GKTFHHNSV,FHHNSVLVI,KTFHHNSVLV,TFHHNSVLVI,CGKTFHHNSV,HHNSVLVIHK,GKTFHHNSVL,FHHNSVLVIH | PRAD |
| ZNF880 | c.1217A>G | p.Q406R | ECKECGK[VFRHKFCLTNHHRMHTGE[p.Q406R]RPYKCNECGKAFRDCSGLTAHLLIHT | HHRMHTGER,HRMHTGERPY | KIRC |
| ZP3 | c.1085_1086insG | p.V362fs | VMSQWSRSASRNRRHVTEEADVTVG[p.V362fs]ATDLPGQEG* | EEADVTVGA,EEADVTVGAT,TEEADVTVGA | KIRC |
| ZPBP | c.460C>T | p.R154C | NFEESMSGIYTCFLEYKPTVEEIVK[p.R154C]CLQLKYAIYAYREPHYYQFTARYHA | IVKCLQLKY,CLQLKYAIY,EEIVKCLQL,CLQLKYAIYA,IVKCLQLKYA,KCLQLKYAIY,VEEIVKCLQL | GBM |
| ZSCAN18 | c.674_675insC | p.P225fs | SSILSDGVYERHMDPLLLPGELASP[p.P225fs]QPGPWSWGDPGTF* | WSWGDPGTF,LASPQPGPW,SPQPGPWSW,GELASPQPG | STAD |
| ZSWIM2 | c.641C>A | p.S214Y | TSMLKCPLCRKEFAPLKLILEEFKN[p.S214Y]YSKLVAAAEKERLDKHLGIPCNNCKQ | KNYSKLVAA,LILEEFKNY,FKNYSKLVA,EEFKNYSKL,ILEEFKNYSK,YSKLVAAAEK,KNYSKLVAAA,KLILEEFKNY,FKNYSKLVAA,LEEFKNYSKL,EEFKNYSKLV | LUAD |
| ZSWIM4 | c.1219G>A | p.E407K | GPSLQPTMAPAPELLQKGSTCITNT[p.E407K]KGWVGHPLDPIGCLCRALLEACRLEE | GSTCITNTK,TKGWVGHPL,KGSTCITNT,NTKGWVGHPL | CESC |
| ZSWIM6 | c.1829delA | p.Q610fs | LAIAIVNTLRRQQQKQLEMFRTQKK[p.Q610fs]SYPIKT* | RTQKKSYPI,TQKKSYPIK,MFRTQKKSY,RTQKKSYPIK,EMFRTQKKSY,FRTQKKSYPI | KICH |
| ZZEF1 | c.89T>C | p.V30A | PSHSSEDEAAAAGEGWGPHQDWAA[p.V30A]ASGTTPGPGVAAPALPPAAALLEPAR | GPHQDWAAA,WAAASGTTPG | ACC |
| ZZZ3 | c.14G>A | p.R5Q | MAAS[p.R5Q]QSTRVTRSTVGLNGLDESFCGRTLRN | MAASQSTRV,ASQSTRVTR,SQSTRVTRST | HNSC |
| ZZZ3 | c.485G>A | p.R162Q | IKSDKESVEQRSTWDNDADFQGTK[p.R162Q]QACRCLILDDCEKREIKVNVSEEGP | KQACRCLIL,GTKQACRCLI,DFQGTKQACR,TKQACRCLIL | LUSC |

Example 5

Recurrent Mutations for Cancer Subtype Specific Immunogenic Compositions.

The Cancer Genome Atlas (TCGA) contains comprehensive large-scale genome sequencing data from tumor samples to catalogue genetic mutations responsible for cancer. Tumor-specific neoantigenic peptides for use in an immunogenic composition can be selected based on a number of criteria. The first criteria is based on gene expression. The fraction of patients (per tumor type) who express the gene at >10 transcripts per million was determined. Estimates assume a random assortment of HLA type vs. mutation status of each gene vs. gene expression (per tumor type). National yearly incidence was used to quantify the population that could be treated with each peptide. Peptides were ranked by expected population. The results of the analysis is shown in Table 9.

TABLE 9

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| RBM14 p.AAAAAAA286del (uc009yrj.2) | VTAASTSYY | 19282 | Pancreatic Cancer | HLA.A01.01<br>HLA.A03.01<br>HLA.A11.01<br>HLA.A26.01<br>HLA.A26.02<br>HLA.A26.03<br>HLA.A29.02<br>HLA.A68.01<br>HLA.A80.01<br>HLA.B15.01<br>HLA.B15.03<br>HLA.B15.17<br>HLA.B58.01 |
| HRAS p.G12D (uc001pv.2)<br>KRAS p.G12D (uc001rgp.1)<br>NRAS p.G12D (uc009wgu.2) | KLVVVGADGV | 16466 | Colorectal Cancer<br>Pancreatic Cancer<br>Uterine Corpus Endometrial Carcinoma | HLA.A02.01<br>HLA.A02.03<br>HLA.A02.06 |
| NRAS p.G12V (uc009wgu.2)<br>KRAS p.G12V (uc001rgp.1) | KLVVVC-3AVGV | 13995 | Colorectal Cancer<br>Lung Adenocarcinorna<br>Pancreatic Cancer<br>Uterine Corpus Endometrial Carcinoma | HLA.A02.01<br>HLA.A02.03<br>HLA.A02.06 |
| NRAS p.G12V (uc009wgu.2)<br>KRAS p.G12V (uc001rgp.1) | VVGAVGVGK | 11278 | Colorectal Cancer<br>Lung Pancreatic Cancer Adenocarcinorna<br>Uterine Corpus Endometrial Carcinoma | HLA.A03.01<br>HLA.A11.01 |
| KRAS p.G12C (uc001rgp.1)<br>NRAS p.G12C (uc009wgu.2)<br>HRAS p.G12C (uc001pv.2) | KLVVVGACGV | 7538 | Colorectal Cancer<br>Lung Adenocarcinoma | HLA.A02.01<br>HLA.A02.03<br>HLA.A02.06 |
| KRAS p.G12C (uc001rgp.1)<br>NRAS p.G12C (uc009wgu.2)<br>HRAS p.G12C (uc001pv.2) | VVGACGVGK | 5751 | Colorectal Cancer<br>Lung Adenocarcinoma | HLA.A03.01<br>HLA.A11.01 |
| NRAS p.G12V (uc009wgu.2)<br>KRAS p.G12V (uc001rgp.1) | VVVGAVGVGK | 5535 | Colorectal Cancer<br>Lung Adenocarcinoma<br>Pancreatic Cancer | HLA.A11.01<br>HLA.A68.01 |
| TP53 p.R248W (uc002gim.2) | GMNWRPILTI | 5006 | Breast Cancer<br>Colorectal Cancer<br>Pancreatic Cancer | HLA.A02.01<br>HLA.A02.03 |
| PIK3CA p.E542K (uc003fjk.2) | AISTRDPLSK | 4852 | Bladder Cancer<br>Breast Cancer | HLA.A03.01<br>HLA.A11.01 |
| FRG1B p.l10T (uc010ztl.1) | KLSDSRTAL | 4782 | Prostate Cancer | HLA.A02.01<br>HLA.A02.02<br>HLA.A02.03<br>HLA.B07.02<br>HLA.B15.03 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| GATA3 p.H435fs (uc001ijz.2) | KIfV1FATLQR | 4535 | Breast Cancer | HLA.A03.01<br>HLA.A11.01<br>HLA.A30.01<br>HLA.A31.01<br>HLA.A68.01 |
| HRAS p.G12D (uc001lpv.2)<br>KRAS p.G12D (uc001rgp.1)<br>NRAS p.G12D (uc009wgu.2) | VVGADGVGK | 4530 | Colorectal Cancer<br>Pancreatic ancer | HLA.A11.01 |
| NRAS p.Q61R (uc009wgu.2)<br>KRAS p.Q61R (uc001rgp.1)<br>HRAS p.Q61R (uc001lpv.2) | ILDTAGREEY | 4433 | Melanoma<br>Thyroid Cancer | HLA.A01.01 |
| NRAS p.Q61K (uc009wgu.2)<br>HRAS p.Q61K (uc001lpv.2)<br>KRAS p.Q61K (uc001rgp.1) | ILDTAGKEEY | 4203 | Colorectal Cancer<br>Melanoma | HLA.A01.01 |
| GATA3 p.H435fs (uc001ijz.2) | MLTGPPARV | 4113 | Breast Cancer | HLA.A02.01<br>HLA.A02.02<br>HLA.A02.03<br>HLA.A02.06<br>HLA.A68.02<br>HLA.A69.01 |
| RBM47 p.495_502AAAAAAAA>A (uc003gvc.2) | AAAAVIPTV | 4035 | Pancreatic Cancer | HLA.A02.01<br>HLA.A02.02<br>HLA.A02.03<br>HLA.A02.06<br>HLA.A68.02<br>HLA.A69.01<br>HLA.B15.17 |
| RBM47 p.495_502AAAAAAAA>A (uc003gvc.2) | AAAAAVIPTV | 3864 | Pancreatic Cancer | HLA.A02.01<br>HLA.A02.03<br>HLA.A02.06<br>HLA.A68.02 |
| GATA3 p.H435fs (uc001ijz,2) | YMFLKAESK | 3832 | Breast Cancer | HLA.A03.01<br>HLA.A11.01<br>HLA.A68.01 |
| GATA3 p.H435fs (uc001ijz.2) | SMLTGPPARV | 3718 | Breast Cancer | HLA.A02.01<br>HLA.A02.03<br>HLA.A02.06 |
| GATA3 p.H435fs (uc001ijz.2) | YIVIFLKAESKI | 3718 | Breast Cancer | HLA.A02.01<br>HLA.A02.03<br>HLA.A02.06 |
| GATA3 p.H435fs (uc001ijz.2) | TLQRSSLWCL | 3621 | Breast Cancer | HLA.A02.01<br>HLA.A02.03 |
| AP3S1 p.K41fs (uc003krl.2) | LVSEMKMIN | 3603 | Pancreatic Cancer | HLA.A02.01<br>HLA.A02.02<br>HLA.A02.03<br>HLA.A02.06<br>HLA.A68.02<br>HLA.A69.01 |
| PIK3CA p.H1047R (uc003fjk.2) | FMKQMNDAR | 3582 | Breast Cancer | HLA.A31.01<br>HLA.A33.01<br>HLA.A68.01 |
| KRAS p.Q61L (uc001rgp.1)<br>NRAS p.Q61L (uc009wgu.2)<br>HRAS p.Q61L (uc001lpv.2) | LLDILDTAGL | 3563 | Colorectal Cancer<br>Lung Adenocarcinoma<br>Melanoma | HLA.A02.01<br>HLA.A02.03<br>HLA.A02.06 |
| GATA3 p.H435fs (uc001ijz.2) | FATLQRSSL | 3551 | Breast Cancer | HLA.B07.02<br>HLA.B08.01<br>HLA.B39.01 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| AP3S1 p.K41fs (uc003krl.2) | HINSEMKMFV | 3524 | Pancreatic Cancer | HLA.A02.01<br>HLA.A02.03<br>HLA.A02.06<br>HLA.A68.02 |
| FRG1B p.L52S (uc010ztl.1) | ALSASNSCH | 3502 | Prostate Cancer | HLA.A02.01<br>HLA.A02.03<br>HLA.A02.06 |
| FRG1B p.L52S (uc010ztl.1) | FQNGKMALSA | 3502 | Prostate Cancer | HLA.A02.01<br>HLA.A02.03<br>HLA.A02.06 |
| RBM14 p.AAAAAAA286del (uc009yrj.2) | AVTAASTSY | 3477 | Pancreatic Cancer | HLA.A26.02<br>HLA.A29.02<br>HLA.615.01<br>HLA.B15.03<br>HLA.B15.17 |
| KRAS p.G12R (ruc001rgp.1)<br>NRAS p.G12R (uc009wgu.2) | VVGARGVGK | 3176 | Pancreatic Cancer | HLA.A03.01<br>HLA.A11.01 |
| PIK3CA p.E545K (uc003fjk.2) | SEITKQEKDF | 3090 | Breast Cancer | HLA.B44.02 |
| FRG1B p.A53T (uc010ztl.1) | LLTSNSCFI | 3016 | Prostate Cancer | HLA.A02.01<br>HLA.A02.02<br>HLA.A02.03<br>HLA.A02.06 |
| FRG1B p.A53T (uc010ztl.1) | ALLTSNSCH | 2959 | Prostate Cancer | HLA.A02.01<br>HLA.A02.03<br>HLA.A02.06 |
| FRG1B p.I10T (uc010ztl.1) | RTALKSGYGK | 2787 | Prostate Cancer | HLA.A03.01<br>HLA.A11.01<br>HLA.A68.01 |
| FRG1B p.A50P (uc010ztl.1) | FQNGKMPLL | 2781 | Prostate Cancer<br>Melanoma | HLA.A02.01<br>HLA.A02.02<br>HLA.A02.03<br>HLA.A02.06<br>HLA.B15.03<br>HLA.B39.01 |
| PIK3CA p.H1047L (uc003fik.2) | FMKQMNDAL | 2610 | Breast Cancer | HLA.A02.01<br>HLA.A02.02<br>HLA.A02.03<br>HLA.A02.06<br>HLA.B08.01<br>HLA.B15.01<br>HLA.B15.03 |
| KRAS p.Q61L (uc001rgp.1)<br>NRAS p.Q61L (uc009wgu.2)<br>HRAS p.Q61L (uc0011pv.2) | ILDTAGLEEY | 2555 | Colorectal Cancer<br>Lung Adenocarcinoma<br>Melanoma | HLA.A01.01 |
| FRG1B p.A113 (uc010ztl.1) | ITLKSGYGIK | 2523 | Prostate Cancer<br>Melanoma | HLA.A03.01<br>HLA.A11.01<br>HLA.A30.01<br>HLA.A31.01<br>HLA.A68.01 |
| ANAPC1 p.T537A (uc002thi.2) | VSAPKPLSK | 2521 | Pancreatic Cancer<br>Prostate Cancer | HLA.A03.01<br>HLA.A11.01<br>HLA.A30.01 |
| GATA3 p.H435fs (uc001ijz.2) | FLKAESKIIVI | 2496 | Breast Cancer | HLA.A02.03<br>HLA.B08.01<br>HLA.B15.01<br>HLA.B15.03 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| FRG1B p.A50P (uc010ztl.1) | FQNGKMPLLA | 2486 | Prostate Cancer Melanoma | HLA.A02.01 HLA.A02.03 HLA.A02.06 |
| PIK3CA p.H1047R (uc003fik.2) | YFIVIKQMNDAR | 2478 | Breast Cancer | HLA.A33.01 HLA.A68.01 |
| GATA3 p.S408fs (uc001ijz.2) | AIQPVLWTT | 2371 | Breast Cancer | HLA.A02.01 HLA.A02.02 HLA.A02.06 |
| RBM1.4 p.AAAAAAA286del (uc009yrj.2) | AVTAASTSYY | 2363 | Pancreatic Cancer | HLA.A11.01 |
| FRG1B p.I10T (uc010ztl.1) | KLSDSRTALK | 2356 | Prostate Cancer | HLA.A03.01 HLA.A11.01 |
| FRG1B p.A11T (uc010ztl.1) | KLSDSRITL | 2328 | Prostate Cancer Melanoma | HLA.A02.01 HLA.A02.02 HLA.A02.03 HLA.A02.06 HLA.B15.03 |
| ANAPC1 p.T537A uc002thi.2) | GVSAPKPLSK | 2260 | Pancreatic Cancer Prostate Cancer | HLA.A03.01 HLA.A11.01 |
| TP53 p.Y220C (uc002gim.2) | VVVPCEPPEV | 2200 | Breast Cancer | HLA.A02.01 HLA.A02.06 |
| TP53 p.R248W (uc002gim.2) | SSCMGGMNWR | 2135 | Colorectal Cancer | HLA.A11.01 HLA.A68.01 |
| KRAS p.G12R (uc001rgp.1) NRAS p.G12R (uc009wgu.2) | GARGVGKSAL | 2075 | Pancreatic Cancer | HLA.B07.02 |
| RAC1 p.P29S (uc003spx.2) | TTNAFSGEY | 2042 | Melanoma | HLA.A01.01 HLA.A11.01 HLA.A25.01 HLA.A26.01 HLA.A26.02 HLA.A26.03 HLA.A29.02 HLA.A68.01 HLA.A80.01 HLA.B15.01 HLA.B15.03 HLA.B15.17 |
| GATA3 p.H435fs (uc001ijz.2) | GPPARVPAV | 2039 | Breast Cancer | HLA.B07.02 |
| GATA3 p.H435fs (uc001ijz.2) | KPKRDGYMF | 2039 | Breast Cancer | HLA.B07.02 |
| GATA3 p.H435fs (uc001ijz.2) | KPKRDGYMEL | 2039 | Breast Cancer | HLA.B07.02 |
| KRAS p.G12A (uc001rgp.1) HRAS p.G12A (uc001lpv.2) NRAS p.G12A (uc009wgu.2) | KLVVVGAAGV | 2034 | Colorectal Cancer Lung Adenocarcinoma | HLA.A02.01 HLA.A02.03 HLA.A02.06 |
| SPOP p.F133L (uc002ipg.2) | FVQGKDWGL | 2002 | Prostate Cancer | HLA.A02.01 HLA.A02.02 HLA.A02.03 HLA.A02.06 HLA.A68.02 HLA.A69.01 |
| GATA3 p.H435fs (uc001ijz.2) | CSMLTGPPAR | 1995 | Breast Cancer | HLA.A11.01 HLA.A33.01 HLA.A68.01 |
| WASH3P p.G175S (uc002cdi.2) WASH2P p.G175S (uc002tkh.2) | SIRAAGGISK | 1978 | Prostate Cancer Melanoma | HLA.A03.01 HLA.A11.01 |
| ARFGAP3 p.N299fs (uc003bdd.2) | EIAEVLFHI | 1959 | Prostate Cancer | HLA.A02.01 HLA.A02.02 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| | | | | HLA.A02.03 |
| | | | | HLA.A02.06 |
| | | | | HLA.A26.02 |
| | | | | HLA.A26.03 |
| | | | | HLA.A68.02 |
| | | | | HLA.A69.01 |
| GATA3 p.S408fs (uc001ijz.2) | ALQPLQPHA | 1906 | Breast Cancer | HLA.A02.01 |
| | | | | HLA.A02.02 |
| | | | | HLA.A02.03 |
| ARFGAP3 p.N299fs (uc003bdd.2) | SAWDLEIAEV | 1892 | Prostate Cancer | HLA.A02.01 |
| | | | | HLA.A02.06 |
| | | | | HLA.A68.02 |
| FRG1B p.I59V (uc010ztl.1) | LLASNSCFV | 1824 | Prostate Cancer | HLA.A02.01 |
| FRG1 p.I157V (uc003izs.2) | | | Melanoma | HLA.A02.02 |
| | | | | HLA.A02.03 |
| | | | | HLA.A02.06 |
| | | | | HLA.A68.02 |
| | | | | HLA.A69.01 |
| ARFGAP3 p.N299fs (uc003bdd.2) | KMLTQTDSA | 1818 | Prostate Cancer | HLA.A02.01 |
| | | | | HLA.A02.02 |
| | | | | HLA.A02.03 |
| | | | | HLA.A02.06 |
| PTH2 p.L22del (uc002pnn.1) | LLLLLLLLV | 1807 | Prostate Cancer | HLA.A02.01 |
| CTSA p.L37del (uc002xqh.2) | | | | HLA.A02.02 |
| AGPAT2 p.17_18insL (uc004cii.1) | | | | HLA.A02.03 |
| | | | | HLA.A02.06 |
| TP53 p.R2480 (uc002gim.2) | SSCMGGMNQR | 1795 | Bladder Cancer | HLA.A11.01 |
| | | | | HLA.A68.01 |
| KRAS p.G12(2 (uc001rgp.1) | VVVGACGVGK | 1785 | Colorectal Cancer | HLA.A11.01 |
| NRAS p.G12C (uc009wgu.2) | | | Lung | |
| HRAS p.G12C (uc001lpv.2) | | | Adenocarcinorna | |
| PiK3CA p.N345K (uc003fjk.2) | KILCATYVK | 1776 | Breast Cancer | HLA.A03.01 |
| | | | | HLA.A11.01 |
| | | | | HLA.A30.01 |
| | | | | HLA.A31.01 |
| FRG1B p.A11T (uc010ztl.1) | KLSDSRITLK | 1749 | Prostate Cancer | HLA.A03.01 |
| | | | | HLA.A11.01 |
| FRG1B p.A11T (uc010ztl.1) | RITLKSGYGK | 1749 | Prostate Cancer | HLA.A03.01 |
| | | | | HLA.A11.01 |
| GATA3 p.H435fs (uca11ijz.2) | AVPFDLHFCR | 1749 | Breast Cancer | HLA.A11.01 |
| | | | | HLA.A68.01 |
| PIK3CA p.E542K (uc003fjk.2) | ISTRDPLSK | 1746 | Breast Cancer | HLA.A11.01 |
| TP53 p.G245S (uc002gim.2) | SSCMGSMNR | 1732 | Colorectal Cancer | HLA.A11.01 |
| | | | | HLA.A31.01 |
| | | | | HLA.A68.01 |
| GATA3 p.H435fs (uca11ijz.2) | AESKIMFATL | 1731 | Breast Cancer | HLA.B40.01 |
| | | | | HLA.B44.02 |
| AKT1 p.E17K (uc001ypk.2) | WLHKRGKYIK | 1717 | Breast Cancer | HLA.A03.01 |
| AKT2 p.E17K (uc002onf.2) | | | | |
| PIK3CA p.N345K (uc003fjk.2) | ILCATYVKV | 1715 | Breast Cancer | HLA.A02.01 |
| | | | | HLA.A02.02 |
| | | | | HLA.A02.03 |
| | | | | HLA.A02.06 |
| FRG1B p.I59V (uc010ztl.1) | ALLASNSCFV | 1698 | Prostate Cancer | HLA.A02.01 |
| FRG1 p.I157V (uc003izs.2) | | | Melanoma | HLA.A02.03 |
| | | | | HLA.A02.06 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| FRG1B p.L52S (uc010ztl.1) | SASNSCFIR | 1685 | Prostate Cancer | HLA.A11.01<br>HLA.A31.01<br>HLA.A33.01<br>HLA.A68.01 |
| PIK3CA p.N345K (uc003fjk.2) | KILCATYVKV | 1679 | Breast Cancer | HLA.A02.01<br>HLA.A02.03<br>HLA.A02.06 |
| AP3S1 p.K41fs (uc003krl.2) | ETFHLVSEM | 1635 | Pancreatic Cancer | HLA.A25.01<br>HLA.A26.01<br>HLA.A26.02<br>HLA.A26.03<br>HLA.A68.01<br>HLA.A68.02<br>HLA.A69.01<br>HLA.B15.17 |
| PIK3CA p.N345K (uc003fik.2) | KVNIRDIDK | 1620 | Breast Cancer | HLA.A03.01<br>HLA.A11.01<br>HLA.A30.01 |
| KRAS p.G12A (uc00irgp.1)<br>HRAS p.G12A (uc001lpv.2)<br>NRAS p.G12A (uc009wgu.2) | VVGAAGVGK | 1613 | Colorectal Cancer<br>Lung Adenocarcinoma | HLA.A03.01<br>HLA.A11.01 |
| CDC27 p.D555E (uc002ile.3) | TLWHLOKEV | 1577 | Colorectal Cancer | HLA.A02.01<br>HLA.A02.02<br>HLA.A02.03<br>HLA.A02.06 |
| GATA3 p.H435fs (uc00lijz.2) | ESKIMFATL | 1573 | Breast Cancer | HLA.A68.02<br>HLA.B08.01 |
| TP53 p.P75fs (uc002gim.2) | KPTRAATVSV | 1536 | Colorectal Cancer | HLA.B07.02 |
| CTNNB1 p.T41A (uc010hla.1) | ATAPSLSGK | 1536 | Prostate Cancer | HLA.A03.01<br>HLA.A11.01<br>HLA.A30.01<br>HLA.A31.01<br>HLA.A68.01 |
| CDC27 p.D555E (uc002ile.3) | HLQKEVALSV | 1530 | Colorectal Cancer | HLA.A02.01<br>HLA.A02.03<br>HLA.A02.06 |
| PIK3CA p.H1047L (uc003fik.2) | ALHGGWTTK | 1513 | Breast Cancer | HLA.A03.01<br>HLA.A11.01<br>HLA.A30.01 |
| UBC p.R73L (uc002gyy.3) | RLRGGMOIFV | 1474 | Prostate Cancer | HLA.A02.01<br>HLA.A02.03<br>HLA.A02.06 |
| PEX1 p.I370fs (uc003uly.2) | KMRRPVCYK | 1456 | Prostate Cancer | HLA.A03.01<br>HLA.A11.01<br>HLA.A30.01 |
| TP53 p.C238Y (uc002gim.2) | TTIHYNYMY | 1454 | Colorectal Cancer | HLA.A31.01<br>HLA.A01.01<br>HLA.A11.01<br>HLA.A25.01<br>HLA.A26.01<br>HLA.A26.02<br>HLA.A26.03<br>HLA.A29.02<br>HLA.A68.01<br>HLA.A80.01<br>HLA.B15.17 |
| ANAPC1 p.T537A (uc002thi.2) | APKPLSKLL | 1449 | Pancreatic Cancer | HLA.B07.02<br>HLA.A11.01<br>HLA.A31.01 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| FRG1B p.A53T (uc010ztl.1) | LTSNSCFIR | 1447 | Prostate Cancer | HLA.A33.01<br>HLA.A68.01 |
| RNF43 p.G659fs (uc002iwf.2) | TQLARFFPI | 1442 | Colorectal Cancer<br>Prostate Cancer | HLA.A02.01<br>HLA.A02.02<br>HLA.A02.03<br>HLA.A02.06<br>HLA.A23.01<br>HLA.A30.01<br>HLA.A31.01<br>HLA.A69.01<br>HLA.B08.01<br>HLA.B08.03<br>HLA.B15.03<br>HLA.B38.01<br>HLA.B39.01<br>HLA.B40.01<br>HLA.B40.02 |
| AP3S1 p.K41fs (uc003krl.2) | EIFFILVSEMK | 1440 | Pancreatic Cancer | HLA.A11.01<br>HLA.A68.01 |
| PIK3CA p.H1047R (uc003fjk.2) | ARHGGWTTK | 1426 | Breast Cancer | HLA.B27.05 |
| PIK3CA p.H1047R (uc003fjk.2) | ARHGGWTTKM | 1426 | Breast Cancer | HLA.B27.05 |
| GATA3 p.S408fs (uc001ijz.2) | QPVLWITPPL | 1421 | Breast Cancer | HLA.B07.02 |
| FRG1B p.A50P (uc010ztl.1) | MPLLASNSCF | 1374 | Prostate Cancer | HLA.B07.02 |
| WASH3P p.G175S (uc002cdi.2)<br>WASH2P p.G175S (uc002tkh.2) | ISKAKLRSM | 1337 | Prostate Cancer<br>Melanoma | HLA.A30.01<br>HLA.B08.01<br>HLA.B15.17 |
| HRAS p.G13R (uc001lpv.2)<br>NRAS p.G13R (uc009wgu.2) | VVGAGRVGK | 1324 | Colorectal Cancer | HLA.A03.01<br>HLA.A11.01<br>HLA.A30.01 |
| ACADS p.R330H (uc001tza.3) | RLLTWHAAM | 1321 | Prostate Cancer | HLA.A02.01<br>HLA.A02.02<br>HLA.A02.03<br>HLA.A02.06<br>HLA.B08.01<br>HLA.B15.01<br>HLA.B15.03<br>HLA.B15.17 |
| HRAS p.G12D (uc001lpv.2)<br>KRAS p.G12D (uc001rgp.1)<br>NRAS p.G12D (uc009wgu.2) | LVVVGADGV | 1284 | Pancreatic Cancer | HLA.A02.06<br>HLA.A68.02<br>HLA.A69.01 |
| KRAS p.G12S (uc001rgp.1)<br>HRAS p.G12S (uc001lpv.2)<br>NRAS p.G12S (uc009wgu.2) | KLVVVGASGV | 1278 | Colorectal Cancer | HLA.A02.01<br>HLA.A02.03<br>HLA.A02.06 |
| TP53 p.A159V (uc002gim.2) | RVRVMAIYK | 1271 | Bladder Cancer | HLA.A03.01<br>HLA.A11.01<br>HLA.A30.01<br>HLA.A31.01 |
| HLA-A p.Q78R (uc003nol.2) | IEREGPEYW | 1271 | Prostate Cancer | HLA.B44.02<br>HLA.B44.03 |
| GATA3 p.H435fs (uc001ijz.2) | LQRSSLWCL | 1248 | Breast Cancer | HLA.A02.06<br>HLA.B15.01<br>HLA.B15.03 |
| ZMIZ2 p.VAAAAATATATATAT153del (uc003tlr.2) | ALQEKQSCIEL | 1226 | Pancreatic Cancer | HLA.A02.01<br>HLA.A02.03 |
| GIGYF2 p.Q1005del (uc002vtj.3) | KLSGWGNVSK | 1204 | Pancreatic Cancer | HLA.A03.01<br>HLA.A11.01 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| FRG1B p.L52S (uc010ztl.1) | LSASNSCFIR | 1190 | Prostate Cancer | HLA.A11.01<br>HLA.A68.01 |
| AKT1 p.E17K (uc001ypk.2)<br>AKT2 p.E17K (uc002onf.2) | WLHKRGKYI | 1172 | Breast Cancer | HLA.A02.03<br>HLA.B08.01 |
| PEX1 p.I370fs (uc003uly.2) | KLGQIIMKK | 1165 | Prostate Cancer | HLA.A03.01<br>HLA.A11.01 |
| RAC1 p.P29S (uc003spx.2) | FSGEYIPTV | 1152 | Melanoma | HLA.A02.01<br>HLA.A02.02<br>HLA.A02.03<br>HLA.A02.06<br>HLA.A68.02<br>HLA.A69.01 |
| GATA3 p.H435fs (uc001ijz.2) | IMKPKRDGY | 1151 | Breast Cancer | HLA.B15.01<br>HLA.B15.03 |
| AEBP1 p.K1133del (uc003tkb.2) | EEEIATGQAF | 1143 | Pancreatic Cancer | HLA.B44.02<br>HLA.A03.01 |
| FBXW7 p.R465H (uc003ims.2) | TVHCMHLHEK | 1142 | Colorectal Cancer | HLA.A11.01<br>HLA.A68.01 |
| TSPAN4 p.L92V (uc001lsd.1) | LTFFLLLLV | 1140 | Prostate Cancer | HLA.A02.01<br>HLA.A02.02<br>HLA.A02.03<br>HLA.A02.06<br>HLA.A68.02<br>HLA.A69.01<br>HLA.B15.17 |
| TP53 p.R158L (uc002gim.2) | RVLAMAIYK | 1136 | Lung Squamous Cell Carcinoma | HLA.A03.01<br>HLA.A11.01<br>HLA.A30.01<br>HLA.A31.01<br>HLA.A68.01 |
| NRAS p.G12V (uc009wgu.2)<br>KRAS p.G12V (uc001rgp.1) | LVVVGAVGV | 1130 | Pancreatic Cancer | HLA.A02.03<br>HLA.A02.06<br>HLA.A68.02<br>HLA.A69.01 |
| GATA3 p.S408fs (uc001ijz.2) | HMSSLSHISA | 1127 | Breast Cancer | HLA.A02.01<br>HLA.A02.03<br>HLA.A02.06 |
| CTNNB1 p.S37F (uc010hia.1) | YLDSGIHFG | 1121 | Uterine Corpus Endometrial Carcinoma | HLA.A02.01<br>HLA.A02.02<br>HLA.A02.06 |
| CTNNB1 p.S37F (uc010hia.1) | YLDSGIHFGA | 1120 | Uterine Corpus Endometrial Carcinoma | HLA.A02.01<br>HLA.A02.03<br>HLA.A02.06 |
| CTNNB1 p.S37C (uc010hia.1) | YLDSGIHCGA | 1111 | Uterine Corpus Endometrial Carcinoma | HLA.A02.01<br>HLA.A02.03<br>HLA.A02.06 |
| SF3B1 p.K700E (uc002uue.2) | GLVDEQQEV | 1099 | Breast Cancer | HLA.A02.01<br>HLA.A02.02<br>HLA.A02.03<br>HLA.A02.06 |
| KRAS p.G12R (uc001rgp.1)<br>NRAS p.G12R (uc009wgu.2) | VVVGARGVGK | 1082 | Pancreatic Cancer | HLA.A11.01 |
| EGFR p.L858R (uc003tqk.2) | KITDFGRAK | 1054 | Lung Adenocarcinoma | HLA.A03.01<br>HLA.A11.01<br>HLA.A30.01 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| TP53 p.E271K (uc002gim.2) | NLLGRNSFK | 1046 | Bladder Cancer | HLA.A03.01<br>HLA.A11.01<br>HLA.A68.01 |
| TSPAN4 p192V (uc001lsd.1) | FLLLLVVFL | 1044 | Prostate Cancer | HLA.A02.01<br>HLA.A02.02<br>HLA.A02.03<br>HLA.A02.06 |
| TSPAN4 p.L92V (uc001lsd.1) | LLVVELLEA | 1044 | Prostate Cancer | HLA.A02.01<br>HLA.A02.02<br>HLA.A02.03<br>HLA.A02.06 |
| TSPAN4 p.L92V (uc001lsd.1) | LLLLVVFLL | 1030 | Prostate Cancer | HLA.A02.01<br>HLA.A02.02<br>HLA.A02.06 |
| TSPAN4 p.L92V (uc001lsd.1) | FLLLLVVFLL | 1027 | Prostate Cancer | HLA.A02.01<br>HLA.A02.03<br>HLA.A02.06 |
| TSPAN4 p.L92V (uc001lsd.1) | LLLVVFLLEA | 1027 | Prostate Cancer | HLA.A02.01<br>HLA.A02.03<br>HLA.A02.06 |
| TSPAN4 p.L92V (uc001lsd.1) | LLTFFLLLLV | 1027 | Prostate Cancer | HLA.A02.01<br>HLA.A02.03<br>HLA.A02.06 |
| ARFGAP3 p.N299fs (uc003bdd.2) | LEIAEVLFHI | 1024 | Prostate Cancer | HLA.B40.01<br>HLA.B44.02 |
| FRG1B p.I10T (uc010ztl.1) | TALKSGYGK | 1020 | Prostate Cancer | HLA.A11.01<br>HLA.A68.01 |
| RBM14 p.AAAAAAA286del (uc009yrj.2) | ATAAAVTAA | 1020 | Pancreatic Cancer | HLA.A02.02<br>HLA.A02.03<br>HLA.A02.06<br>HLA.A68.02<br>HLA.A69.01 |
| KRAS p.G12S (uc001rgp.1)<br>HRAS p.G12S (uc001lpv.2)<br>NRAS p.G12S (uc009wgu.2) | VVGASGVG K | 1019 | Colorectal Cancer | HLA.A03.01<br>HLA.A11.01 |
| UBC p.L149R (uc002gyy.3) | STLHLVLRR | 1014 | Prostate Cancer | HLA.A11.01<br>HLA.A31.01<br>HLA.A33.01<br>HLA.A68.01 |
| PIK3CA p.N345K (uc003fjk.2) | ATYV KV N IR | 1007 | Breast Cancer | HLA.A11.01<br>HLA.A31.01<br>HLA.A33.01<br>HLA.A68.01 |
| ERBB3 p.V104M (uc001sjh.2) | RMVRETOVY | 990 | Colorectal Cancer | HLA.A03.01<br>HLA.A29.02<br>HLA.A80.01<br>HLA.B15.01<br>HLA.B15.03<br>HLA.B15.17 |
| GATA3 p.H435fs (uc001ijz.2) | AESKIMFAT | 984 | Breast Cancer | HLA.B40.01<br>HLA.B40.02<br>HLA.B45.01 |
| FRG1B p.L52S (uc01ztl.1) | ALSASNSCF | 982 | Prostate Cancer | HLA.B15.01<br>HLA.B15.03 |
| TP53 p.E271K (uc002gim.2) | LLGRNSFKV | 978 | Bladder Cancer | HLA.A02.01<br>HLA.A02.02<br>HLA.A02.03<br>HLA.A02.06 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| TP53 p.E271K (uc002gim.2) | NLLGRNSFKV | 969 | Bladder Cancer | HLA.A02.01<br>HLA.A02.03<br>HLA.A02.06 |
| FRG1B p.A11T (uc010ztl.1) | TLKSGYGKY | 969 | Prostate Cancer | HLA.A26.02<br>HLA.A29.02<br>HLA.B15.01<br>HLA.B15.03 |
| NFE2L2 p.E79Q (uc002ulh.3) | QLDEQTGEFL | 966 | Lung Squamous Cell Carcinoma | HLA.A02.01<br>HLA.A02.06 |
| TP53 p.K132N (uc002gim.2) | ALNNMFCQL | 955 | Bladder Cancer | HLA.A02.01<br>HLA.A02.02<br>HLA.A02.03<br>HLA.A02.06<br>HLA.B15.01<br>HLA.B15.03 |
| MAP2K1 p.P124S (uc010bhq.2) | NSSYIVGFY | 943 | Melanoma | HLA.A01.01<br>HLA.A26.01<br>HLA.A26.02<br>HLA.A29.02<br>HLA.A68.01<br>HLA.A80.01<br>HLA.B15.03<br>HLA.B15.17 |
| TSPAN9 p.S50L (uc001qlp.2) | ATESPSFPL | 937 | Melanoma | HLA.A02.01<br>HLA.A02.02<br>HLA.A02.03<br>HLA.A02.06<br>HLA.A11.01<br>HLA.A30.01<br>HLA.A31.01<br>HLA.A68.02<br>HLA.A69.01<br>HLA.B15.03<br>HLA.B15.17<br>HLA.B58.01 |
| SF361 p.K700E (uc002uue.2) | QEVRTISAL | 936 | Breast Cancer | HLA.B15.03<br>HLA.B39.01<br>HLA.B40.01<br>HLA.B40.02<br>HLA.B44.02<br>HLA.B44.03 |
| ZNF91 p.R333H (uc002nre.2) | FSHSSTLAK | 907 | Prostate Cancer | HLA.A03.01<br>HLA.A11.01<br>HLA.A30.01<br>HLA.A68.01 |
| FNBP4 p.TT58del (uc009ylv.2) | APSAATTTA | 905 | Prostate Cancer | HLA.B07.02 |
| FNBP4 p.TT58del (uc009ylv.2) | APSAATTTVA | 905 | Prostate Cancer | HLA.B07.02 |
| RAC1 p.P29S (uc003spx.2) | YTTNAFSGEY | 901 | Melanoma | HLA.A01.01<br>HLA.A68.01 |
| ACADS p.R330H (uc001tza.3) | LTWHAAMLK | 896 | Prostate Cancer | HLA.A03.01<br>HLA.A11.01<br>HLA.A30.01<br>HLA.A31.01<br>HLA.A68.01 |
| TP53 p.C242F (uc002gim.2) | SSFMGGMNR | 889 | Lung Squamous Cell Carcinoma | HLA.A03.01<br>HLA.A11.01<br>HLA.A31.01<br>HLA.A33.01<br>HLA.A68.01 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| CNPY3 p.17_18LL>L (uc003ota.3) | LLLLPAPEL | 878 | Prostate Cancer | HLA.A02.01<br>HLA.A02.02<br>HLA.A02.06 |
| CNPY3 p.17_18LL>L (uc003ota.3) | LLLLLLLLPA | 876 | Prostate Cancer | HLA.A02.01<br>HLA.A02.03<br>HLA.A02.06 |
| CNPY3 p.17_18ll>L (uc003ota.3) | LLLLLLLPA | 876 | Prostate Cancer | HLA.A02.01<br>HLA.A02.03<br>HLA.A02.06 |
| CNPY3 p.17_18LL>L (uc003ota.3) | LLLLLPAPEL | 876 | Prostate Cancer | HLA.A02.01<br>HLA.A02.03<br>HLA.A02.06 |
| ZMIZ2 p.VAAAAATATATATAT153del (uc003tlr.2) | AAAAAVAAL | 855 | Pancreatic Cancer | HLA.A02.02<br>HLA.A02.03<br>HLA.A02.06<br>HLA.A68.02<br>HLA.B07.02<br>HLA.B15.03<br>HLA.B15.17 |
| PODXL p.28_30PSP>P (uc003vqw.3) | SPSPSQNAT | 852 | Prostate Cancer | HLA.B07.02 |
| PODXL p.2830PSP>P (uc003vqw.3) | SPSQNATQTT | 852 | Prostate Cancer | HLA.B07.02 |
| AP3S1 p.K41fs (uc003krl.2) | HLVSEMKMF | 849 | Pancreatic Cancer | HLA.A26.02<br>HLA.B15.01<br>HLA.B15.03 |
| STK19 p.D89N (uc003nyv.2) | NPIFRFSSL | 849 | Melanoma | HLA.A26.02<br>HLA.B07.02<br>HLA.B08.01<br>HLA.B39.01 |
| NUF2 p.S340L (uc001gcq.1) | NLFKRLMIV | 845 | Colorectal Cancer | HLA.A02.01<br>HLA.A02.02<br>HLA.A02.03<br>HLA.A02.06<br>HLA.B08.01 |
| FRG1B p.A53T (uc010ztl.1) | ALLTSNSCF | 833 | Prostate Cancer | HLA.B15.01<br>HLA.B15.03 |
| UBC p.L149R (uc002gyy.3) | LVLRRRGGM | 829 | Prostate Cancer | HLA.B08.01 |
| TP53 p.A159P (uc002gim.2) | RVRPMAIYK | 820 | Lung Adenocarcinoma | HLA.A03.01<br>HLA.A11.01<br>HLA.A30.01<br>HLA.A31.01<br>HLA.A68.01 |
| FRG1B p.K13N (uc010ztl.1) | IALNSGYGK | 791 | Prostate Cancer | HLA.A03.01<br>HLA.A11.01<br>HLA.A30.01<br>HLA.A31.01<br>HLA.A68.01 |
| GATA3 p.H435fs (uc001ijz.2) | VPFDLHFCR | 791 | Breast Cancer | HLA.A33.01<br>HLA.A68.01 |
| UBC p.L149R (uc002gyy.3) | STI.HLVL.RRR | 789 | Prostate Cancer | HLA.A11.01<br>HLA.A33.01<br>HLA.A68.01 |
| ACADS p.R330H (uc001tza.3) | LLTWHAAML | 789 | Prostate Cancer | HLA.A02.01<br>HLA.A02.02<br>HLA.A02.03<br>HLA.A02.06 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| GATA3 p.H435fs (uc001ijz.2) | ATLQRSSLW | 782 | Breast Cancer | HLA.B15.17<br>HLA.B57.01<br>HLA.B58.01 |
| MAP2K1 p.P124S (uc010bhq.2) | VLHECNSSYI | 779 | Melanoma | HLA.A02.01<br>HLA.A02.03<br>HLA.A02.06 |
| ACADS p.R330H (uc001tza.3) | RLLTVVHAAML | 773 | Prostate Cancer | HLA.A02.01<br>HLA.A02.03<br>HLA.A02.06 |
| RXRA p.S427F (uc004cfb.2)<br>RXRG p.S428F (uc001gda.2) | RLPALRFIGL | 771 | Bladder Cancer | HLA.A02.01<br>HLA.A02.03<br>HLA.A02.06 |
| ERBB3 p.V104M (uc001sjh.2) | LPLPNLRMV | 765 | Colorectal Cancer | HLA.B07.02 |
| TSPAN9 p.S50L (uc001qlp.2) | LLSAANLVI | 759 | Melanoma | HLA.A02.01<br>HLA.A02.02<br>HLA.A02.03<br>HLA.B15.01<br>HLA.B15.03<br>HLA.B15.17 |
| CTNNB1 p.S33F (uc010hia.1) | YLDI-GIHSGA | 755 | Uterine Corpus Endometrial Carcinoma | HLA.A02.01<br>HLA.A02.03<br>HLA.A02.06 |
| CTNNB1 p.S33F (uc010hia.1) | YLDFGIHSG | 754 | Uterine Corpus Endometrial Carcinoma | HLA.A02.01<br>HLA.A02.02<br>HLA.A02.06 |
| PTEN p.R130G (uc001kfb.2) | GTGVMICAY | 751 | Uterine Corpus Endometrial Carcinoma | HLA.A29.02<br>HLA.B15.01<br>HLA.B15.17 |
| RXRA p.S427F (uc004cfb.2)<br>RXRG p.S428F (uc001gda.2) | LPALRFIGL | 748 | Bladder Cancer | HLA.B07.02<br>HLA.B08.01 |
| NOTCH2 p.P6fs (uc001eik.2) | WIPALRRSAV | 747 | Bladder Cancer | HLA.B07.02<br>HLA.B08.01 |
| JMY p.PPPPPPPPPPPP811del (uc003kfx.3) | LPPTPPPLPV | 733 | Pancreatic Cancer | HLA.B07.02 |
| JMY p.PPPPPPPPPPPP811del (uc003kfx.3) | SPLPPTPPPL | 733 | Pancreatic Cancer | HLA.B07.02 |
| ACADS p.R330H (uc001tza.3) | LLTWHAAMLK | 729 | Prostate Cancer | HLA.A03.01<br>HLA.A11.01<br>HLA.A68.01 |
| GATA3 p.H435fs (uc001ijz.2) | RSSIMKPKR | 703 | Breast Cancer | HLA.A30.01<br>HLA.A31.01 |
| OGEOD1 p.G477fs (uc002ejb.2) | FL.LLTLPKV | 702 | Pancreatic Cancer | HLA.A02.01<br>HLA.A02.02<br>HLA.A02.03<br>HLA.A02.06 |
| HERC2P3 p.A803V (uc001ytg.2) | RVRDIVI KO. M | 699 | Pancreatic Cancer | HLA.A30.01<br>HLA.B07.02<br>HLA.B15.17 |
| C1QB p.GPKGPMGPKGGPGAPGAP90del (uc001bgd.2) | ESGDYKATQK | 697 | Pancreatic Cancer | HLA.A68.01 |
| SLC38A10 p.1071_1072II>I (uc002jzz.1) | GLNPLPDVQV | 689 | Pancreatic Cancer | HLA.A02.01<br>HLA.A02.03 |
| UBB p.I188fs (uc002gpx.2)<br>UBC p.I191T (uc002gyy.3) | IPPTSRGSSL | 686 | Prostate Cancer | HLA.B07.02 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| UBB p.I188fs (uc002gpx.2) UBC p.I191T (uc002gyy.3) | PPTSRGSSL | 686 | Prostate Cancer | HLA.B07.02 |
| CTNNB1 p.D32N (uc010hia.1) | YLNSG1HSGA | 672 | Uterine Corpus Endornetrial Carcinoma | HLA.A02.01 HLA.A02.03 HLA.A02.06 |
| FRG1B p.K13N (uc010ztl.1) | ALNSGYGKYL | 670 | Prostate Cancer | HLA.A02.01 HLA.A02.03 |
| NBPF14 p.R25C (uc001eqf.2) | KLCPQLAENK | 667 | Pancreatic Cancer | HLA.A03.01 HLA.A11.01 |
| IARS2 p.R832C (uc001hmc.2) | VIVCSFAPI | 662 | Melanoma | HLA.A02.01 HLA.A02.02 HLA.A02.03 HLA.A02.06 HLA.A68.02 HLA.A69.01 HLA.B15.03 |
| P1K3CA p.H1047R (uc003fjk.2) | KONINDARHG | 661 | Breast Cancer | HLA.B15.03 |
| CTNNB1 p.D32N (uc010hia.1) | YLNSGIHSG | 658 | Uterine Corpus Endometrial Carcinoma | HLA.A027.01 HLA.A02.02 HLA.A02.03 |
| SIK3 p.950_951QQ>Q (uc001ppy.2) | QEYQELFRHM | 653 | Pancreatic Cancer | HLA.B40.01 HLA.B44.02 |
| IARS2 p.R832C (uc001hmc.2) | ILDVIVCSFA | 651 | Melanoma | HLA.A02.01 HLA.A02.03 HLA.A02.06 |
| AP3S1 p.K41fs (uc003krl.2) | RETFHLVSEM | 650 | Pancreatic Cancer | HLA.B40.01 |
| PPP2R1A p.P179R (uc002pyp.2) | RMVRRAAASK | 649 | Uterine Corpus Endometrial Carcinoma | HLA.A03.01 HLA.A11.01 |
| ZMIZ2 p.VAAAAATATATATAT153del (uc003tlr.2) | AAAAAVAAL | 641 | Pancreatic Cancer | HLA.B07.02 |
| HSD17B7P2 p.N175S (uc010qex.1) | SARKSNFSL | 637 | Prostate Cancer | HLA.A30.01 HLA.B07.02 HLA.B08.01 HLA.B15.17 |
| ARL16 p.G6R (uc002kbf.2) | RVAGRRALSR | 632 | Melanoma | HLA.A03.01 HLA.A11.01 HLA.A33.01 HLA.A68.01 |
| GATA3 p.S408fs (uc001ijz.2) | TIPPLOHGHR | 623 | Breast Cancer | HLA.A33.01 HLA.A68.01 |
| AP3S1 p.K4ifs (uc003krl.2) | FHLVSEMKM | 619 | Pancreatic Cancer | HLA.B38.01 HLA.B39.01 |
| PLEKHA6 p.V328fs (uc001hau.2) | SIMIVISWMPPL | 613 | Colorectal Cancer | HLA.A02.01 HLA.A02.03 HLA.A02.06 HLA.A68.02 HLA.B07.02 |
| LZTS1 p.RTQDLEGALRTKGLEL432del (uc003wzr.2) | KLEGLELEV | 609 | Pancreatic Cancer | HLA.A02.01 HLA.A02.02 HLA.A02.03 HLA.A02.06 |

TABLE 9 -continued

| Mutation | Mutant Sequence (SEQ ID NOS 33503-33732 respectively, in order of appearance) | Estimated Yearly Population | Relevant Tumor Types (>500 patients per year) | Presenting HLAs (predicted <500 nm) |
|---|---|---|---|---|
| HSD17B7P2 p.N175S (uc010qex.1) | WTSSRSARK | 607 | Prostate Cancer | HLA.A03.01<br>HLA.A11.01<br>HLA.A30.01<br>HLA.A68.01 |
| RBM14 p.AAAAAAA286del (uc009yrj.2) | GAAATAAAV | 606 | Pancreatic Cancer | HLA.A02.03<br>HLA.A68.02 |
| TP53 p.R249M (uc002gim.2) | MPILTIITL | 606 | Lung Adenocarcinorna | HLA.A69.01<br>HLA.B07.02<br>HLA.B08.01<br>HLA.B15.03<br>HLA.B39.01<br>HLA.B53.01 |
| IRF2BPL p.114_115QQ>Q (uc001xsy.2) | QLNHVDGSSK | 605 | Prostate Cancer | HLA.A03.01<br>HLA.A11.01 |
| POLI p.D17del (uc002lfj.3) | EEDAEAWAM | 599 | Prostate Cancer | HLA.B40.01<br>HLA.B44.02<br>HLA.B44.03 |
| ZNF780A p.Q600H (uc010xvh.1) | HMHURHO,K | 594 | Prostate Cancer | HLA.A03.01<br>HLA.A11.01<br>HLA.A30.01<br>HLA.A31.01<br>HLA.A33.01<br>HLA.A58.01 |
| FRG1B p.I10T (uc010ztI.1) | LSDSRTALK | 589 | Prostate Cancer | HLA.A11.01 |
| PARG p.A584T (uc001jih.2) | EETEAQHLY | 585 | Prostate Cancer | HLA.B44.02<br>HLA.B44.03 |
| GATA3 p.S408fs (uc001ijz.2) | SSLSHISAL | 573 | Breast Cancer | HLA.A02.06<br>HLA.B08.01<br>HLA.B15.03<br>HLA.B15.17<br>HLA.B39.01 |
| EGFR p.L858R (uc003tkq.2) | FGRAKLLGA | 564 | Lung Adenocarcinorna | HLA.B08.01 |
| TP53 p.R249M (uc002gim.2) | RMPILTIITL | 563 | Lung Adenocarcinorna | HLA.A02.01<br>HLA.A02.03<br>HLA.A02.06 |
| PARG p.A584T (uc001jih.2) | TEAQHLYQSI | 557 | Prostate Cancer | HLA.B40.01<br>HLA.B44.02 |
| CDC27 p.D555E (uc002ile.3) | EVALSVLSK | 557 | Colorectal Cancer | HLA.A11.01<br>HLA.A68.01 |
| GATA3 p.H435fs (uc001ijz.2) | MFLKAESKI | 554 | Breast Cancer | HLA.A23.01 |
| FRG1B p.K13N (uc010zt1.1) | RIALNSGYGK | 546 | Prostate Cancer | HLA.A03.01<br>HLA.A11.01 |
| CTNNB1 p.G34R (uc010hia.1) | YLDSRIHSGA | 530 | Uterine Corpus Endornetrial Carcinoma | HLA.A02.01<br>HLA.A02.03<br>HLA.A02.06 |
| FRG1B p.L525 (uc010zt1.1) | LSASNSCH | 528 | Prostate Cancer | HLA.A68.02<br>HLA.B15.17<br>HLA.B58.01 |
| AXIN2 p.W663fs (uc002jfi,2) | TPAPPPVPT | 520 | Colorectal Cancer | HLA.B07.02 |
| AXIN2 p.W663fs (uc002jfi.2) | VPTCSPRTL | 520 | Colorectal Cancer | HLA.B07.02 |
| FCGBP p.A2493V (uc002omp.3) | RPGLHRFVV | 504 | Pancreatic Cancer | HLA.B07.02<br>HLA.B08.01 |

Example 6

Therapeutic Targeting of Recurrent Mutations Expressed in Genes Containing Extracellular Domains.

Tumor-specific mutations present in greater than 1% of a population of cancer patients may be targeted with a drug or therapy that recognizes the tumor-specific neoepitope resulting from the mutation. The mutation is preferably within an extracellular domain. The drug or therapy is an antibody, antibody fragment, antibody drug conjugate, aptamer, CAR, or T cell receptor. The antibody or fragment thereof may be humanized, fully humanized, or chimeric. The antibody fragment may be a nanobody, Fab, Fab', (Fab')2, Fv, ScFv, diabody, triabody, tetrabody, Bis-scFv, minibody, Fab2, or Fab3 fragment.

A recurrent mutation that may be targeted is FGFR3:p.S249C. Fibroblast growth factor receptor 3 (FGFR3) is a protein that in humans is encoded by the FGFR3 gene. FGFR3 has also been designated as CD333 (cluster of differentiation 333). The full-length protein includes an extracellular region, composed of three immunoglobulin-like domains, a single hydrophobic membrane-spanning segment and a cytoplasmic tyrosine kinase domain. The mutation occurs in the extracellular domain of the protein. The mutation is present in 6.92% of bladder cancer (BLCA) patients analyzed and 1.12% of lung squamous cell carcinoma (LUSC) patients analyzed.

Another recurrent mutation that may be targeted is ERBB3:p.V104M. Receptor tyrosine-protein kinase erbB-3, also known as HER3 (human epidermal growth factor receptor 3), is a membrane bound protein that in humans is encoded by the ERBB3 gene. ErbB3 is a member of the epidermal growth factor receptor (EGFR/ERBB) family of receptor tyrosine kinases. The mutation is present in 1.72% of colorectal cancer (CRC), 2.86% of colon adenocarcinoma (COAD), 2.42% of stomach adenocarcinoma (STAD), and 2.06% of cervical squamous cell carcinoma and endocervical adenocarcinoma (CESC) patients analyzed.

Another recurrent mutation that may be targeted is EGFR:p.L858R. The epidermal growth factor receptor (EGFR; ErbB-1; HER1 in humans) is the cell-surface receptor for members of the epidermal growth factor family (EGF-family) of extracellular protein ligands. The mutation is present in 3.24% of lung adenocarcinoma (LUAD) patients analyzed.

Another recurrent mutation that may be targeted is MUC4:p.H4205Q. Mucin 4 (MUC 4) is a mucin protein that in humans is encoded by the MUC4 gene. This gene encodes an integral membrane glycoprotein found on the cell surface, although secreted isoforms may exist. The mutation is present in 2.3% of prostate adenocarcinoma (PRAD), 2.31% of bladder urothelial carcinoma (BLCA), and 7.14% of uterine carcinosarcoma (UCS) patients analyzed.

Another recurrent mutation that may be targeted is PDGFRA:p.R483fs. Platelet-derived growth factor receptor, alpha polypeptide is a protein that in humans is encoded by the PDGFRA gene. This gene encodes a cell surface tyrosine kinase receptor for members of the platelet-derived growth factor family. The mutation is present in 1.92% of prostate adenocarcinoma (PRAD) patients analyzed.

Another recurrent mutation that may be targeted is TMEM52 23_26LLPL>L. Transmembrane protein 52 is encoded by the TMEM52 gene. The mutation is present in 1.53% of prostate adenocarcinoma (PRAD) patients analyzed.

Another recurrent mutation that may be targeted is PODXL 28_30PSP>P. Podocalyxin-like protein 1 is a protein that in humans is encoded by the PODXL gene. The mutation is present in 1.53% of prostate adenocarcinoma (PRAD), 15.56% of adrenocortical carcinoma (ACC), and 3.57% of uterine carcinosarcoma (UCS) patients analyzed.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

SEQUENCE LISTING (33733 sequences)

SEQ ID NO: 1 - protein, 28 aa, Artificial Sequence
  source: /note="Description of Artificial Sequence: Synthetic peptide"
ENHTAELVIPGNILNVSIKICLTLSPST

SEQ ID NO: 2 - protein, 9 aa, Artificial Sequence
  source: /note="Description of Artificial Sequence: Synthetic peptide"
VIPGNILNV

SEQ ID NO: 3 - protein, 9 aa, Artificial Sequence
  source: /note="Description of Artificial Sequence: Synthetic peptide"
AELVIPGNI

SEQ ID NO: 4 - protein, 9 aa, Artificial Sequence
  source: /note="Description of Artificial Sequence: Synthetic peptide"
NILNVSIKI

SEQ ID NO: 5 - protein, 9 aa, Artificial Sequence
  source: /note="Description of Artificial Sequence: Synthetic peptide"
VSIKICLTL

SEQ ID NO: 6 - protein, 9 aa, Artificial Sequence
  source: /note="Description of Artificial Sequence: Synthetic peptide"
VSIKICLTL

SEQ ID NO: 7 - protein, 9 aa, Artificial Sequence
  source: /note="Description of Artificial Sequence: Synthetic peptide"
AELVIPGNI

SEQ ID NO: 8 - protein, 9 aa, Artificial Sequence
  source: /note="Description of Artificial Sequence: Synthetic peptide"
AELVIPGNI

SEQ ID NO: 9 - protein, 9 aa, Artificial Sequence
  source: /note="Description of Artificial Sequence: Synthetic peptide"
AELVIPGNI

SEQ ID NO: 10 - protein, 9 aa, Artificial Sequence
  source: /note="Description of Artificial Sequence: Synthetic peptide"
VIPGNILNV

SEQ ID NO: 11 - protein, 9 aa, Artificial Sequence
  source: /note="Description of Artificial Sequence: Synthetic peptide"
VSIKICLTL

SEQ ID NO: 12 - protein, 9 aa, Artificial Sequence
  source: /note="Description of Artificial Sequence: Synthetic peptide"
HTAELVIPG

SEQ ID NO: 13 - protein, 9 aa, Artificial Sequence
  source: /note="Description of Artificial Sequence: Synthetic peptide"
AELVIPGNI

SEQ ID NO: 14 - protein, 9 aa, Artificial Sequence
  source: /note="Description of Artificial Sequence: Synthetic peptide"
AELVIPGNI

SEQ ID NO: 15 - protein, 9 aa, Artificial Sequence
  source: /note="Description of Artificial Sequence: Synthetic peptide"
AELVIPGNI

SEQ ID NO: 16 - protein, 9 aa, Artificial Sequence
  source: /note="Description of Artificial Sequence: Synthetic peptide"
VSIKICLTL

SEQ ID NO: 17 - protein, 9 aa, Artificial Sequence
  source: /note="Description of Artificial Sequence: Synthetic peptide"
VIPGNILNV

SEQ ID NO: 18 - protein, 9 aa, Artificial Sequence
  source: /note="Description of Artificial Sequence: Synthetic peptide"
VIPGNILNV

SEQ ID NO: 19 - protein, 9 aa, Artificial Sequence
  source: /note="Description of Artificial Sequence: Synthetic peptide"
HTAELVIPG

SEQ ID NO: 20 - protein, 9 aa, Artificial Sequence
  source: /note="Description of Artificial Sequence: Synthetic peptide"
NILNVSIKI

SEQ ID NO: 21 - protein, 8 aa, Artificial Sequence
  source: /note="Description of Artificial Sequence: Synthetic peptide"
KICLTLSP

SEQ ID NO: 22 - protein, 9 aa, Artificial Sequence
  source: /note="Description of Artificial Sequence: Synthetic peptide"
VSIKICLTL

SEQ ID NO: 23 - protein, 9 aa, Artificial Sequence
  source: /note="Description of Artificial Sequence: Synthetic peptide"
VIPGNILNV

SEQ ID NO: 24 - protein, 9 aa, Artificial Sequence
  source: /note="Description of Artificial Sequence: Synthetic peptide"
RVFGVSEWL

SEQ ID NO: 25 - protein, 9 aa, Artificial Sequence
  source: /note="Description of Artificial Sequence: Synthetic peptide"
GMTLGAVVV

SEQ ID NO: 26 - protein, 9 aa, Artificial Sequence
  source: /note="Description of Artificial Sequence: Synthetic peptide"
MTLGEKFRV

SEQ ID NO: 27 - protein, 9 aa, Artificial Sequence
  source: /note="Description of Artificial Sequence: Synthetic peptide"
RVGNCKHLK

SEQ ID NO: 28 - protein, 9 aa, Artificial Sequence
  source: /note="Description of Artificial Sequence: Synthetic peptide"
RVGNCKHLK

SEQ ID NO: 29 - protein, 9 aa, Artificial Sequence
  source: /note="Description of Artificial Sequence: Synthetic peptide"
VVVSERILR

SEQ ID NO: 30 - protein, 9 aa, Artificial Sequence
  source: /note="Description of Artificial Sequence: Synthetic peptide"
RVGNCKHLK

SEQ ID NO: 31 - protein, 9 aa, Artificial Sequence
  source: /note="Description of Artificial Sequence: Synthetic peptide"
KFRVGNCKH

SEQ ID NO: 32 - protein, 10 aa, Artificial Sequence
  source: /note="Description of Artificial Sequence: Synthetic peptide"
KFRVGNCKHL

SEQ ID NO: 33 - protein, 7 aa, Artificial Sequence
  source: /note="Description of Artificial Sequence: Synthetic peptide"
RVGNCKH

SEQ ID NO: 34 - protein, 7 aa, Artificial Sequence
  source: /note="Description of Artificial Sequence: Synthetic peptide"
TLGAVVV

SEQ ID NO: 35 - protein, 8 aa, Artificial Sequence
  source: /note="Description of Artificial Sequence: Synthetic peptide"
VVVSERIL

SEQ ID NO: 36 - protein, 7 aa, Artificial Sequence
  source: /note="Description of Artificial Sequence: Synthetic peptide"
GMTLGEK

SEQ ID NO: 37 - protein, 7 aa, Artificial Sequence
  source: /note="Description of Artificial Sequence: Synthetic peptide"
AVVVSER

SEQ ID NO: 38 - protein, 7 aa, Artificial Sequence
  source: /note="Description of Artificial Sequence: Synthetic peptide"
AGMTLGE

SEQ ID NO: 39 - protein, 7 aa, Artificial Sequence
  source: /note="Description of Artificial Sequence: Synthetic peptide"
GNCKHLK

SEQ ID NO: 40 - protein, 7 aa, Artificial Sequence
  source: /note="Description of Artificial Sequence: Synthetic peptide"
LGAVVVS

SEQ ID NO: 41 - protein, 7 aa, Artificial Sequence
  source: /note="Description of Artificial Sequence: Synthetic peptide"
RVFGVSE

SEQ ID NO: 42 - protein, 8 aa, Artificial Sequence
  source: /note="Description of Artificial Sequence: Synthetic peptide"
ILRVFGVS

SEQ ID NO: 43 - protein, 7 aa, Artificial Sequence
  source: /note="Description of Artificial Sequence: Synthetic peptide"
NCKHLKM

SEQ ID NO: 44 - protein, 7 aa, Artificial Sequence
  source: /note="Description of Artificial Sequence: Synthetic peptide"
TLGAVVV

SEQ ID NO: 45 - protein, 8 aa, Artificial Sequence
  source: /note="Description of Artificial Sequence: Synthetic peptide"
VVVSERIL

SEQ ID NO: 46 - protein, 7 aa, Artificial Sequence
  source: /note="Description of Artificial Sequence: Synthetic peptide"
TLGAVVV

SEQ ID NO: 47 - protein, 7 aa, Artificial Sequence
  source: /note="Description of Artificial Sequence: Synthetic peptide"
EAGMTLG

SEQ ID NO: 48 - protein, 7 aa, Artificial Sequence
  source: /note="Description of Artificial Sequence: Synthetic peptide"
LGAVVVS

SEQ ID NO: 49 - protein, 7 aa, Artificial Sequence
  source: /note="Description of Artificial Sequence: Synthetic peptide"
AVVVSER

SEQ ID NO: 50 - protein, 9 aa, Artificial Sequence
  source: /note="Description of Artificial Sequence: Synthetic peptide"
SLLNYLREM

SEQ ID NO: 51 - protein, 9 aa, Artificial Sequence
  source: /note="Description of Artificial Sequence: Synthetic peptide"
EYMANGSLL

SEQ ID NO: 52 - protein, 9 aa, Artificial Sequence
  source: /note="Description of Artificial Sequence: Synthetic peptide"
TEYMANGSL

SEQ ID NO: 53 - protein, 9 aa, Artificial Sequence
  source: /note="Description of Artificial Sequence: Synthetic peptide"
MANGSLLNY

SEQ ID NO: 54 - protein, 9 aa, Artificial Sequence
  source: /note="Description of Artificial Sequence: Synthetic peptide"
MANGSLLNY

SEQ ID NO: 55 - protein, 9 aa, Artificial Sequence
  source: /note="Description of Artificial Sequence: Synthetic peptide"
TEYMANGSL

SEQ ID NO: 56 - protein, 9 aa, Artificial Sequence
  source: /note="Description of Artificial Sequence: Synthetic peptide"
LLNYLREMR

SEQ ID NO: 57 - protein, 9 aa, Artificial Sequence
  source: /note="Description of Artificial Sequence: Synthetic peptide"
EYMANGSLL

SEQ ID NO: 58 - protein, 9 aa, Artificial Sequence
  source: /note="Description of Artificial Sequence: Synthetic peptide"
MANGSLLNY

SEQ ID NO: 59 - protein, 9 aa, Artificial Sequence
  source: /note="Description of Artificial Sequence: Synthetic peptide"
TEYMANGSL

SEQ ID NO: 60 - protein, 9 aa, Artificial Sequence
  source: /note="Description of Artificial Sequence: Synthetic peptide"
TEYMANGSL

SEQ ID NO: 61 - protein, 9 aa, Artificial Sequence
  source: /note="Description of Artificial Sequence: Synthetic peptide"
MANGSLLNY

SEQ ID NO: 62 - protein, 9 aa, Artificial Sequence
  source: /note="Description of Artificial Sequence: Synthetic peptide"
LLNYLREMR

SEQ ID NO: 63 - protein, 9 aa, Artificial Sequence
  source: /note="Description of Artificial Sequence: Synthetic peptide"
MANGSLLNY

SEQ ID NO: 64 - protein, 9 aa, Artificial Sequence
  source: /note="Description of Artificial Sequence: Synthetic peptide"
EYMANGSLL

SEQ ID NO: 65 - protein, 9 aa, Artificial Sequence
  source: /note="Description of Artificial Sequence: Synthetic peptide"
TEYMANGSL

SEQ ID NO: 66 - protein, 9 aa, Artificial Sequence
  source: /note="Description of Artificial Sequence: Synthetic peptide"
MANGSLLNY

SEQ ID NO: 67 - protein, 9 aa, Artificial Sequence
  source: /note="Description of Artificial Sequence: Synthetic peptide"
MANGSLLNY

SEQ ID NO: 68 - protein, 9 aa, Artificial Sequence
  source: /note="Description of Artificial Sequence: Synthetic peptide"
TEYMANGSL

SEQ ID NO: 69 - protein, 9 aa, Artificial Sequence
  source: /note="Description of Artificial Sequence: Synthetic peptide"
LLNYLREMR

SEQ ID NO: 70 - protein, 9 aa, Artificial Sequence
  source: /note="Description of Artificial Sequence: Synthetic peptide"
EYMANGSLL

SEQ ID NO: 71 - protein, 9 aa, Artificial Sequence
  source: /note="Description of Artificial Sequence: Synthetic peptide"
MANGSLLNY

SEQ ID NO: 72 - protein, 9 aa, Artificial Sequence
  source: /note="Description of Artificial Sequence: Synthetic peptide"
TEYMANGSL

SEQ ID NO: 73 - protein, 10 aa, Artificial Sequence
  source: /note="Description of Artificial Sequence: Synthetic peptide"
VQLIMQLMPF

SEQ ID NO: 74 - protein, 10 aa, Artificial Sequence
  source: /note="Description of Artificial Sequence: Synthetic peptide"
STVQLIMQLM

SEQ ID NO: 75 - protein, 9 aa, Artificial Sequence
  source: /note="Description of Artificial Sequence: Synthetic peptide"
QLIMQLMPF

SEQ ID NO: 76 - protein, 9 aa, Artificial Sequence
  source: /note="Description of Artificial Sequence: Synthetic peptide"
QLIMQLMPF

SEQ ID NO: 77 - protein, 10 aa, Artificial Sequence
  source: /note="Description of Artificial Sequence: Synthetic peptide"
VQLIMQLMPF

SEQ ID NO: 78 - protein, 10 aa, Artificial Sequence
  source: /note="Description of Artificial Sequence: Synthetic peptide"
MQLMPFGCLL

SEQ ID NO: 79 - protein, 9 aa, Artificial Sequence
  source: /note="Description of Artificial Sequence: Synthetic peptide"
MQLMPFGCL

SEQ ID NO: 80 - protein, 9 aa, Artificial Sequence
  source: /note="Description of Artificial Sequence: Synthetic peptide"
QLIMQLMPF

SEQ ID NO: 81 - protein, 52 aa, Artificial Sequence
  source: /note="Description of Artificial Sequence: Synthetic polypeptide"
  source: /note="p.R732Q"
FYESDVMGRGHARLVHVEEPHTETVQQKYFPETWIWDLVVVNSAGVAEVGVT

SEQ ID NO: 82 - protein, 37 aa, Artificial Sequence
  source: /note="Description of Artificial Sequence: Synthetic polypeptide"
  source: /note="p.S654fs"
YDQCPVSGPWDFPQPLIDPMPQGHSEPAFHYLEALVL

SEQ ID NO: 83 - protein, 52 aa, Artificial Sequence
  source: /note="Description of Artificial Sequence: Synthetic polypeptide"
  source: /note="p.A266T"
VPLLSRKFMVTSLCNYLAIDLSWRDTTILNGTCVPPDVWRKYEKWLSPDNIP

SEQ ID NO: 84 - protein, 33 aa, Artificial Sequence
  source: /note="Description of Artificial Sequence: Synthetic polypeptide"
  source: /note="p.T878fs"
KTIDLVAYGDINGFSAMAKTVGLPTRHGSQNVA

SEQ ID NO: 85 - protein, 52 aa, Artificial Sequence
  source: /note="Description of Artificial Sequence: Synthetic polypeptide"
  source: /note="p.R385I"
TGEKPYTCGECGKTFRQSANLYVHRIIIHTGEKPYKCEDCGKAFGRYTALNQ

SEQ ID NO: 86 - protein, 52 aa, Artificial Sequence
  source: /note="Description of Artificial Sequence: Synthetic polypeptide"
  source: /note="p.E95D"
TFPPPGDTWELAYIPSHSDAAKTVTDDTVRRALVINMRVRGFPSEKDFEDYI

SEQ ID NO: 87 - protein, 52 aa, Artificial Sequence
  source: /note="Description of Artificial Sequence: Synthetic polypeptide"
  source: /note="p.R1476Q"
PQITLLDEPSTGMDPKAKQHMWRAIQQTAFKNRKRAAILTTHYMEEAEAVCD

SEQ ID NO: 88 - protein, 31 aa, Artificial Sequence
  source: /note="Description of Artificial Sequence: Synthetic polypeptide"
  source: /note="p.L306fs"
FVTIIITFTQIIVMTGFMVIFILFFYMAYLW

SEQ ID NO: 89 - protein, 52 aa, Artificial Sequence
  source: /note="Description of Artificial Sequence: Synthetic polypeptide"
  source: /note="p.A696T"
STQFMDEADILADRKVFLSQGKLKCTTGSSLFLKKKWGIGYHLSLQLNEICV

SEQ ID NO: 90 - protein, 52 aa, Artificial Sequence
  source: /note="Description of Artificial Sequence: Synthetic polypeptide"
  source: /note="p.R842Q"
RLVEMEQVLSSLNKMRKTIGGVALWQQQQICAIARVRLLKLKHERKALLALL

SEQ ID NO: 91 - protein, 52 aa, Artificial Sequence
  source: /note="Description of Artificial Sequence: Synthetic polypeptide"
  source: /note="p.E1158K"
NSGIWSFCFYVVTVFSVAGFAFSIFKKSDIPFIFTFLIPPATMIGCLFLSSH

SEQ ID NO: 92 - protein, 52 aa, Artificial Sequence
  source: /note="Description of Artificial Sequence: Synthetic polypeptide"
  source: /note="p.R467L"
RLYDPTEGMVSVDGQDIRTINVRFLLLEIIGVVSQEPVLFATTIAENIRYGR

SEQ ID NO: 93 - protein, 51 aa, Artificial Sequence
  source: /note="Description of Artificial Sequence: Synthetic polypeptide"
  source: /note="p.R527fs"
VKEANAYDFIMKLPHKFDTLVGERGPVEWWAEAEDRHCTCPGSQPQDPPAG

SEQ ID NO: 94 - protein, 33 aa, Artificial Sequence
  source: /note="Description of Artificial Sequence: Synthetic polypeptide"
  source: /note="p.G318fs"
LTEKAPWNSLAWTVTSYVFLKFLQGVALAVQAS

SEQ ID NO: 95 - protein, 52 aa, Artificial Sequence
  source: /note="Description of Artificial Sequence: Synthetic polypeptide"
  source: /note="p.R345H"
SRQCQEQIARAMGVADEALGNVRTVHHAFAMEQREEERYGAELEACRCRAEE

SEQ ID NO: 96 - protein, 52 aa, Artificial Sequence
  source: /note="Description of Artificial Sequence: Synthetic polypeptide"
  source: /note="p.R570W"
RMLILPLNNFPWVINGLLEAKVSLDWWIQLFLDLPNHNPQAYYSPDPPAEPS

SEQ ID NO: 97 - protein, 31 aa, Artificial Sequence
  source: /note="Description of Artificial Sequence: Synthetic polypeptide"
  source: /note="p.L883fs"
VAVIPWIAIPLVPLGIIFIFLRRYFWKRQEM

SEQ ID NO: 98 - protein, 50 aa, Artificial Sequence
  source: /note="Description of Artificial Sequence: Synthetic polypeptide"
  source: /note="p.L1090fs"
HAYNKGQEFLHRYQELLDDNQAPFFCLRVRCGGWLCGWTSSASPSSPPRG

SEQ ID NO: 99 - protein, 52 aa, Artificial Sequence
  source: /note="Description of Artificial Sequence: Synthetic polypeptide"
  source: /note="p.Y512C"
STLEYSNERLKQTNEMLRGIKLLKLCCAWENIFRTRVETTRRKEMTSLRAFA

SEQ ID NO: 100 - protein, 52 aa, Artificial Sequence
  source: /note="Description of Artificial Sequence: Synthetic polypeptide"
  source: /note="p.L466P"
IIMGVILLYNLLGSSALVGAAVIVLPPAPIQYFIATKLAEAQKSTLDYSTER

SEQ ID NO: 101 - protein, 52 aa, Artificial Sequence
  source: /note="Description of Artificial Sequence: Synthetic polypeptide"
  source: /note="p.S606P"
DVVHLHHILQREGGWEAMCDWKDVLPPGGEKQRIGMARMFYHRPKYALLDEC

SEQ ID NO: 102 - protein, 52 aa, Artificial Sequence
  source: /note="Description of Artificial Sequence: Synthetic polypeptide"
  source: /note="p.H169Q"
ATFVNSAIRYLEGQLALSFRSRLVAQQAYRLYFSQQTYYRVSNMDGRLRNPD

SEQ ID NO: 103 - protein, 52 aa, Artificial Sequence
  source: /note="Description of Artificial Sequence: Synthetic polypeptide"
  source: /note="p.K445N"
DYEDEEAAVVQYNDPYADGDPAWAPNNNYIEKVVAIYDYTKDKDDELSFMEG

SEQ ID NO: 104 - protein, 45 aa, Artificial Sequence
  source: /note="Description of Artificial Sequence: Synthetic polypeptide"
  source: /note="p.P19T"
MGQQVGRVGEAPGLQQPQTTRGIRGSSAARPSGRRRDPAGRTTET

SEQ ID NO: 105 - protein, 29 aa, Artificial Sequence
  source: /note="Description of Artificial Sequence: Synthetic peptide"
  source: /note="p.L249fs"
TIEPPPADPRLREDMALLADCALPPRAPR

SEQ ID NO: 106 - protein, 52 aa, Artificial Sequence
  source: /note="Description of Artificial Sequence: Synthetic polypeptide"
  source: /note="p.R1731C"
ARAEGIPRIYVSANSGARIGLAEEICCHMFHVAWVDPEDPYKGYRYLYLTPQ

SEQ ID NO: 107 - protein, 52 aa, Artificial Sequence
  source: /note="Description of Artificial Sequence: Synthetic polypeptide"
  source: /note="p.E2318Q"
VAVQFADFHDTPGRMLEKGVISDILQQWKTARTFLYWRLRRLLLEDQVKQEI

SEQ ID NO: 108 - protein, 41 aa, Artificial Sequence
  source: /note="Description of Artificial Sequence: Synthetic polypeptide"
  source: /note="p.G255fs"
EHKKLDLHRDFTVASPAEFVTRFGGIGSSRRCLLPTTGLPP

SEQ ID NO: 109 - protein, 52 aa, Artificial Sequence
  source: /note="Description of Artificial Sequence: Synthetic polypeptide"
  source: /note="p.F48C"
QHTKANRQREPGLGFSFEFTEQQKECCQATARKFAREEIIPVAAEYDKTGEY

SEQ ID NO: 110 - protein, 52 aa, Artificial Sequence
  source: /note="Description of Artificial Sequence: Synthetic polypeptide"
  source: /note="p.R330H"
TKLQVIQFKLADMALALESARLLTWHHAAMLKDNKKPFIKEAAMAKLAASEA

SEQ ID NO: 111 - protein, 52 aa, Artificial Sequence
  source: /note="Description of Artificial Sequence: Synthetic polypeptide"
  source: /note="p.R224L"
REEEERERLQKEEEKRRREEEERLRLLEEEERRRIEEERLRLEQQKQQIMAA

SEQ ID NO: 112 - protein, 52 aa, Artificial Sequence
  source: /note="Description of Artificial Sequence: Synthetic polypeptide"
  source: /note="p.R50Q"
GPQNPKKQGIFHIHEACSSIHVNHVQQDKLREIVGASTNWRDHVKAMEERKL

SEQ ID NO: 113 - protein, 85 aa, Artificial Sequence
  source: /note="Description of Artificial Sequence: Synthetic polypeptide"
  source: /note="p.Q123fs"
DLNRKSNQVKTCKAKIELLGSYDPQNNLLLKIPIMGMTLTLRRCTSSVSGAAERSWRRPTEAGSCPAAASLTRPHPEVLHFSVGV

SEQ ID NO: 114 - protein, 52 aa, Artificial Sequence
  source: /note="Description of Artificial Sequence: Synthetic polypeptide"
  source: /note="p.V29G"
GVFSMRLWTPVGVLTSLAYCLHQRRGGALAELQEADGQCPVDRSLLKLKMVQ

SEQ ID NO: 115 - protein, 52 aa, Artificial Sequence
  source: /note="Description of Artificial Sequence: Synthetic polypeptide"
  source: /note="p.R43W"
FLFLLFFWLDRSVLAKELKFVTLVFWWHGDRSPIDTFPTDPIKESSWPQGFG

SEQ ID NO: 116 - protein, 52 aa, Artificial Sequence
  source: /note="Description of Artificial Sequence: Synthetic polypeptide"
  source: /note="p.R105Q"
ELGEYIRKRYRKFLNESYKHEQVYIQQSTDVDRTLMSAMTNLAALFPPEGVS

SEQ ID NO: 117 - protein, 52 aa, Artificial Sequence
  source: /note="Description of Artificial Sequence: Synthetic polypeptide"
  source: /note="p.E321K"
LQMALDVYNGLLPPYASCHLTELYFKKKGEYFVEMYYRNETQHEPYPLMLPG

SEQ ID NO: 118 - protein, 52 aa, Artificial Sequence
  source: /note="Description of Artificial Sequence: Synthetic polypeptide"
  source: /note="p.W279C"
YVVVGITSWGVGCARAKRPGIYTATCCPYLNWIASKIGSNALRMIQSATPPP

SEQ ID NO: 119 - protein, 52 aa, Artificial Sequence
  source: /note="Description of Artificial Sequence: Synthetic polypeptide"
  source: /note="p.I250M"
AVLIYTSGTTGIPKGVMLSHDNITWMMAGAVTKDFKLTDKHETVVSYLPLSH

SEQ ID NO: 120 - protein, 52 aa, Artificial Sequence
  source: /note="Description of Artificial Sequence: Synthetic polypeptide"
  source: /note="p.T188S"
AIFCETRAEWMIAAQACFMYNFQLVSSLYATLGGPAIVHALNETEVTNIITS

SEQ ID NO: 121 - protein, 72 aa, Artificial Sequence
  source: /note="Description of Artificial Sequence: Synthetic polypeptide"
  source: /note="p.L402fs"
PGYMGTAASCYDVQIIDDKGNVLPPRHRRRHWHQGQTHQAYRHLLWLCGQSRQDSSQHSRRLLAPWRPGNQR

SEQ ID NO: 122 - protein, 52 aa, Artificial Sequence
  source: /note="Description of Artificial Sequence: Synthetic polypeptide"
  source: /note="p.K195N"
VASECPSLRIKLLVSEKSCDGWLNFNNKLLNEASTTHHCVETGSQEASAIYF

SEQ ID NO: 123 - protein, 52 aa, Artificial Sequence
  source: /note="Description of Artificial Sequence: Synthetic polypeptide"
  source: /note="p.G275C"
ITIGNERFRCPETLFQPSFIGMESACCIHETTYNSIMKCDIDIRKDLYANNV

SEQ ID NO: 124 - protein, 48 aa, Artificial Sequence
  source: /note="Description of Artificial Sequence: Synthetic polypeptide"
  source: /note="p.A22P"
MEEEIAALVIDNGSGMCKAGFPPGDDAPRAVFPSIVGRPRHQGVMVGM

SEQ ID NO: 125 - protein, 71 aa, Artificial Sequence
  source: /note="Description of Artificial Sequence: Synthetic polypeptide"
  source: /note="p.L88fs"
GPTYYIDTNALRVPRENMEAISPLKMGWLKTGIVSKLFWIIPTKCMSNQKPVSILFSCQRHRGILEQRERN

SEQ ID NO: 126 - protein, 52 aa, Artificial Sequence
  source: /note="Description of Artificial Sequence: Synthetic polypeptide"
  source: /note="p.R354H"
TGFKEEMAANVLLCGGCTMLDGFPEHHFQRELSLLCPGDSPAVAAAPERKTS

SEQ ID NO: 127 - protein, 52 aa, Artificial Sequence
  source: /note="Description of Artificial Sequence: Synthetic polypeptide"
  source: /note="p.E211K"
IYSYGKTSGLVVESGHGVSHVVPISKKGDVLPGLTSRADYAGGDLTNYLMQL

SEQ ID NO: 128 - protein, 52 aa, Artificial Sequence
  source: /note="Description of Artificial Sequence: Synthetic polypeptide"
  source: /note="p.R331H"
EVPGLSPVGLSTMAKQSLRKLSLEMHHADLAQNVLLCGGSSLFTGFEGRFRA

SEQ ID NO: 129 - protein, 28 aa, Artificial Sequence
  source: /note="Description of Artificial Sequence: Synthetic peptide"
  source: /note="p.D893Y"
AYSGPGSVPGALDYAAFSSALYGESYYL

SEQ ID NO: 130 - protein, 52 aa, Artificial Sequence
  source: /note="Description of Artificial Sequence: Synthetic polypeptide"
  source: /note="p.R206H"
ADLLDHSCTSGSGSGLPFLVQRTVAHHQITLLECVGKGRYGEVWRGSWQGEN

SEQ ID NO: 131 - protein, 52 aa, Artificial Sequence
  source: /note="Description of Artificial Sequence: Synthetic polypeptide"
  source: /note="p.S290L"
FIASDMTSRHSSTQLWLITHYHEMGLLLYDYLQLTTLDTVSCLRIVLSIASG

SEQ ID NO: 132 - protein, 37 aa, Artificial Sequence
  source: /note="Description of Artificial Sequence: Synthetic polypeptide"
  source: /note="p.S11L"
MASNNHWFQSLLQVPSFAQMLKKNLPVQPATKTITTP

SEQ ID NO: 133 - protein, 52 aa, Artificial Sequence
  source: /note="Description of Artificial Sequence: Synthetic polypeptide"
  source: /note="p.G44E"
LAASLQISPQPRPWRPLPAQAQSAWEEPAPAPATYRAEGGWPQVSVLRDSGP

SEQ ID NO: 134 - protein, 52 aa, Artificial Sequence
  source: /note="Description of Artificial Sequence: Synthetic polypeptide"
  source: /note="p.K380M"
EKDQIDITTNPVQMLHEFSKYRQRIMMQHADAVHLISRVTFHYKRSSLSYFG

SEQ ID NO: 135 - protein, 39 aa, Artificial Sequence
  source: /note="Description of Artificial Sequence: Synthetic polypeptide"
  source: /note="p.K73fs"
QEQFETELKYKMTINGKIAVLYLKKKQEPPCTRLHGNIL

SEQ ID NO: 136 - protein, 52 aa, Artificial Sequence
  source: /note="Description of Artificial Sequence: Synthetic polypeptide"
  source: /note="p.V205I"
IDNSTQKQSSYVGWWIHFRIVEIVVIIIDNYLYIRYERNDSKLLEDLYVIVN

SEQ ID NO: 137 - protein, 52 aa, Artificial Sequence
  source: /note="Description of Artificial Sequence: Synthetic polypeptide"
  source: /note="p.Q741H"
LKPKQEKMPLSKAKTEQEESKTKTVHHEESKTKTGQEESEAKTGQEESKAKT

SEQ ID NO: 138 - protein, 53 aa, Artificial Sequence
  source: /note="Description of Artificial Sequence: Synthetic polypeptide"
  source: /note="p.G97L"
KHVLHLWPKRLLLPRHLRVFSFTEHLLELLEDHPYIPKDCNYMGSVKESLDSK

SEQ ID NO: 139 - protein, 52 aa, Artificial Sequence
  source: /note="Description of Artificial Sequence: Synthetic polypeptide"
  source: /note="p.S314Y"
SSDWAHLYLQRKYNDALAWSFGKVCYYLEYAGSVSTLLDTNILAPATWSAHE

SEQ ID NO: 140 - protein, 52 aa, Artificial Sequence
  source: /note="Description of Artificial Sequence: Synthetic polypeptide"
  source: /note="p.R559Q"
DRNNKYVFCGWRNLICGRLVCTYPTQQKPFHQENGDVIYAFVRDSVCITVDY

SEQ ID NO: 141 - protein, 52 aa, Artificial Sequence
  source: /note="Description of Artificial Sequence: Synthetic polypeptide"
  source: /note="p.R256Q"
NQTAVREEMILLANYLDSMYIMLNIQQIVLVGLEIWTNGNLINIVGGAGDVL

SEQ ID NO: 142 - protein, 52 aa, Artificial Sequence
  source: /note="Description of Artificial Sequence: Synthetic polypeptide"
  source: /note="p.E359K"
LNPVHHDVAVLLTRKDICAGFNRPCKKTLGLSHLSGMCQPHRSCNINEDSGL

SEQ ID NO: 143 - protein, 52 aa, Artificial Sequence
  source: /note="Description of Artificial Sequence: Synthetic polypeptide"
  source: /note="p.P1053A"
RPRMLTTPTGPESMSTSTPAISSPSAATTASKEGDLGGKQWQDSSTQPELSS

SEQ ID NO: 144 - protein, 52 aa, Artificial Sequence
  source: /note="Description of Artificial Sequence: Synthetic polypeptide"
  source: /note="p.G238C"
QQEWAEPDGDLHNEAFGLGDLPNLLCCLVGDQLGDTERKRRHAKPGSYSIEV

SEQ ID NO: 145 - protein, 52 aa, Artificial Sequence
  source: /note="Description of Artificial Sequence: Synthetic polypeptide"
  source: /note="p.D817N"
LRRYYLNGHWTVDWPGRYKFSGTTFNNYRRSYNEPENLIATGPTNETLIVEL

SEQ ID NO: 146 - protein, 52 aa, Artificial Sequence
  source: /note="Description of Artificial Sequence: Synthetic polypeptide"
  source: /note="p.N572T"
SPWGAWSMCSRTCGTGARFRQRKCDTTPPPGPGGTHCPGASVEHAVCENLPC

SEQ ID NO: 147 - protein, 52 aa, Artificial Sequence
  source: /note="Description of Artificial Sequence: Synthetic polypeptide"
  source: /note="p.D948N"
WEPCSQTCGRTGMQVRSVRCIQPLHNNNTTRSVHAKHCNDARPESRRACSRE

SEQ ID NO: 148 - protein, 52 aa, Artificial Sequence
  source: /note="Description of Artificial Sequence: Synthetic polypeptide"
  source: /note="p.R541L"
KLHKGCFTQHVPPADGTDCGPGMHCLLHGLCVNKETETRPVNGEWGPWEPYS

SEQ ID NO: 149 - protein, 52 aa, Artificial Sequence
  source: /note="Description of Artificial Sequence: Synthetic polypeptide"
  source: /note="p.R1251S"
GKTTRQVLCMNYHQPIDENYCDPEVSSPLMEQECSLAACPPAHSHFPSSPVQ

SEQ ID NO: 150 - protein, 52 aa, Artificial Sequence
  source: /note="Description of Artificial Sequence: Synthetic polypeptide"
  source: /note="p.R156W"
TINGDPESVASLHWDGGALLGVLQYWWGAELHLQPLEGGTPNSAGGPGAHIL

SEQ ID NO: 151 - protein, 52 aa, Artificial Sequence
  source: /note="Description of Artificial Sequence: Synthetic polypeptide"
  source: /note="p.L549M"
QGQMVCLTKKLPAVEGTPCGKGRICMMQGKCVDKTKKKYYSTSSHGNWGSWG

SEQ ID NO: 152 - protein, 52 aa, Artificial Sequence
  source: /note="Description of Artificial Sequence: Synthetic polypeptide"
  source: /note="p.V524M"
TPCGPGHLCSEGSCLPEEEVERPKPMMADGGWAPWGPWGECSRTCGGGVQFS

SEQ ID NO: 153 - protein, 52 aa, Artificial Sequence
  source: /note="Description of Artificial Sequence: Synthetic polypeptide"
  source: /note="p.G659W"
FKSCNTEPCLKQKRDFRDEQCAHFDWWKHFNINGLLPNVRWVPKYSGILMKD

SEQ ID NO: 154 - protein, 83 aa, Artificial Sequence
  source: /note="Description of Artificial Sequence: Synthetic polypeptide"
  source: /note="p.G778fs"
TSCSRSCGPGTQHRQLQCRQEFGGGWLLGAPGALWTSPPAQHHPVLPAAPLWPLGSWLSLEPVLRAVRPGPEKPAGSLCWEQW

SEQ ID NO: 155 - protein, 52 aa, Artificial Sequence
  source: /note="Description of Artificial Sequence: Synthetic polypeptide"
  source: /note="p.A87V"
LAVFFALGLEVEDHVAFLITVPTALVVIFFAIFILVCIESVFKKLLRLFSLV

SEQ ID NO: 156 - protein, 52 aa, Artificial Sequence
  source: /note="Description of Artificial Sequence: Synthetic polypeptide"
  source: /note="p.V888I"
HVAEHFLARSLKNEELYHQSYDCVCIIMFASIPDFKEFYTESDVNKEGLECL

SEQ ID NO: 157 - protein, 52 aa, Artificial Sequence
  source: /note="Description of Artificial Sequence: Synthetic polypeptide"
  source: /note="p.P1016T"
SFNDFKLRVGINHGPVIAGVIGAQKTTQYDIWGNTVNVASRMDSTGVLDKIQ

SEQ ID NO: 158 - protein, 52 aa, Artificial Sequence
  source: /note="Description of Artificial Sequence: Synthetic polypeptide"
  source: /note="p.R661H"
SIETFLILRCTQKRKEEKAMIAKMNHHQRTNSIGHNPPHWGAERPFYNHLGG

SEQ ID NO: 159 - protein, 52 aa, Artificial Sequence
  source: /note="Description of Artificial Sequence: Synthetic polypeptide"
  source: /note="p.E570K"
HGPPAPPNPFSHLTEGELEEYKRTIKKRKQQGLEDAEQELLSDDASSVSQIQ

SEQ ID NO: 160 - protein, 52 aa, Artificial Sequence
  source: /note="Description of Artificial Sequence: Synthetic polypeptide"
  source: /note="p.S1124L"
PCNSFAIKEIRDYYIPNDKKILFRYLLVKVLTPQPATIQVRTSKPDAFIKLQ

SEQ ID NO: 161 - protein, 52 aa, Artificial Sequence
  source: /note="Description of Artificial Sequence: Synthetic polypeptide"
  source: /note="p.D154V"
SRFTCRRKPIHHFLGISTFSQYTVVVVENAVAKIDAASPLEKVCLIGCGFST

SEQ ID NO: 162 - protein, 32 aa, Artificial Sequence
  source: /note="Description of Artificial Sequence: Synthetic polypeptide"
  source: /note="p.S322fs"
NSPSPAAGQPVTVAQGAPGSLTHSPLLLANPT

SEQ ID NO: 163 - protein, 52 aa, Artificial Sequence
  source: /note="Description of Artificial Sequence: Synthetic polypeptide"
  source: /note="p.R597H"
VKTNASQVPAEPKERPLLSLIREKAHHPRPTQKIPETKALKHKLSTTSETVS

SEQ ID NO: 164 - protein, 52 aa, Artificial Sequence
  source: /note="Description of Artificial Sequence: Synthetic polypeptide"
  source: /note="p.E919K"
INKNEKMLRSPISPLSDASKHKYTSKKDLTSSSRPNGNSLFTSASSSKKPKA

SEQ ID NO: 165 - protein, 52 aa, Artificial Sequence
  source: /note="Description of Artificial Sequence: Synthetic polypeptide"
  source: /note="p.A182G"
TFMNKFIYEIARRHPFLYAPTILLWGGARYDKIIPSCCKAENAVECFQTKAA

SEQ ID NO: 166 - protein, 46 aa, Artificial Sequence
  source: /note="Description of Artificial Sequence: Synthetic polypeptide"
  source: /note="p.G127fs"
GGRFKKEIVVDGQSYLLLIRDEGGPRRRSLPCGWTLLYLSSAWRMK

SEQ ID NO: 167 - protein, 52 aa, Artificial Sequence
  source: /note="Description of Artificial Sequence: Synthetic polypeptide"
  source: /note="p.R766W"
VWEGALGGYSKPGPDACREEKERWIWWAKYEQKLFLAPLPSSDVPLGQQLLR

SEQ ID NO: 168 - protein, 77 aa, Artificial Sequence
  source: /note="Description of Artificial Sequence: Synthetic polypeptide"
  source: /note="p.D69fs"
MAAAVQPAEVTVEVGEDLHMHHVRDGRCLKLWSLTFLPIQSQAQYSRGTLKQKLWSLTLLPIQRQAQYSRGTLKQML

SEQ ID NO: 169 - protein, 52 aa, Artificial Sequence
  source: /note="Description of Artificial Sequence: Synthetic polypeptide"
  source: /note="p.S127I"
NPSANPEASTIFQRNSQTDVVEIRRIINCTNHVSAVRFSQQYSLCSTIFLDD

SEQ ID NO: 170 - protein, 53 aa, Artificial Sequence
  source: /note="Description of Artificial Sequence: Synthetic polypeptide"
  source: /note="p.E71fs"
AAAVQPAEVTVEVGEDLHMHHVRDRRCLKLWSLTLLPIQRQAQYSRGTLKQML

SEQ ID NO: 171 - protein, 52 aa, Artificial Sequence
  source: /note="Description of Artificial Sequence: Synthetic polypeptide"
  source: /note="p.M248V"
STSQEDPQFSVPPTANTPTPVCKLSVVRWSNLFTSEKGSDPDKERKAPENHA

SEQ ID NO: 172 - protein, 52 aa, Artificial Sequence
  source: /note="Description of Artificial Sequence: Synthetic polypeptide"
  source: /note="p.I420fs"
KLNSVWIMPQQSAGLEESAPDTIPPQREWRCLLCGPAWTCFQKGLLHVRKQL

SEQ ID NO: 173 - protein, 52 aa, Artificial Sequence
  source: /note="Description of Artificial Sequence: Synthetic polypeptide"
  source: /note="p.V313M"
TGTPEIAGLTPSQALEIIRGCQGLNMMMGCDLVEVSPPYDLSGNTALLAANL

SEQ ID NO: 174 - protein, 52 aa, Artificial Sequence
  source: /note="Description of Artificial Sequence: Synthetic polypeptide"
  source: /note="p.A212T"
ISMQVARAKGLPRLKHHLLPRTKGFTTITVRSLRNVVSAVYDCTLNFRNNEN

SEQ ID NO: 175 - protein, 54 aa, Artificial Sequence
  source: /note="Description of Artificial Sequence: Synthetic polypeptide"
  source: /note="p.1284_1285VT>A"
GATSGAIAAGATARATTASRLPSSAAAPRAPHPSHTSQPVAKTTAAPTTRRPPT

SEQ ID NO: 176 - protein, 39 aa, Artificial Sequence
  source: /note="Description of Artificial Sequence: Synthetic polypeptide"
  source: /note="p.R502C"
FSQTFRIAPSMCITKPEVDFAVEVFCCSALTQHMERRAK

SEQ ID NO: 177 - protein, 30 aa, Artificial Sequence
  source: /note="Description of Artificial Sequence: Synthetic polypeptide"
  source: /note="p.K303fs"
DDEISSMEQSTEDSMQDDTKPKPKKNKKED

SEQ ID NO: 178 - protein, 52 aa, Artificial Sequence
  source: /note="Description of Artificial Sequence: Synthetic polypeptide"
  source: /note="p.S4150F"
KAPKISMPEVDLNLKGPKMKGDVDVFFLPKVEGDLKGPEVDIKGPKVDIDVP

SEQ ID NO: 179 - protein, 34 aa, Artificial Sequence
  source: /note="Description of Artificial Sequence: Synthetic polypeptide"
  source: /note="p.5_6insE"
MEKEEEETTRELLLPNWQGSGSHGLTIAQRDDGV

SEQ ID NO: 180 - protein, 52 aa, Artificial Sequence
  source: /note="Description of Artificial Sequence: Synthetic polypeptide"
  source: /note="p.V1220I"
ISMPDVDLHLKGPKVKGDVDVSVPKIIEGEMKVPDVEIKGPKMDIDAPDVEV

SEQ ID NO: 181 - protein, 52 aa, Artificial Sequence
  source: /note="Description of Artificial Sequence: Synthetic polypeptide"
  source: /note="p.A2114G"
PDVSLEGPEGKLKGPKLKMPEMHFKGGPKISMPDVDLHLKGPKVKGDVDVSL

SEQ ID NO: 182 - protein, 52 aa, Artificial Sequence
  source: /note="Description of Artificial Sequence: Synthetic polypeptide"
  source: /note="p.D2889H"
LKGPEVDLKGPKVDIDVPDVNVQGPHHWHLKMPKMKMPKFSMPGFKAEGPEV

SEQ ID NO: 183 - protein, 52 aa, Artificial Sequence
  source: /note="Description of Artificial Sequence: Synthetic polypeptide"
  source: /note="p.P1215S"
APKVEADVSLPSMQGDLKTTDLSIQSSPSADLEVHAGQVDVKLLEGHVPEGA

SEQ ID NO: 184 - protein, 52 aa, Artificial Sequence
  source: /note="Description of Artificial Sequence: Synthetic polypeptide"
  source: /note="p.L1640M"
PDVKMSLSSMEVDVQAPRAKLDGAQMMEGDLSLADKAVTAKDSKFKMPKFKM

SEQ ID NO: 185 - protein, 52 aa, Artificial Sequence
  source: /note="Description of Artificial Sequence: Synthetic polypeptide"
  source: /note="p.S2166F"
LANKDLTTKDSKFKMPKFKMPSFGVFFAPGKSIEASVDVSPPKVEADMSLPS

SEQ ID NO: 186 - protein, 52 aa, Artificial Sequence
  source: /note="Description of Artificial Sequence: Synthetic polypeptide"
  source: /note="p.R131G"
LRIFTARLYFCEDRKAEPEGLRRLHGGAGVQIAIMTFKDYFYCWNTFVENHE

SEQ ID NO: 187 - protein, 52 aa, Artificial Sequence
  source: /note="Description of Artificial Sequence: Synthetic polypeptide"
  source: /note="p.Y144F"
RKAEPEGLRRLHRAGVQIAIMTFKDFFFYCWNTFVENHERTFKAWEGLHENS

SEQ ID NO: 188 - protein, 52 aa, Artificial Sequence
  source: /note="Description of Artificial Sequence: Synthetic polypeptide"
  source: /note="p.K247M"
VDIELQKHVEKLTKGAAIFFEFKHYMMPKKRFTSTKCFAFMEMDEIKPGPIV

SEQ ID NO: 189 - protein, 52 aa, Artificial Sequence
  source: /note="Description of Artificial Sequence: Synthetic polypeptide"
  source: /note="p.Q191R"
AVSTQQQEEDRSSSCREAVLQWRLQRRTIKEQALLNAHVTQVTESLKQVQLE

SEQ ID NO: 190 - protein, 52 aa, Artificial Sequence
  source: /note="Description of Artificial Sequence: Synthetic polypeptide"
  source: /note="p.A159V"
SALSEEVSHFEKRKLFILLSTVMTWVVRSKALDPEDSEVPFTEEDYRRRKSH

SEQ ID NO: 191 - protein, 52 aa, Artificial Sequence
  source: /note="Description of Artificial Sequence: Synthetic polypeptide"
  source: /note="p.D243A"
KLLEYHRNIVRVIPSYPKILKVISAAAQPCVDVFYQALTYVQSNHRTNAPFT

SEQ ID NO: 192 - protein, 52 aa, Artificial Sequence
  source: /note="Description of Artificial Sequence: Synthetic polypeptide"
  source: /note="p.E1282K"
ILSKTEGTQEADQYADEKTKDVPFFKKGLEGSIDTGITVSREKVTEVALKGE

SEQ ID NO: 193 - protein, 58 aa, Artificial Sequence
  source: /note="Description of Artificial Sequence: Synthetic polypeptide"
  source: /note="p.K2785fs"
QAPASTSASTRLFGLTKPKEKKEKKRRTKPAALSPVMVPRQKYQQRVKRSSADPLPLC

SEQ ID NO: 194 - protein, 52 aa, Artificial Sequence
  source: /note="Description of Artificial Sequence: Synthetic polypeptide"
  source: /note="p.L3482I"
RRILYQNLNEPTTWSLTSDRTRNWVIIQQKIEGETKESNYAKLIEMNGGGTG

SEQ ID NO: 195 - protein, 31 aa, Artificial Sequence
  source: /note="Description of Artificial Sequence: Synthetic polypeptide"
  source: /note="p.M3743fs"
YLLLLLGGFQECEDATLALLARMGGSQLSRI

SEQ ID NO: 196 - protein, 63 aa, Artificial Sequence
  source: /note="Description of Artificial Sequence: Synthetic polypeptide"
  source: /note="p.R1209fs"
DMKAKIRVDTIAKRRAELILERDKKGGRMLLEMMKRLVRKNLKKTMMILKTSLKMSFQKMRKR

SEQ ID NO: 197 - protein, 52 aa, Artificial Sequence
  source: /note="Description of Artificial Sequence: Synthetic polypeptide"
  source: /note="p.K620R"
AEMTAPSPSCAFCRRLLEWKQNVEKRRGHGRINCGRFSIVLHEKAPHSDSTP

SEQ ID NO: 198 - protein, 43 aa, Artificial Sequence
  source: /note="Description of Artificial Sequence: Synthetic polypeptide"
  source: /note="p.E17K"
MSDVAIVKEGWLHKRGKKYIKTWRPRYFLLKNDGTFIGYKERP

SEQ ID NO: 199 - protein, 52 aa, Artificial Sequence
  source: /note="Description of Artificial Sequence: Synthetic polypeptide"
  source: /note="p.I289M"
EYLHSRDVVYRDIKLENLMLDKDGHMMKITDFGLCKEGISDGATMKTFCGTP

SEQ ID NO: 200 - protein, 52 aa, Artificial Sequence
  source: /note="Description of Artificial Sequence: Synthetic polypeptide"
  source: /note="p.G302R"
PRVCGAVMDTLKQHGAGAGGTRNISRRTSKFHVDLERELADLHGKDAALLFS

SEQ ID NO: 201 - protein, 52 aa, Artificial Sequence
  source: /note="Description of Artificial Sequence: Synthetic polypeptide"
  source: /note="p.S294L"
CCHGDLLECADDRADLAKYICENQDLLISSKLKECCEKPLLEKSHCIAEVEN

SEQ ID NO: 202 - protein, 52 aa, Artificial Sequence
  source: /note="Description of Artificial Sequence: Synthetic polypeptide"
  source: /note="p.R85C"
PATGEQVCEVQEADKADIDKAVQAACCLAFSLGSVWRRMDASERGRLLDKLA

SEQ ID NO: 203 - protein, 52 aa, Artificial Sequence
  source: /note="Description of Artificial Sequence: Synthetic polypeptide"
  source: /note="p.A870T"
KALYVSDKLQAGTVFVNTYNKTDVATTPFGGFKQSGFGKDLGEAALNEYLRV

SEQ ID NO: 204 - protein, 146 aa, Artificial Sequence
  source: /note="Description of Artificial Sequence: Synthetic polypeptide"
  source: /note="p.L286fs"
TEIGRVIQVAAGSSNLKRVTLELGGRAPTSSCQMPIWIGPWNRPTSPCSSTRASAAVPAPGPSCRRTSMMSLWSGALPGPSLGWSGTPLIARPSRGRRWMKLSLRRSSATSTRGSKRGRSCCVVGALLLTVVTSSSPLCLEMCRMA

SEQ ID NO: 205 - protein, 30 aa, Artificial Sequence
  source: /note="Description of Artificial Sequence: Synthetic polypeptide"
  source: /note="p.P562fs"
ETFSHRRSCLVRPLMNDEGLKVRYPRARPR

SEQ ID NO: 206 - protein, 52 aa, Artificial Sequence
  source: /note="Description of Artificial Sequence: Synthetic polypeptide"
  source: /note="p.S302Y"
NVEHYQELKKMVQQSDLGQYVTFLRYYFSDKQKISLLHSCTCVLYTPSNEHF

SEQ ID NO: 207 - protein, 52 aa, Artificial Sequence
  source: /note="Description of Artificial Sequence: Synthetic polypeptide"
  source: /note="p.K137E"
WHWVKQCLKLYSQKPNVCNLDKHMSEEEETQDLWEQSKEFLRYKEATKRRPR

SEQ ID NO: 208 - protein, 26 aa, Artificial Sequence
  source: /note="Description of Artificial Sequence: Synthetic peptide"
  source: /note="p.L356fs"
ECSDVMTDYSNAVWQRNLLGTEHVFY

SEQ ID NO: 209 - protein, 39 aa, Artificial Sequence
  source: /note="Description of Artificial Sequence: Synthetic polypeptide"
  source: /note="p.K523fs"
LLSGESENSGMSQCWETAADKRVGGRTYGARGVQGNLPG

SEQ ID NO: 210 - protein, 52 aa, Artificial Sequence
  source: /note="Description of Artificial Sequence: Synthetic polypeptide"
  source: /note="p.D53N"
DAVLRCIISGQPKPEVTWYKNGQAINNGSGIISNYEFFENQYIHVLHLSCCT

SEQ ID NO: 211 - protein, 52 aa, Artificial Sequence
  source: /note="Description of Artificial Sequence: Synthetic polypeptide"
  source: /note="p.W31S"
VLLLLGLRLQLSLGIIPVEEENPDFSSNRQAAEALGAAKKLQPAQTAAKNLI

SEQ ID NO: 212 - protein, 52 aa, Artificial Sequence
  source: /note="Description of Artificial Sequence: Synthetic polypeptide"
  source: /note="p.R126Q"
PPPQPQPQQQQPQPQPPAQPHLYLQQQGACKTPPDGSLKLQEGSSGHSAALQ

SEQ ID NO: 213 - protein, 52 aa, Artificial Sequence
  source: /note="Description of Artificial Sequence: Synthetic polypeptide"
  source: /note="p.S225Y"
QGPSLPGLDFADPQGSTIFQIARLIYYHGPMPQNKQSPLYPGMLYVPFGANQ

SEQ ID NO: 214 - protein, 29 aa, Artificial Sequence
  source: /note="Description of Artificial Sequence: Synthetic peptide"
  source: /note="p.S3G"
MAGGGHSLLLENAQQVVLVCARGERFLAR

SEQ ID NO: 215 - protein, 52 aa, Artificial Sequence
  source: /note="Description of Artificial Sequence: Synthetic polypeptide"
  source: /note="p.R292W"
PSPLPSPTASPNHTLAPASPAPARPWWSPSQTRKGPPVPPLPKVTPTKELQQ

SEQ ID NO: 216 - protein, 52 aa, Artificial Sequence
  source: /note="Description of Artificial Sequence: Synthetic polypeptide"
  source: /note="p.T537A"
PGLPAPSLTMSNTMPRPSTPLDGVSAAPKPLSKLLGSLDEVVLLSPVPELRD

SEQ ID NO: 217 - protein, 52 aa, Artificial Sequence
  source: /note="Description of Artificial Sequence: Synthetic polypeptide"
  source: /note="p.N453S"
TESGLTPIHVAAFMGHLNIVLLLLQSSGASPDVTNIRGETALHMAARAGQVE

SEQ ID NO: 218 - protein, 52 aa, Artificial Sequence
  source: /note="Description of Artificial Sequence: Synthetic polypeptide"
  source: /note="p.Q3076L"
DDEAFEARVKEEEQKIFGLMVDRQSLLGTTPDTTPARTPTEEGTPTSEQNPF

SEQ ID NO: 219 - protein, 52 aa, Artificial Sequence
  source: /note="Description of Artificial Sequence: Synthetic polypeptide"
  source: /note="p.D1322E"
LATQLYRELICVPYMAKFVVFAKMNEEPVESSLRCFCMTDDKVDKTLEQQEN

SEQ ID NO: 220 - protein, 50 aa, Artificial Sequence
  source: /note="Description of Artificial Sequence: Synthetic polypeptide"
  source: /note="p.R24H"
MQEELAWETDGLLPLERQLHEAAHHQNNVGRMQELIGRRVNTRARNHVGR

SEQ ID NO: 221 - protein, 52 aa, Artificial Sequence
  source: /note="Description of Artificial Sequence: Synthetic polypeptide"
  source: /note="p.M280I"
YRLYRRMKTGFEHARAPEMPTNVCLIIVTSSTSLTVSFQEPLSVNAAVVTRY

SEQ ID NO: 222 - protein, 41 aa, Artificial Sequence
  source: /note="Description of Artificial Sequence: Synthetic polypeptide"
  source: /note="p.C644fs"
TAAPISGFRRGVCVCVCVCVCVCVCVCVCVCREHPGRSPPG

SEQ ID NO: 223 - protein, 57 aa, Artificial Sequence
  source: /note="Description of Artificial Sequence: Synthetic polypeptide"
  source: /note="p.C644fs"
TAAPISGFRRGVCVCVCVCVCVCVCVCVCVCVGSTQADLPQAERGLCYRWYCWRGSK

SEQ ID NO: 224 - protein, 52 aa, Artificial Sequence
  source: /note="Description of Artificial Sequence: Synthetic polypeptide"
  source: /note="p.N302I"
KELDARIFLNEIPPFVEDGEPWFIIIIETPLLVKIQKQTYKFRNKPAHTSWN

SEQ ID NO: 225 - protein, 52 aa, Artificial Sequence
  source: /note="Description of Artificial Sequence: Synthetic polypeptide"
  source: /note="p.K369R"
KDEYEFDEDDEQDRVPPVDDKHLLKRRDYRKETKSNSFISIPKMEVKSYTKN

SEQ ID NO: 226 - protein, 52 aa, Artificial Sequence
  source: /note="Description of Artificial Sequence: Synthetic polypeptide"
  source: /note="p.Y2015S"
SPKRFCPADPLHSAAPGPFSASEAPSSPAPPASPAPYALPVAEPGLEDVKDG

SEQ ID NO: 227 - protein, 52 aa, Artificial Sequence
  source: /note="Description of Artificial Sequence: Synthetic polypeptide"
  source: /note="p.E627K"
HKEKSKHQKDFHLEFGEKSNAKIKDKKDHSPTFENSDCTLKKMDKEGKTLKK

SEQ ID NO: 228 - protein, 52 aa, Artificial Sequence
  source: /note="Description of Artificial Sequence: Synthetic polypeptide"
  source: /note="p.E721Q"
WKENFFKSDETEDLFLNMEHESLTLQQKKSKLEKNIKDDKSTKEKHVSKERN

SEQ ID NO: 229 - protein, 52 aa, Artificial Sequence
  source: /note="Description of Artificial Sequence: Synthetic polypeptide"
  source: /note="p.T999N"
SEFILASKGLTHLNELLMACKSHKENNTSVHTDWLLDLYAGNIKTLQKLPHI

SEQ ID NO: 230 - protein, 52 aa, Artificial Sequence
  source: /note="Description of Artificial Sequence: Synthetic polypeptide"
  source: /note="p.P337R"
TSDKDDSVSNTATEIKDEQKSGTVLRRAVEQCLNRSLYRPDAVAQPVTENEF

SEQ ID NO: 231 - protein, 52 aa, Artificial Sequence
  source: /note="Description of Artificial Sequence: Synthetic polypeptide"
  source: /note="p.K378R"
VAQPVTENEFSLESEIISKLYIPKRRRIISPRSIKDVLPPVEEAVDRCLYLL

SEQ ID NO: 232 - protein, 52 aa, Artificial Sequence
  source: /note="Description of Artificial Sequence: Synthetic polypeptide"
  source: /note="p.D1014Y"
SEKPPGLKATSDEKDSVLNIARGKKYYGEKTRTVSSQKPPTLKATSDEEDSV

SEQ ID NO: 233 - protein, 52 aa, Artificial Sequence
  source: /note="Description of Artificial Sequence: Synthetic polypeptide"
  source: /note="p.M1144T"
KSRTVSSPKQPALKAICDKEDSVPNTTATEKKDEQISGTVSCQKQPALKATS

SEQ ID NO: 234 - protein, 33 aa, Artificial Sequence
  source: /note="Description of Artificial Sequence: Synthetic polypeptide"
  source: /note="p.H438R"
LEKDTIKNQNLEKKYLKDFEIVKRKRREDLQKA

SEQ ID NO: 235 - protein, 52 aa, Artificial Sequence
  source: /note="Description of Artificial Sequence: Synthetic polypeptide"
  source: /note="p.V637M"
WTALRSAAWGGHTEVVSALLYAGVKMMDCADADSRTALRAAAWGGHEDIVLN

SEQ ID NO: 236 - protein, 52 aa, Artificial Sequence
  source: /note="Description of Artificial Sequence: Synthetic polypeptide"
  source: /note="p.R479C"
TQHQMRVLDKLMVERLSAERTECLNCCLQQHSDTEKHEGEKRQISLVDELKT

SEQ ID NO: 237 - protein, 52 aa, Artificial Sequence
  source: /note="Description of Artificial Sequence: Synthetic polypeptide"
  source: /note="p.R334C"
PLHDGEYDSPEDDMNDRKLLYQEWACCYGVFYKFQPIDLIRKYFGEKIGLYF

SEQ ID NO: 238 - protein, 52 aa, Artificial Sequence
  source: /note="Description of Artificial Sequence: Synthetic polypeptide"
  source: /note="p.A41S"
GMNISKSEITKETSLKPSRRSLPCLSSQSYAYSKSLSQSTSLFQSTESESQA

SEQ ID NO: 239 - protein, 52 aa, Artificial Sequence
  source: /note="Description of Artificial Sequence: Synthetic polypeptide"
  source: /note="p.M956I"
IAYLIPDVPKGLHDRIRREKYLVQEIIMYEAELEHLQQQRRKSGQPVHHEWP

SEQ ID NO: 240 - protein, 52 aa, Artificial Sequence
  source: /note="Description of Artificial Sequence: Synthetic polypeptide"
  source: /note="p.R231Q"
RSKQHLRLVFDEYLKTTGKPIEASIQQGELSGDFEKLMLAVVKCIRSTPEYF

SEQ ID NO: 241 - protein, 84 aa, Artificial Sequence
  source: /note="Description of Artificial Sequence: Synthetic polypeptide"
  source: /note="p.L79fs"
QSQLFADLSREELTAVMRFLTQRLGARAGGCSPGPALGQLCLLSGVAAASQGCSPGSLGQGEPPTCPGGTGHRLLWQATPAQRE

SEQ ID NO: 242 - protein, 52 aa, Artificial Sequence
  source: /note="Description of Artificial Sequence: Synthetic polypeptide"
  source: /note="p.A507V"
GRHWNEQMLDIACRLILNEVSLLGSVVPGGKVEFKRTLIISFLFKFYLEVSQ

SEQ ID NO: 243 - protein, 52 aa, Artificial Sequence
  source: /note="Description of Artificial Sequence: Synthetic polypeptide"
  source: /note="p.R723L"
NDIAAGIPSITAYSKNGLKIEFTFELLSNTNPSVTVITIQASNSTELDMTDF

SEQ ID NO: 244 - protein, 52 aa, Artificial Sequence
  source: /note="Description of Artificial Sequence: Synthetic polypeptide"
  source: /note="p.D243N"
PQLVHILRTLVTMGYSTEHSISGVSNNPFLQVQILRLLRILGRNHEESSETM

SEQ ID NO: 245 - protein, 33 aa, Artificial Sequence
  source: /note="Description of Artificial Sequence: Synthetic polypeptide"
  source: /note="p.K41fs"
LSKFYQPYSEDTQQQIIRETFHLVSEMKMFVIS

SEQ ID NO: 246 - protein, 52 aa, Artificial Sequence
  source: /note="Description of Artificial Sequence: Synthetic polypeptide"
  source: /note="p.R276W"
VVMGATKLFLILAKMFPHVQTDVLVWWVKGPLLAACSSESRELCFVALCHVR

SEQ ID NO: 247 - protein, 52 aa, Artificial Sequence
  source: /note="Description of Artificial Sequence: Synthetic polypeptide"
  source: /note="p.E624K"
LIAQSIGQAFSVAYQEFLRANGINPKKDLSQKEYSDLLNTQDMYNDDLIHFS

SEQ ID NO: 248 - protein, 52 aa, Artificial Sequence
  source: /note="Description of Artificial Sequence: Synthetic polypeptide"
  source: /note="p.K730N"
QIMSINGTSLVGLPLSTCQSIIKGLNNNQSRVKLNIVRCPPVTTVLIRRPDL

SEQ ID NO: 249 - protein, 39 aa, Artificial Sequence
  source: /note="Description of Artificial Sequence: Synthetic polypeptide"
  source: /note="p.T243fs"
EDGQVATVSSSPETKKDHPKTGAKTRLCTAPDPEPGTER

SEQ ID NO: 250 - protein, 36 aa, Artificial Sequence
  source: /note="Description of Artificial Sequence: Synthetic polypeptide"
  source: /note="p.E847fs"
PYLNTTVLPSSSSSRGSLDSSRSEKIEVWRENAELV

SEQ ID NO: 251 - protein, 84 aa, Artificial Sequence
  source: /note="Description of Artificial Sequence: Synthetic polypeptide"
  source: /note="p.F1354fs"
PRTKSSRLQGSSLSSESARHKAVEFLQERNLPPKVVLRHPKVHLNTMFRRPHSCLADVLLSVHLIVLRVVRLPAPFRVNHAVEW

SEQ ID NO: 252 - protein, 52 aa, Artificial Sequence
  source: /note="Description of Artificial Sequence: Synthetic polypeptide"
  source: /note="p.A43V"
LLLLLAGARAEEEMLENVSLVCPKDVVTRFKHLRKYTYNYEAESSSGVPGTA

SEQ ID NO: 253 - protein, 52 aa, Artificial Sequence
  source: /note="Description of Artificial Sequence: Synthetic polypeptide"
  source: /note="p.L973M"
TKTEVIPPLIENRQSWSVCKQVFPGMMNYCTSGAYSNASSTDSASYYPLTGD

SEQ ID NO: 254 - protein, 52 aa, Artificial Sequence
  source: /note="Description of Artificial Sequence: Synthetic polypeptide"
  source: /note="p.F3102L"
FLSPSAQQASWQVSARFNQYKYNQNLLSAGNNENIMEAHVGINGEANLDFLN

SEQ ID NO: 255 - protein, 52 aa, Artificial Sequence
  source: /note="Description of Artificial Sequence: Synthetic polypeptide"
  source: /note="p.R3136C"
MEAHVGINGEANLDFLNIPLTIPEMCCLPYTIITTPPLKDFSLWEKTGLKEF

SEQ ID NO: 256 - protein, 52 aa, Artificial Sequence
  source: /note="Description of Artificial Sequence: Synthetic polypeptide"
  source: /note="p.R840L"
SQVEAFESREGGPWGGRVEAEESAGLVEDSCGLDPAGSQTARAEGMGAMVEA

SEQ ID NO: 257 - protein, 52 aa, Artificial Sequence
  source: /note="Description of Artificial Sequence: Synthetic polypeptide"
  source: /note="p.S115L"
IEGEATPVNLTEPAKLEVKFSWFMPLLAPYWILATDYENYALVYSCTCIIQL

SEQ ID NO: 258 - protein, 52 aa, Artificial Sequence
  source: /note="Description of Artificial Sequence: Synthetic polypeptide"
  source: /note="p.C130R"
EETRARLSKELQAAQARLGADMEDVRRGRLVQYRGEVQAMLGQSTEELRVRL

SEQ ID NO: 259 - protein, 52 aa, Artificial Sequence
  source: /note="Description of Artificial Sequence: Synthetic polypeptide"
  source: /note="p.I138L"
PKMGVITVSGLAGLVSARKGSKFKKLLTYPLGLATLGATVCYPVQSVIIAKV

SEQ ID NO: 260 - protein, 52 aa, Artificial Sequence
  source: /note="Description of Artificial Sequence: Synthetic polypeptide"
  source: /note="p.R668W"
ERVKEKQQKELNKQKQIEKDLEEQSWWLIAASSRPNQASSEGQFVVLSSSQS

SEQ ID NO: 261 - protein, 52 aa, Artificial Sequence
  source: /note="Description of Artificial Sequence: Synthetic polypeptide"
  source: /note="p.Q261L"
SAGNGWWWVPVVAPLVGATVGTATYLLLLVALHHPEGPEPAQDLVSAQHKAS

SEQ ID NO: 262 - protein, 52 aa, Artificial Sequence
  source: /note="Description of Artificial Sequence: Synthetic polypeptide"
  source: /note="p.N68T"
QIAMAFGLGIGTLVQALGHISGAHITTPAVTVACLVGCHVSVLRAAFYVAAQ

SEQ ID NO: 263 - protein, 52 aa, Artificial Sequence
  source: /note="Description of Artificial Sequence: Synthetic polypeptide"
  source: /note="p.A309T"
KEDVNGSKWTVTTFSTTPHMPTYLVTTFVICDYDHVNRTERGKEIRIWARKD

SEQ ID NO: 264 - protein, 52 aa, Artificial Sequence
  source: /note="Description of Artificial Sequence: Synthetic polypeptide"
  source: /note="p.R1226L"
ASLLLKKVPLAQAGCLFTGIRRESPLLVGLLRCREEPPRLLGSRFQERFFLL

SEQ ID NO: 265 - protein, 52 aa, Artificial Sequence
  source: /note="Description of Artificial Sequence: Synthetic polypeptide"
  source: /note="p.R149H"
FANKQDLPNAMAISEMTDKLGLQSLHHNRTWYVQATCATQGTGLYEGLDWLS

SEQ ID NO: 266 - protein, 52 aa, Artificial Sequence
  source: /note="Description of Artificial Sequence: Synthetic polypeptide"
  source: /note="p.S38N"
LFKRLRAVPTNKACFDCGAKNPSWANNITYGVFLCIDCSGVHRSLGVHLSFI

SEQ ID NO: 267 - protein, 46 aa, Artificial Sequence
  source: /note="Description of Artificial Sequence: Synthetic polypeptide"
  source: /note="p.N299fs"
SLRLAYKDLEIQMKKDEKMNISGKKMLTQTDSAWDLEIAEVLFHIQ

SEQ ID NO: 268 - protein, 31 aa, Artificial Sequence
  source: /note="Description of Artificial Sequence: Synthetic polypeptide"
  source: /note="p.P1552fs"
LDIFKTTIPHALLTWRPNSGETAPPTSISCK

SEQ ID NO: 269 - protein, 52 aa, Artificial Sequence
  source: /note="Description of Artificial Sequence: Synthetic polypeptide"
  source: /note="p.D1632N"
KFPEQKLFAALLIKCVVQLELIQTINNNIVFFPATSKKEDAENLAAAQRDAV

SEQ ID NO: 270 - protein, 52 aa, Artificial Sequence
  source: /note="Description of Artificial Sequence: Synthetic polypeptide"
  source: /note="p.R86L"
GLIPTGSGRHPSHSTTPSGPGDEVALLGIAGEKFDIVKKWGINTYKCTKQLL

SEQ ID NO: 271 - protein, 52 aa, Artificial Sequence
  source: /note="Description of Artificial Sequence: Synthetic polypeptide"
  source: /note="p.T35A"
NPQQGQGRQNAIKCGWLRKQGGFVKAAWHTRWFVLKGDQLYYFKDEDETKPL

SEQ ID NO: 272 - protein, 52 aa, Artificial Sequence
  source: /note="Description of Artificial Sequence: Synthetic polypeptide"
  source: /note="p.E1253K"
LEFADKSPTPPNLPSDKIYPPSGSPKKENTSTATMTYMTTTPATAQMSTKEA

SEQ ID NO: 273 - protein, 52 aa, Artificial Sequence
  source: /note="Description of Artificial Sequence: Synthetic polypeptide"
  source: /note="p.R128C"
GQQRAVSHKTFGISLEEVLVNEFTRCCKHLELTATMQVEEATGQAAGRRRGN

SEQ ID NO: 274 - protein, 52 aa, Artificial Sequence
  source: /note="Description of Artificial Sequence: Synthetic polypeptide"
  source: /note="p.A147V"
VNEFTRRKHLELTATMQVEEATGQAVVGRRRGNVVRRVFGRIRRFFSRRRNE

SEQ ID NO: 275 - protein, 42 aa, Artificial Sequence
  source: /note="Description of Artificial Sequence: Synthetic polypeptide"
  source: /note="p.P16H"
MGGCIPFLKAARALCHHRIMPPLLLLSAFIFLVSVLGGAPGH

SEQ ID NO: 276 - protein, 52 aa, Artificial Sequence
  source: /note="Description of Artificial Sequence: Synthetic polypeptide"
  source: /note="p.M691L"
ESLSFIGEFIGKIRTEASQIRKDKYLLANLPFTLILANQRDSISKNLPILRH

SEQ ID NO: 277 - protein, 33 aa, Artificial Sequence
  source: /note="Description of Artificial Sequence: Synthetic polypeptide"
  source: /note="p.D890fs"
RAFLSEVQDTIPVQLVAVTDSQADFLKMRLSKS

SEQ ID NO: 278 - protein, 52 aa, Artificial Sequence
  source: /note="Description of Artificial Sequence: Synthetic polypeptide"
  source: /note="p.R137C"
QQVSLAEGDRFLLLRKTNSDWWLARCCLEAPSTSRPIFVPAAYMIEESIPSQ

SEQ ID NO: 279 - protein, 34 aa, Artificial Sequence
  source: /note="Description of Artificial Sequence: Synthetic polypeptide"
  source: /note="p.A615fs"
VQEARQVFEKIQRMGAQQDDGSDAPLEALTGQGM

SEQ ID NO: 280 - protein, 52 aa, Artificial Sequence
  source: /note="Description of Artificial Sequence: Synthetic polypeptide"
  source: /note="p.E487G"
PISLLGSFLTEESPDKEIDQNSQQEGGSRLRKGTVSSQGTEVVFASASVTPP

SEQ ID NO: 281 - protein, 48 aa, Artificial Sequence
  source: /note="Description of Artificial Sequence: Synthetic polypeptide"
  source: /note="p.S1512fs"
EKLRWISALAMPREELDLLECYNSPRYSAFEPTSPERMMNWHWRKPTW

SEQ ID NO: 282 - protein, 52 aa, Artificial Sequence
  source: /note="Description of Artificial Sequence: Synthetic polypeptide"
  source: /note="p.S614L"
QTAYSQQRFPPPQELSQDSFGSQASLLAPSMTSSKGGQEDMNLSLQSRPSSL

SEQ ID NO: 283 - protein, 45 aa, Artificial Sequence
  source: /note="Description of Artificial Sequence: Synthetic polypeptide"
  source: /note="p.K1071fs"
KPLDLYRLYVSVKEIGGLTQVNKNKNGGNLQPTSMWAHQAVLPAP

SEQ ID NO: 284 - protein, 179 aa, Artificial Sequence
  source: /note="Description of Artificial Sequence: Synthetic polypeptide"
  source: /note="p.Y1324fs"
STGAPQPNLMPSNPDSGMYSPSRYPRSSSSSSSNDMIPMAISSPPKAPLLAAPSPASRLQCINSNSRITSGQWMAHMALLPSGTKGRCTACHTALGRGSLSSSSCPQPSPSLPASNKLPSLPLSKMYTTSMAMPILPLPQLLLSADQQAAPRTNFHSSLAETVSLHPLAPMPSKTCHHK

SEQ ID NO: 285 - protein, 57 aa, Artificial Sequence
  source: /note="Description of Artificial Sequence: Synthetic polypeptide"
  source: /note="p.G1848fs"
VDCSDKLGRVQEFDSGLLHWRIGGGTPLSISRPTSRARQSCCLPGLTHPAHQPLGSM

SEQ ID NO: 286 - protein, 83 aa, Artificial Sequence
  source: /note="Description of Artificial Sequence: Synthetic polypeptide"
  source: /note="p.P2139fs"
RLVLETLSKLSIQDNNVDLILATPPSAAWRSCIALWCASSVTERTRCAGRWLWYCWPTWLRGTAWQLVPLQCRRAVSATSWAS

SEQ ID NO: 287 - protein, 63 aa, Artificial Sequence
  source: /note="Description of Artificial Sequence: Synthetic polypeptide"
  source: /note="p.G550fs"
NGIMYTGVLFAQPPAPTPTSAPNKGRRRRRQQQQRRRPGRKHRNQRRPGWASGAVHTLHIYLK

SEQ ID NO: 288 - protein, 52 aa, Artificial Sequence
  source: /note="Description of Artificial Sequence: Synthetic polypeptide"
  source: /note="p.D1154E"
LNVSKPQKLARSPARISPHIKDGEKEEKHREKHPNSSPRTYKWSFQLNELDN

SEQ ID NO: 289 - protein, 52 aa, Artificial Sequence
  source: /note="Description of Artificial Sequence: Synthetic polypeptide"
  source: /note="p.R358L"
ETDRPSLESANGKKKTKKLRMKRNHLLVEPLNIDDCAPESPTPPPPPPPVGW

SEQ ID NO: 290 - protein, 32 aa, Artificial Sequence
  source: /note="Description of Artificial Sequence: Synthetic polypeptide"
  source: /note="p.G6R"
MRVAGRRRALSRGAELRVPGGAKHGMCLLLGA

SEQ ID NO: 291 - protein, 52 aa, Artificial Sequence
  source: /note="Description of Artificial Sequence: Synthetic polypeptide"
  source: /note="p.M75L"
GVVSLVFLIIYYLDPSVLSGVSCFVLLFLCLADYLVPILAPRIFGSNKWTTE

SEQ ID NO: 292 - protein, 52 aa, Artificial Sequence
  source: /note="Description of Artificial Sequence: Synthetic polypeptide"
  source: /note="p.A514T"
LRSKNDEVRKHASWAVMVCAGDELTTTNELCRLGALDILEEVNVSGTRKNKF

SEQ ID NO: 293 - protein, 48 aa, Artificial Sequence
  source: /note="Description of Artificial Sequence: Synthetic polypeptide"
  source: /note="p.E22K"
MGVALRKLTQWTAAGHGTGILKKITPLNEAILKEIIVFVESFIYKHPQ

SEQ ID NO: 294 - protein, 52 aa, Artificial Sequence
  source: /note="Description of Artificial Sequence: Synthetic polypeptide"
  source: /note="p.T395M"
GTSCYEYFHQDDIGHLAECHRQVLQMMREKITTNCYKFKIKDGSFITLRSRW

SEQ ID NO: 295 - protein, 52 aa, Artificial Sequence
  source: /note="Description of Artificial Sequence: Synthetic polypeptide"
  source: /note="p.F212L"
SKMPFGQLMSEFGGSGTGGWVHGVSLLSASGSRLAWVSHDSTVSVADASKSV

SEQ ID NO: 296 - protein, 52 aa, Artificial Sequence
  source: /note="Description of Artificial Sequence: Synthetic polypeptide"
  source: /note="p.R338H"
SSSENELKWSDHQRAWSSTDSDSSNHHNLKPAMTKTASFGGITVLTRGDSTS

SEQ ID NO: 297 - protein, 100 aa, Artificial Sequence
  source: /note="Description of Artificial Sequence: Synthetic polypeptide"
  source: /note="p.I130fs"
HNVEKQDIATYYCALWEVHSKLGKKSRYLVPEQSLSLQINNLMQMFPPSPLFFFLQLLKQSSRRLEHTFVFLRNFSLMLLRYIGKKRRATRFWDPRRGTP

SEQ ID NO: 298 - protein, 52 aa, Artificial Sequence
  source: /note="Description of Artificial Sequence: Synthetic polypeptide"
  source: /note="p.T99P"
LSFRKDLFIATYQAFPPVPNPPRPPPPRLQDRLLRKLGQHAHPFFFTVRMPL

SEQ ID NO: 299 - protein, 52 aa, Artificial Sequence
  source: /note="Description of Artificial Sequence: Synthetic polypeptide"
  source: /note="p.T79A"
ALRLEAQGRATAAWGPSTCPRASASAAAALAVFSEVEYLNVRLSLREPPAGE

SEQ ID NO: 300 - protein, 52 aa, Artificial Sequence
  source: /note="Description of Artificial Sequence: Synthetic polypeptide"
  source: /note="p.A234G"
LGILTLAAGQTCGFFSVSARAVTGMGGGVGCLFFISWYSSFGFVRRWNCILM

SEQ ID NO: 301 - protein, 59 aa, Artificial Sequence
  source: /note="Description of Artificial Sequence: Synthetic polypeptide"
  source: /note="p.AGV234del"
LGILTLAAGQTCGFFSVSARAVTGMGCLFFISWYSSFGFVRRWNCILMRNHDVTEQPMV

SEQ ID NO: 302 - protein, 52 aa, Artificial Sequence
  source: /note="Description of Artificial Sequence: Synthetic polypeptide"
  source: /note="p.V131I"
FAVTSVGGLPLNETTLAEVLQQAGYIITGIIGKWHLGHHGSYHPNFRGFDYY

SEQ ID NO: 303 - protein, 30 aa, Artificial Sequence
  source: /note="Description of Artificial Sequence: Synthetic polypeptide"
  source: /note="p.I243fs"
IWTCLGAPIKGYSFFPGEEEVLIPPLRPSK

SEQ ID NO: 304 - protein, 52 aa, Artificial Sequence
  source: /note="Description of Artificial Sequence: Synthetic polypeptide"
  source: /note="p.T249A"
QHVALYLEHGADVGLRTSQGETALNAAACAGAEGPGSCRRHQAAARRLLEAG

SEQ ID NO: 305 - protein, 52 aa, Artificial Sequence
  source: /note="Description of Artificial Sequence: Synthetic polypeptide"
  source: /note="p.H207Y"
QEEVLAKCSMDHGVDSSIFQNPKKLYYLTIGMLVLLSEEEIQQTCEMLQQCK

SEQ ID NO: 306 - protein, 52 aa, Artificial Sequence
  source: /note="Description of Artificial Sequence: Synthetic polypeptide"
  source: /note="p.R365L"
CDNIQGFIEEFLQIFSSLLQEKRFLLLDYDALFPVAEDISLLQQASSVLDET

SEQ ID NO: 307 - protein, 52 aa, Artificial Sequence
  source: /note="Description of Artificial Sequence: Synthetic polypeptide"
  source: /note="p.R1197Q"
VKQCVHQIPSVMMEASIQPITRTVLQQVTLSIYADFTWNDQVHGTVGEPWWI

SEQ ID NO: 308 - protein, 52 aa, Artificial Sequence
  source: /note="Description of Artificial Sequence: Synthetic polypeptide"
  source: /note="p.R136Q"
ETKAIKQMFGPFPSSSATAACNATNQQIISHFSQDDLTALVQMTEKEHGDRV

SEQ ID NO: 309 - protein, 77 aa, Artificial Sequence
  source: /note="Description of Artificial Sequence: Synthetic polypeptide"
  source: /note="p.D35fs"
ALPYSLRTAPLGVPGTLPGLPRRDPSGSPCVWTPRAGSGRAAAAHGDGSTCPCRWTAPSSPPSSASATSASGSGCAA

SEQ ID NO: 310 - protein, 52 aa, Artificial Sequence
  source: /note="Description of Artificial Sequence: Synthetic polypeptide"
  source: /note="p.R46L"
RMAREEPAPAALAAAGQPGGGRGGELLALQGPGVARRGRPSLSRAKLHGLRH

SEQ ID NO: 311 - protein, 44 aa, Artificial Sequence
  source: /note="Description of Artificial Sequence: Synthetic polypeptide"
  source: /note="p.Q266R"
AVHTRRENPAEPGAVTGSATVTAFWRRSLLACCQLPSRPGIHLC

SEQ ID NO: 312 - protein, 52 aa, Artificial Sequence
  source: /note="Description of Artificial Sequence: Synthetic polypeptide"
  source: /note="p.S240F"
EENKIPISPISPAFNECHGATCLPLFFVRRSTTYSSLHASENRELLNVHSAN

SEQ ID NO: 313 - protein, 48 aa, Artificial Sequence
  source: /note="Description of Artificial Sequence: Synthetic polypeptide"
  source: /note="p.F67fs"
DDDDDDDDDEDNSLFPTREPRSHFFHLICFQCVHLDVSAIHELYIAQI

SEQ ID NO: 314 - protein, 53 aa, Artificial Sequence
  source: /note="Description of Artificial Sequence: Synthetic polypeptide"
  source: /note="p.L221del"
EIVEEQMHILHISVMGGLIALLLLLVFTVALYAQRRWQKRRRIPQKSASTEAT

SEQ ID NO: 315 - protein, 52 aa, Artificial Sequence
  source: /note="Description of Artificial Sequence: Synthetic polypeptide"
  source: /note="p.S1081L"
EGLSKATQDQILQTLIQRVRRQNLLLLVVPPSQFNFAHSGFQLEDISTSQRF

SEQ ID NO: 316 - protein, 83 aa, Artificial Sequence
  source: /note="Description of Artificial Sequence: Synthetic polypeptide"
  source: /note="p.E873fs"
SIPELASTEMIKVKNHSVLQRTEKKCYLHHWNYLSFLKGQIIREMSFHLLNYRTSNISHQWIRLHFQKALEIKHISKGVHRVG

SEQ ID NO: 317 - protein, 52 aa, Artificial Sequence
  source: /note="Description of Artificial Sequence: Synthetic polypeptide"
  source: /note="p.P1470Q"
NRADNSGKPQQPPGGFAPAAINRSIQQCKVIVDHSTTLTSSLSLTVSVESSE

SEQ ID NO: 318 - protein, 52 aa, Artificial Sequence
  source: /note="Description of Artificial Sequence: Synthetic polypeptide"
  source: /note="p.I305V"
EIPDSTMSICVPSETVDEIVKSGYIVGESENSEISQQVRFKTVTVLAQVHPI

SEQ ID NO: 319 - protein, 52 aa, Artificial Sequence
  source: /note="Description of Artificial Sequence: Synthetic polypeptide"
  source: /note="p.S800F"
SLRNMMQLCTRCLSNCTKKSPNKIAFFGFFLRLLTSKLMNDIADICKSLASF

SEQ ID NO: 320 - protein, 52 aa, Artificial Sequence
  source: /note="Description of Artificial Sequence: Synthetic polypeptide"
  source: /note="p.L1304I"
CNSPTNPYWVMEGQLSNPTFYLVCFIITPVVALLPRYFFLSLQGTCGKSLIS

SEQ ID NO: 321 - protein, 52 aa, Artificial Sequence
  source: /note="Description of Artificial Sequence: Synthetic polypeptide"
  source: /note="p.R311H"
AVVGIVVYAGHETKAMLNNSGPRYKHHSKLERRANTDVLWCVMLLVIMCLTG

SEQ ID NO: 322 - protein, 52 aa, Artificial Sequence
  source: /note="Description of Artificial Sequence: Synthetic polypeptide"
  source: /note="p.R858C"
LGTDIIPSIALAYEKAESDIMNRKPCCHKNKDRLVNQPLAVYSYLHIGLMQA

SEQ ID NO: 323 - protein, 52 aa, Artificial Sequence
  source: /note="Description of Artificial Sequence: Synthetic polypeptide"
  source: /note="p.G704C"
VEPSHKSKIVEYLQSYDEITAMTGDCCVNDAPALKKAEIGIAMGSGTAVAKT

SEQ ID NO: 324 - protein, 63 aa, Artificial Sequence
  source: /note="Description of Artificial Sequence: Synthetic polypeptide"
  source: /note="p.R819fs"
LVTDGLPATALGFNPPDLDIMDRPPPEPQGAPHQWLALLPLHGNRGLCGCSHRGSSCLVVPVR

SEQ ID NO: 325 - protein, 52 aa, Artificial Sequence
  source: /note="Description of Artificial Sequence: Synthetic polypeptide"
  source: /note="p.R183H"
SVIIVVLVTAFNDWSKEKQFRGLQCHHIEQEQKFSIIRNGQLIQLPVAEIVV

SEQ ID NO: 326 - protein, 52 aa, Artificial Sequence
  source: /note="Description of Artificial Sequence: Synthetic polypeptide"
  source: /note="p.E724K"
GTDVCKEAADMILVDDDFQTIMSAIKKEGKGIYNNIKNFVRFQLSTSIAALT

SEQ ID NO: 327 - protein, 52 aa, Artificial Sequence
  source: /note="Description of Artificial Sequence: Synthetic polypeptide"
  source: /note="p.E119Q"
ISYPLENAVPFSLDSVANSIHSLFSQQETPVVLQLAPSEERVYMVGKANSVF

SEQ ID NO: 328 - protein, 52 aa, Artificial Sequence
  source: /note="Description of Artificial Sequence: Synthetic polypeptide"
  source: /note="p.R191Q"
MTGKLGFIAGVINRERMASFERLLWQQICRGNVYLKFSEMDAPLEDPVTKEE

SEQ ID NO: 329 - protein, 52 aa, Artificial Sequence
  source: /note="Description of Artificial Sequence: Synthetic polypeptide"
  source: /note="p.L237P"
RQVRPVTEKLPANHPLLTGQRVLDAPPFPCVQGGTTAIPGAFGCGKTVISQS

SEQ ID NO: 330 - protein, 34 aa, Artificial Sequence
  source: /note="Description of Artificial Sequence: Synthetic polypeptide"
  source: /note="p.Y383fs"
DLTGFITEGQIYVDRQLHNRQIYPPSTCSLPCRG

SEQ ID NO: 331 - protein, 44 aa, Artificial Sequence
  source: /note="Description of Artificial Sequence: Synthetic polypeptide"
  source: /note="p.R312fs"
STFPDHKVKVTPLGNPDRPAAGQTDKERERVRARVRAPCCAGSR

SEQ ID NO: 332 - protein, 71 aa, Artificial Sequence
  source: /note="Description of Artificial Sequence: Synthetic polypeptide"
  source: /note="p.Q990fs"
IVETYFPGYNRSISRTETIIRFAFQSLYHSSVYCMSLFTGTGHSNCCDGGYRSRCSKWHTNKRWRAIGDGS

SEQ ID NO: 333 - protein, 52 aa, Artificial Sequence
  source: /note="Description of Artificial Sequence: Synthetic polypeptide"
  source: /note="p.R519Q"
VYQASSPDEVALVQWTESVGLTLVGQQDQSSMQLRTPGDQILNFTILQIFPF

SEQ ID NO: 334 - protein, 52 aa, Artificial Sequence
  source: /note="Description of Artificial Sequence: Synthetic polypeptide"
  source: /note="p.R290Q"
ASGTVVGVVLYTGRELRSVMNTSNPQQSKIGLFDLEVNCLTKILFGALVVVS

SEQ ID NO: 335 - protein, 52 aa, Artificial Sequence
  source: /note="Description of Artificial Sequence: Synthetic polypeptide"
  source: /note="p.S39G"
AAAAANRKRAAYYSAAGPRPGADRHGGRYQLEDESAHLDEMPLMMSEEGFEN

SEQ ID NO: 336 - protein, 34 aa, Artificial Sequence
  source: /note="Description of Artificial Sequence: Synthetic polypeptide"
  source: /note="p.R1814fs"
NYLAADGKSTTWSVRLGQLLLSAKKEISQLFMTH

SEQ ID NO: 337 - protein, 52 aa, Artificial Sequence
  source: /note="Description of Artificial Sequence: Synthetic polypeptide"
  source: /note="p.P197Q"
LRFNHFATECSWDHLYVYDGDSIYAQQLVAAFSGLIVPERDGNETVPEVVAT

SEQ ID NO: 338 - protein, 52 aa, Artificial Sequence
  source: /note="Description of Artificial Sequence: Synthetic polypeptide"
  source: /note="p.L1244F"
IAFSQHNTIMDLVQFFVTFFSCFLSFFLLVAAVVWKIKQTCWASRRREQLLR

SEQ ID NO: 339 - protein, 52 aa, Artificial Sequence
  source: /note="Description of Artificial Sequence: Synthetic polypeptide"
  source: /note="p.K1936R"
IASDSDETSMSLSSDDYTKKKKKGKRRGKKDSSSSGSGSDNDVEVIKVWNSR

SEQ ID NO: 340 - protein, 52 aa, Artificial Sequence
  source: /note="Description of Artificial Sequence: Synthetic polypeptide"
  source: /note="p.Q217H"
GHKAEQQQQQQQQQQQQHQHQQQQQHHQQQQQQQQHLSRAPGLITPGSPPPA

SEQ ID NO: 341 - protein, 43 aa, Artificial Sequence
  source: /note="Description of Artificial Sequence: Synthetic polypeptide"
  source: /note="p.S387L"
RLLKHNPSQRPMLREVLEHPWITANLLSKPSNCQNKESASKQS

SEQ ID NO: 342 - protein, 52 aa, Artificial Sequence
  source: /note="Description of Artificial Sequence: Synthetic polypeptide"
  source: /note="p.G64W"
EGDCYVILSTRRVASLLSQDIHFWIWWKDSSQDEQSCAAIYTTQLDDYLGGS

SEQ ID NO: 343 - protein, 29 aa, Artificial Sequence
  source: /note="Description of Artificial Sequence: Synthetic peptide"
  source: /note="p.G299fs"
DLLNHDDCYILDQSGTKIYVWKGKGSHKG

SEQ ID NO: 344 - protein, 52 aa, Artificial Sequence
  source: /note="Description of Artificial Sequence: Synthetic polypeptide"
  source: /note="p.F34L"
DGVPRGPVLHIVVVGFHHKKGCQVELLSYPPLIPGDGHDSHTLPEEWKYLPF

SEQ ID NO: 345 - protein, 32 aa, Artificial Sequence
  source: /note="Description of Artificial Sequence: Synthetic polypeptide"
  source: /note="p.G7fs"
MEKARRGGGWRPPGARTAHRGGRISPQEGLPG

SEQ ID NO: 346 - protein, 43 aa, Artificial Sequence
  source: /note="Description of Artificial Sequence: Synthetic polypeptide"
  source: /note="p.F351fs"
ENPTITITALLGSLNSCCNPWIYMFLVAISFKTVFKASHAAKT

SEQ ID NO: 347 - protein, 52 aa, Artificial Sequence
  source: /note="Description of Artificial Sequence: Synthetic polypeptide"
  source: /note="p.G39R"
RGTLSAPNATTPWLGRDEELAKVEIRRVLATVLVLATGGNLAVLLTLGQLGR

SEQ ID NO: 348 - protein, 52 aa, Artificial Sequence
  source: /note="Description of Artificial Sequence: Synthetic polypeptide"
  source: /note="p.E930D"
WRESAKQGTLAQKYLEAMAVIEHMQDDKLLEVENRARQAEEKFEDAYEKLHH

SEQ ID NO: 349 - protein, 52 aa, Artificial Sequence
  source: /note="Description of Artificial Sequence: Synthetic polypeptide"
  source: /note="p.W101R"
CPENLLPPKKIKTPKGTLPRLVDHVRRHHPVRRNKFKYLIDHPVSLTGAGRD

SEQ ID NO: 350 - protein, 48 aa, Artificial Sequence
  source: /note="Description of Artificial Sequence: Synthetic polypeptide"
  source: /note="p.W663fs"
QSTKKAYPLESARSSPGERASRHHLSTAGTPAPPPVPTCSPRTLRCLP

SEQ ID NO: 351 - protein, 65 aa, Artificial Sequence
  source: /note="Description of Artificial Sequence: Synthetic polypeptide"
  source: /note="p.G665fs"
KKAYPLESARSSPGERASRHHLWGGQQRAPPHHPPCPPVHPGPCDASPDPTQHAGSAGGGLSQAS

SEQ ID NO: 352 - protein, 48 aa, Artificial Sequence
  source: /note="Description of Artificial Sequence: Synthetic polypeptide"
  source: /note="p.G665fs"
TKKAYPLESARSSPGERASRHHLWGATAGTPAPPPVPTCSPRTLRCLP

SEQ ID NO: 353 - protein, 27 aa, Artificial Sequence
  source: /note="Description of Artificial Sequence: Synthetic peptide"
  source: /note="p.M1V"
VVSRSVALAVLALLSLSGLEAIQRTPK

SEQ ID NO: 354 - protein, 54 aa, Artificial Sequence
  source: /note="Description of Artificial Sequence: Synthetic polypeptide"
  source: /note="p.L13fs"
MSRSVALAVLALLSFWPGGYPAYSKDSGLLTSSSREWKVKFPELLCVWVSSIRH

SEQ ID NO: 355 - protein, 27 aa, Artificial Sequence
  source: /note="Description of Artificial Sequence: Synthetic peptide"
  source: /note="p.M1I"
IISRSVALAVLALLSLSGLEAIQRTPK

SEQ ID NO: 356 - protein, 52 aa, Artificial Sequence
  source: /note="Description of Artificial Sequence: Synthetic polypeptide"
  source: /note="p.R145Q"
QEAEKEDKMLALSLEDEHLLYGDIIQQQDFLDTYNNLTLKTIMAFRWVTEFC

SEQ ID NO: 357 - protein, 52 aa, Artificial Sequence
  source: /note="Description of Artificial Sequence: Synthetic polypeptide"
  source: /note="p.R125L"
AELTRMANTLLHVPNLHWLVVEDAPLLRTPLTARLLRDTGLNYTHLHVETPR

SEQ ID NO: 358 - protein, 33 aa, Artificial Sequence
  source: /note="Description of Artificial Sequence: Synthetic polypeptide"
  source: /note="p.F30fs"
GRRVKKWQLIIQLFATCFLASLMFFGNQSIITL

SEQ ID NO: 359 - protein, 37 aa, Artificial Sequence
  source: /note="Description of Artificial Sequence: Synthetic polypeptide"
  source: /note="p.G88fs"
PVRIKEQVVGLLAWNNCSCESSGGGPPPPLPETSPSY

SEQ ID NO: 360 - protein, 52 aa, Artificial Sequence
  source: /note="Description of Artificial Sequence: Synthetic polypeptide"
  source: /note="p.R538Q"
ESCSAREQECEVKLPFNAQRIISLSQQNDFQSLLKMHKLTPEQLDCIHDIRR

SEQ ID NO: 361 - protein, 52 aa, Artificial Sequence
  source: /note="Description of Artificial Sequence: Synthetic polypeptide"
  source: /note="p.G45R"
RLRALRPGREPRQSEPPAQRGPPPSRRRPPARSTASGHDRPTRGAAAGARRP

SEQ ID NO: 362 - protein, 52 aa, Artificial Sequence
  source: /note="Description of Artificial Sequence: Synthetic polypeptide"
  source: /note="p.A231G"
EECGRAAGRACGFAQPGCSCPGEAGGGGSTTTTSPGPPAAHTLSNALVPGGP

SEQ ID NO: 363 - protein, 52 aa, Artificial Sequence
  source: /note="Description of Artificial Sequence: Synthetic polypeptide"
  source: /note="p.V396M"
SSASGWFPEAYVKALEEGPVNPMTPMMTPMTSMTSMSPMTPMNPGNELPSRS

SEQ ID NO: 364 - protein, 52 aa, Artificial Sequence
  source: /note="Description of Artificial Sequence: Synthetic polypeptide"
  source: /note="p.N78S"
IEERRSRRKVSTLVDDTSVIDDDIVSSNMFFAHQLIPNSCATHALLSVLLNC

SEQ ID NO: 365 - protein, 52 aa, Artificial Sequence
  source: /note="Description of Artificial Sequence: Synthetic polypeptide"
  source: /note="p.R227C"
WTDKARRVIMERIGLATAGEPYHDICCFNLMAVVPDRRIKYEARLHVLKVNR

SEQ ID NO: 366 - protein, 52 aa, Artificial Sequence
  source: /note="Description of Artificial Sequence: Synthetic polypeptide"
  source: /note="p.R68P"
SLYSVCPSLVVRPKPLHSCTGSPSLPPAYPLLSVITRQPTVISHLVPATPGI

SEQ ID NO: 367 - protein, 57 aa, Artificial Sequence
  source: /note="Description of Artificial Sequence: Synthetic polypeptide"
  source: /note="p.M38fs"
SEQIMKTGALLLQGFIQDRAGRMGGGGTRAGPGPGASGCVHQEAERVSQAHRGRTGQ

SEQ ID NO: 368 - protein, 52 aa, Artificial Sequence
  source: /note="Description of Artificial Sequence: Synthetic polypeptide"
  source: /note="p.F176V"
RLTGASDKPGEVSKLGKRMGFLYLTVVYGHTWQVQDKIDANNVAYTTGKLSF

SEQ ID NO: 369 - protein, 35 aa, Artificial Sequence
  source: /note="Description of Artificial Sequence: Synthetic polypeptide"
  source: /note="p.F268fs"
ALDICIVSFNQSASSVFVLGERNFFALRIMDKFDS

SEQ ID NO: 370 - protein, 52 aa, Artificial Sequence
  source: /note="Description of Artificial Sequence: Synthetic polypeptide"
  source: /note="p.L133R"
SSKSRNAPRSSCGNCGARAPEHPPVRRRVESLNLPLLNGLREEGPGVFSRSV

SEQ ID NO: 371 - protein, 52 aa, Artificial Sequence
  source: /note="Description of Artificial Sequence: Synthetic polypeptide"
  source: /note="p.T214M"
DLHCNKRILVVVLQEKIAAFDSCTFMMKKFFVTSCYPCPGPNMNPIALGSRW

SEQ ID NO: 372 - protein, 47 aa, Artificial Sequence
  source: /note="Description of Artificial Sequence: Synthetic polypeptide"
  source: /note="p.H37fs"
RGLSQAALLLLRQPGARGLARSHPPGSSSSFHLWMTSPSSQGPRRSL

SEQ ID NO: 373 - protein, 46 aa, Artificial Sequence
  source: /note="Description of Artificial Sequence: Synthetic polypeptide"
  source: /note="p.G129fs"
LCCFWPVGIAAFCLAQKVSLCVGLGIKEKNAPQKQRAIYLRREGGR

SEQ ID NO: 374 - protein, 52 aa, Artificial Sequence
  source: /note="Description of Artificial Sequence: Synthetic polypeptide"
  source: /note="p.E579K"
SMQHFSEAFHQVLGEKHKRGHLAEAKKGHRDTCDEDSVAGESDRIDDGTVNG

SEQ ID NO: 375 - protein, 52 aa, Artificial Sequence
  source: /note="Description of Artificial Sequence: Synthetic polypeptide"
  source: /note="p.N172S"
IVAFFEFGGVMCVESVNREMSPLVDSSIALWMTEYLNRHLHTWIQDNGGWDA

SEQ ID NO: 376 - protein, 46 aa, Artificial Sequence
  source: /note="Description of Artificial Sequence: Synthetic polypeptide"
  source: /note="p.H20Q"
MAHAGRTGYDNREIVMKYIQQYKLSQRGYEWDAGDVGAAPPGAAPA

SEQ ID NO: 377 - protein, 52 aa, Artificial Sequence
  source: /note="Description of Artificial Sequence: Synthetic polypeptide"
  source: /note="p.G33R"
GYDNREIVMKYIHYKLSQRGYEWDARRDVGAAPPGAAPAPGIFSSQPGHTPH

SEQ ID NO: 378 - protein, 52 aa, Artificial Sequence
  source: /note="Description of Artificial Sequence: Synthetic polypeptide"
  source: /note="p.R91Q"
PPASPGPFATRSPLFIFMRRSSLLSQQSSSGYFSFDTDRSPAPMSCDKSTQT

SEQ ID NO: 379 - protein, 101 aa, Artificial Sequence
  source: /note="Description of Artificial Sequence: Synthetic polypeptide"
  source: /note="p.L187fs"
YARRVFLNNYQAAEDHPRMVILRLLTLHCPPGVENALTGSLRSRDTMQTFCLFKPTRPSTAVSWCHYYAASGSLVEGAGDVSEDTELDGTTFLFITTQQNF

SEQ ID NO: 380 - protein, 52 aa, Artificial Sequence
  source: /note="Description of Artificial Sequence: Synthetic polypeptide"
  source: /note="p.T52M"
KVRKWEKKWVTVGDTSLRIYKWVPVMMEPKVDDKNKNKKKGKDEKCGSEVTT

SEQ ID NO: 381 - protein, 52 aa, Artificial Sequence
  source: /note="Description of Artificial Sequence: Synthetic polypeptide"
  source: /note="p.G980C"
PQTPSQMVPLPSANPPGPLKSPQVLCCSSLSVRSPTGSPSRLKSPSMAVPSP

SEQ ID NO: 382 - protein, 66 aa, Artificial Sequence
  source: /note="Description of Artificial Sequence: Synthetic polypeptide"
  source: /note="p.P1127fs"
YHNAIKTIATSDDELLPDRPLLPPPTTTAGLRARDQQQPAQPDAPELSRCPEPYGHEPARPAAPVP

SEQ ID NO: 383 - protein, 56 aa, Artificial Sequence
  source: /note="Description of Artificial Sequence: Synthetic polypeptide"
  source: /note="p.R37fs"
RSKSRSQSSSRSRSRSHSRKKRYSSTGLVPEHIQGLVVEIVCILEIIVAITEIIEE

SEQ ID NO: 384 - protein, 52 aa, Artificial Sequence
  source: /note="Description of Artificial Sequence: Synthetic polypeptide"
  source: /note="p.N1459S"
LPCSSSPQETTQSRPMPPEARRLIVSSKNAGETLLQRAARLGYEEVVLYCLE

SEQ ID NO: 385 - protein, 52 aa, Artificial Sequence
  source: /note="Description of Artificial Sequence: Synthetic polypeptide"
  source: /note="p.P536Q"
RILFSKEILISSSVDIHLKDSQSLDQQNKMAALREYLATTFPTCDLHEHGKD

SEQ ID NO: 386 - protein, 52 aa, Artificial Sequence
  source: /note="Description of Artificial Sequence: Synthetic polypeptide"
  source: /note="p.E630K"
NDQRGRDGGEGCSWMFQPMNNSKMRKKKRNLQPNSNAIPEGMREPSTDNPEE

SEQ ID NO: 387 - protein, 78 aa, Artificial Sequence
  source: /note="Description of Artificial Sequence: Synthetic polypeptide"
  source: /note="p.D265fs"
FQPPPEYQLTAAELKQIVDQSLSGGTWPAACWCSSSPSSSATWTSPGAAVPVALRPSASWSRCTCSSSATMWRSTTPR

SEQ ID NO: 388 - protein, 52 aa, Artificial Sequence
  source: /note="Description of Artificial Sequence: Synthetic polypeptide"
  source: /note="p.R198C"
LEDAVVPRALYEELLRNYQQQQEEMCCHLQQELERTRRQLVQQAKKLKEYGA

SEQ ID NO: 389 - protein, 42 aa, Artificial Sequence
  source: /note="Description of Artificial Sequence: Synthetic polypeptide"
  source: /note="p.P383L"
SFLGSTVQMGKQMPKNEWKMEDIKILLLPQPQFQCAKSDPGG

SEQ ID NO: 390 - protein, 82 aa, Artificial Sequence
  source: /note="Description of Artificial Sequence: Synthetic polypeptide"
  source: /note="p.P444fs"
SSMFLPRDDLSPARDLLDVPSRNPPQGLTHLEEILLPRRKPHAALQHGRAVHHQGDQPDKHFTEPDPTVQCENFPHQNATGT

SEQ ID NO: 391 - protein, 52 aa, Artificial Sequence
  source: /note="Description of Artificial Sequence: Synthetic polypeptide"
  source: /note="p.L62Q"
STPPGMDLSLAPPPRERPASSSSSPQQGCFEPADPEGAGLLLPPPGGGGGGS

SEQ ID NO: 392 - protein, 52 aa, Artificial Sequence
  source: /note="Description of Artificial Sequence: Synthetic polypeptide"
  source: /note="p.R162H"
SENERLASVAQELKEINQNVEIQRGHHLRDDIKEYKFREARLLQDYSELEEE

SEQ ID NO: 393 - protein, 52 aa, Artificial Sequence
  source: /note="Description of Artificial Sequence: Synthetic polypeptide"
  source: /note="p.V414L"
SCFGSGSCPHFLAAATKRGKICIWDLLSKLMKVHLKFEINAYDPAIVQQLIL

SEQ ID NO: 394 - protein, 38 aa, Artificial Sequence
  source: /note="Description of Artificial Sequence: Synthetic polypeptide"
  source: /note="p.A225M"
VFIPCGHLVTCKQCAEAVDRCPMCSMMVIDFKQRVFMS

SEQ ID NO: 395 - protein, 52 aa, Artificial Sequence
  source: /note="Description of Artificial Sequence: Synthetic polypeptide"
  source: /note="p.H660Q"
ASRNLKHERFQSLSFPHTKEMMKIFQQKKFGLHNFRTNQLEAINAALLGEDC

SEQ ID NO: 396 - protein, 52 aa, Artificial Sequence
  source: /note="Description of Artificial Sequence: Synthetic polypeptide"
  source: /note="p.S44L"
AGSVRMRDLRNPHPSSAFLNLIGFVLLRRELGSIDGVQQISLEDALSSQEVE

SEQ ID NO: 397 - protein, 52 aa, Artificial Sequence
  source: /note="Description of Artificial Sequence: Synthetic polypeptide"
  source: /note="p.H487Q"
QQQQQQQQQQQQQQQQQQQQQQQQQQQHHHHHHHLLQDAYMQQYQHATQQQQ

SEQ ID NO: 398 - protein, 52 aa, Artificial Sequence
  source: /note="Description of Artificial Sequence: Synthetic polypeptide"
  source: /note="p.R344W"
KPYKTLQAQAPEKSKNKKKQRKGPHWWKSQTLQFDEQTLKKARRKQWIEPRN

SEQ ID NO: 399 - protein, 52 aa, Artificial Sequence
  source: /note="Description of Artificial Sequence: Synthetic polypeptide"
  source: /note="p.Q118L"
PRPLHGLQQPQPPALRQQEEQQQQQLLLPRGEPPPGRLKSAPLFMLDLYNAL

SEQ ID NO: 400 - protein, 62 aa, Artificial Sequence
  source: /note="Description of Artificial Sequence: Synthetic polypeptide"
  source: /note="p.RIAL444del"
KSVELVLGESRVSLQQHLTVRWNGSPCRAPHFHIDLDGYLLKVTTKAGLEISWDGDSFVEVM

SEQ ID NO: 401 - protein, 52 aa, Artificial Sequence
  source: /note="Description of Artificial Sequence: Synthetic polypeptide"
  source: /note="p.R241Q"
PPGQCCPKCLGQRKVFDLPFGSCLFQQSDVYDNGSSFLYDNCTACTCRDSTV

SEQ ID NO: 402 - protein, 52 aa, Artificial Sequence
  source: /note="Description of Artificial Sequence: Synthetic polypeptide"
  source: /note="p.G455V"
KAIFGDEDESGDSDDEEDDEMSEDDVVLENGSSDEEAEEEENAEMTDQYMAV

SEQ ID NO: 403 - protein, 52 aa, Artificial Sequence
  source: /note="Description of Artificial Sequence: Synthetic polypeptide"
  source: /note="p.E878D"
GEMQKQAQLNRAEFEDQDDEARVQYDDGFRPGMYVRIEIENVPCEFVQNFDP

SEQ ID NO: 404 - protein, 52 aa, Artificial Sequence
  source: /note="Description of Artificial Sequence: Synthetic polypeptide"
  source: /note="p.Y937N"
MEKADQSLASLPSGLPITCHLCQKTNNSNKGTFRAHYKTVHLRQLHKCKVPG

SEQ ID NO: 405 - protein, 52 aa, Artificial Sequence
  source: /note="Description of Artificial Sequence: Synthetic polypeptide"
  source: /note="p.R512W"
NRHSANPNPRLHMPMLRNNRDKDLIWWATSGAATPVIASTKSNLALTSPGRP

SEQ ID NO: 406 - protein, 52 aa, Artificial Sequence
  source: /note="Description of Artificial Sequence: Synthetic polypeptide"
  source: /note="p.S575R"
LQNPLPSQLVFSGLKTVQPVPPFYRRRLLTPGEMVSPPTSLPTSPIIPTSGT

SEQ ID NO: 407 - protein, 52 aa, Artificial Sequence
  source: /note="Description of Artificial Sequence: Synthetic polypeptide"
  source: /note="p.M255I"
IDSVAGINYGLVAPPATTAETLDVQIIKGEFYSENHHNPPPFAPPVMEFPAA

SEQ ID NO: 408 - protein, 32 aa, Artificial Sequence
  source: /note="Description of Artificial Sequence: Synthetic polypeptide"
  source: /note="p.P403fs"
NIDDLIRDQGFRGDGGSTTGLSATPLPHYLAH

SEQ ID NO: 409 - protein, 52 aa, Artificial Sequence
  source: /note="Description of Artificial Sequence: Synthetic polypeptide"
  source: /note="p.G466V"
LGRRDSSDDWEIPDGQITVGQRIGSVVSFGTVYKGKWHGDVAVKMLNVTAPT

SEQ ID NO: 410 - protein, 52 aa, Artificial Sequence
  source: /note="Description of Artificial Sequence: Synthetic polypeptide"
  source: /note="p.G469A"
RDSSDDWEIPDGQITVGQRIGSGSFAATVYKGKWHGDVAVKMLNVTAPTPQQ

SEQ ID NO: 411 - protein, 52 aa, Artificial Sequence
  source: /note="Description of Artificial Sequence: Synthetic polypeptide"
  source: /note="p.G469V"
RDSSDDWEIPDGQITVGQRIGSGSFVVTVYKGKWHGDVAVKMLNVTAPTPQQ

SEQ ID NO: 412 - protein, 53 aa, Artificial Sequence
  source: /note="Description of Artificial Sequence: Synthetic polypeptide"
  source: /note="p.V600K"
RDLKSNNIFLHEDLTVKIGDFGLATKKKSRWSGSHQFEQLSGSILWMAPEVIR

SEQ ID NO: 413 - protein, 52 aa, Artificial Sequence
  source: /note="Description of Artificial Sequence: Synthetic polypeptide"
  source: /note="p.V600E"
RDLKSNNIFLHEDLTVKIGDFGLATEEKSRWSGSHQFEQLSGSILWMAPEVI

SEQ ID NO: 414 - protein, 52 aa, Artificial Sequence
  source: /note="Description of Artificial Sequence: Synthetic polypeptide"
  source: /note="p.K601E"
DLKSNNIFLHEDLTVKIGDFGLATVEESRWSGSHQFEQLSGSILWMAPEVIR

SEQ ID NO: 415 - protein, 52 aa, Artificial Sequence
  source: /note="Description of Artificial Sequence: Synthetic polypeptide"
  source: /note="p.K601N"
DLKSNNIFLHEDLTVKIGDFGLATVNNSRWSGSHQFEQLSGSILWMAPEVIR

SEQ ID NO: 416 - protein, 74 aa, Artificial Sequence
  source: /note="Description of Artificial Sequence: Synthetic polypeptide"
  source: /note="p.P24fs"
MSTATTVAPAGIPATPGPVNPPPPGGLQPQQARPQDQPAAVHAECGGEDALETPVRLALLPARGRNQIEPAGLS

SEQ ID NO: 417 - protein, 52 aa, Artificial Sequence
  source: /note="Description of Artificial Sequence: Synthetic polypeptide"
  source: /note="p.G330W"
HAADEARDRINRFLPGGKMGYLKRNWWDGSLLYSVVNTAEPDADEEETHPVD

SEQ ID NO: 418 - protein, 52 aa, Artificial Sequence
  source: /note="Description of Artificial Sequence: Synthetic polypeptide"
  source: /note="p.V469L"
DGELDLSGIDDLEIDRYILNESEARLLKAELWMRENAEYLREQREKEARIAK

SEQ ID NO: 419 - protein, 32 aa, Artificial Sequence
  source: /note="Description of Artificial Sequence: Synthetic polypeptide"
  source: /note="p.K70Q"
SRLATLNEKLTALERRIEYIEARVTQQGETLT

SEQ ID NO: 420 - protein, 46 aa, Artificial Sequence
  source: /note="Description of Artificial Sequence: Synthetic polypeptide"
  source: /note="p.G107fs"
LSQLRLRLEEVGAERAPEYTEPLGGCSGASRFAFRWQGSTRASVWM

SEQ ID NO: 421 - protein, 52 aa, Artificial Sequence
  source: /note="Description of Artificial Sequence: Synthetic polypeptide"
  source: /note="p.R66C"
HLYHYDHDNPPPPQQTPLRKHKKKGCCQSRPANKQSPSPSEVSQSPGREVMS

SEQ ID NO: 422 - protein, 52 aa, Artificial Sequence
  source: /note="Description of Artificial Sequence: Synthetic polypeptide"
  source: /note="p.K1319R"
TSSGRRRVHDGKKSIRATNYVESNWRRKQCKELVNLIFQCEDSEPFRQPVDL

SEQ ID NO: 423 - protein, 52 aa, Artificial Sequence
  source: /note="Description of Artificial Sequence: Synthetic polypeptide"
  source: /note="p.R787C"
TVEKKKKPSYTTQRNDYEPSCGRSLCCRTQRKRQHTYQTRSNIEHNSQASCQ

SEQ ID NO: 424 - protein, 52 aa, Artificial Sequence
  source: /note="Description of Artificial Sequence: Synthetic polypeptide"
  source: /note="p.H160N"
VNYVKPPNVVNITSARQLTGCSRFGNNIFPSSAYQHIKMHKRILGHLSSVYC

SEQ ID NO: 425 - protein, 52 aa, Artificial Sequence
  source: /note="Description of Artificial Sequence: Synthetic polypeptide"
  source: /note="p.G36A"
LLQLLLQLLLLLLLLAAGGARARWRAAEGTSAHLRDIFLGRCAEYRALLSPE

SEQ ID NO: 426 - protein, 77 aa, Artificial Sequence
  source: /note="Description of Artificial Sequence: Synthetic polypeptide"
  source: /note="p.T451fs"
LSDLVSRAMHHLQPLNAKHHGNGTPCTTSRGHCTGSPRPCTPFAISCTAHKWNGKTPTWSLPKSTSRWKGPSSCCRR

SEQ ID NO: 427 - protein, 52 aa, Artificial Sequence
  source: /note="Description of Artificial Sequence: Synthetic polypeptide"
  source: /note="p.A561V"
LLPGVDCEPRQLRADDCFCASRKLDVVVAIEAKFKQDLGFRMLNCGRTDLVK

SEQ ID NO: 428 - protein, 52 aa, Artificial Sequence
  source: /note="Description of Artificial Sequence: Synthetic polypeptide"
  source: /note="p.G265A"
CMESLFRDIYSRVVASGVPRSCSGPAASGSGSGPGPSSGPGAAPAADKEREA

SEQ ID NO: 429 - protein, 52 aa, Artificial Sequence
  source: /note="Description of Artificial Sequence: Synthetic polypeptide"
  source: /note="p.S436L"
HPYGSKWVHRQALHFLCEEFSQVMTLLDVFYELSKDHLLTAIQSDYLQASEQ

SEQ ID NO: 430 - protein, 52 aa, Artificial Sequence
  source: /note="Description of Artificial Sequence: Synthetic polypeptide"
  source: /note="p.L31F"
TRAATMIGEIAAAVSFISKFLRTKGFFTSERQLQTFSQSLQELLAEHYKHHW

SEQ ID NO: 431 - protein, 52 aa, Artificial Sequence
  source: /note="Description of Artificial Sequence: Synthetic polypeptide"
  source: /note="p.Q86K"
KYCANRPHVTWCKLNGTTCVKLEDRKKTSWKEEKNISFFILHFEPVLPNDNG

SEQ ID NO: 432 - protein, 41 aa, Artificial Sequence
  source: /note="Description of Artificial Sequence: Synthetic polypeptide"
  source: /note="p.L15F"
MEPAAALHFSLPASFFLLLLLLLLLSLCALVSAQFTVVGPA

SEQ ID NO: 433 - protein, 52 aa, Artificial Sequence
  source: /note="Description of Artificial Sequence: Synthetic polypeptide"
  source: /note="p.E153K"
FQDGDFYEKALVELKVAALGSNLHVKKVKGYEDGGIHLECRSTGWYPQPQIQ

SEQ ID NO: 434 - protein, 52 aa, Artificial Sequence
  source: /note="Description of Artificial Sequence: Synthetic polypeptide"
  source: /note="p.I416M"
FNNGMMVTCSKDRSIAVWDMASPTDMMTLRRVLVGHRAAVNVVDFDDKYIVS

SEQ ID NO: 435 - protein, 52 aa, Artificial Sequence
  source: /note="Description of Artificial Sequence: Synthetic polypeptide"
  source: /note="p.G260W"
TDSLWRGLAERRGWGQYLFKNKPPDWWNAPPNSFYRALYPKIIQDIETIESN

SEQ ID NO: 436 - protein, 52 aa, Artificial Sequence
  source: /note="Description of Artificial Sequence: Synthetic polypeptide"
  source: /note="p.F996L"
VFWDGSFWKLSQNISELKDGELWNKLLFVRILNANDEATVSVLGELAAEMNG

SEQ ID NO: 437 - protein, 64 aa, Artificial Sequence
  source: /note="Description of Artificial Sequence: Synthetic polypeptide"
  source: /note="p.P1416fs"
CLEDMPGLVGGSSRRRGGGSPEKPPKPQAASRSPRTLQPTSQQQWAPGLWTTGPHTGEGWPPRN

SEQ ID NO: 438 - protein, 52 aa, Artificial Sequence
  source: /note="Description of Artificial Sequence: Synthetic polypeptide"
  source: /note="p.V1627I"
VLRPSTAELVPARSPSETLAYQHLPIIRIFVALFDYDPVSMSPNPDAGEEEL

SEQ ID NO: 439 - protein, 52 aa, Artificial Sequence
  source: /note="Description of Artificial Sequence: Synthetic polypeptide"
  source: /note="p.A85S"
GRRRRSCSPAPTWPPLCCYPQSRPTSSSAAGPGACMRASGRPHGNTTASTAP

SEQ ID NO: 440 - protein, 52 aa, Artificial Sequence
  source: /note="Description of Artificial Sequence: Synthetic polypeptide"
  source: /note="p.R1111C"
KQTASQVEQPIITQGSSVTKITFEGCCQPPTVTKITGGSSVPKLTSPVTSIS

SEQ ID NO: 441 - protein, 52 aa, Artificial Sequence
  source: /note="Description of Artificial Sequence: Synthetic polypeptide"
  source: /note="p.V135L"
PGSPNSEPVGWIAVYGQGYSPNSGDLLQGLQAAWEALQTSGRPITPGTLRQL

SEQ ID NO: 442 - protein, 98 aa, Artificial Sequence
  source: /note="Description of Artificial Sequence: Synthetic polypeptide"
  source: /note="p.S261fs"
QLLQQHGAELPTHPSKKRKHSESPPQHPQCPDAEWNDQTGAWDRDSPASAPHSSPIATLASPGSALPGPWFLASQHCPCPDTALAPARCPLPRPPAGQ

SEQ ID NO: 443 - protein, 52 aa, Artificial Sequence
  source: /note="Description of Artificial Sequence: Synthetic polypeptide"
  source: /note="p.D60V"
LPITHTRQVPSKPIDHSTITSWVSPVVFDTAAGSLFPAYQKHQNRARHSSRK

SEQ ID NO: 444 - protein, 52 aa, Artificial Sequence
  source: /note="Description of Artificial Sequence: Synthetic polypeptide"
  source: /note="p.R335Q"
KLHRLQTALSLYSTSLCGLVLLVDNQQINSYSGIKRDFATVCQECTDFHFPR

SEQ ID NO: 445 - protein, 52 aa, Artificial Sequence
  source: /note="Description of Artificial Sequence: Synthetic polypeptide"
  source: /note="p.E28Q"
APSGTVSDSESSNSSSDAEELERCRQQAAMPAWGLEQRPHVAGKPRAGAANS

SEQ ID NO: 446 - protein, 50 aa, Artificial Sequence
  source: /note="Description of Artificial Sequence: Synthetic polypeptide"
  source: /note="p.K143T"
VFYNGENSPVHKEKREAAKKKQERKTTRAKETLEKKKLLKELWESSKKVH

SEQ ID NO: 447 - protein, 53 aa, Artificial Sequence
  source: /note="Description of Artificial Sequence: Synthetic polypeptide"
  source: /note="p.R67fs"
QPGAFQLSGDQLVVARPGEPAAARGASTSSVTASCASTGSSTASAATSRGMWN

SEQ ID NO: 448 - protein, 52 aa, Artificial Sequence
  source: /note="Description of Artificial Sequence: Synthetic polypeptide"
  source: /note="p.E295K"
FSLAKSEIGSSMSEILLSQVTNMRTKKLSFNIQALAVCANICLATKDRQNPS

SEQ ID NO: 449 - protein, 93 aa, Artificial Sequence
  source: /note="Description of Artificial Sequence: Synthetic polypeptide"
  source: /note="p.R90fs"
SSDESDTNKKLKQTSRKKKKEKKKKGSISIIRKQRGSMGRRVAAGLRQTPILKRTNLPEALEAVKRNLRNRIKEIMLQLILDIALFGLRTFRL

SEQ ID NO: 450 - protein, 52 aa, Artificial Sequence
  source: /note="Description of Artificial Sequence: Synthetic polypeptide"
  source: /note="p.D115N"
RKHQHHKKTKRKHGPSSSSRSETDTNNSEKDKPSRGVGGSKKESEEPNQGNN

SEQ ID NO: 451 - protein, 52 aa, Artificial Sequence
  source: /note="Description of Artificial Sequence: Synthetic polypeptide"
  source: /note="p.R100I"
ASRDMYFDIPLEHRETSIIKRHPPQIILQKLEPIDLPRVITSGRLLSQREAR

SEQ ID NO: 452 - protein, 52 aa, Artificial Sequence
  source: /note="Description of Artificial Sequence: Synthetic polypeptide"
  source: /note="p.R279I"
GECVPGFTVPNLLPKWAPDHCSEVEIIMDSGLDKFSDSTFLLPSRPAQRGYH

SEQ ID NO: 453 - protein, 32 aa, Artificial Sequence
  source: /note="Description of Artificial Sequence: Synthetic polypeptide"
  source: /note="p.R6W"
MAEGSWWIPQARALLQQCLHARLQIRPADGDV

SEQ ID NO: 454 - protein, 52 aa, Artificial Sequence
  source: /note="Description of Artificial Sequence: Synthetic polypeptide"
  source: /note="p.F230L"
DSAALLCQALSTNYQIKKLDLSHNQLLSDVGGEHLGQMLAINVGLTSLDLSW

SEQ ID NO: 455 - protein, 52 aa, Artificial Sequence
  source: /note="Description of Artificial Sequence: Synthetic polypeptide"
  source: /note="p.G90V"
CCGECSTCFCTEEKSECQRHEETSPVVSCNHQIMSASTISAFCATPRFKQLF

SEQ ID NO: 456 - protein, 28 aa, Artificial Sequence
  source: /note="Description of Artificial Sequence: Synthetic peptide"
  source: /note="p.P313fs"
GLQPAGPLGQSHLAHHSMAPYPFPPTQI

SEQ ID NO: 457 - protein, 52 aa, Artificial Sequence
  source: /note="Description of Artificial Sequence: Synthetic polypeptide"
  source: /note="p.V488I"
LALPADLVPILGDQSNEKGGSYNSVIIGAAPLTSDPPTPPSSTPSFKPPVTR

SEQ ID NO: 458 - protein, 52 aa, Artificial Sequence
  source: /note="Description of Artificial Sequence: Synthetic polypeptide"
  source: /note="p.V753F"
PGSGNTQPSGNTASVQGSTSLPAQSFFRAPATASNHPLNPGATPQPKFGAPD

SEQ ID NO: 459 - protein, 52 aa, Artificial Sequence
  source: /note="Description of Artificial Sequence: Synthetic polypeptide"
  source: /note="p.G906W"
RRPTTTSSHPLNTGSISHSTLGATDWWQQKSDSSFILGNPATPAPVIGLTSP

SEQ ID NO: 460 - protein, 50 aa, Artificial Sequence
  source: /note="Description of Artificial Sequence: Synthetic polypeptide"
  source: /note="p.S24F"
MAAPEAPPLDRVFRTTWLSTECDFFHPLPPSYRKFLFETQAADLAGGTTV

SEQ ID NO: 461 - protein, 52 aa, Artificial Sequence
  source: /note="Description of Artificial Sequence: Synthetic polypeptide"
  source: /note="p.D340N"
GSKKAPAKSVKERIADSQEHISTSINNFNIIKILNNPRAYTLPISKEESRLS

SEQ ID NO: 462 - protein, 27 aa, Artificial Sequence
  source: /note="Description of Artificial Sequence: Synthetic peptide"
  source: /note="p.G98fs"
RKKNQALLRRYQEIQEDRRQAEQGGWL

SEQ ID NO: 463 - protein, 52 aa, Artificial Sequence
  source: /note="Description of Artificial Sequence: Synthetic polypeptide"
  source: /note="p.G65S"
RACPVACPVGCPIACPVSCPVACPVSSCPVGSMATAPQGLSPQEWEADRETG

SEQ ID NO: 464 - protein, 49 aa, Artificial Sequence
  source: /note="Description of Artificial Sequence: Synthetic polypeptide"
  source: /note="p.D118A"
RASNETLVSCSSSGSDQQRTIREPEAAWGPYRRHRNPSTADAYNSHLKE

SEQ ID NO: 465 - protein, 52 aa, Artificial Sequence
  source: /note="Description of Artificial Sequence: Synthetic polypeptide"
  source: /note="p.L244I"
SDTSVIQFYPSKFVLITDILDTFGKIIVYERIFSMCVDSRSVLPDHFSPENA

SEQ ID NO: 466 - protein, 48 aa, Artificial Sequence
  source: /note="Description of Artificial Sequence: Synthetic polypeptide"
  source: /note="p.S21del"
MGLKMSCLKGFQMCVSSSSSHDEAPVLNDKHLDVPDIIITPPTPTGMM

SEQ ID NO: 467 - protein, 30 aa, Artificial Sequence
  source: /note="Description of Artificial Sequence: Synthetic polypeptide"
  source: /note="p.R151I"
ANLSDEKAFVFSVALAEINRKIINQIILIL

SEQ ID NO: 468 - protein, 52 aa, Artificial Sequence
  source: /note="Description of Artificial Sequence: Synthetic polypeptide"
  source: /note="p.L63V"
LCLRALAFCALAKPRASSLGPGPGEVVAARSPVLRGPQAPLRPGGWAPDGLK

SEQ ID NO: 469 - protein, 38 aa, Artificial Sequence
  source: /note="Description of Artificial Sequence: Synthetic polypeptide"
  source: /note="p.G12R"
MAAPSGGWNGVRRASLWAALLLGAVALRPAEAVSEPTT

SEQ ID NO: 470 - protein, 52 aa, Artificial Sequence
  source: /note="Description of Artificial Sequence: Synthetic polypeptide"
  source: /note="p.R262C"
PHLANGHVVPIKPQVKGVVREENKVCCAVPTWASVQVVDDPGSLASVESPGT

SEQ ID NO: 471 - protein, 63 aa, Artificial Sequence
  source: /note="Description of Artificial Sequence: Synthetic polypeptide"
  source: /note="p.P50fs"
YDQELLGPSDKSQAALQKAGEVVPPPCTSSASTCVSRQACRYPSSQPLQRFTFPSVTPGMQAS

SEQ ID NO: 472 - protein, 52 aa, Artificial Sequence
  source: /note="Description of Artificial Sequence: Synthetic polypeptide"
  source: /note="p.T225I"
ESDIFSIREVSFQSTGESEWKDTNYIILNTDSLDWALYDHLMDFLADRGVDN

SEQ ID NO: 473 - protein, 30 aa, Artificial Sequence
  source: /note="Description of Artificial Sequence: Synthetic polypeptide"
  source: /note="p.G194fs"
CVWHIQVATDHAIQLKIEALSIESVGLLPF

SEQ ID NO: 474 - protein, 31 aa, Artificial Sequence
  source: /note="Description of Artificial Sequence: Synthetic polypeptide"
  source: /note="p.P308fs"
NCADGSDETNCSAKFSGSVEQSHPPPRLLAP

SEQ ID NO: 475 - protein, 124 aa, Artificial Sequence
  source: /note="Description of Artificial Sequence: Synthetic polypeptide"
  source: /note="p.P216fs"
AECSSELYTEASGYISSLEYPRSYPLTCAATTASGWSGASPCTSSSWSLLILMTTSKYTAPMTSYRSMPTGRTLASSVGSKGPPTSTPAAMLWICCSSQMSRGTAGAGSCATPPRSSSAPSPRP

SEQ ID NO: 476 - protein, 59 aa, Artificial Sequence
  source: /note="Description of Artificial Sequence: Synthetic polypeptide"
  source: /note="p.L351fs"
PDYRQNESHNFSGDIALLELQHSIPWAPTSSRSVCPIMRPSTAAACWATSVGLAWRWAG

SEQ ID NO: 477 - protein, 52 aa, Artificial Sequence
  source: /note="Description of Artificial Sequence: Synthetic polypeptide"
  source: /note="p.R538C"
PPGYFPAGRYVVVAESPLPPGEWELCCRAAPGPAYEEEGTPLRYQRLVPSRS

SEQ ID NO: 478 - protein, 52 aa, Artificial Sequence
  source: /note="Description of Artificial Sequence: Synthetic polypeptide"
  source: /note="p.S123G"
WWHLRALGPDATSSCTKTPSALEPLGGSSTLQDSLEKVPRAPTLPDTLQGSL

SEQ ID NO: 479 - protein, 52 aa, Artificial Sequence
  source: /note="Description of Artificial Sequence: Synthetic polypeptide"
  source: /note="p.S688Y"
ESFENVLKEGTEKGTQEIAEGLSEKYYGKHVSAEEKEKDKSKLWEESTAQVK

SEQ ID NO: 480 - protein, 52 aa, Artificial Sequence
  source: /note="Description of Artificial Sequence: Synthetic polypeptide"
  source: /note="p.G1454S"
AGVGTPGALERKTSGLGQEQEEGSESSQEAATGSGDGRQETGAAEKFRLGLS

SEQ ID NO: 481 - protein, 42 aa, Artificial Sequence
  source: /note="Description of Artificial Sequence: Synthetic polypeptide"
  source: /note="p.D254N"
PGLRDILNTWEKDLRTRFRTQNDFANNLSISSEIVTLPAVAL

SEQ ID NO: 482 - protein, 32 aa, Artificial Sequence
  source: /note="Description of Artificial Sequence: Synthetic polypeptide"
  source: /note="p.R541L"
LSPQKIDQALRRFRSGENMLLEPALLLYLKEL

SEQ ID NO: 483 - protein, 52 aa, Artificial Sequence
  source: /note="Description of Artificial Sequence: Synthetic polypeptide"
  source: /note="p.E382D"
LKLPLRFQRLGHLVALMALLCGDPQDDKVAEEAAEGIHSLLHITLRLKYITH

SEQ ID NO: 484 - protein, 51 aa, Artificial Sequence
  source: /note="Description of Artificial Sequence: Synthetic polypeptide"
  source: /note="p.P46fs"
KAGRRAACRSSVSRRPLHSMPLYPPTTSSTPRFCCVTTWRKRSSSWATLPG

SEQ ID NO: 485 - protein, 52 aa, Artificial Sequence
  source: /note="Description of Artificial Sequence: Synthetic polypeptide"
  source: /note="p.R1088Q"
LEVQMAQPNYGLELVTGSAKNGTYFQQIHINKYKMVETITCLSREPFPASNY

SEQ ID NO: 486 - protein, 52 aa, Artificial Sequence
  source: /note="Description of Artificial Sequence: Synthetic polypeptide"
  source: /note="p.P28L"
ASATAAWHCPPLCLPPLPASAPTSPLLNPATRPAPGPGRRARCPQSAHPAPT

SEQ ID NO: 487 - protein, 209 aa, Artificial Sequence
  source: /note="Description of Artificial Sequence: Synthetic polypeptide"
  source: /note="p.P32fs"
RPLGVFECELCTLTAPYSYVGQKPPQHPVDGPPGGKLCHEGSLHLRQGQIPGPRLVLQFVQQAGVCGPGMQFILLQEILPPLCPGEHQCFSSGNSARLGEKESSIKEDPQPARFSDVSATGARSSGGTLHRAPGPACARDAAELGAAMPGLVSGPLGAALQPRGAGVQLGAATGPGSCSKRVVQRQMPDKTQPGTRPGPPTCPSGPRPE

SEQ ID NO: 488 - protein, 45 aa, Artificial Sequence
  source: /note="Description of Artificial Sequence: Synthetic polypeptide"
  source: /note="p.K19E"
MGNILTCCINSHCGWPRGEEDAPCYESDTDIYETVAAATSESTTV

SEQ ID NO: 489 - protein, 52 aa, Artificial Sequence
  source: /note="Description of Artificial Sequence: Synthetic polypeptide"
  source: /note="p.N456K"
IMLEEEPSITSGESQTTYSTFSAPLKKKANRKKLIESLSPDFCHQNKGLLLT

SEQ ID NO: 490 - protein, 52 aa, Artificial Sequence
  source: /note="Description of Artificial Sequence: Synthetic polypeptide"
  source: /note="p.P272H"
VEYPICLVCLRPRSPSCPLPRYRTGHHRLLAFPQLLPCVQGQESGPLRIGIG

SEQ ID NO: 491 - protein, 54 aa, Artificial Sequence
  source: /note="Description of Artificial Sequence: Synthetic polypeptide"
  source: /note="p.1225_1226insS"
GRPQPPTLDPTSTSYESQLGQNSSSSSEESPKKDTEPGSSPCSPELQGGTRRAS

SEQ ID NO: 492 - protein, 52 aa, Artificial Sequence
  source: /note="Description of Artificial Sequence: Synthetic polypeptide"
  source: /note="p.T315P"
LELRSEGVPCIASGVLVSYPSVGGAPPRPSASCQQQRAGHSDVRLSAHHHRM

SEQ ID NO: 493 - protein, 37 aa, Artificial Sequence
  source: /note="Description of Artificial Sequence: Synthetic polypeptide"
  source: /note="p.P890fs"
LLHNPAFCSLATTKRRHQQTVTIPPSPRCPFHMSSCR

SEQ ID NO: 494 - protein, 52 aa, Artificial Sequence
  source: /note="Description of Artificial Sequence: Synthetic polypeptide"
  source: /note="p.R552Q"
RTCHALQEDEKLVKKAEKQVTLALQQQQRNLHEHKVSLVENHLAGLEGRALA

SEQ ID NO: 495 - protein, 52 aa, Artificial Sequence
  source: /note="Description of Artificial Sequence: Synthetic polypeptide"
  source: /note="p.R740L"
IISSQNYTSTGQLQWLLNTLYNHQQLLGRGSPCIQCRYDSYRLLQYDLDSPL

SEQ ID NO: 496 - protein, 52 aa, Artificial Sequence
  source: /note="Description of Artificial Sequence: Synthetic polypeptide"
  source: /note="p.R217C"
SWLDNNGKSAVKKLKNSLPLRKELDCCLKDELSHQLQLSDIRWQRSWGIAHR

SEQ ID NO: 497 - protein, 52 aa, Artificial Sequence
  source: /note="Description of Artificial Sequence: Synthetic polypeptide"
  source: /note="p.D227E"
AERRTSEQITHRLSKLSERRPSVQIEESGSSVPSDQSPSVQIDSGSSVPSDQ

SEQ ID NO: 498 - protein, 52 aa, Artificial Sequence
  source: /note="Description of Artificial Sequence: Synthetic polypeptide"
  source: /note="p.R333W"
LALAQEFQMKTVTVSLEDHTFADVVWWLVSNASMLVSMHGAQLVTTLFLPRG

SEQ ID NO: 499 - protein, 52 aa, Artificial Sequence
  source: /note="Description of Artificial Sequence: Synthetic polypeptide"
  source: /note="p.R185Q"
SNMPLNNSSQEVTKDLLDMIDHTSIQQTIEELAGKIEFENELNHMCGHCQDS

SEQ ID NO: 500 - protein, 32 aa, Artificial Sequence
  source: /note="Description of Artificial Sequence: Synthetic polypeptide"
  source: /note="p.S6L"
MSAAALLPASERGWKSEKLDEAQALARSCAAR

SEQ ID NO: 501 - protein, 52 aa, Artificial Sequence
  source: /note="Description of Artificial Sequence: Synthetic polypeptide"
  source: /note="p.E800Q"
SKDTEAHISEPEDLGKIRSPPPDHVQQVETAREGKQYWNPRNSSELSGLVNT

SEQ ID NO: 502 - protein, 30 aa, Artificial Sequence
  source: /note="Description of Artificial Sequence: Synthetic polypeptide"
  source: /note="p.D4N"
MEVNNINGESRSTLTTLPFPGAEANSPGKA

SEQ ID NO: 503 - protein, 52 aa, Artificial Sequence
  source: /note="Description of Artificial Sequence: Synthetic polypeptide"
  source: /note="p.R114Q"
LFFWSFNGLLLVVDTTGKPNFISRYQQIQVGKNEPVDPVKLRQSIRTVLFNQ

SEQ ID NO: 504 - protein, 52 aa, Artificial Sequence
  source: /note="Description of Artificial Sequence: Synthetic polypeptide"
  source: /note="p.Q245R"
PRAAGAPRPRLLLRTGSLDESLGPLRRAAAGFVQTALARKLSPEAPAPSSAT

SEQ ID NO: 505 - protein, 52 aa, Artificial Sequence
  source: /note="Description of Artificial Sequence: Synthetic polypeptide"
  source: /note="p.K724T"
RTGAINECVTFIFNRYAKKLQVSRHTTKFGYGVLVTRVASTAAGGIALKKSG

SEQ ID NO: 506 - protein, 34 aa, Artificial Sequence
  source: /note="Description of Artificial Sequence: Synthetic polypeptide"
  source: /note="p.P58fs"
GMSEKAIEKFIRQLLEKNEPQRPPPAVSSPYSCV

SEQ ID NO: 507 - protein, 52 aa, Artificial Sequence
  source: /note="Description of Artificial Sequence: Synthetic polypeptide"
  source: /note="p.R687S"
GMSLEGPSAFLCGSSLKWSPEMKNASSCVQKENPLTQAVPKCQRWEKLQNSR

SEQ ID NO: 508 - protein, 43 aa, Artificial Sequence
  source: /note="Description of Artificial Sequence: Synthetic polypeptide"
  source: /note="p.G130fs"
GSSSEEEDSGKQALAPGLSPSQRPGVPALPVAGALRRRRKRMC

SEQ ID NO: 509 - protein, 160 aa, Artificial Sequence
  source: /note="Description of Artificial Sequence: Synthetic polypeptide"
  source: /note="p.L179fs"
RARELTVQKAEALMRELDEEGSDPPCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIF

SEQ ID NO: 510 - protein, 52 aa, Artificial Sequence
  source: /note="Description of Artificial Sequence: Synthetic polypeptide"
  source: /note="p.E30K"
SKELQGATHRYAPCDWYYHVPVKRSKKKAVDAPPASQIPGLSNLGDSHSENL

SEQ ID NO: 511 - protein, 52 aa, Artificial Sequence
  source: /note="Description of Artificial Sequence: Synthetic polypeptide"
  source: /note="p.G140W"
HQHILTQHGYTVVIAEERLNAGLGPWWLLEQGDLGSWDLLICLSSKKAEGTP

SEQ ID NO: 512 - protein, 52 aa, Artificial Sequence
  source: /note="Description of Artificial Sequence: Synthetic polypeptide"
  source: /note="p.R238L"
PSVCLDQGMQLKPSTSSHLLKTVKPLLVWKPGDWSREQLNETTVLAPHETIF

SEQ ID NO: 513 - protein, 36 aa, Artificial Sequence
  source: /note="Description of Artificial Sequence: Synthetic polypeptide"
  source: /note="p.A10T"
MWTEEAGATTTEAQESGIRNKSSSSSQIPVVGVVTE

SEQ ID NO: 514 - protein, 73 aa, Artificial Sequence
  source: /note="Description of Artificial Sequence: Synthetic polypeptide"
  source: /note="p.P342fs"
GYETHLETTGHKKMPQAFEPPMPPPANPQLLCQNPEKLALKEDLLYLRTSGEPWDTERNLRPLSLQCQSLALP

SEQ ID NO: 515 - protein, 52 aa, Artificial Sequence
  source: /note="Description of Artificial Sequence: Synthetic polypeptide"
  source: /note="p.R136W"
ITNHREKKLQQSTKYWCLNQSAESLWWICAMRGGENRPPARVQSSSEELELR

SEQ ID NO: 516 - protein, 48 aa, Artificial Sequence
  source: /note="Description of Artificial Sequence: Synthetic polypeptide"
  source: /note="p.R145fs"
NGDGEITLVELQQAMQRLLGERLTPGRSLRLSGRLMLMETAQLTLKSL

SEQ ID NO: 517 - protein, 52 aa, Artificial Sequence
  source: /note="Description of Artificial Sequence: Synthetic polypeptide"
  source: /note="p.S720Y"
SLMDKAFDPTRRQWYLHAVANPGLIYYLTGPYLDVGGAGYVVTISHTIHSSS

SEQ ID NO: 518 - protein, 52 aa, Artificial Sequence
  source: /note="Description of Artificial Sequence: Synthetic polypeptide"
  source: /note="p.T665M"
NFDEGTPPTNFDTFPAAIMTVFQILMMGEDWNEVMYDGIKSQGGVQGGMVFS

SEQ ID NO: 519 - protein, 52 aa, Artificial Sequence
  source: /note="Description of Artificial Sequence: Synthetic polypeptide"
  source: /note="p.S772Y"
EVSPLSAANMSIAVKEQQKNQKPAKYYVWEQRTSEMRKQNLLASREALYNEM

SEQ ID NO: 520 - protein, 52 aa, Artificial Sequence
  source: /note="Description of Artificial Sequence: Synthetic polypeptide"
  source: /note="p.S710L"
RRSTFDNFPQSLLTVFQILTGEDWNLLVMYDGIMAYGGPSFPGMLVCIYFII

SEQ ID NO: 521 - protein, 52 aa, Artificial Sequence
  source: /note="Description of Artificial Sequence: Synthetic polypeptide"
  source: /note="p.R1073L"
AKSNPEECRGLFILYKDGDVDSPVVLLERIWQNSDFNFDNVLSAMMALFTVS

SEQ ID NO: 522 - protein, 52 aa, Artificial Sequence
  source: /note="Description of Artificial Sequence: Synthetic polypeptide"
  source: /note="p.A352E"
AKGITDYKKGFSFAFEQLLNYNVSREENCNKIIMLFTDGGEERAQEIFNKYN

SEQ ID NO: 523 - protein, 52 aa, Artificial Sequence
  source: /note="Description of Artificial Sequence: Synthetic polypeptide"
  source: /note="p.A332T"
CLNGTLVQADRTNKEHFREHLDKLFTTKGIGMLDIALNEAFNILSDFNHTGQ

SEQ ID NO: 524 - protein, 52 aa, Artificial Sequence
  source: /note="Description of Artificial Sequence: Synthetic polypeptide"
  source: /note="p.R608H"
ASHRDHNHRDETHGSSDHRHRESRHHHSRDVDREQDHNECNKQRSRHKSKDR

SEQ ID NO: 525 - protein, 52 aa, Artificial Sequence
  source: /note="Description of Artificial Sequence: Synthetic polypeptide"
  source: /note="p.V134I"
ILSVTLLFFGGLCVAASEFHRSRHNIIILSAGIFFVSAGLSNIIGIIVYISA

SEQ ID NO: 526 - protein, 52 aa, Artificial Sequence
  source: /note="Description of Artificial Sequence: Synthetic polypeptide"
  source: /note="p.A138V"
TLLFFGGLCVAASEFHRSRHNVILSVVGIFFVSAGLSNIIGIIVYISANAGD

SEQ ID NO: 527 - protein, 52 aa, Artificial Sequence
  source: /note="Description of Artificial Sequence: Synthetic polypeptide"
  source: /note="p.R232W"
LRAKSHSEFLKKSTFARLPPYRYRFWWRRSSSRSTEPRSRDLSPISKGFHTI

SEQ ID NO: 528 - protein, 52 aa, Artificial Sequence
  source: /note="Description of Artificial Sequence: Synthetic polypeptide"
  source: /note="p.G121R"
MIRSATPFPLVSLFFMFIGFILNNIRRHIRPHRTILAFVSGIFFILSGLSLV

SEQ ID NO: 529 - protein, 52 aa, Artificial Sequence
  source: /note="Description of Artificial Sequence: Synthetic polypeptide"
  source: /note="p.V146G"
LRVVRASSIFPILSAILLLLGGVCVGGASRVYKSKRNIILGAGILFVAAGLS

SEQ ID NO: 530 - protein, 52 aa, Artificial Sequence
  source: /note="Description of Artificial Sequence: Synthetic polypeptide"
  source: /note="p.S190L"
NCTAMASKPATTIRWFKGNTELKGKLLEVEEWSDMYTVTSQLMLKVHKEDDG

SEQ ID NO: 531 - protein, 52 aa, Artificial Sequence
  source: /note="Description of Artificial Sequence: Synthetic polypeptide"
  source: /note="p.R959S"
DAALEVQPPDTWDSFPLFQLLNDFLSSTDYNLCNGKFHKHLQDLFAPLVVRY

SEQ ID NO: 532 - protein, 52 aa, Artificial Sequence
  source: /note="Description of Artificial Sequence: Synthetic polypeptide"
  source: /note="p.A1073T"
PSWMAAIYDADNGSGTSEDLFWKLDTTLQTFIRDLHWPEEEFGKHLEQRLKL

SEQ ID NO: 533 - protein, 52 aa, Artificial Sequence
  source: /note="Description of Artificial Sequence: Synthetic polypeptide"
  source: /note="p.K60N"
YIEGKELENFFQELEKARKGSGMMSNNSDNFGEKMKEFMQKYDKNSDGKIEM

SEQ ID NO: 534 - protein, 40 aa, Artificial Sequence
  source: /note="Description of Artificial Sequence: Synthetic polypeptide"
  source: /note="p.R258C"
KEMNIQQLTNYRKSVMSLAEAGKLYCCKDLEIVLCSEPPM

SEQ ID NO: 535 - protein, 52 aa, Artificial Sequence
  source: /note="Description of Artificial Sequence: Synthetic polypeptide"
  source: /note="p.R81T"
DYVQMKASELKQEQETQGSSSAAQKTTACNTATCVTHRLAGLLSRSGGMVKS

SEQ ID NO: 536 - protein, 52 aa, Artificial Sequence
  source: /note="Description of Artificial Sequence: Synthetic polypeptide"
  source: /note="p.E340K"
ERMREEEKRAAEERQRIKEEEKRAAKKERQRIKEEEKRAAEERQRIKEEEKR

SEQ ID NO: 537 - protein, 52 aa, Artificial Sequence
  source: /note="Description of Artificial Sequence: Synthetic polypeptide"
  source: /note="p.V231I"
LNETSGNCQTEFEGVHSQKQNRQTCIIRKSLICAFAMAFIISVMLIAANQIL

SEQ ID NO: 538 - protein, 52 aa, Artificial Sequence
  source: /note="Description of Artificial Sequence: Synthetic polypeptide"
  source: /note="p.G131V"
EYYSEADASHCIQQILEAVLHCHQMVVVVHRDLKPENLLLASKCKGAAVKLA

SEQ ID NO: 539 - protein, 43 aa, Artificial Sequence
  source: /note="Description of Artificial Sequence: Synthetic polypeptide"
  source: /note="p.T466fs"
RHRSNSLTRVDGQPRGAAIAWPEKKNQACVPANTFCSTSRCEL

SEQ ID NO: 540 - protein, 70 aa, Artificial Sequence
  source: /note="Description of Artificial Sequence: Synthetic polypeptide"
  source: /note="p.T466fs"
RHRSNSLTRVDGQPRGAAIAWPEKKPGLRPSQHLLLYITLRVVKWIPALATASAWPAPSAKTVWHPTLLI

SEQ ID NO: 541 - protein, 52 aa, Artificial Sequence
  source: /note="Description of Artificial Sequence: Synthetic polypeptide"
  source: /note="p.K131R"
RIAVIADLDTESRAQEENTWFSYLKRRGYLTLSDSGDKVAVEWDKDHGVLES

SEQ ID NO: 542 - protein, 42 aa, Artificial Sequence
  source: /note="Description of Artificial Sequence: Synthetic polypeptide"
  source: /note="p.LV303del"
LHTSSELQSPSSYFASRPWVRAKGLLGFPVLTLHPPLPSGCS

SEQ ID NO: 543 - protein, 39 aa, Artificial Sequence
  source: /note="Description of Artificial Sequence: Synthetic polypeptide"
  source: /note="p.E13K"
MEVQVSQASLGFKKLTSVEKSLREWSRLSREVIAWLCPS

SEQ ID NO: 544 - protein, 52 aa, Artificial Sequence
  source: /note="Description of Artificial Sequence: Synthetic polypeptide"
  source: /note="p.R423Q"
IEKDKYRKQIRELEEKNDEMRIEMVQQREACIVNLESKLRRLSKDSNNLDQS

SEQ ID NO: 545 - protein, 52 aa, Artificial Sequence
  source: /note="Description of Artificial Sequence: Synthetic polypeptide"
  source: /note="p.E626K"
LDDDSHERYSFGPSSIHSSSSSHQSKKGLDAYDLEQVNLMFRKFSLERPFRP

SEQ ID NO: 546 - protein, 52 aa, Artificial Sequence
  source: /note="Description of Artificial Sequence: Synthetic polypeptide"
  source: /note="p.E93D"
SKINRAGRLLDILHTKGQRGYVVFLDDSLEFYYPELYKLVTGKEPTRRFSTI

SEQ ID NO: 547 - protein, 52 aa, Artificial Sequence
  source: /note="Description of Artificial Sequence: Synthetic polypeptide"
  source: /note="p.I1065M"
ANIEAVAAKNKHCLLEAGIGCTRDLMMKSNIYPIVLFIRVCEKNIKRFRKLL

SEQ ID NO: 548 - protein, 52 aa, Artificial Sequence
  source: /note="Description of Artificial Sequence: Synthetic polypeptide"
  source: /note="p.A202V"
LQNHTDFKDKIVLDVGCGSGILSFFVVAQAGARKIYAVEASTMAQHAEVLVK

SEQ ID NO: 549 - protein, 52 aa, Artificial Sequence
  source: /note="Description of Artificial Sequence: Synthetic polypeptide"
  source: /note="p.R54Q"
ERRLKEEEEARLKYEKEEMERLEIQQQIEKEKWHRLEAKDLERRNEELEELY

SEQ ID NO: 550 - protein, 52 aa, Artificial Sequence
  source: /note="Description of Artificial Sequence: Synthetic polypeptide"
  source: /note="p.P603L"
MNLPHPGLHPHQTPAPLPNPGLYPPLLVSMSPGQPPPQQLLAPTYFSAPGVM

SEQ ID NO: 551 - protein, 52 aa, Artificial Sequence
  source: /note="Description of Artificial Sequence: Synthetic polypeptide"
  source: /note="p.P645L"
TYFSAPGVMNFGNPSYPYAPGALPPLLPPPHLYPNTQAPSQVYGGVTYYNPA

SEQ ID NO: 552 - protein, 52 aa, Artificial Sequence
  source: /note="Description of Artificial Sequence: Synthetic polypeptide"
  source: /note="p.S658L"
PSYPYAPGALPPPPPPHLYPNTQAPLLQVYGGVTYYNPAQQQVQPKPSPPRR

SEQ ID NO: 553 - protein, 52 aa, Artificial Sequence
  source: /note="Description of Artificial Sequence: Synthetic polypeptide"
  source: /note="p.S232F"
RQRKLWKDEGRWEHDKFREDEQAPKFFRQELIALYGYDIRSAHNPDDIKPRR

SEQ ID NO: 554 - protein, 45 aa, Artificial Sequence
  source: /note="Description of Artificial Sequence: Synthetic polypeptide"
  source: /note="p.F781fs"
DLAQIIIPKDNSSLLKRLACIAAFFVDSSSYHPFKINQNIRFQKF

SEQ ID NO: 555 - protein, 31 aa, Artificial Sequence
  source: /note="Description of Artificial Sequence: Synthetic polypeptide"
  source: /note="p.R5W"
MSNPWWSLEEEKYDMSGARLALILCVTKARE

SEQ ID NO: 556 - protein, 42 aa, Artificial Sequence
  source: /note="Description of Artificial Sequence: Synthetic polypeptide"
  source: /note="p.R23fs"
MAAVPRVEGVFIFLIEDSGKKKGVRILKLCSKVSFRVDWITS

SEQ ID NO: 557 - protein, 97 aa, Artificial Sequence
  source: /note="Description of Artificial Sequence: Synthetic polypeptide"
  source: /note="p.R471fs"
YEVSNKDDKKNMGKQMPQPTFTLRKNLSSLLIDGAILFVLFCFVFLRQNLALSPRLECSGVISAHRKLRLPGSGHSPASASRVAGTTGARHHTWLIF

SEQ ID NO: 558 - protein, 52 aa, Artificial Sequence
  source: /note="Description of Artificial Sequence: Synthetic polypeptide"
  source: /note="p.D639E"
DDALDKLSDSLGQRQPDPDENKPMEEEKVKEKAKAEHRDKLGERDDTIPPEY

SEQ ID NO: 559 - protein, 52 aa, Artificial Sequence
  source: /note="Description of Artificial Sequence: Synthetic polypeptide"
  source: /note="p.T425M"
MIVEEVRAIRFNQEQESEVLNRRSSMMSGSLETTSSKDIRQMSQQQDLLSAL

SEQ ID NO: 560 - protein, 52 aa, Artificial Sequence
  source: /note="Description of Artificial Sequence: Synthetic polypeptide"
  source: /note="p.E152K"
FDEERAQQEDALAQQAFEEARRRTRKKFEDRDRSHREEMEVRVSQLLAVTGK

SEQ ID NO: 561 - protein, 76 aa, Artificial Sequence
  source: /note="Description of Artificial Sequence: Synthetic polypeptide"
  source: /note="p.E138fs"
PIKIYGRMIPCKHVFCYDCAILHEKREIRCVQAVVILCSELSSVHEVLSSCVALFKGAREHICLRETYRLISTIAI

SEQ ID NO: 562 - protein, 59 aa, Artificial Sequence
  source: /note="Description of Artificial Sequence: Synthetic polypeptide"
  source: /note="p.P69fs"
ECLVVCEPGRAAAGGPGGAALGEAPLGEWHLLRSEATTMSQQGKPAMAPVGPSTSTRSW

SEQ ID NO: 563 - protein, 27 aa, Artificial Sequence
  source: /note="Description of Artificial Sequence: Synthetic peptide"
  source: /note="p.E102fs"
ESGEGSALEKSLAVSQGGELYEEWLGT

SEQ ID NO: 564 - protein, 52 aa, Artificial Sequence
  source: /note="Description of Artificial Sequence: Synthetic polypeptide"
  source: /note="p.R1284C"
ESQEDEKLLQATEKFQAECALKFPNCCQCLTTVIDISGKTVFITRYLKPLNP

SEQ ID NO: 565 - protein, 29 aa, Artificial Sequence
  source: /note="Description of Artificial Sequence: Synthetic peptide"
  source: /note="p.P1164fs"
LERDPTPCELTYKVPTRHSMSQIPPSSPL

SEQ ID NO: 566 - protein, 52 aa, Artificial Sequence
  source: /note="Description of Artificial Sequence: Synthetic polypeptide"
  source: /note="p.R417L"
GIKGGIRRWNYFFPEELLVYDICKYLLWCENIGRAHKSNNIMILVDLKNEVW

SEQ ID NO: 567 - protein, 34 aa, Artificial Sequence
  source: /note="Description of Artificial Sequence: Synthetic polypeptide"
  source: /note="p.I8V"
MEVKGQLVVSSPTFNAPAALFGEAAPQVKSERLR

SEQ ID NO: 568 - protein, 52 aa, Artificial Sequence
  source: /note="Description of Artificial Sequence: Synthetic polypeptide"
  source: /note="p.W397L"
IEQAQKLTATQSHLENRKQQLQQEQLLYLESLIQARQRLQGSHNQCLNRQDV

SEQ ID NO: 569 - protein, 52 aa, Artificial Sequence
  source: /note="Description of Artificial Sequence: Synthetic polypeptide"
  source: /note="p.R838C"
NIYVDALLKEFEQFNRRLNEVSKRVCCIPLPVSNILWEHCIRLANRTIVEGY

SEQ ID NO: 570 - protein, 52 aa, Artificial Sequence
  source: /note="Description of Artificial Sequence: Synthetic polypeptide"
  source: /note="p.E313K"
AEKAKPDALHGLRVHSWVLVLSGKRKKVPENFFIDPFTGHSYSTQDEHFLGI

SEQ ID NO: 571 - protein, 52 aa, Artificial Sequence
  source: /note="Description of Artificial Sequence: Synthetic polypeptide"
  source: /note="p.S1264L"
NTTSIKTQMELTIKDLESEISRIKTLLQADFNKTELERYKELYLEEVKVRES

SEQ ID NO: 572 - protein, 39 aa, Artificial Sequence
  source: /note="Description of Artificial Sequence: Synthetic polypeptide"
  source: /note="p.K420fs"
KEEEKEKLWKKKELLQRAEKKKKIKNTGPRKNRSGKKWK

SEQ ID NO: 573 - protein, 52 aa, Artificial Sequence
  source: /note="Description of Artificial Sequence: Synthetic polypeptide"
  source: /note="p.P488H"
ILPKYQDQNFLPKDQNFLSRDQHVLHHKDQDILPKYQDQNFLPKDQNFLSRD

SEQ ID NO: 574 - protein, 52 aa, Artificial Sequence
  source: /note="Description of Artificial Sequence: Synthetic polypeptide"
  source: /note="p.E153Q"
GYKKEISKLYQDMQRKVELNEEKHKQQLIEKKEMEISELNAKLRSQEKEKQN

SEQ ID NO: 575 - protein, 33 aa, Artificial Sequence
  source: /note="Description of Artificial Sequence: Synthetic polypeptide"
  source: /note="p.P200fs"
QWDGAALRLHARHKEQQRQFGLTPPWIFEATSP

SEQ ID NO: 576 - protein, 28 aa, Artificial Sequence
  source: /note="Description of Artificial Sequence: Synthetic peptide"
  source: /note="p.P200fs"
QQWDGAALRLHARHKEQQRQFGLTPLDL

SEQ ID NO: 577 - protein, 52 aa, Artificial Sequence
  source: /note="Description of Artificial Sequence: Synthetic polypeptide"
  source: /note="p.A332S"
KELSDIWSAVHVLQNSIDSLTLCSGSSCPKASSLRGHKGHQCLSPPLPSWDS

SEQ ID NO: 578 - protein, 52 aa, Artificial Sequence
  source: /note="Description of Artificial Sequence: Synthetic polypeptide"
  source: /note="p.D5020Y"
GYTLSNSKGPVQPTAQGEEKGGLRIYYMEDKMLPKCTDLKAKQLLLSDILNT

SEQ ID NO: 579 - protein, 52 aa, Artificial Sequence
  source: /note="Description of Artificial Sequence: Synthetic polypeptide"
  source: /note="p.K162R"
LDDCIFNMVLLKVPSSLSAEELEAIRRLIRFGKKKNTHSLFVFIIPENFKGC

SEQ ID NO: 580 - protein, 52 aa, Artificial Sequence
  source: /note="Description of Artificial Sequence: Synthetic polypeptide"
  source: /note="p.R207L"
KLRMEQEEELKDMSKIILNAKCHAILLDAQILEKQQIQKELDTEEKRLDQMM

SEQ ID NO: 581 - protein, 52 aa, Artificial Sequence
  source: /note="Description of Artificial Sequence: Synthetic polypeptide"
  source: /note="p.R279L"
RIRGRRQIVEQMEKNQEERSLLAEQLLEQEKEQMLEYMEQLQEEDLKDMERR

SEQ ID NO: 582 - protein, 52 aa, Artificial Sequence
  source: /note="Description of Artificial Sequence: Synthetic polypeptide"
  source: /note="p.R209I"
AQNDLVFEAVQDKGNMEQAILEMKKIIFEARQGEFIEMKSNLKHLEVLVAQQ

SEQ ID NO: 583 - protein, 52 aa, Artificial Sequence
  source: /note="Description of Artificial Sequence: Synthetic polypeptide"
  source: /note="p.R58C"
FVVHTVQFLNRFSTVCEEKLADLSLCCIQQIETTLNILDAKLSSIPGLDDVT

SEQ ID NO: 584 - protein, 52 aa, Artificial Sequence
  source: /note="Description of Artificial Sequence: Synthetic polypeptide"
  source: /note="p.R230H"
GQKWEHFITAPKTKKFKIPTMRVTNHHKPSRRGSTLSLSRASGGSSPQSSMI

SEQ ID NO: 585 - protein, 52 aa, Artificial Sequence
  source: /note="Description of Artificial Sequence: Synthetic polypeptide"
  source: /note="p.N440T"
IEQLEREGNEEEIQRENYQDNISSMTTISIQNTWKHLHADRIGRGSKAEDED

SEQ ID NO: 586 - protein, 52 aa, Artificial Sequence
  source: /note="Description of Artificial Sequence: Synthetic polypeptide"
  source: /note="p.R259I"
NRERKCKLKDQSDKEEGTRDISSPKIILRDRQALFPAKVTNVSLLEKFERSE

SEQ ID NO: 587 - protein, 28 aa, Artificial Sequence
  source: /note="Description of Artificial Sequence: Synthetic peptide"
  source: /note="p.K677fs"
ITCEKIEALEQENSELERENRKLKKNIG

SEQ ID NO: 588 - protein, 28 aa, Artificial Sequence
  source: /note="Description of Artificial Sequence: Synthetic peptide"
  source: /note="p.P1851fs"
QKLGAPEALGGRETGSHTLQSPAPPQLP

SEQ ID NO: 589 - protein, 52 aa, Artificial Sequence
  source: /note="Description of Artificial Sequence: Synthetic polypeptide"
  source: /note="p.L271M"
QKKSAKERKPSTTSSGKYEDSDGCYMMQKTRPPRKLELRQLSTGSSSRANRI

SEQ ID NO: 590 - protein, 52 aa, Artificial Sequence
  source: /note="Description of Artificial Sequence: Synthetic polypeptide"
  source: /note="p.V236M"
SARVRQTWSVLLLLLLFFIPGVVMAMMAYGLISRELYLGLRFDGDSDSDSQS

SEQ ID NO: 591 - protein, 52 aa, Artificial Sequence
  source: /note="Description of Artificial Sequence: Synthetic polypeptide"
  source: /note="p.A932T"
ETLLKKPLALKMSTINEAVLFEDMITTLNEKPTTGKELSFKEPLALQESPTY

SEQ ID NO: 592 - protein, 52 aa, Artificial Sequence
  source: /note="Description of Artificial Sequence: Synthetic polypeptide"
  source: /note="p.S185I"
SLPGIIFTRSQKEGLHYTCSSHFPYIIQYQFWKNFQTLKIVILGLVLPLLVM

SEQ ID NO: 593 - protein, 52 aa, Artificial Sequence
  source: /note="Description of Artificial Sequence: Synthetic polypeptide"
  source: /note="p.E214D"
IFGGISFFPLDKMTYLKIQSFINRMDDESLNIVKYTAFLYNDQLIWSGLEQD

SEQ ID NO: 594 - protein, 52 aa, Artificial Sequence
  source: /note="Description of Artificial Sequence: Synthetic polypeptide"
  source: /note="p.R594Q"
SDLKVPLTVTWQFQPASSHIFHQLIQQITHNGTIEWGNFLSRFQKKTKVSQS

SEQ ID NO: 595 - protein, 52 aa, Artificial Sequence
  source: /note="Description of Artificial Sequence: Synthetic polypeptide"
  source: /note="p.D283Y"
PDETWMFITKKQTDQTTLRIQPAVKYYFQVNITADSLFAEGKPLELVCLVVS

SEQ ID NO: 596 - protein, 52 aa, Artificial Sequence
  source: /note="Description of Artificial Sequence: Synthetic polypeptide"
  source: /note="p.L470Q"
AYFLGSKSSMAVHSLFKSPSKTYIQQQKTRDENIKVGSPFELVVSGNKRLKE

SEQ ID NO: 597 - protein, 52 aa, Artificial Sequence
  source: /note="Description of Artificial Sequence: Synthetic polypeptide"
  source: /note="p.V721M"
SDMELRLVGGSSRCAGKVEVNVQGAMMGILCANGWGMNIAEVVCRQLECGSA

SEQ ID NO: 598 - protein, 52 aa, Artificial Sequence
  source: /note="Description of Artificial Sequence: Synthetic polypeptide"
  source: /note="p.N228T"
SLNFNGNNVKGIELGAFDSTIFQSLTTFGGTPNLSVIFNGLQNSTTQSLWLG

SEQ ID NO: 599 - protein, 52 aa, Artificial Sequence
  source: /note="Description of Artificial Sequence: Synthetic polypeptide"
  source: /note="p.W41L"
GNSEHAFQGPTSFHVIQTSSFTNSTLLAQTQGSGWLDDLQIHGWDSDSGTAI

SEQ ID NO: 600 - protein, 52 aa, Artificial Sequence
  source: /note="Description of Artificial Sequence: Synthetic polypeptide"
  source: /note="p.R89C"
TIIFLHNWSKGNFSNEELSDLELLFCCFYLFGLTREIQDHASQDYSKYPFEV

SEQ ID NO: 601 - protein, 67 aa, Artificial Sequence
  source: /note="Description of Artificial Sequence: Synthetic polypeptide"
  source: /note="p.L25fs"
MGCLLFLLLWALLQAWGSAEVPQRLSPSAASRSRPSPIAAGRAPTAWRGWGSCRRTAGATTRTPSAL

SEQ ID NO: 602 - protein, 52 aa, Artificial Sequence
  source: /note="Description of Artificial Sequence: Synthetic polypeptide"
  source: /note="p.F85V"
GDLQTHGWDTVLGTIRFLKPWSHGNVVSKQELKNLQSLFQLYFHSFIQIVQA

SEQ ID NO: 603 - protein, 52 aa, Artificial Sequence
  source: /note="Description of Artificial Sequence: Synthetic polypeptide"
  source: /note="p.A283T"
WEWTFFQGNCYFMSNSQRNWHDSITTTCKEVGAQLVVIKSAEEQNFLQLQSS

SEQ ID NO: 604 - protein, 55 aa, Artificial Sequence
  source: /note="Description of Artificial Sequence: Synthetic polypeptide"
  source: /note="p.Q164fs"
TLESPPGSSPSVQCRSPRGKNIQGGRPSPCLSWSSRIVAPGHALSCRTRRRWSSK

SEQ ID NO: 605 - protein, 52 aa, Artificial Sequence
  source: /note="Description of Artificial Sequence: Synthetic polypeptide"
  source: /note="p.E156K"
PGYRREPSLSPKLTCLQNLKWSTAVKKFCKKKSCPNPGEIRNGQIDVPGGIL

SEQ ID NO: 606 - protein, 36 aa, Artificial Sequence
  source: /note="Description of Artificial Sequence: Synthetic polypeptide"
  source: /note="p.P174fs"
ASALPAPPTGSALPDPQTASALPDPQQPLPSLRPWR

SEQ ID NO: 607 - protein, 52 aa, Artificial Sequence
  source: /note="Description of Artificial Sequence: Synthetic polypeptide"
  source: /note="p.Y197H"
LFIIVPIFLLLDKDDSKAGMEEDHTHHEGLDIDQTATYEDIVTLRTGEVKWS

SEQ ID NO: 608 - protein, 52 aa, Artificial Sequence
  source: /note="Description of Artificial Sequence: Synthetic polypeptide"
  source: /note="p.Y197D"
LFIIVPIFLLLDKDDSKAGMEEDHTDDEGLDIDQTATYEDIVTLRTGEVKWS

SEQ ID NO: 609 - protein, 43 aa, Artificial Sequence
  source: /note="Description of Artificial Sequence: Synthetic polypeptide"
  source: /note="p.D280fs"
PLCVSPKYGCNFNNGGCHQDCFEGGMAPSSAAADQDSGCWMTW

SEQ ID NO: 610 - protein, 31 aa, Artificial Sequence
  source: /note="Description of Artificial Sequence: Synthetic polypeptide"
  source: /note="p.L646fs"
GERKQFAVVLLSLRLLAKFLGFVAFPAIPGA

SEQ ID NO: 611 - protein, 88 aa, Artificial Sequence
  source: /note="Description of Artificial Sequence: Synthetic polypeptide"
  source: /note="p.N123fs"
AYAVIYLKKTPEEAYRALLSGSNPPIFHSGMLPLEIALTISPFSTVCRESERDYNMDFLTLRHLMWMNMNIMSELKMVTSTGLFQENF

SEQ ID NO: 612 - protein, 52 aa, Artificial Sequence
  source: /note="Description of Artificial Sequence: Synthetic polypeptide"
  source: /note="p.R375C"
GSVIGPQQQFLVMKQTNLWLEGDYFCCQKLKGQENGQHRAAFSKLLSGVDDI

SEQ ID NO: 613 - protein, 39 aa, Artificial Sequence
  source: /note="Description of Artificial Sequence: Synthetic polypeptide"
  source: /note="p.K322fs"
ENLNRPRLKQVEKFKDNTIPDKVKKSIFLAKESSGRAYV

SEQ ID NO: 614 - protein, 33 aa, Artificial Sequence
  source: /note="Description of Artificial Sequence: Synthetic polypeptide"
  source: /note="p.L460fs"
ITKLDSSIISEGKISTITPQIQAFNHKKQQQKV

SEQ ID NO: 615 - protein, 52 aa, Artificial Sequence
  source: /note="Description of Artificial Sequence: Synthetic polypeptide"
  source: /note="p.D555E"
EVRRIENYRVEGMEIYSTTLWHLQKEEVALSVLSKDLTDMDKNSPEAWCAAG

SEQ ID NO: 616 - protein, 52 aa, Artificial Sequence
  source: /note="Description of Artificial Sequence: Synthetic polypeptide"
  source: /note="p.N571I"
STTLWHLQKDVALSVLSKDLTDMDKIISPEAWCAAGNCFSLQREHDIAIKFF

SEQ ID NO: 617 - protein, 78 aa, Artificial Sequence
  source: /note="Description of Artificial Sequence: Synthetic polypeptide"
  source: /note="p.I91fs"
CTTPQCKYLLAKCCVDLSKLAEGEQSYLVECLISRKAMMILLLSLVIQLALLFHCWDMYIARQIGLPKDQNVTKRALV

SEQ ID NO: 618 - protein, 52 aa, Artificial Sequence
  source: /note="Description of Artificial Sequence: Synthetic polypeptide"
  source: /note="p.P242S"
LESSNSKYSLNTDSSVSYIDSAVISSSDTVPLGTGTSILSKQVQNKPKTGRS

SEQ ID NO: 619 - protein, 52 aa, Artificial Sequence
  source: /note="Description of Artificial Sequence: Synthetic polypeptide"
  source: /note="p.P675T"
EQSEHYSKQLENELEGLKQKQISYSTTGVCSIEHQQEITKLKTDLEKKSIFY

SEQ ID NO: 620 - protein, 70 aa, Artificial Sequence
  source: /note="Description of Artificial Sequence: Synthetic polypeptide"
  source: /note="p.P405fs"
GPCLRNRYGEDVRSALLDPDWVCPPVVGSAIAATVGSVTAAVPQESSFIWPSFMVMTMLRNIWRAYKRSW

SEQ ID NO: 621 - protein, 52 aa, Artificial Sequence
  source: /note="Description of Artificial Sequence: Synthetic polypeptide"
  source: /note="p.E243K"
EPLDRERIATYTLFSHAVSSNGNAVKKDPMEILITVTDQNDNKPEFTQEVFK

SEQ ID NO: 622 - protein, 52 aa, Artificial Sequence
  source: /note="Description of Artificial Sequence: Synthetic polypeptide"
  source: /note="p.D254Y"
TLFSHAVSSNGNAVEDPMEILITVTYYQNDNKPEFTQEVFKGSVMEGALPGT

SEQ ID NO: 623 - protein, 52 aa, Artificial Sequence
  source: /note="Description of Artificial Sequence: Synthetic polypeptide"
  source: /note="p.E349K"
DTQEGIITVKKPLDYESRRLYTLKVKKAENTHVDPRFYYLGPFKDTTIVKIS

SEQ ID NO: 624 - protein, 52 aa, Artificial Sequence
  source: /note="Description of Artificial Sequence: Synthetic polypeptide"
  source: /note="p.R472C"
LDRELSQWHNLTVIAAEINNPKETTCCVAVFVRILDVNDNAPQFAVFYDTFV

SEQ ID NO: 625 - protein, 52 aa, Artificial Sequence
  source: /note="Description of Artificial Sequence: Synthetic polypeptide"
  source: /note="p.S577R"
NGFNRHEISTYLLPVVISDNDYPIQRRSTGTLTIRVCACDSQGNMQSCSAEA

SEQ ID NO: 626 - protein, 52 aa, Artificial Sequence
  source: /note="Description of Artificial Sequence: Synthetic polypeptide"
  source: /note="p.R128S"
IIDEKTGDIHATRRIDREEKAFYTLSSAQAINRRTLRPVEPESEFVIKIHDI

SEQ ID NO: 627 - protein, 52 aa, Artificial Sequence
  source: /note="Description of Artificial Sequence: Synthetic polypeptide"
  source: /note="p.K357T"
KKPVDFETKRAYSLKVEAANVHIDPTTFISNGPFKDTVTVKISVEDADEPPM

SEQ ID NO: 628 - protein, 52 aa, Artificial Sequence
  source: /note="Description of Artificial Sequence: Synthetic polypeptide"
  source: /note="p.D674N"
SKEDIRDNVIHYDDEGGGEEDTQAFNNIGALRNPKVIEENKIRRDIKPDSLC

SEQ ID NO: 629 - protein, 52 aa, Artificial Sequence
  source: /note="Description of Artificial Sequence: Synthetic polypeptide"
  source: /note="p.P706T"
PKVIEENKIRRDIKPDSLCLPRQRPTTMEDNTDIRDFIHQRLQENDVDPTAP

SEQ ID NO: 630 - protein, 52 aa, Artificial Sequence
  source: /note="Description of Artificial Sequence: Synthetic polypeptide"
  source: /note="p.A721S"
KLTPRHQTSSTLESIDVQEFIKQRLSSEADLDPSVPPYDSLQTYAYEGQRSE

SEQ ID NO: 631 - protein, 52 aa, Artificial Sequence
  source: /note="Description of Artificial Sequence: Synthetic polypeptide"
  source: /note="p.A195T"
EMSDMGTSVLQVTATDADDPTYGNSTTRVVYSILQGQPYFSVDPKTGVIRTA

SEQ ID NO: 632 - protein, 52 aa, Artificial Sequence
  source: /note="Description of Artificial Sequence: Synthetic polypeptide"
  source: /note="p.D547Y"
QDPDRYMQQNIRYTKLSDPANWLKIYYPVNGQITTIAVLDRESPNVKNNIYN

SEQ ID NO: 633 - protein, 52 aa, Artificial Sequence
  source: /note="Description of Artificial Sequence: Synthetic polypeptide"
  source: /note="p.P433H"
IQIISAKDPDVTNNSIRYSIDRSSDHHGRFFYVDITTGALMTARPLDREEFS

SEQ ID NO: 634 - protein, 52 aa, Artificial Sequence
  source: /note="Description of Artificial Sequence: Synthetic polypeptide"
  source: /note="p.A134V"
IDDTTGDIHAIQRLDREERAQYTLRVVQALDRRTGRPMEPESEFIIKIQDIN

SEQ ID NO: 635 - protein, 52 aa, Artificial Sequence
  source: /note="Description of Artificial Sequence: Synthetic polypeptide"
  source: /note="p.V403I"
EGLNSMFEVYLVGNNSHHFIISPTSIIQGKADIRIRVAIPLDYETVDRYDFD

SEQ ID NO: 636 - protein, 52 aa, Artificial Sequence
  source: /note="Description of Artificial Sequence: Synthetic polypeptide"
  source: /note="p.F1132Y"
ASVPEDIPEGHSILQLKATDADEGEYYGRVWYRILHGNHGNNFRIHVSNGLL

SEQ ID NO: 637 - protein, 52 aa, Artificial Sequence
  source: /note="Description of Artificial Sequence: Synthetic polypeptide"
  source: /note="p.F177L"
FIVNATDPDLGAGGSVLYSFQPPSQLLFAIDSARGIVTVIRELDYETTQAYQ

SEQ ID NO: 638 - protein, 52 aa, Artificial Sequence
  source: /note="Description of Artificial Sequence: Synthetic polypeptide"
  source: /note="p.Q237K"
SETGIIKTALLNMDRENREQYQVVIKKAKDMGGQMGGLSGTTTVNITLTDVN

SEQ ID NO: 639 - protein, 52 aa, Artificial Sequence
  source: /note="Description of Artificial Sequence: Synthetic polypeptide"
  source: /note="p.Q225K"
PYFSVEPKTGVIKTALPNMDREAKDKKYLLVIQAKDMVGQNGGLSGTTSVTV

SEQ ID NO: 640 - protein, 52 aa, Artificial Sequence
  source: /note="Description of Artificial Sequence: Synthetic polypeptide"
  source: /note="p.F523L"
ENAKPGQLIQTVSVMDKDDPPRGHKLLFFEPVPEFTLNPNFTIVDNKDNTAG

SEQ ID NO: 641 - protein, 52 aa, Artificial Sequence
  source: /note="Description of Artificial Sequence: Synthetic polypeptide"
  source: /note="p.R218G"
QAGATLDYERSRTHYITVVAKDGGGGGLHGADVVFSATTTVTVNVEDVQDMA

SEQ ID NO: 642 - protein, 53 aa, Artificial Sequence
  source: /note="Description of Artificial Sequence: Synthetic polypeptide"
  source: /note="p.E79del"
SPYRREDSMEDRGEEDDSLAIKPPQMSRKEKVHHRKDEKRKEKCRHHSHSAEG

SEQ ID NO: 643 - protein, 52 aa, Artificial Sequence
  source: /note="Description of Artificial Sequence: Synthetic polypeptide"
  source: /note="p.R880S"
DFGLARLYSSEESRPYTNKVITLWYSSPPELLLGEERYTPAIDVWSCGCILG

SEQ ID NO: 644 - protein, 52 aa, Artificial Sequence
  source: /note="Description of Artificial Sequence: Synthetic polypeptide"
  source: /note="p.R108C"
GSDGESDQASATSSDEVQSPVRVRMCCNHPPRKISTEDINKRLSLPADIRLP

SEQ ID NO: 645 - protein, 52 aa, Artificial Sequence
  source: /note="Description of Artificial Sequence: Synthetic polypeptide"
  source: /note="p.H1592Q"
LDEEHRRLREASGEGWKGQDPFRDLQQSLLMEIQALRLQLERSIETSSTLQS

SEQ ID NO: 646 - protein, 53 aa, Artificial Sequence
  source: /note="Description of Artificial Sequence: Synthetic polypeptide"
  source: /note="p.P409L"
YKFPSLFINQFYPRPGTPAAKMEQVLLAQVKKQRTKDLSRVFHSYSPYDHKIG

SEQ ID NO: 647 - protein, 52 aa, Artificial Sequence
  source: /note="Description of Artificial Sequence: Synthetic polypeptide"
  source: /note="p.H83Y"
RVAELLLLHGAEPNCADPATLTRPVYYDAAREGFLDTLVVLHRAGARLDVRD

SEQ ID NO: 648 - protein, 52 aa, Artificial Sequence
  source: /note="Description of Artificial Sequence: Synthetic polypeptide"
  source: /note="p.D108Y"
HDAAREGFLDTLVVLHRAGARLDVRYYAWGRLPVDLAEELGHRDVARYLRAA

SEQ ID NO: 649 - protein, 52 aa, Artificial Sequence
  source: /note="Description of Artificial Sequence: Synthetic polypeptide"
  source: /note="p.V31A"
DVDFLEDVPLLEDIPLLEDVPLLEDAAPLLEDTSRLEDINLMEDMALLEDVD

SEQ ID NO: 650 - protein, 52 aa, Artificial Sequence
  source: /note="Description of Artificial Sequence: Synthetic polypeptide"
  source: /note="p.A60G"
VSAPDGPSDPSISVSSEQSGAQQPPGGLQVERIVDKRKNKKGKTEYLVRWKG

SEQ ID NO: 651 - protein, 52 aa, Artificial Sequence
  source: /note="Description of Artificial Sequence: Synthetic polypeptide"
  source: /note="p.L640I"
CHSASNPSPQYSWRINGIPQQHTQVIIFIAKITPNNNGTYACFVSNLATGRN

SEQ ID NO: 652 - protein, 52 aa, Artificial Sequence
  source: /note="Description of Artificial Sequence: Synthetic polypeptide"
  source: /note="p.A309P"
YLNPMAAFAAAQMQQMAALNMNGLAPPAPMTPTSGGSTPPGITAPAVPSIPS

SEQ ID NO: 653 - protein, 78 aa, Artificial Sequence
  source: /note="Description of Artificial Sequence: Synthetic polypeptide"
  source: /note="p.G614fs"
AVDADSGENARLHYRLVDTASTFLGAAALGLRILPPPLTSPSRSTTAPVGSQCVPSWTARRWSTTASGWRRWTTARPP

SEQ ID NO: 654 - protein, 45 aa, Artificial Sequence
  source: /note="Description of Artificial Sequence: Synthetic polypeptide"
  source: /note="p.16_17insP"
MRSPATGVPLPTPPPPPPLLLLLLLLLPPPLLGDQVGPCRSLGSR

SEQ ID NO: 655 - protein, 43 aa, Artificial Sequence
  source: /note="Description of Artificial Sequence: Synthetic polypeptide"
  source: /note="p.L17P"
MRSPATGVPLPTPPPPPPLLLLLLLLPPPLLGDQVGPCRSLGS

SEQ ID NO: 656 - protein, 47 aa, Artificial Sequence
  source: /note="Description of Artificial Sequence: Synthetic polypeptide"
  source: /note="p.E21K"
MSLDFGSVALPVQNEDEEYDKKEDYEREKELQQLLTDLPHDMLDDDL

SEQ ID NO: 657 - protein, 52 aa, Artificial Sequence
  source: /note="Description of Artificial Sequence: Synthetic polypeptide"
  source: /note="p.S2058L"
TEVYDLPQRPNDVQLFYGSMCKIILLLVIGEFRDCISSREFLQPSSKASLES

SEQ ID NO: 658 - protein, 52 aa, Artificial Sequence
  source: /note="Description of Artificial Sequence: Synthetic polypeptide"
  source: /note="p.S253L"
VNVNPEITALQTMLAECQENLKKLTLLIEKRLDCLEQKMKGKVMVDENTWTN

SEQ ID NO: 659 - protein, 60 aa, Artificial Sequence
  source: /note="Description of Artificial Sequence: Synthetic polypeptide"
  source: /note="p.A85fs"
RARMALWCATDHNVDNTTEMLQEWLGAMTMLLWSGGLRASPGSTQMKRVPSTGPKKGTSF

SEQ ID NO: 660 - protein, 52 aa, Artificial Sequence
  source: /note="Description of Artificial Sequence: Synthetic polypeptide"
  source: /note="p.E95D"
FVASPLAKSFGIKETVRKVTPNTVLDDNFFKHSTRQPLQTDIYGLAKKCNLT

SEQ ID NO: 661 - protein, 28 aa, Artificial Sequence
  source: /note="Description of Artificial Sequence: Synthetic peptide"
  source: /note="p.K63fs"
TDKDEAIDYHELKVAMRALGFDVKKLMY

SEQ ID NO: 662 - protein, 53 aa, Artificial Sequence
  source: /note="Description of Artificial Sequence: Synthetic polypeptide"
  source: /note="p.R314M"
INVSVAIITFASEPKVLMSVLNDNSMMDMTEVISSLENANYKDHENGTGTNTY

SEQ ID NO: 663 - protein, 29 aa, Artificial Sequence
  source: /note="Description of Artificial Sequence: Synthetic peptide"
  source: /note="p.P129fs"
ARKKKEDELWASFLNDVGPKSKVPPKYTS

SEQ ID NO: 664 - protein, 52 aa, Artificial Sequence
  source: /note="Description of Artificial Sequence: Synthetic polypeptide"
  source: /note="p.R441H"
LCKENYLLPEAKEIVCKDGRWQSLPHHCVESTAYCGPPPSINNGDTTSFPLS

SEQ ID NO: 665 - protein, 89 aa, Artificial Sequence
  source: /note="Description of Artificial Sequence: Synthetic polypeptide"
  source: /note="p.K37fs"
CFHLRFCKVTYTSQEDLVEKKCLAKNILTSPAIKSSASHGRDALRAPVFVNYRISAQRMALQCVQLTGEASQHTVNKRVWNVFIQGQSF

SEQ ID NO: 666 - protein, 44 aa, Artificial Sequence
  source: /note="Description of Artificial Sequence: Synthetic polypeptide"
  source: /note="p.T18A"
MEMFQGLLLLLLLSMGGAAWASREMLRPRCRPINATLAVEKEGC

SEQ ID NO: 667 - protein, 52 aa, Artificial Sequence
  source: /note="Description of Artificial Sequence: Synthetic polypeptide"
  source: /note="p.T79M"
PCLGGMASGPCGEQFKSAFSCFHYSMMEEIKGSDCVDQFRAMQECMQKYPDL

SEQ ID NO: 668 - protein, 40 aa, Artificial Sequence
  source: /note="Description of Artificial Sequence: Synthetic polypeptide"
  source: /note="p.P597fs"
WRWGEPPVAVPAPQQADGNPDVPPPVLFKADQSESSLSSG

SEQ ID NO: 669 - protein, 52 aa, Artificial Sequence
  source: /note="Description of Artificial Sequence: Synthetic polypeptide"
  source: /note="p.R975H"
LGPHMLRRLKADVFKNMPSKTELIVHHVELSPMQKKYYKYILTRNFEALNAR

SEQ ID NO: 670 - protein, 52 aa, Artificial Sequence
  source: /note="Description of Artificial Sequence: Synthetic polypeptide"
  source: /note="p.A801T"
YVVTYTGDKESRSVIRENEFSFEDNTTIRSGKKVFRMKKEVQIKFHVLLTSY

SEQ ID NO: 671 - protein, 52 aa, Artificial Sequence
  source: /note="Description of Artificial Sequence: Synthetic polypeptide"
  source: /note="p.E40A"
ARGALGQQQSLGARALASAGSESRDAAYSYVVVGAGSAGCVLAGRLTEDPAE

SEQ ID NO: 672 - protein, 53 aa, Artificial Sequence
  source: /note="Description of Artificial Sequence: Synthetic polypeptide"
  source: /note="p.K373E"
LKPENVLLSSQEEDCLIKITDFGHSEEILGETSLMRTLCGTPTYLAPEVLVSV

SEQ ID NO: 673 - protein, 52 aa, Artificial Sequence
  source: /note="Description of Artificial Sequence: Synthetic polypeptide"
  source: /note="p.K373E"
LKPENVLLSSQEEDCLIKITDFGHSEEILGETSLMRTLCGTPTYLAPEVLVS

SEQ ID NO: 674 - protein, 45 aa, Artificial Sequence
  source: /note="Description of Artificial Sequence: Synthetic polypeptide"
  source: /note="p.P284fs"
LILGMPTYGRSFTLASSSDTRVGAPSHRVWHSRPLHQGRRDAGLL

SEQ ID NO: 675 - protein, 52 aa, Artificial Sequence
  source: /note="Description of Artificial Sequence: Synthetic polypeptide"
  source: /note="p.K264N"
CGLNVHKQCSKMVPNDCKPDLKHVKNNVYSCDLTTLVKAHTTKRPMVVDMCI

SEQ ID NO: 676 - protein, 52 aa, Artificial Sequence
  source: /note="Description of Artificial Sequence: Synthetic polypeptide"
  source: /note="p.I43M"
AEEYQPPIWKSYLYQLQQEAPRPKRMMICPREVENRPKYYGREFHGIISREQ

SEQ ID NO: 677 - protein, 50 aa, Artificial Sequence
  source: /note="Description of Artificial Sequence: Synthetic polypeptide"
  source: /note="p.L23del"
MGSGPLSLPLALSPPRLLLLLLSLLPVARASEAEHRLFERLFEDYNEIIR

SEQ ID NO: 678 - protein, 52 aa, Artificial Sequence
  source: /note="Description of Artificial Sequence: Synthetic polypeptide"
  source: /note="p.S396R"
LIESMHKMASAPRFWPEPEGEPPATRRGTQSLHPPSPSFCVPLDVPAEPGPS

SEQ ID NO: 679 - protein, 52 aa, Artificial Sequence
  source: /note="Description of Artificial Sequence: Synthetic polypeptide"
  source: /note="p.P361Q"
WARVVILKYMSRVLFVYDVGESCLSQQHHSRERDHLTKVYSKLPESNLKAAR

SEQ ID NO: 680 - protein, 38 aa, Artificial Sequence
  source: /note="Description of Artificial Sequence: Synthetic polypeptide"
  source: /note="p.R507fs"
PEGNKGFGRKVFSPVIRSSFTHCRPHWTLSPQGPRILL

SEQ ID NO: 681 - protein, 58 aa, Artificial Sequence
  source: /note="Description of Artificial Sequence: Synthetic polypeptide"
  source: /note="p.A1114fs"
ITAFYSGSPAPTSSAPLAQPSQAPPKPGLHCGHQHNPTCSHHSAQGPASPCHCHPSPD

SEQ ID NO: 682 - protein, 69 aa, Artificial Sequence
  source: /note="Description of Artificial Sequence: Synthetic polypeptide"
  source: /note="p.A1114fs"
VITAFYSGSPAPTSSAPLAQPSQAPQAWSTLWPPAQPHLQPPFCPRARQPLPLPPQPRLALSPAPQQVP

SEQ ID NO: 683 - protein, 52 aa, Artificial Sequence
  source: /note="Description of Artificial Sequence: Synthetic polypeptide"
  source: /note="p.E728K"
AESELAFPSFLLQCFLGALWLALSGKKIKDKELPQYLALTPRKKRPYDNWLE

SEQ ID NO: 684 - protein, 52 aa, Artificial Sequence
  source: /note="Description of Artificial Sequence: Synthetic polypeptide"
  source: /note="p.V553M"
VTFVDPSGEFMDAVRVLPFDPRGAGMMYHEVKAMRKKAPVILHTSQSNTIPL

SEQ ID NO: 685 - protein, 52 aa, Artificial Sequence
  source: /note="Description of Artificial Sequence: Synthetic polypeptide"
  source: /note="p.S250I"
TGTLVKSHLIANADVQSIAVADQEDIIFVVGTAEGTVFHFQLVPVTSNSSEK

SEQ ID NO: 686 - protein, 52 aa, Artificial Sequence
  source: /note="Description of Artificial Sequence: Synthetic polypeptide"
  source: /note="p.V668A"
SEPQHQQRLGEIQHMSQACLLSLLPAAPRDVLETEDEEPPPRRWCNTCQLYY

SEQ ID NO: 687 - protein, 52 aa, Artificial Sequence
  source: /note="Description of Artificial Sequence: Synthetic polypeptide"
  source: /note="p.L89P"
QLLQLQQLLQQSPPQAPLPMAVSRGPPPPQQPQQPLLNLQGTNSASLLNGSM

SEQ ID NO: 688 - protein, 29 aa, Artificial Sequence
  source: /note="Description of Artificial Sequence: Synthetic peptide"
  source: /note="p.*684K"
GRETDAFVCRPNAALCRVYYEADTTKKEK

SEQ ID NO: 689 - protein, 52 aa, Artificial Sequence
  source: /note="Description of Artificial Sequence: Synthetic polypeptide"
  source: /note="p.G576A"
AGGPPKKGKPAAPGGAGNTGTKNKKAALETKEIVEPELSIEVCEEKASAVLP

SEQ ID NO: 690 - protein, 55 aa, Artificial Sequence
  source: /note="Description of Artificial Sequence: Synthetic polypeptide"
  source: /note="p.645_645R>RR"
ILLGSIERSQVVALLGAQLSPARRRRRRQHMQERRATQTSPLSDQEGPPTPEASV

SEQ ID NO: 691 - protein, 52 aa, Artificial Sequence
  source: /note="Description of Artificial Sequence: Synthetic polypeptide"
  source: /note="p.P124Q"
YPVALVSFSSGFSQSITPSSGGSGIQQELKTMLAGVILEDYLDIKNFGAKVV

SEQ ID NO: 692 - protein, 52 aa, Artificial Sequence
  source: /note="Description of Artificial Sequence: Synthetic polypeptide"
  source: /note="p.V210M"
CDERCRRRRKGPSAGPRRSSVSTIQMMEWPEPDLAPAIKYYSDGQHRPPPAQ

SEQ ID NO: 693 - protein, 52 aa, Artificial Sequence
  source: /note="Description of Artificial Sequence: Synthetic polypeptide"
  source: /note="p.S172A"
DFYNPLIPTNIKYEFGPAIFIGWAGAAALVILGGALLSCSCPGNESKAGYRV

SEQ ID NO: 694 - protein, 52 aa, Artificial Sequence
  source: /note="Description of Artificial Sequence: Synthetic polypeptide"
  source: /note="p.W217L"
MSQPLLMFSFFWLGLSWDSSGRSWFLLEDGSVPSPSLFSTKELDQINGSKGC

SEQ ID NO: 695 - protein, 50 aa, Artificial Sequence
  source: /note="Description of Artificial Sequence: Synthetic polypeptide"
  source: /note="p.R423H"
GQPDNHGFGNCVELQASAAFNWNNQHHCKTRNRYICQFAQEHISRWGPGS

SEQ ID NO: 696 - protein, 52 aa, Artificial Sequence
  source: /note="Description of Artificial Sequence: Synthetic polypeptide"
  source: /note="p.R209H"
YNESSTFWHPREPSDPNERCVVLNFHHKSPKRWGWNDVNCLGPQRSVCEMMK

SEQ ID NO: 697 - protein, 52 aa, Artificial Sequence
  source: /note="Description of Artificial Sequence: Synthetic polypeptide"
  source: /note="p.R179L"
QWVDQTPYNENVTFWHSGEPNNLDELLCAIINFRSSEEWGWNDIHCHVPQKS

SEQ ID NO: 698 - protein, 52 aa, Artificial Sequence
  source: /note="Description of Artificial Sequence: Synthetic polypeptide"
  source: /note="p.Q298E"
EGPAGDSMDAEGPAGRARRVSGEPQEESGDGSLSPQAEAIEVAAGESAGRSP

SEQ ID NO: 699 - protein, 37 aa, Artificial Sequence
  source: /note="Description of Artificial Sequence: Synthetic polypeptide"
  source: /note="p.S1018fs"
AAKKHEEEKKELERKLSDLEKKMETKPQPVSGAESQV

SEQ ID NO: 700 - protein, 52 aa, Artificial Sequence
  source: /note="Description of Artificial Sequence: Synthetic polypeptide"
  source: /note="p.R68L"
CKPHHQFKESDCHYLEARSLNERDYLLDRRYVDEYRNDYCEGYVPRHYHRDI

SEQ ID NO: 701 - protein, 52 aa, Artificial Sequence
  source: /note="Description of Artificial Sequence: Synthetic polypeptide"
  source: /note="p.G206S"
ISWWSSGTGGAGLLGALSYLGLTQASSLSPQQTLLSMLGIPALLLASYFLLL

SEQ ID NO: 702 - protein, 52 aa, Artificial Sequence
  source: /note="Description of Artificial Sequence: Synthetic polypeptide"
  source: /note="p.T615M"
LEGEDLGELDKAMQHISYLNSRQFPMMPGIRRLKITSTIKCFNEATCISVPP

SEQ ID NO: 703 - protein, 52 aa, Artificial Sequence
  source: /note="Description of Artificial Sequence: Synthetic polypeptide"
  source: /note="p.P759L"
YSIYGVGSMSRYEQVLHHIRYRNWRLLASLEARRFRIKCSELNGRYTSNEFN

SEQ ID NO: 704 - protein, 52 aa, Artificial Sequence
  source: /note="Description of Artificial Sequence: Synthetic polypeptide"
  source: /note="p.G463R"
SELANQAPETEIIFNSIQVVPRIHERRNISKQDETMMTDLSILPSSNFTLKI

SEQ ID NO: 705 - protein, 52 aa, Artificial Sequence
  source: /note="Description of Artificial Sequence: Synthetic polypeptide"
  source: /note="p.I81K"
IRRNFVLTAAHCAGRSITVTLGAHNKKTEEEDTWQKLEVIKQFRHPKYNTST

SEQ ID NO: 706 - protein, 52 aa, Artificial Sequence
  source: /note="Description of Artificial Sequence: Synthetic polypeptide"
  source: /note="p.R110Q"
FQSVWVSTDHDEIENVAKQFGAQVHQQRSSEVSKDSSTSLDAIIEFLNYHNE

SEQ ID NO: 707 - protein, 52 aa, Artificial Sequence
  source: /note="Description of Artificial Sequence: Synthetic polypeptide"
  source: /note="p.A230T"
EIVSKLLSENTNLTTQEHENIIVAITTPLLENNHPPPDLCEFFCKHCRERPR

SEQ ID NO: 708 - protein, 52 aa, Artificial Sequence
  source: /note="Description of Artificial Sequence: Synthetic polypeptide"
  source: /note="p.S26T"
MEEPQRARSHTVTTTASSFAENFSTTTSSSFAYDREFLRTLPGFLIVAEIVL

SEQ ID NO: 709 - protein, 52 aa, Artificial Sequence
  source: /note="Description of Artificial Sequence: Synthetic polypeptide"
  source: /note="p.L396P"
RSIIGFVKLRSNKVKRSQKLVYMGKPPKEKESFGEISVLLQVPFTCTIITKK

SEQ ID NO: 710 - protein, 52 aa, Artificial Sequence
  source: /note="Description of Artificial Sequence: Synthetic polypeptide"
  source: /note="p.K510T"
AEIALQEATESRLRGLDQQLDDLQTTTFARLLAELESSALKIAYRIERLEWQ

SEQ ID NO: 711 - protein, 52 aa, Artificial Sequence
  source: /note="Description of Artificial Sequence: Synthetic polypeptide"
  source: /note="p.P249L"
SEGLGMYIKSTYDGLHVITGTTENSLLADRCKKIHAGDEVIQVNHQTVVGWQ

SEQ ID NO: 712 - protein, 46 aa, Artificial Sequence
  source: /note="Description of Artificial Sequence: Synthetic polypeptide"
  source: /note="p.E20K"
MADKRKLQGEIDRCLKKVSKKGVEQFEDIWQKLHNAANANQKEKYE

SEQ ID NO: 713 - protein, 26 aa, Artificial Sequence
  source: /note="Description of Artificial Sequence: Synthetic peptide"
  source: /note="p.S248fs"
QEILSCNADIVSLQEVETEQYYSFFW

SEQ ID NO: 714 - protein, 52 aa, Artificial Sequence
  source: /note="Description of Artificial Sequence: Synthetic polypeptide"
  source: /note="p.R102W"
EPDGDRVVYTGTYDTEGVTPTKSGEWWQPIQITMPFTDIGTFETVWQVKFYN

SEQ ID NO: 715 - protein, 52 aa, Artificial Sequence
  source: /note="Description of Artificial Sequence: Synthetic polypeptide"
  source: /note="p.D252Y"
QTPSTWPDPESFPLKFFLRYRPLILYYQWQHVELSDGTAHTITDAYAGKEYI

SEQ ID NO: 716 - protein, 52 aa, Artificial Sequence
  source: /note="Description of Artificial Sequence: Synthetic polypeptide"
  source: /note="p.S379F"
LEIPNVQLDDAGIYECRAENSRGKNFFFRGQLQVYTYPHWVEKLNDTQLDSG

SEQ ID NO: 717 - protein, 52 aa, Artificial Sequence
  source: /note="Description of Artificial Sequence: Synthetic polypeptide"
  source: /note="p.T178N"
IDGTFIISNPSEAKDSGHYQCLATNNNVGSILSREATLQFAYLGNFSGRTRS

SEQ ID NO: 718 - protein, 52 aa, Artificial Sequence
  source: /note="Description of Artificial Sequence: Synthetic polypeptide"
  source: /note="p.R807M"
NNEGEGSLSTVTIVYSGEDEPQLAPMMGTSLQSFSASEMEVSWNAIAWNRNT

SEQ ID NO: 719 - protein, 52 aa, Artificial Sequence
  source: /note="Description of Artificial Sequence: Synthetic polypeptide"
  source: /note="p.S1029I"
EPGTWMRYNLQSALRSAAREFSHMLIIRPVPGYEPGYIPGYDTPGYVPGYHG

SEQ ID NO: 720 - protein, 52 aa, Artificial Sequence
  source: /note="Description of Artificial Sequence: Synthetic polypeptide"
  source: /note="p.F395L"
EPYTVPVFFNATSYLEVPGRLNQDLLLSVSFQFRTWNPNGLLVFSHFADNLG

SEQ ID NO: 721 - protein, 52 aa, Artificial Sequence
  source: /note="Description of Artificial Sequence: Synthetic polypeptide"
  source: /note="p.Y436S"
LFSELQLISGGILLFLSDGKLKSNLSSQPGKLPSDITAGVELNDGQWHSVSL

SEQ ID NO: 722 - protein, 38 aa, Artificial Sequence
  source: /note="Description of Artificial Sequence: Synthetic polypeptide"
  source: /note="p.I12F"
MLLFYLLVVLSFFDSTKASALTNPNVALFLLADDCDDP

SEQ ID NO: 723 - protein, 52 aa, Artificial Sequence
  source: /note="Description of Artificial Sequence: Synthetic polypeptide"
  source: /note="p.P185S"
SKIEGIENMCNLQKLNLAGNEIEHISSVWLGKKLKSLRVLNLKGNKISSLQD

SEQ ID NO: 724 - protein, 49 aa, Artificial Sequence
  source: /note="Description of Artificial Sequence: Synthetic polypeptide"
  source: /note="p.R920fs"
PKTEKPPARKKSGHPAPSSMRSRGGSLEMSPPTLSPLCSLIVVILINAH

SEQ ID NO: 725 - protein, 52 aa, Artificial Sequence
  source: /note="Description of Artificial Sequence: Synthetic polypeptide"
  source: /note="p.K732N"
DPLTVKDPICAHGNDDLLPPVDRIDNNNSTASYLKNYPLYRQDYNPKPKPSN

SEQ ID NO: 726 - protein, 52 aa, Artificial Sequence
  source: /note="Description of Artificial Sequence: Synthetic polypeptide"
  source: /note="p.H617R"
TKVVSSQSSFPLAAEQTIISALKAIRRALMENAVQPLLTSVGDAIEAIIITM

SEQ ID NO: 727 - protein, 52 aa, Artificial Sequence
  source: /note="Description of Artificial Sequence: Synthetic polypeptide"
  source: /note="p.R1082I"
STVGALNKIGTDGTQVAMVQFTDDPIITEFKLNAYKTKETLLDAIKHISYKG

SEQ ID NO: 728 - protein, 52 aa, Artificial Sequence
  source: /note="Description of Artificial Sequence: Synthetic polypeptide"
  source: /note="p.K708R"
ARGPNGSVGEKGDPGNRGLPGPPGKRRGQAGPPGVMGPPGPPGPPGPPGPGC

SEQ ID NO: 729 - protein, 41 aa, Artificial Sequence
  source: /note="Description of Artificial Sequence: Synthetic polypeptide"
  source: /note="p.G884fs"
DRGSRGEKGDPGKDGVGQPGLPGPPDPRDLWSTCRSRTDPS

SEQ ID NO: 730 - protein, 52 aa, Artificial Sequence
  source: /note="Description of Artificial Sequence: Synthetic polypeptide"
  source: /note="p.P538Q"
GPPGLIGSPGLKGQQGSAGSMGPRGQQPGDVGLPGEHGIPGKQGIKGEKGDP

SEQ ID NO: 731 - protein, 52 aa, Artificial Sequence
  source: /note="Description of Artificial Sequence: Synthetic polypeptide"
  source: /note="p.L550I"
GPAGAPGLVGPLGPSGPKGKKGEPIIISTIQGMPGDRGDSGSQGFRGVIGEP

SEQ ID NO: 732 - protein, 52 aa, Artificial Sequence
  source: /note="Description of Artificial Sequence: Synthetic polypeptide"
  source: /note="p.G516W"
QGPIGPPGEEGKRGPRGDPGTVGPPWWPVGERGAPGNRGFPGSDGLPGPKGA

SEQ ID NO: 733 - protein, 52 aa, Artificial Sequence
  source: /note="Description of Artificial Sequence: Synthetic polypeptide"
  source: /note="p.G612W"
LGPLGAPGEDGRPGPPGSIGIRGQPWWSMGLPGPKGSSGDPGKPGEAGNAGV

SEQ ID NO: 734 - protein, 52 aa, Artificial Sequence
  source: /note="Description of Artificial Sequence: Synthetic polypeptide"
  source: /note="p.A2378D"
GQKGDPGYPGPAGPKGNRGDSIDQCDDLIQSIKDKCPCCYGPLECPVFPTEL

SEQ ID NO: 735 - protein, 52 aa, Artificial Sequence
  source: /note="Description of Artificial Sequence: Synthetic polypeptide"
  source: /note="p.D2792N"
YFFVVLGIGRKVNIKEVYTFASEPNNNVFFKLVDKSTELNEEPLMRFGRLLP

SEQ ID NO: 736 - protein, 52 aa, Artificial Sequence
  source: /note="Description of Artificial Sequence: Synthetic polypeptide"
  source: /note="p.T2224M"
QEDFLGGNGFIGQELNSGRESPFVKMMEDNGSDYLVYLPSQMFEPQKLMINY

SEQ ID NO: 737 - protein, 52 aa, Artificial Sequence
  source: /note="Description of Artificial Sequence: Synthetic polypeptide"
  source: /note="p.P211Q"
GVERSSATLFVDCNRIESLPIKPRGQQIDIDGFAVLGKLADNPQVSVPFELQ

SEQ ID NO: 738 - protein, 69 aa, Artificial Sequence
  source: /note="Description of Artificial Sequence: Synthetic polypeptide"
  source: /note="p.P283fs"
RITPSQTTDERGPPGEQGPPGPPGPLEFQASMASTVTEVLRAPRAPRVLQVNRESQELQASLAHLALMD

SEQ ID NO: 739 - protein, 52 aa, Artificial Sequence
  source: /note="Description of Artificial Sequence: Synthetic polypeptide"
  source: /note="p.R425C"
NVIPVLMEFLSDNNEAAAADVLEFVCCEAIQRFDNLRMLIVEKMLEVFHAIK

SEQ ID NO: 740 - protein, 52 aa, Artificial Sequence
  source: /note="Description of Artificial Sequence: Synthetic polypeptide"
  source: /note="p.V66L"
SFALARAAGAPHGGDLQPPACPEPRLWRQLSLSAAAVVDSAPRPLQPYLRLM

SEQ ID NO: 741 - protein, 46 aa, Artificial Sequence
  source: /note="Description of Artificial Sequence: Synthetic polypeptide"
  source: /note="p.*526R"
LTQREVQAKQLELEIKNLRMGSEQLRRAETSALLTLRDTTRLHGEV

SEQ ID NO: 742 - protein, 52 aa, Artificial Sequence
  source: /note="Description of Artificial Sequence: Synthetic polypeptide"
  source: /note="p.L86I"
PSKAAERVVGRWLLVCSGTVAGAVIIIGGVTRLTESGLSMVDWHLIKEMKPP

SEQ ID NO: 743 - protein, 34 aa, Artificial Sequence
  source: /note="Description of Artificial Sequence: Synthetic polypeptide"
  source: /note="p.S8L"
MAVVGVSLLVSRLLGRSRPQLGRPMSSGAHGEEG

SEQ ID NO: 744 - protein, 56 aa, Artificial Sequence
  source: /note="Description of Artificial Sequence: Synthetic polypeptide"
  source: /note="p.P784fs"
TDEAVPAFQPHTGSLVAVAPSRHPPEQRREKGLSSPKHGFGIVSTSVTHLVRGHSV

SEQ ID NO: 745 - protein, 52 aa, Artificial Sequence
  source: /note="Description of Artificial Sequence: Synthetic polypeptide"
  source: /note="p.P290Q"
SAHEYSSSPDDAIFQSLARAYSSFNQQAMSDPNRPPCRKNDDDSSFVDGTTN

SEQ ID NO: 746 - protein, 52 aa, Artificial Sequence
  source: /note="Description of Artificial Sequence: Synthetic polypeptide"
  source: /note="p.Q127H"
SKSPNLSKHDFLGQVFCTLGEIVGSHHGSRLEKPIVGIPGKKCGTIILTAEE

SEQ ID NO: 747 - protein, 52 aa, Artificial Sequence
  source: /note="Description of Artificial Sequence: Synthetic polypeptide"
  source: /note="p.T855K"
TPRLPMNKEWPSNLDLRKELSEPSSKKRIYAIAKAIDDNMSLDEIEKLTYID

SEQ ID NO: 748 - protein, 52 aa, Artificial Sequence
  source: /note="Description of Artificial Sequence: Synthetic polypeptide"
  source: /note="p.P219Q"
NPPLQRSSSLIQLTSQNSSPNQQRTQQQVIGVMQSQNSSAGNRGPRPLEQVT

SEQ ID NO: 749 - protein, 47 aa, Artificial Sequence
  source: /note="Description of Artificial Sequence: Synthetic polypeptide"
  source: /note="p.L79fs"
PIGTYLNYECRPGYSGRPFSIICLKTQSGQVLRTSANVNHVVILQIL

SEQ ID NO: 750 - protein, 34 aa, Artificial Sequence
  source: /note="Description of Artificial Sequence: Synthetic polypeptide"
  source: /note="p.V206fs"
ESGYLLVGEKIINCLSSGKWSAVPPHVKRHAVNL

SEQ ID NO: 751 - protein, 36 aa, Artificial Sequence
  source: /note="Description of Artificial Sequence: Synthetic polypeptide"
  source: /note="p.L628fs"
SICAFQNSFLGGLPVGMTSNGVALLTSIICHPHLRL

SEQ ID NO: 752 - protein, 52 aa, Artificial Sequence
  source: /note="Description of Artificial Sequence: Synthetic polypeptide"
  source: /note="p.F630V"
ICAFQNSFLGGLPVGMTSNGVALLNVVYNMPSTPSFVGCLQDIKIDWNHITL

SEQ ID NO: 753 - protein, 52 aa, Artificial Sequence
  source: /note="Description of Artificial Sequence: Synthetic polypeptide"
  source: /note="p.T1110M"
GWEGPRCEAHVDPCHSAPCARGRCHMMHPDGRFECRCPPGFGGPRCRLPVPS

SEQ ID NO: 754 - protein, 52 aa, Artificial Sequence
  source: /note="Description of Artificial Sequence: Synthetic polypeptide"
  source: /note="p.D1435H"
FGMHVQEYGSDCPPPNTRRVYISYLHHSIHFFRPRCLRTAVYHEILIGYLEY

SEQ ID NO: 755 - protein, 52 aa, Artificial Sequence
  source: /note="Description of Artificial Sequence: Synthetic polypeptide"
  source: /note="p.R1446H"
CPPPNTRRVYISYLDSIHFFRPRCLHHTAVYHEILIGYLEYVKKLGYVTGHI

SEQ ID NO: 756 - protein, 52 aa, Artificial Sequence
  source: /note="Description of Artificial Sequence: Synthetic polypeptide"
  source: /note="p.P2094L"
DLLRTLKSPSSPQQQQQVLNILKSNLLQLMAAFIKQRTAKYVANQPGMQPQP

SEQ ID NO: 757 - protein, 167 aa, Artificial Sequence
  source: /note="Description of Artificial Sequence: Synthetic polypeptide"
  source: /note="p.M48fs"
PACSCAHVECPPAHTCRCGVPACSHTCPCGVPACSHVPMWSARLLTHVSMWSAHLLMCPCGVPTCSHVPMWSATCSHTCPCGVPACSRAHVECPPAHTCRCGVPACSHVPMRSARLLTRAHAECPPAHTCPCGVPACSHVPTWSARLLTRAHVECPPAHTCQRGVPA

SEQ ID NO: 758 - protein, 52 aa, Artificial Sequence
  source: /note="Description of Artificial Sequence: Synthetic polypeptide"
  source: /note="p.C143R"
SHVPMRSARLLTRAHAECPPAHTCPRRGVPACSHVPMRSARLLTRADVECPP

SEQ ID NO: 759 - protein, 52 aa, Artificial Sequence
  source: /note="Description of Artificial Sequence: Synthetic polypeptide"
  source: /note="p.C174R"
SHVPMRSARLLTRADVECPPAHTCPRRGVPACSHVPTWSARLITRAHVECSP

SEQ ID NO: 760 - protein, 259 aa, Artificial Sequence
  source: /note="Description of Artificial Sequence: Synthetic polypeptide"
  source: /note="p.S180fs"
LTRADVECPPAHTCPCGVPACSHVPMWSARLLTRADVECLPAHTCPCGVFACSHVPMRSARLLTRADAECPPAHTCPCGVPACSRADVECPPAHTCPCGVPACSRADVGCPPAHMCRCGVPACSHVPMWSARLLTRADVECPPAHVPIWSARLLTRAIVECPPAHTHADVECPPAHTCPCGVPACSHVPMWSARLLTHVPMWSARLLTRAHVECLPAHTRAHVECPPAHTKPWHGGSVGFLSCRPSQTLLPYILLMVAF

SEQ ID NO: 761 - protein, 52 aa, Artificial Sequence
  source: /note="Description of Artificial Sequence: Synthetic polypeptide"
  source: /note="p.I190L"
ECPPAHTCPCGVPACSHVPTWSARLLLTRAHVECSPAHTCRCGVPACSHVPM

SEQ ID NO: 762 - protein, 52 aa, Artificial Sequence
  source: /note="Description of Artificial Sequence: Synthetic polypeptide"
  source: /note="p.R222W"
PKAVYLVCNYSPKGNWWGHAPYKHGWWPCSACPPSFGGGCRENLCYKEGSDR

SEQ ID NO: 763 - protein, 52 aa, Artificial Sequence
  source: /note="Description of Artificial Sequence: Synthetic polypeptide"
  source: /note="p.A355P"
RTSRAVQEAGLGLSTGLRLAESRAEPPALEKQALLQAQLEEQLRDKVLREKD

SEQ ID NO: 764 - protein, 52 aa, Artificial Sequence
  source: /note="Description of Artificial Sequence: Synthetic polypeptide"
  source: /note="p.Q580H"
DPLFSKSGGGGNFVLSTSLVGYLRVHHGVVVPMVHNGYGFFYHIRDDRFVVA

SEQ ID NO: 765 - protein, 37 aa, Artificial Sequence
  source: /note="Description of Artificial Sequence: Synthetic polypeptide"
  source: /note="p.L32fs"
TEERTFQYQDSLPSLPVPSLEESLKNTLNQSPEHATR

SEQ ID NO: 766 - protein, 52 aa, Artificial Sequence
  source: /note="Description of Artificial Sequence: Synthetic polypeptide"
  source: /note="p.S363L"
NKTVLSSSLNNHPQTSVPNASALHPLLLRLFSLSNPSLSTTNLSGPSRRRQP

SEQ ID NO: 767 - protein, 52 aa, Artificial Sequence
  source: /note="Description of Artificial Sequence: Synthetic polypeptide"
  source: /note="p.R143G"
HLTEIHSLNVLEGSWILYEMPNYRGGGQYLLRPGEYRRFLDWGAPNAKVGSL

SEQ ID NO: 768 - protein, 33 aa, Artificial Sequence
  source: /note="Description of Artificial Sequence: Synthetic polypeptide"
  source: /note="p.G159fs"
YEMPNYRGRQYLLRPGDYRRYHDWGVQMPKSAL

SEQ ID NO: 769 - protein, 31 aa, Artificial Sequence
  source: /note="Description of Artificial Sequence: Synthetic polypeptide"
  source: /note="p.*315K"
FKSLGMAVEDTVAAKLIYDSWSSGKKKNKGT

SEQ ID NO: 770 - protein, 52 aa, Artificial Sequence
  source: /note="Description of Artificial Sequence: Synthetic polypeptide"
  source: /note="p.R220C"
NVQLETGDKINFVIDNNKHTGAVSACCNIMLLKKKQARCQGVVCAMKEAFGF

SEQ ID NO: 771 - protein, 52 aa, Artificial Sequence
  source: /note="Description of Artificial Sequence: Synthetic polypeptide"
  source: /note="p.G298S"
SFGLFYKPSPDAGEEECSPVLREGLSSSLHTRHHCQIPVPDPATHGQYIVSV

SEQ ID NO: 772 - protein, 46 aa, Artificial Sequence
  source: /note="Description of Artificial Sequence: Synthetic polypeptide"
  source: /note="p.P468fs"
SLWVGWEPPNPWPQGYVIEWGLGPPARAIATRPGGWNRMGEPRGFC

SEQ ID NO: 773 - protein, 52 aa, Artificial Sequence
  source: /note="Description of Artificial Sequence: Synthetic polypeptide"
  source: /note="p.L362F"
VSLNEEFNRGRGLNVGARAWDKGEVFFMFFCDVDIYFSAEFLNSCRLNAEPG

SEQ ID NO: 774 - protein, 52 aa, Artificial Sequence
  source: /note="Description of Artificial Sequence: Synthetic polypeptide"
  source: /note="p.R117Q"
SSNMEETQQKSNLELLHISLLLIESQQLEPVRFLRSTFTNNLVYDTSDSDDY

SEQ ID NO: 775 - protein, 52 aa, Artificial Sequence
  source: /note="Description of Artificial Sequence: Synthetic polypeptide"
  source: /note="p.P1855Q"
PTCVVPCGGNLTERRGTILSPGFPEQQYLNSLNCVWKIVVPEGAGIQIQVVS

SEQ ID NO: 776 - protein, 52 aa, Artificial Sequence
  source: /note="Description of Artificial Sequence: Synthetic polypeptide"
  source: /note="p.Q691K"
DPGTPLYGIREGDGFSNRDVLRFECKKFGFELIGEKSIVCQENNQWSANIPI

SEQ ID NO: 777 - protein, 52 aa, Artificial Sequence
  source: /note="Description of Artificial Sequence: Synthetic polypeptide"
  source: /note="p.H952Y"
AEPGHSIKITFERFQTELNYDVLEVYYDGPNLLSPLLGSYNGTQVPQFLFSS

SEQ ID NO: 778 - protein, 52 aa, Artificial Sequence
  source: /note="Description of Artificial Sequence: Synthetic polypeptide"
  source: /note="p.T1094K"
GDVRGPSGTILSPGYPEFYPNSLNCKKWTVDVTHGKGVQFNFHTFHLEDHHD

SEQ ID NO: 779 - protein, 52 aa, Artificial Sequence
  source: /note="Description of Artificial Sequence: Synthetic polypeptide"
  source: /note="p.E171K"
STKSVFSLRLTSDFAVSAHGFKVYYKKELQSSSCGNPGVPPKGVLYGTRFDV

SEQ ID NO: 780 - protein, 52 aa, Artificial Sequence
  source: /note="Description of Artificial Sequence: Synthetic polypeptide"
  source: /note="p.Q174H"
SVFSLRLTSDFAVSAHGFKVYYEELHHSSSCGNPGVPPKGVLYGTRFDVGDK

SEQ ID NO: 781 - protein, 46 aa, Artificial Sequence
  source: /note="Description of Artificial Sequence: Synthetic polypeptide"
  source: /note="p.F2383fs"
LESVYSTSNQILIKFHSDFTTSGFFCAQLSRLSTKGVPTSTTCAQC

SEQ ID NO: 782 - protein, 52 aa, Artificial Sequence
  source: /note="Description of Artificial Sequence: Synthetic polypeptide"
  source: /note="p.P2727T"
LEHGRWRIVNGSHYEYKTKVVFSCDTTGYHGLGPASIECLPNGTWSWRNERP

SEQ ID NO: 783 - protein, 52 aa, Artificial Sequence
  source: /note="Description of Artificial Sequence: Synthetic polypeptide"
  source: /note="p.T2810N"
CDLGFMLVGSAVRECLSSGLWSESENNRCLAGHCGIPELIVNGQVIGENYGY

SEQ ID NO: 784 - protein, 52 aa, Artificial Sequence
  source: /note="Description of Artificial Sequence: Synthetic polypeptide"
  source: /note="p.D119N"
AVTGTAWLEADSPGLGGVTAEAGSGNNAQALPATLQAPHEVLGQSIMPPAIP

SEQ ID NO: 785 - protein, 78 aa, Artificial Sequence
  source: /note="Description of Artificial Sequence: Synthetic polypeptide"
  source: /note="p.234_243EKLTEEATEE>E"
DLAEMAREPAEEAADEKPPEEAAEEEPAAEEPTSEEAVAPEEVTKSQPEKWDEEAQDAAGEEEKEQEKEKDVENKVKN

SEQ ID NO: 786 - protein, 52 aa, Artificial Sequence
  source: /note="Description of Artificial Sequence: Synthetic polypeptide"
  source: /note="p.A364V"
IIQLSEVDKTKEELTEHIKNLQTQQVVSLQSENIYFESENQKLQQKLKIMTE

SEQ ID NO: 787 - protein, 43 aa, Artificial Sequence
  source: /note="Description of Artificial Sequence: Synthetic polypeptide"
  source: /note="p.K202fs"
EQGELPPQEDPSWQKDPDYQPPAKKKQRKPKRANCVIQRRAKM

SEQ ID NO: 788 - protein, 42 aa, Artificial Sequence
  source: /note="Description of Artificial Sequence: Synthetic polypeptide"
  source: /note="p.K202fs"
EQGELPPQEDPSWQKDPDYQPPAKKQRKPKRANCVIQRRAKM

SEQ ID NO: 789 - protein, 52 aa, Artificial Sequence
  source: /note="Description of Artificial Sequence: Synthetic polypeptide"
  source: /note="p.E423K"
YECHICHTRFTQSGTMKIHILQKHGKKNVPKYQCPHCATIIARKSDLRVHMR

SEQ ID NO: 790 - protein, 52 aa, Artificial Sequence
  source: /note="Description of Artificial Sequence: Synthetic polypeptide"
  source: /note="p.E126K"
KHPVRFFVHKRPHVDFFLEVVSQWYKKLVVFTASMEIYGSAVADKLDNSRSI

SEQ ID NO: 791 - protein, 27 aa, Artificial Sequence
  source: /note="Description of Artificial Sequence: Synthetic peptide"
  source: /note="p.K856fs"
IIRIQSPAGPRHPVVMWRMKAPAKKNP

SEQ ID NO: 792 - protein, 52 aa, Artificial Sequence
  source: /note="Description of Artificial Sequence: Synthetic polypeptide"
  source: /note="p.K335I"
ESKLIILASGGPQALVNIMRTYTYEIILLWTTSRVLKVLSVCSSNKPAIVEA

SEQ ID NO: 793 - protein, 52 aa, Artificial Sequence
  source: /note="Description of Artificial Sequence: Synthetic polypeptide"
  source: /note="p.G34R"
ELDMAMEPDRKAAVSHWQQQSYLDSRRIHSGATTTAPSLSGKGNPEEEDVDT

SEQ ID NO: 794 - protein, 52 aa, Artificial Sequence
  source: /note="Description of Artificial Sequence: Synthetic polypeptide"
  source: /note="p.G34V"
ELDMAMEPDRKAAVSHWQQQSYLDSVVIHSGATTTAPSLSGKGNPEEEDVDT

SEQ ID NO: 795 - protein, 52 aa, Artificial Sequence
  source: /note="Description of Artificial Sequence: Synthetic polypeptide"
  source: /note="p.H36P"
DMAMEPDRKAAVSHWQQQSYLDSGIPPSGATTTAPSLSGKGNPEEEDVDTSQ

SEQ ID NO: 796 - protein, 52 aa, Artificial Sequence
  source: /note="Description of Artificial Sequence: Synthetic polypeptide"
  source: /note="p.S37A"
MAMEPDRKAAVSHWQQQSYLDSGIHAAGATTTAPSLSGKGNPEEEDVDTSQV

SEQ ID NO: 797 - protein, 52 aa, Artificial Sequence
  source: /note="Description of Artificial Sequence: Synthetic polypeptide"
  source: /note="p.S37C"
MAMEPDRKAAVSHWQQQSYLDSGIHCCGATTTAPSLSGKGNPEEEDVDTSQV

SEQ ID NO: 798 - protein, 52 aa, Artificial Sequence
  source: /note="Description of Artificial Sequence: Synthetic polypeptide"
  source: /note="p.S37F"
MAMEPDRKAAVSHWQQQSYLDSGIHFFGATTTAPSLSGKGNPEEEDVDTSQV

SEQ ID NO: 799 - protein, 52 aa, Artificial Sequence
  source: /note="Description of Artificial Sequence: Synthetic polypeptide"
  source: /note="p.N387K"
GMQALGLHLTDPSQRLVQNCLWTLRKKLSDAATKQEGMEGLLGTLVQLLGSD

SEQ ID NO: 800 - protein, 52 aa, Artificial Sequence
  source: /note="Description of Artificial Sequence: Synthetic polypeptide"
  source: /note="p.T41A"
PDRKAAVSHWQQQSYLDSGIHSGATAATAPSLSGKGNPEEEDVDTSQVLYEW

SEQ ID NO: 801 - protein, 52 aa, Artificial Sequence
  source: /note="Description of Artificial Sequence: Synthetic polypeptide"
  source: /note="p.T41I"
PDRKAAVSHWQQQSYLDSGIHSGATIITAPSLSGKGNPEEEDVDTSQVLYEW

SEQ ID NO: 802 - protein, 52 aa, Artificial Sequence
  source: /note="Description of Artificial Sequence: Synthetic polypeptide"
  source: /note="p.S45P"
AAVSHWQQQSYLDSGIHSGATTTAPPPLSGKGNPEEEDVDTSQVLYEWEQGF

SEQ ID NO: 803 - protein, 52 aa, Artificial Sequence
  source: /note="Description of Artificial Sequence: Synthetic polypeptide"
  source: /note="p.D32N"
LMELDMAMEPDRKAAVSHWQQQSYLNNSGIHSGATTTAPSLSGKGNPEEEDV

SEQ ID NO: 804 - protein, 52 aa, Artificial Sequence
  source: /note="Description of Artificial Sequence: Synthetic polypeptide"
  source: /note="p.D32Y"
LMELDMAMEPDRKAAVSHWQQQSYLYYSGIHSGATTTAPSLSGKGNPEEEDV

SEQ ID NO: 805 - protein, 52 aa, Artificial Sequence
  source: /note="Description of Artificial Sequence: Synthetic polypeptide"
  source: /note="p.D32G"
LMELDMAMEPDRKAAVSHWQQQSYLGGSGIHSGATTTAPSLSGKGNPEEEDV

SEQ ID NO: 806 - protein, 52 aa, Artificial Sequence
  source: /note="Description of Artificial Sequence: Synthetic polypeptide"
  source: /note="p.D32V"
LMELDMAMEPDRKAAVSHWQQQSYLVVSGIHSGATTTAPSLSGKGNPEEEDV

SEQ ID NO: 807 - protein, 52 aa, Artificial Sequence
  source: /note="Description of Artificial Sequence: Synthetic polypeptide"
  source: /note="p.S33P"
MELDMAMEPDRKAAVSHWQQQSYLDPPGIHSGATTTAPSLSGKGNPEEEDVD

SEQ ID NO: 808 - protein, 52 aa, Artificial Sequence
  source: /note="Description of Artificial Sequence: Synthetic polypeptide"
  source: /note="p.S33Y"
MELDMAMEPDRKAAVSHWQQQSYLDYYGIHSGATTTAPSLSGKGNPEEEDVD

SEQ ID NO: 809 - protein, 52 aa, Artificial Sequence
  source: /note="Description of Artificial Sequence: Synthetic polypeptide"
  source: /note="p.S33C"
MELDMAMEPDRKAAVSHWQQQSYLDCCGIHSGATTTAPSLSGKGNPEEEDVD

SEQ ID NO: 810 - protein, 52 aa, Artificial Sequence
  source: /note="Description of Artificial Sequence: Synthetic polypeptide"
  source: /note="p.S33F"
MELDMAMEPDRKAAVSHWQQQSYLDFFGIHSGATTTAPSLSGKGNPEEEDVD

SEQ ID NO: 811 - protein, 73 aa, Artificial Sequence
  source: /note="Description of Artificial Sequence: Synthetic polypeptide"
  source: /note="p.I447fs"
VHLGACGALKNISFGRDQDNKIAIKTVMVCLPLCDCFERLVIWTLLKLLPEPCGIFHPMTQSKWRLWTMHCMP

SEQ ID NO: 812 - protein, 34 aa, Artificial Sequence
  source: /note="Description of Artificial Sequence: Synthetic polypeptide"
  source: /note="p.F105fs"
NSGHFTIIYNQGFEIVLNDYKWFAFLSIKKRAAR

SEQ ID NO: 813 - protein, 74 aa, Artificial Sequence
  source: /note="Description of Artificial Sequence: Synthetic polypeptide"
  source: /note="p.P89fs"
GPIPEVLKNYMDAQYYGEIGIGTPPPVLHSRLRHGLLQPVGPLHPLQTAGHRLLDPPQVQQRQVQHLREEWYLV

SEQ ID NO: 814 - protein, 52 aa, Artificial Sequence
  source: /note="Description of Artificial Sequence: Synthetic polypeptide"
  source: /note="p.S420L"
TSSTPPLPSNAAPPTAQTPGIAPQNLLQAPPMHSLHSPCANTSLHPGLNPRI

SEQ ID NO: 815 - protein, 52 aa, Artificial Sequence
  source: /note="Description of Artificial Sequence: Synthetic polypeptide"
  source: /note="p.R164C"
LEMEKLQLQALEQEHKKLAARLEEECCGKNKQVVLMLVKECKQLSGKVIEEA

SEQ ID NO: 816 - protein, 52 aa, Artificial Sequence
  source: /note="Description of Artificial Sequence: Synthetic polypeptide"
  source: /note="p.G596C"
EHLRNGRGFTVRWETQQPECGGILTCCPYGSIKSPGYPGNYPPGRDCVWIVV

SEQ ID NO: 817 - protein, 52 aa, Artificial Sequence
  source: /note="Description of Artificial Sequence: Synthetic polypeptide"
  source: /note="p.I2816M"
GGGFYATWNTQTLGCGGIFHSDNGTMMRSPHWPQNFPENSRCSWTAITHKSK

SEQ ID NO: 818 - protein, 52 aa, Artificial Sequence
  source: /note="Description of Artificial Sequence: Synthetic polypeptide"
  source: /note="p.E485K"
DVFQKFYAKMLAKRLVHQNSASDDAKKASMISKLKQACGFEYTSKLQRMFQD

SEQ ID NO: 819 - protein, 52 aa, Artificial Sequence
  source: /note="Description of Artificial Sequence: Synthetic polypeptide"
  source: /note="p.L371F"
QAQPSFRRSRRFRPRSEFASGNTYAFFYVRDTLQPGMRVRMLDDYEEISAGD

SEQ ID NO: 820 - protein, 52 aa, Artificial Sequence
  source: /note="Description of Artificial Sequence: Synthetic polypeptide"
  source: /note="p.D1726E"
SPRCWPVSPLCYLYHPRKCLPTEFCEEALDRFSSFYSQSQNHPVLDMGPHRR

SEQ ID NO: 821 - protein, 40 aa, Artificial Sequence
  source: /note="Description of Artificial Sequence: Synthetic polypeptide"
  source: /note="p.A439fs"
LSGSARRKGKDQPESRRPGSLPAPPSFSVAPQPGGAGFQY

SEQ ID NO: 822 - protein, 52 aa, Artificial Sequence
  source: /note="Description of Artificial Sequence: Synthetic polypeptide"
  source: /note="p.K364E"
EELERKRQEMMENAKWREEERLNILEERHAKDEEREQRLEKLDSRDGKFIHR

SEQ ID NO: 823 - protein, 30 aa, Artificial Sequence
  source: /note="Description of Artificial Sequence: Synthetic polypeptide"
  source: /note="p.K122N"
KKQKNGKKHQKKKVLKVRKSQRSRQNNKTT

SEQ ID NO: 824 - protein, 34 aa, Artificial Sequence
  source: /note="Description of Artificial Sequence: Synthetic polypeptide"
  source: /note="p.E345Q"
VSRGSSLKILSKGKRGGHSSVSTESQQSSSFHSS

SEQ ID NO: 825 - protein, 52 aa, Artificial Sequence
  source: /note="Description of Artificial Sequence: Synthetic polypeptide"
  source: /note="p.Q156H"
MLARGSASPHKSSPQPLVATPSQHHHHQQQQQIKRSARMCGECEACRRTEDC

SEQ ID NO: 826 - protein, 52 aa, Artificial Sequence
  source: /note="Description of Artificial Sequence: Synthetic polypeptide"
  source: /note="p.V43I"
QTPSTSSTKGRKKGKTPRQRRSRSGIIKGLKTTRKAKRPLRGSSSQKAGETN

SEQ ID NO: 827 - protein, 52 aa, Artificial Sequence
  source: /note="Description of Artificial Sequence: Synthetic polypeptide"
  source: /note="p.R198M"
LLHLSGKMPPGINSSQSLPVDNHEKMMVIQLHLQHSSLLDFLNAQGGCISHV

SEQ ID NO: 828 - protein, 52 aa, Artificial Sequence
  source: /note="Description of Artificial Sequence: Synthetic polypeptide"
  source: /note="p.R498G"
LVRVFLYSLGRNPALFPRPERYNPQGGWLDIRGSGRNFYHVPFGFGMRQCLG

SEQ ID NO: 829 - protein, 52 aa, Artificial Sequence
  source: /note="Description of Artificial Sequence: Synthetic polypeptide"
  source: /note="p.F406L"
DVIDGYPVKKGTNIILNIGRMHRLELLFPKPNEFTLENFAKNVPYRYFQPFG

SEQ ID NO: 830 - protein, 52 aa, Artificial Sequence
  source: /note="Description of Artificial Sequence: Synthetic polypeptide"
  source: /note="p.S113I"
WISGEETLIISKSSSMFHIMKHNHYIISRFGSKLGLQCIGMHEKGIIFNNNP

SEQ ID NO: 831 - protein, 52 aa, Artificial Sequence
  source: /note="Description of Artificial Sequence: Synthetic polypeptide"
  source: /note="p.V483M"
CIGEVLAKWEIFLFLAILLQQLEFSMMPPGVKVDLTPIYGLTMKHARCEHVQ

SEQ ID NO: 832 - protein, 52 aa, Artificial Sequence
  source: /note="Description of Artificial Sequence: Synthetic polypeptide"
  source: /note="p.P112Q"
LYKAKYGPMWMSYLGPQMHVNLASAQQLLEQVMRQEGKYPVRNDMELWKEHR

SEQ ID NO: 833 - protein, 52 aa, Artificial Sequence
  source: /note="Description of Artificial Sequence: Synthetic polypeptide"
  source: /note="p.A444E"
ALKKTEAFIPFSLGKRICLGEGIAREEELFLFFTTILQNFSMASPVAPEDID

SEQ ID NO: 834 - protein, 52 aa, Artificial Sequence
  source: /note="Description of Artificial Sequence: Synthetic polypeptide"
  source: /note="p.H352R"
VQRRVQQEIDDVIGQVRRPEMGDQARRMPYTTAVIHEVQRFGDIVPLGVTHM

SEQ ID NO: 835 - protein, 52 aa, Artificial Sequence
  source: /note="Description of Artificial Sequence: Synthetic polypeptide"
  source: /note="p.V185F"
GLMADSVRVMLDKWEELLGQDSPLEFFFQHVSLMTLDTIMKCAFSHQGSIQV

SEQ ID NO: 836 - protein, 52 aa, Artificial Sequence
  source: /note="Description of Artificial Sequence: Synthetic polypeptide"
  source: /note="p.E434D"
HIYALHRNSAVWPDPEVFDSLRFSTDDNASKRHPFAFMPFSAGPRNCIGQQF

SEQ ID NO: 837 - protein, 52 aa, Artificial Sequence
  source: /note="Description of Artificial Sequence: Synthetic polypeptide"
  source: /note="p.K332T"
YLLRHPEAMAAVRDEIDRLLQSTGQTTKGSGFPIHLTREQLDSLICLESSIF

SEQ ID NO: 838 - protein, 52 aa, Artificial Sequence
  source: /note="Description of Artificial Sequence: Synthetic polypeptide"
  source: /note="p.E161K"
ILGQDYCFEVTTSSGSKCFSCRSAAKKRDKWMENLRRAVHPNKDNSRRVEHI

SEQ ID NO: 839 - protein, 52 aa, Artificial Sequence
  source: /note="Description of Artificial Sequence: Synthetic polypeptide"
  source: /note="p.R539C"
TMQKRLKKEKKTKRKLQEALEFESKCCREQVEQALKQATTSDSGLRMLKDTG

SEQ ID NO: 840 - protein, 52 aa, Artificial Sequence
  source: /note="Description of Artificial Sequence: Synthetic polypeptide"
  source: /note="p.R539L"
TMQKRLKKEKKTKRKLQEALEFESKLLREQVEQALKQATTSDSGLRMLKDTG

SEQ ID NO: 841 - protein, 52 aa, Artificial Sequence
  source: /note="Description of Artificial Sequence: Synthetic polypeptide"
  source: /note="p.V216I"
AIKVTETRTGPLGCNSYDNLDSVSSIILLQSTESKLHLQGLQIIFPQYLQEK

SEQ ID NO: 842 - protein, 52 aa, Artificial Sequence
  source: /note="Description of Artificial Sequence: Synthetic polypeptide"
  source: /note="p.S254Y"
PFLKIEDESRKFRPFHHQFKSFPEIYYFLGPKDASPFEAPTTLGSMHHTRES

SEQ ID NO: 843 - protein, 52 aa, Artificial Sequence
  source: /note="Description of Artificial Sequence: Synthetic polypeptide"
  source: /note="p.R246H"
RMDPDMFNGSIAWHSEVGLPVYAHIHHPRDVEAIPRASTNPSNRKVRALAFS

SEQ ID NO: 844 - protein, 52 aa, Artificial Sequence
  source: /note="Description of Artificial Sequence: Synthetic polypeptide"
  source: /note="p.R446H"
AIPSSSVLPSAPRDVVPVLVSSRFVHHLSWRPPAEAKGNIQTFTVFFSREGD

SEQ ID NO: 845 - protein, 30 aa, Artificial Sequence
  source: /note="Description of Artificial Sequence: Synthetic polypeptide"
  source: /note="p.R235fs"
LDRENRSHYMLQLEAYDGGSPPRRARPCWT

SEQ ID NO: 846 - protein, 52 aa, Artificial Sequence
  source: /note="Description of Artificial Sequence: Synthetic polypeptide"
  source: /note="p.F2149L"
TRENTYVEYSIISGNSQNNFHVETKLLFHSEYPYKQVGYLVLLHSLDREASA

SEQ ID NO: 847 - protein, 52 aa, Artificial Sequence
  source: /note="Description of Artificial Sequence: Synthetic polypeptide"
  source: /note="p.S549Y"
HGLSIVHRDIKPENLLVCEYPDGTKYYLKLGDFGLATVVEGPLYTVCGTPTY

SEQ ID NO: 848 - protein, 52 aa, Artificial Sequence
  source: /note="Description of Artificial Sequence: Synthetic polypeptide"
  source: /note="p.F28I"
GVLIPHTPIAVDFWSLRRAGTARLFIILSHMHSDHTVGLSSTWARPLYCSPI

SEQ ID NO: 849 - protein, 47 aa, Artificial Sequence
  source: /note="Description of Artificial Sequence: Synthetic polypeptide"
  source: /note="p.R532Q"
LVVMGTLVALVGLFVLLAFLQYRRLQQKGYTPLMETHLSSKRYTEEA

SEQ ID NO: 850 - protein, 52 aa, Artificial Sequence
  source: /note="Description of Artificial Sequence: Synthetic polypeptide"
  source: /note="p.L275P"
EKDQRSLDINTAKCMLGLLLGKIWPPPFPVFHQFLEQSKYKVINKDQWCNVL

SEQ ID NO: 851 - protein, 122 aa, Artificial Sequence
  source: /note="Description of Artificial Sequence: Synthetic polypeptide"
  source: /note="p.I433fs"
LVCFRLKGSNKVNEALLQRINSAKKSTWFHVTSGTSLSCALPSVLARWNLPMCSGPGNTSKSWRPTCCEQRGSRSEASCRNQKLKRDISENWNKKQINIILPSWNSAVCGFPCLSPKLSRGL

SEQ ID NO: 852 - protein, 52 aa, Artificial Sequence
  source: /note="Description of Artificial Sequence: Synthetic polypeptide"
  source: /note="p.R275Q"
VNGHPLKAFVDSGAQMTIMSQACAEQQCNIMRLVDRRWAGVAKGVGTQRIIG

SEQ ID NO: 853 - protein, 52 aa, Artificial Sequence
  source: /note="Description of Artificial Sequence: Synthetic polypeptide"
  source: /note="p.A376T"
PYYGSRLAIPAAQLVVLPYQMLLHATTTRQAAGIRLQDQVVIIDEAHNLIDT

SEQ ID NO: 854 - protein, 42 aa, Artificial Sequence
  source: /note="Description of Artificial Sequence: Synthetic polypeptide"
  source: /note="p.K208fs"
AERLEQLESGEEELVLAEYESDEEKRWRAEWMRMRMTWRKNT

SEQ ID NO: 855 - protein, 28 aa, Artificial Sequence
  source: /note="Description of Artificial Sequence: Synthetic peptide"
  source: /note="p.*128Q"
CLFLSLEPPPPRDHISHCLLSAQFHQQK

SEQ ID NO: 856 - protein, 44 aa, Artificial Sequence
  source: /note="Description of Artificial Sequence: Synthetic polypeptide"
  source: /note="p.G163fs"
HPEVARLTPYEVDELRRKKEITVRGEMFVLNPCLPSIMLTSHNM

SEQ ID NO: 857 - protein, 33 aa, Artificial Sequence
  source: /note="Description of Artificial Sequence: Synthetic polypeptide"
  source: /note="p.F149fs"
LAFQISKEYERFSKYMPNVKVAVFFWWSVYQEG

SEQ ID NO: 858 - protein, 52 aa, Artificial Sequence
  source: /note="Description of Artificial Sequence: Synthetic polypeptide"
  source: /note="p.R329L"
FNQGFYDCVIATDAEVLGAPVKGKRLLGRGPKGDKASDPEAGVARGIDFHHV

SEQ ID NO: 859 - protein, 31 aa, Artificial Sequence
  source: /note="Description of Artificial Sequence: Synthetic polypeptide"
  source: /note="p.W90C"
DCYCRIPACIAGERRYGTCIYQGRLCCAFCC

SEQ ID NO: 860 - protein, 52 aa, Artificial Sequence
  source: /note="Description of Artificial Sequence: Synthetic polypeptide"
  source: /note="p.R499L"
GRKKRKIPKLVLRINAIYEVRRGKKLLVKRLSQSMESNSGKVTDENSESDSD

SEQ ID NO: 861 - protein, 52 aa, Artificial Sequence
  source: /note="Description of Artificial Sequence: Synthetic polypeptide"
  source: /note="p.R688Q"
EVYCIVSRLGCFSLFSRILDEVEKRQQGISPALVQPLMRSVMEAPFPALGKT

SEQ ID NO: 862 - protein, 52 aa, Artificial Sequence
  source: /note="Description of Artificial Sequence: Synthetic polypeptide"
  source: /note="p.P357H"
LYRYSISGPHVLPIEKHISHFMHKVHHFPSPQRPRILVQLSPHDNLILSQPV

SEQ ID NO: 863 - protein, 52 aa, Artificial Sequence
  source: /note="Description of Artificial Sequence: Synthetic polypeptide"
  source: /note="p.R1081Q"
ESEKSSPAVSRSKTFTGRFKQQTPSQQTHKERSTSLSALVRSSPHGSLGSVV

SEQ ID NO: 864 - protein, 52 aa, Artificial Sequence
  source: /note="Description of Artificial Sequence: Synthetic polypeptide"
  source: /note="p.G1023E"
GELGDTGVMQIPKNLLEMTFECQNLEEKLTTVQIGHDNSGLLAKWLVDCVMV

SEQ ID NO: 865 - protein, 52 aa, Artificial Sequence
  source: /note="Description of Artificial Sequence: Synthetic polypeptide"
  source: /note="p.E518K"
SVQDAPTKKEFVINPNGKSEVCILHKKYMQRVLKVRPVYNFFECENPSEPFG

SEQ ID NO: 866 - protein, 39 aa, Artificial Sequence
  source: /note="Description of Artificial Sequence: Synthetic polypeptide"
  source: /note="p.S13L"
MTNQEKWAHLSPLLEFSQLQKYAEYSTKKLKDVLEEFHG

SEQ ID NO: 867 - protein, 52 aa, Artificial Sequence
  source: /note="Description of Artificial Sequence: Synthetic polypeptide"
  source: /note="p.F49L"
LPPESTQVRGYDFNRGVNYRALLEALLGTTGFQATNFGRAVQQVNAMIEKKL

SEQ ID NO: 868 - protein, 52 aa, Artificial Sequence
  source: /note="Description of Artificial Sequence: Synthetic polypeptide"
  source: /note="p.I218T"
LGLNKTLAIELAPRNIRVNCLAPGLTTKTSFSRMLWMDKEKEESMKETLRIR

SEQ ID NO: 869 - protein, 52 aa, Artificial Sequence
  source: /note="Description of Artificial Sequence: Synthetic polypeptide"
  source: /note="p.R410Q"
DIGKLVGCAIIHVNGDSPEEVVRATQQLAFEYQRQFRKDVIIDLLCYRQWGH

SEQ ID NO: 870 - protein, 52 aa, Artificial Sequence
  source: /note="Description of Artificial Sequence: Synthetic polypeptide"
  source: /note="p.V40G"
RKMTPSYEIRAVGNKNRQKFMCEVQGGEGYNYTGMGNSTNKKDAQSNAARDF

SEQ ID NO: 871 - protein, 52 aa, Artificial Sequence
  source: /note="Description of Artificial Sequence: Synthetic polypeptide"
  source: /note="p.E121K"
ERSLNLSEKEVLDLFEKMMEDMNLNKKEKKAPLRNKDFTTKREMVVQYISAT

SEQ ID NO: 872 - protein, 52 aa, Artificial Sequence
  source: /note="Description of Artificial Sequence: Synthetic polypeptide"
  source: /note="p.E1705K"
KAYLLQAFTHASYHYNTITDCYQRLKKFLGDAILDYLITKHLYEDPRQHSPG

SEQ ID NO: 873 - protein, 52 aa, Artificial Sequence
  source: /note="Description of Artificial Sequence: Synthetic polypeptide"
  source: /note="p.G79C"
VCTLQITDTTGSHQFPAMQRLSISKCCHAFILVFSVTSKQSLEELGPIYKLI

SEQ ID NO: 874 - protein, 52 aa, Artificial Sequence
  source: /note="Description of Artificial Sequence: Synthetic polypeptide"
  source: /note="p.R780K"
CSGMDNDFHHYGLASPIYTHFTSPIKKRYADVIVHRLLAVAIGADCTYPELT

SEQ ID NO: 875 - protein, 53 aa, Artificial Sequence
  source: /note="Description of Artificial Sequence: Synthetic polypeptide"
  source: /note="p.G732L"
EKVLPCIVIKFRYLWLFWFLALTVGLLAYIVCINPKMKLPSLELSEFQVFRSS

SEQ ID NO: 876 - protein, 52 aa, Artificial Sequence
  source: /note="Description of Artificial Sequence: Synthetic polypeptide"
  source: /note="p.R763C"
INPKMKLPSLELSEFQVFRSSHPFECCYDAEYKKLFMFERVHHGEELHMPIT

SEQ ID NO: 877 - protein, 52 aa, Artificial Sequence
  source: /note="Description of Artificial Sequence: Synthetic polypeptide"
  source: /note="p.F1021S"
VAGTVLLTVGLLVLLEWQLNTAEALSSLSASVGLSVDFTVNYCISYHLCPHP

SEQ ID NO: 878 - protein, 52 aa, Artificial Sequence
  source: /note="Description of Artificial Sequence: Synthetic polypeptide"
  source: /note="p.R230H"
KPVLHQGEVCTKQRKKGSHGLEIFQHHCDCAKGLSCKVWKDATYSSKARLHV

SEQ ID NO: 879 - protein, 52 aa, Artificial Sequence
  source: /note="Description of Artificial Sequence: Synthetic polypeptide"
  source: /note="p.A350V"
LATQEPTDNQVRLRKRKEIREDRDRVVRLDSMVLLIMKLDQLDQDIENALST

SEQ ID NO: 880 - protein, 52 aa, Artificial Sequence
  source: /note="Description of Artificial Sequence: Synthetic polypeptide"
  source: /note="p.S741T"
ISALNGNRINVPMVRKRSVSNSTQTTTSSSSQSETSSAVSTPSPVTRTRSLS

SEQ ID NO: 881 - protein, 52 aa, Artificial Sequence
  source: /note="Description of Artificial Sequence: Synthetic polypeptide"
  source: /note="p.E222D"
ISLSEIKDAPKVNAVDTLNVKDIAPDDKQLLNSAVIAQQRRKPDPPKDENER

SEQ ID NO: 882 - protein, 52 aa, Artificial Sequence
  source: /note="Description of Artificial Sequence: Synthetic polypeptide"
  source: /note="p.A83V"
RARPGPGREERGGGVGTRSRRTAARVVNSPEEEVVRGAEGGAELLPFPRDRG

SEQ ID NO: 883 - protein, 52 aa, Artificial Sequence
  source: /note="Description of Artificial Sequence: Synthetic polypeptide"
  source: /note="p.S624L"
KRRVERKERARLKTVKFNAKPGVIDLLKGSFNDKRKKSFIFSRKFPFYKNKE

SEQ ID NO: 884 - protein, 115 aa, Artificial Sequence
  source: /note="Description of Artificial Sequence: Synthetic polypeptide"
  source: /note="p.G377fs"
GLLGPETKAKARTYHYLQVPQDDWGVTPPVARMGRSPAAGCGAAATSKPWGMRRAETQTAAPRHLPKQSPDASPPVAPPAWTRPGSTAVSHPGSTPGAPSLATAVPSPLDSSAMS

SEQ ID NO: 885 - protein, 52 aa, Artificial Sequence
  source: /note="Description of Artificial Sequence: Synthetic polypeptide"
  source: /note="p.D318H"
PRSFECTCPRGFYGLRCEVSGVTCAHHGPCFNGGLCVGGADPDSAYICHCPP

SEQ ID NO: 886 - protein, 52 aa, Artificial Sequence
  source: /note="Description of Artificial Sequence: Synthetic polypeptide"
  source: /note="p.R1521L"
SRASTAGSESTLALRLVNGGDRCRGLLVEVLYQGSWGTVCDDYWDTNDANVV

SEQ ID NO: 887 - protein, 52 aa, Artificial Sequence
  source: /note="Description of Artificial Sequence: Synthetic polypeptide"
  source: /note="p.K1772N"
DHCRKLVEPQISELNHRFAAISHRINNTGKASIPLKELEQFNSDIQKLLEPL

SEQ ID NO: 888 - protein, 52 aa, Artificial Sequence
  source: /note="Description of Artificial Sequence: Synthetic polypeptide"
  source: /note="p.R3195H"
NVPLCVDMCLNWLLNVYDTGRTGRIHHVLSFKTGIISLCKAHLEDKYRYLFK

SEQ ID NO: 889 - protein, 52 aa, Artificial Sequence
  source: /note="Description of Artificial Sequence: Synthetic polypeptide"
  source: /note="p.R44H"
AGVGPGLPGAGAPARPSPGRPPGAGHHLRTGPGQVRGRLLAVGPKSRVFQSV

SEQ ID NO: 890 - protein, 52 aa, Artificial Sequence
  source: /note="Description of Artificial Sequence: Synthetic polypeptide"
  source: /note="p.S45T"
PGVPPQGRAGGFGKASGALVGAASGTTSAGGSSRGGGSGSGASDLGAGSKKS

SEQ ID NO: 891 - protein, 52 aa, Artificial Sequence
  source: /note="Description of Artificial Sequence: Synthetic polypeptide"
  source: /note="p.T106S"
RGGPQPRPPLAPQASPAGTGPRERCSSPAGGGAEPRKLSRTPKCARCRNHGV

SEQ ID NO: 892 - protein, 52 aa, Artificial Sequence
  source: /note="Description of Artificial Sequence: Synthetic polypeptide"
  source: /note="p.D2412E"
GGGVKLVVKPRRQSENISAPPVLSEEEIDKHRRRFNMRMLVPGRPVKDATPP

SEQ ID NO: 893 - protein, 52 aa, Artificial Sequence
  source: /note="Description of Artificial Sequence: Synthetic polypeptide"
  source: /note="p.C1853F"
GAPAGPAGTGKTETTKDLAKALGLLFFVVTNCGEGMDYRAVGKIFSGLAQCG

SEQ ID NO: 894 - protein, 52 aa, Artificial Sequence
  source: /note="Description of Artificial Sequence: Synthetic polypeptide"
  source: /note="p.R1888Q"
DYRAVGKIFSGLAQCGAWGCFDEFNQQIDASVLSVISSQIQTIRNALIHQLT

SEQ ID NO: 895 - protein, 52 aa, Artificial Sequence
  source: /note="Description of Artificial Sequence: Synthetic polypeptide"
  source: /note="p.R1367C"
QDIGPPAVKMLISAEGEGLVLPKKICCVRSAVEQWLVNVEKSMFDVLKKERY

SEQ ID NO: 896 - protein, 52 aa, Artificial Sequence
  source: /note="Description of Artificial Sequence: Synthetic polypeptide"
  source: /note="p.E3367Q"
LNLRIKYIIDHFTLSIYNNVCRSLFQQKDKLLFSLLLTIGIMKQKKEITEEV

SEQ ID NO: 897 - protein, 52 aa, Artificial Sequence
  source: /note="Description of Artificial Sequence: Synthetic polypeptide"
  source: /note="p.R3822L"
QKLEISAETEVQINSAREEYRPVATLLGSILYFLITEMRLVNEMYQTSLRQF

SEQ ID NO: 898 - protein, 52 aa, Artificial Sequence
  source: /note="Description of Artificial Sequence: Synthetic polypeptide"
  source: /note="p.R742Q"
LFRETECMAQMGLEVSPLATSLFQKQQDRYKRNFSNMKMMLAEYQRVKSKIP

SEQ ID NO: 899 - protein, 52 aa, Artificial Sequence
  source: /note="Description of Artificial Sequence: Synthetic polypeptide"
  source: /note="p.R982H"
ELLSHFNHQNMDALLKVTRNTLEAIHHKRIHSSHTINFRDSNSASNMKQNSL

SEQ ID NO: 900 - protein, 52 aa, Artificial Sequence
  source: /note="Description of Artificial Sequence: Synthetic polypeptide"
  source: /note="p.Q1797E"
TIELDKPVMAEGNVEVWLNSLLEESEESSLHLVIRQAAANIQETGFQLTEFL

SEQ ID NO: 901 - protein, 52 aa, Artificial Sequence
  source: /note="Description of Artificial Sequence: Synthetic polypeptide"
  source: /note="p.R224Q"
FLSSLEGFVNVLSGAQESLKEKVNLQQKCDILELKTLKEPTDYLTLANNPET

SEQ ID NO: 902 - protein, 52 aa, Artificial Sequence
  source: /note="Description of Artificial Sequence: Synthetic polypeptide"
  source: /note="p.R3197Q"
HVTPKSYLSFIQGYKFIYGEKHVEVQQTLANRMNTGLEKLKEASESVAALSK

SEQ ID NO: 903 - protein, 52 aa, Artificial Sequence
  source: /note="Description of Artificial Sequence: Synthetic polypeptide"
  source: /note="p.D3236N"
KEASESVAALSKELEAKEKELQVANNNKADMVLKEVTMKAQAAEKVKAEVQK

SEQ ID NO: 904 - protein, 52 aa, Artificial Sequence
  source: /note="Description of Artificial Sequence: Synthetic polypeptide"
  source: /note="p.R2961Q"
LCKGRDIPCSDDCSLMGTLGEAVTIQQTWNIAGLPSDSFSIDNGIIIMNARR

SEQ ID NO: 905 - protein, 52 aa, Artificial Sequence
  source: /note="Description of Artificial Sequence: Synthetic polypeptide"
  source: /note="p.D1547N"
LESIFTGSEDIRAQLPQDSKRFEGINNIDFKELAYDAQKIPNVVQTTNKPGL

SEQ ID NO: 906 - protein, 52 aa, Artificial Sequence
  source: /note="Description of Artificial Sequence: Synthetic polypeptide"
  source: /note="p.S2993R"
KFPAIVNCTAIHWFHEWPQQALESVRRLRFLQNTEGIEPTVKQSISKFMAFV

SEQ ID NO: 907 - protein, 52 aa, Artificial Sequence
  source: /note="Description of Artificial Sequence: Synthetic polypeptide"
  source: /note="p.V231L"
PNKPELALKPSSPLVTLEFNPKDSHLLLLGGCYNGQIACWDTRKGSLVAELS

SEQ ID NO: 908 - protein, 46 aa, Artificial Sequence
  source: /note="Description of Artificial Sequence: Synthetic polypeptide"
  source: /note="p.K193fs"
AVVWSIYLEKQLDELLSRKKREKKKRLAARVWMYQNSVLQKKMKDC

SEQ ID NO: 909 - protein, 52 aa, Artificial Sequence
  source: /note="Description of Artificial Sequence: Synthetic polypeptide"
  source: /note="p.I80K"
FKKLALKLHPDKNPNNPNAHGDFLKKKNRAYEVLKDEDLRKKYDKYGEKGLE

SEQ ID NO: 910 - protein, 52 aa, Artificial Sequence
  source: /note="Description of Artificial Sequence: Synthetic polypeptide"
  source: /note="p.R135K"
DLMLEESDKTHTTKMENEECNEQREKKKKEELASTAEKTEQKEPKPLEKSVS

SEQ ID NO: 911 - protein, 52 aa, Artificial Sequence
  source: /note="Description of Artificial Sequence: Synthetic polypeptide"
  source: /note="p.E1248K"
TPRLQSNTRALYQYCPIPIINYPQLKKNELFCNIYYLKQLCDTLRFPDWPIK

SEQ ID NO: 912 - protein, 52 aa, Artificial Sequence
  source: /note="Description of Artificial Sequence: Synthetic polypeptide"
  source: /note="p.E61K"
LMYHPDKQSTDVPAGTVEECVQKFIKKIDQAWKILGNEETKREYDLQRCEDD

SEQ ID NO: 913 - protein, 52 aa, Artificial Sequence
  source: /note="Description of Artificial Sequence: Synthetic polypeptide"
  source: /note="p.D212N"
CASLTKKRLDKLELRTEPGFHWVIANNGEDTTVRASTHCTYDRVVLHGERCR

SEQ ID NO: 914 - protein, 52 aa, Artificial Sequence
  source: /note="Description of Artificial Sequence: Synthetic polypeptide"
  source: /note="p.E378D"
TLELSGGARINRIFHERFPFELVKMDDFDEKDLRREISYAIKNIHGVRTGLF

SEQ ID NO: 915 - protein, 55 aa, Artificial Sequence
  source: /note="Description of Artificial Sequence: Synthetic polypeptide"
  source: /note="p.P791fs"
QRRPVSSIHPPGRPPAVRGPTPGPPPDSCSRGGSSLLLGAPNPIPAWTPERVCQQ

SEQ ID NO: 916 - protein, 52 aa, Artificial Sequence
  source: /note="Description of Artificial Sequence: Synthetic polypeptide"
  source: /note="p.T78P"
SSFVEIVTIPSLKEGERLFVCICEFPPSQELDNLPLHRGDLVILDGIPTAGW

SEQ ID NO: 917 - protein, 52 aa, Artificial Sequence
  source: /note="Description of Artificial Sequence: Synthetic polypeptide"
  source: /note="p.E432K"
LTCFSVYCKHGHLCPIDTGLIEKNIKKLFFSGSAKPIYDDDPSLEGGVNGKN

SEQ ID NO: 918 - protein, 52 aa, Artificial Sequence
  source: /note="Description of Artificial Sequence: Synthetic polypeptide"
  source: /note="p.E51K"
RRLKDLERDSLTEKECVKEKLNLLHKKFLQTEIKNQLCDLETKLRKEELSEE

SEQ ID NO: 919 - protein, 52 aa, Artificial Sequence
  source: /note="Description of Artificial Sequence: Synthetic polypeptide"
  source: /note="p.R995Q"
PEHYRKYSDYIKGSNLDAPEPYRIGQQIKEIFCPKKSNGRPNETDIKIRVNK

SEQ ID NO: 920 - protein, 52 aa, Artificial Sequence
  source: /note="Description of Artificial Sequence: Synthetic polypeptide"
  source: /note="p.E1531Q"
RHNHWAGLYGRLEWDGFFSTTVTNPQQPMGKQGRVLHPEQHRVVSVRECARS

SEQ ID NO: 921 - protein, 52 aa, Artificial Sequence
  source: /note="Description of Artificial Sequence: Synthetic polypeptide"
  source: /note="p.R736H"
NDLSIVNPARKGLYEGTGRLFFEFYHHLLHDARPKEGDDRPFFWLFENVVAM

SEQ ID NO: 922 - protein, 52 aa, Artificial Sequence
  source: /note="Description of Artificial Sequence: Synthetic polypeptide"
  source: /note="p.R882C"
DILWCTEMERVFGFPVHYTDVSNMSCCLARQRLLGRSWSVPVIRHLFAPLKE

SEQ ID NO: 923 - protein, 52 aa, Artificial Sequence
  source: /note="Description of Artificial Sequence: Synthetic polypeptide"
  source: /note="p.R882H"
DILWCTEMERVFGFPVHYTDVSNMSHHLARQRLLGRSWSVPVIRHLFAPLKE

SEQ ID NO: 924 - protein, 52 aa, Artificial Sequence
  source: /note="Description of Artificial Sequence: Synthetic polypeptide"
  source: /note="p.R92W"
TQDLTGDGDGEDGDGSDTPVMPKLFWWETRTRSESPAVRTRNNNSVSSRERH

SEQ ID NO: 925 - protein, 52 aa, Artificial Sequence
  source: /note="Description of Artificial Sequence: Synthetic polypeptide"
  source: /note="p.E864K"
SKMFTEFILNVPMGLLTIQKLYCLIKKIVHSDLFTQHDCREILLPMMTDQLK

SEQ ID NO: 926 - protein, 52 aa, Artificial Sequence
  source: /note="Description of Artificial Sequence: Synthetic polypeptide"
  source: /note="p.A1830V"
NENILVEQLYMCVEFLWKSERYELIVVDVNKPIIAVFEKQRDFKKLSDLYYD

SEQ ID NO: 927 - protein, 52 aa, Artificial Sequence
  source: /note="Description of Artificial Sequence: Synthetic polypeptide"
  source: /note="p.Q169E"
FEIDEDCEKDEDSSSLCSQKGGVIKEEGWLHKANVNSTITVTMKVFKRRYFY

SEQ ID NO: 928 - protein, 52 aa, Artificial Sequence
  source: /note="Description of Artificial Sequence: Synthetic polypeptide"
  source: /note="p.R1183C"
ELFSLLTQLFGPYPSLLEKVEQETWCCETGISFVTSVTRLMERLLDYRDCMK

SEQ ID NO: 929 - protein, 52 aa, Artificial Sequence
  source: /note="Description of Artificial Sequence: Synthetic polypeptide"
  source: /note="p.E177K"
IDHGNRMLGLDLVVRDDNGNILDPDKKTSTIALFKAHEVASKRIEEKIQEEK

SEQ ID NO: 930 - protein, 26 aa, Artificial Sequence
  source: /note="Description of Artificial Sequence: Synthetic peptide"
  source: /note="p.L1111fs"
TLISMRLEFLRILCSHEHYLNLNLFL

SEQ ID NO: 931 - protein, 43 aa, Artificial Sequence
  source: /note="Description of Artificial Sequence: Synthetic polypeptide"
  source: /note="p.A177fs"
HKTLPKQTFESETLECSEPAAQAGPPPLKRAVRRVWERPRHCL

SEQ ID NO: 932 - protein, 52 aa, Artificial Sequence
  source: /note="Description of Artificial Sequence: Synthetic polypeptide"
  source: /note="p.R274W"
KMSERAASLSTMVPLPRSAYWQHITWWQHSTGQLYRLQDVSSPLKLHRTETF

SEQ ID NO: 933 - protein, 52 aa, Artificial Sequence
  source: /note="Description of Artificial Sequence: Synthetic polypeptide"
  source: /note="p.G461D"
GQTSAGCPSGWLGTRRRGLVMEAPQDDSEATLPGPAPGEPWEAGGPHAGPPP

SEQ ID NO: 934 - protein, 52 aa, Artificial Sequence
  source: /note="Description of Artificial Sequence: Synthetic polypeptide"
  source: /note="p.E1196K"
KAGAKLSLVRVDSDKTQASESFSSDKKEADLELQALTTSRLLKQQRERQEAV

SEQ ID NO: 935 - protein, 52 aa, Artificial Sequence
  source: /note="Description of Artificial Sequence: Synthetic polypeptide"
  source: /note="p.Y2048S"
FEQKAMLLKRQAFAVFSGELDQYHLSSLPLIQERLTDNLRVGQTSIVAAQMF

SEQ ID NO: 936 - protein, 53 aa, Artificial Sequence
  source: /note="Description of Artificial Sequence: Synthetic polypeptide"
  source: /note="p.L768del"
NRERTANENTTPSPAQPTENGDRTPANEKTTPSLAEPTENGKRTPFANEKTTS

SEQ ID NO: 937 - protein, 37 aa, Artificial Sequence
  source: /note="Description of Artificial Sequence: Synthetic polypeptide"
  source: /note="p.V11L"
MWSGWWLWPLLLAVCTADFFRDEAERIMRDSPVIDGH

SEQ ID NO: 938 - protein, 52 aa, Artificial Sequence
  source: /note="Description of Artificial Sequence: Synthetic polypeptide"
  source: /note="p.V183I"
TASYVIYNIHTREVWELNPPEVEDSIILQYAAWGVQGQQLIYIFENNIYYQP

SEQ ID NO: 939 - protein, 52 aa, Artificial Sequence
  source: /note="Description of Artificial Sequence: Synthetic polypeptide"
  source: /note="p.L757F"
TFTCGSALSPITDFKLYASAFSERYFFGLHGLDNRAYEMTKVAHRVSALEEQ

SEQ ID NO: 940 - protein, 52 aa, Artificial Sequence
  source: /note="Description of Artificial Sequence: Synthetic polypeptide"
  source: /note="p.G165R"
QATLDYGMYSREEELLRERKRIGTVRRIASYDYHQGSGTFLFQAGSGIYHVK

SEQ ID NO: 941 - protein, 52 aa, Artificial Sequence
  source: /note="Description of Artificial Sequence: Synthetic polypeptide"
  source: /note="p.F378L"
ILKYLTSKIFGIADDAHIGNLLTSKLLFSYKDFDTLLYTCAAEFDFMEKETP

SEQ ID NO: 942 - protein, 52 aa, Artificial Sequence
  source: /note="Description of Artificial Sequence: Synthetic polypeptide"
  source: /note="p.V249L"
MLLVTHILRATKLYRGSLIALCISNLLFFMLPWQFAQFVLLTQIASLFAVYV

SEQ ID NO: 943 - protein, 52 aa, Artificial Sequence
  source: /note="Description of Artificial Sequence: Synthetic polypeptide"
  source: /note="p.M210V"
INAIKRFHLYPEVIIASWYCTFMGIVVNLFGLETKTCWNVTRIEPLNEVQSC

SEQ ID NO: 944 - protein, 52 aa, Artificial Sequence
  source: /note="Description of Artificial Sequence: Synthetic polypeptide"
  source: /note="p.R505H"
ASCEFDCVDEMLTLAAMLTAAPGFTHHPPLSAEEAALRRALEHTDGDHSSLI

SEQ ID NO: 945 - protein, 52 aa, Artificial Sequence
  source: /note="Description of Artificial Sequence: Synthetic polypeptide"
  source: /note="p.S275R"
RIAQVQIRRISSLERAAEHAQSCRSRRAACAPDTSLRASIKKETKVLKTLSV

SEQ ID NO: 946 - protein, 52 aa, Artificial Sequence
  source: /note="Description of Artificial Sequence: Synthetic polypeptide"
  source: /note="p.R128L"
NPRTGEINITSVVDREITPLFLIYCLLALNSRGEDLERPLELRVKVMDINDN

SEQ ID NO: 947 - protein, 52 aa, Artificial Sequence
  source: /note="Description of Artificial Sequence: Synthetic polypeptide"
  source: /note="p.R160G"
CDAYQKRLLQLQEQMRALYKAISVPGGVRRASSKGGGGYTCQSGSGWDEFTK

SEQ ID NO: 948 - protein, 52 aa, Artificial Sequence
  source: /note="Description of Artificial Sequence: Synthetic polypeptide"
  source: /note="p.A4410S"
TICGKSVERQNKLEEALLFSGQFTDSSLQALIDWLYRVEPQLAEDQPVHGDI

SEQ ID NO: 949 - protein, 52 aa, Artificial Sequence
  source: /note="Description of Artificial Sequence: Synthetic polypeptide"
  source: /note="p.S1767Y"
ITLTRSLSVQDGLDEMLDWMGNVESYYLKEQGQVPLNSTALQDIISKNIMLE

SEQ ID NO: 950 - protein, 36 aa, Artificial Sequence
  source: /note="Description of Artificial Sequence: Synthetic polypeptide"
  source: /note="p.F101fs"
KDCRYALYDASFETKESRKEELMFFFVGTRTSTSEK

SEQ ID NO: 951 - protein, 52 aa, Artificial Sequence
  source: /note="Description of Artificial Sequence: Synthetic polypeptide"
  source: /note="p.F880L"
SPEDKSRLMFTMYDLDENGFLSKDELLFTMMRSFIEISNNCLSKAQLAEVVE

SEQ ID NO: 952 - protein, 104 aa, Artificial Sequence
  source: /note="Description of Artificial Sequence: Synthetic polypeptide"
  source: /note="p.A601fs"
YGGGSASSQHSEGSRSSGSTRSDGGQGARGGPRSGPPSPSPAVAVSLSPPAEGAAFGGVGKQVGLAMGALLHPEAQLGVPLISEPTQGSIPMDRPLAWPSPTTP

SEQ ID NO: 953 - protein, 52 aa, Artificial Sequence
  source: /note="Description of Artificial Sequence: Synthetic polypeptide"
  source: /note="p.V66G"
GDFKSVLQRPAGAKYFFKSMDQDFGGGVKEEISDDNARLPCFNGRVVSWLVS

SEQ ID NO: 954 - protein, 52 aa, Artificial Sequence
  source: /note="Description of Artificial Sequence: Synthetic polypeptide"
  source: /note="p.E883D"
KEWIVIGQVDMEALVEKHLFTVHDWDDKNFKALKIKGKEVERLPSAVKVDCL

SEQ ID NO: 955 - protein, 43 aa, Artificial Sequence
  source: /note="Description of Artificial Sequence: Synthetic polypeptide"
  source: /note="p.Q545fs"
DVPHKTHQAPASASSLPGTGAQLPPSPDTLVVPHHQPHHHPRS

SEQ ID NO: 956 - protein, 36 aa, Artificial Sequence
  source: /note="Description of Artificial Sequence: Synthetic polypeptide"
  source: /note="p.K468fs"
TASRRQTFFDSKGFPKNITNNRGKKDTQIPRTSRWC

SEQ ID NO: 957 - protein, 52 aa, Artificial Sequence
  source: /note="Description of Artificial Sequence: Synthetic polypeptide"
  source: /note="p.M322L"
NLKYPGENDQSFSGKKCLKEGCTGDLLVRMLQCDVPGIVKILFEVVRKDEYI

SEQ ID NO: 958 - protein, 52 aa, Artificial Sequence
  source: /note="Description of Artificial Sequence: Synthetic polypeptide"
  source: /note="p.I91S"
PITPVKFVDRQQAEPWTPTANLKMLSSSAASPDIRDREKKKGLFRPIENKDD

SEQ ID NO: 959 - protein, 54 aa, Artificial Sequence
  source: /note="Description of Artificial Sequence: Synthetic polypeptide"
  source: /note="p.V109fs"
CILIINHDTGECRLEKLSSNITVKKQELKEAVKFSIVKNNSNNKCGIQPGLPIL

SEQ ID NO: 960 - protein, 52 aa, Artificial Sequence
  source: /note="Description of Artificial Sequence: Synthetic polypeptide"
  source: /note="p.E187K"
EEDAAWQAEEVLRQQKLADREKRAAKKQQRKKMEKEAQRLMKKEQNKIGVKL

SEQ ID NO: 961 - protein, 52 aa, Artificial Sequence
  source: /note="Description of Artificial Sequence: Synthetic polypeptide"
  source: /note="p.D353G"
SYKSKQFCKGTPGRFIYTALNEPTIGGYGFQRLQKVIPRHPGDPERLPKEVI

SEQ ID NO: 962 - protein, 44 aa, Artificial Sequence
  source: /note="Description of Artificial Sequence: Synthetic polypeptide"
  source: /note="p.L189V"
YCWLYLFFFNGVWVLIPGLLLWQSWVVELKKMHQKETSSVKKFQ

SEQ ID NO: 963 - protein, 37 aa, Artificial Sequence
  source: /note="Description of Artificial Sequence: Synthetic polypeptide"
  source: /note="p.Q196P"
FFNGVWVLIPGLLLWQSWLELKKMHPPKETSSVKKFQ

SEQ ID NO: 964 - protein, 52 aa, Artificial Sequence
  source: /note="Description of Artificial Sequence: Synthetic polypeptide"
  source: /note="p.D254N"
DRGVSPCEDFYQFSCGGWIRRNPLPNNGRSRWNTFNSLWDQNQAILKHLLEN

SEQ ID NO: 965 - protein, 52 aa, Artificial Sequence
  source: /note="Description of Artificial Sequence: Synthetic polypeptide"
  source: /note="p.K55R"
HMNRTAMRASQKDFENSMNQVKLLKRRDPGNEVKLKLYALYKQATEGPCNMP

SEQ ID NO: 966 - protein, 52 aa, Artificial Sequence
  source: /note="Description of Artificial Sequence: Synthetic polypeptide"
  source: /note="p.E266K"
EIGYSRCCHCRSHTNRLECAKLVWEKKAMSRFCEAEFSVKTRPHWCCTRQGE

SEQ ID NO: 967 - protein, 52 aa, Artificial Sequence
  source: /note="Description of Artificial Sequence: Synthetic polypeptide"
  source: /note="p.L58F"
RAGEGNSCLLFLGFFGLSLALHLLTFFCCYLELRSELRRERGAESRLGGSGT

SEQ ID NO: 968 - protein, 52 aa, Artificial Sequence
  source: /note="Description of Artificial Sequence: Synthetic polypeptide"
  source: /note="p.L450R"
SRILKLTLYNQNDPNRCELLSFLLVRWDYIGINMASLNSCINPIALYLVSKR

SEQ ID NO: 969 - protein, 32 aa, Artificial Sequence
  source: /note="Description of Artificial Sequence: Synthetic polypeptide"
  source: /note="p.N570fs"
EREDLYAKIQAGEGETAVLNQLQEKTIHYRSK

SEQ ID NO: 970 - protein, 53 aa, Artificial Sequence
  source: /note="Description of Artificial Sequence: Synthetic polypeptide"
  source: /note="p.T432L"
GKPMCVESFSDYPPLGRFAVRDMRQLLVAVGVIKAVDKKAAGAGKVTKSAQKA

SEQ ID NO: 971 - protein, 52 aa, Artificial Sequence
  source: /note="Description of Artificial Sequence: Synthetic polypeptide"
  source: /note="p.Y418S"
SLKSGDAAIVEMVPGKPMCVESFSQSSPPLGRFAVRDMRQTVAVGVIKNVEK

SEQ ID NO: 972 - protein, 52 aa, Artificial Sequence
  source: /note="Description of Artificial Sequence: Synthetic polypeptide"
  source: /note="p.S43G"
YLADKSYIEGYVPSQADVAVFEAVSGGPPPADLCHALRWYNHIKSYEKEKAS

SEQ ID NO: 973 - protein, 52 aa, Artificial Sequence
  source: /note="Description of Artificial Sequence: Synthetic polypeptide"
  source: /note="p.E673K"
TDCDEGGEYDGMQDEPRYMMLAREAKKMLFTGGYGLEKDPQRSGDLYTQAAE

SEQ ID NO: 974 - protein, 52 aa, Artificial Sequence
  source: /note="Description of Artificial Sequence: Synthetic polypeptide"
  source: /note="p.E265Q"
MEQQIKSEKEQFLLKDTERFQARSQQQLEQKLLCKEQELEQLTQKQKRLEGQ

SEQ ID NO: 975 - protein, 52 aa, Artificial Sequence
  source: /note="Description of Artificial Sequence: Synthetic polypeptide"
  source: /note="p.R379K"
NWKQFLTSFHEPQGLQVSSKGPLTKKKNSINSRNESHKENIITKLFRHTEDH

SEQ ID NO: 976 - protein, 52 aa, Artificial Sequence
  source: /note="Description of Artificial Sequence: Synthetic polypeptide"
  source: /note="p.E1002K"
DQSKTNYISICKMQEVLEECGCSLTKKGELTHLLNSWGVSRHDNAINYLDFL

SEQ ID NO: 977 - protein, 52 aa, Artificial Sequence
  source: /note="Description of Artificial Sequence: Synthetic polypeptide"
  source: /note="p.P596S"
CTGRGPDNCIQCAHYIDGPHCVKTCSSAGVMGENNTLVWKYADAGHVCHLCH

SEQ ID NO: 978 - protein, 52 aa, Artificial Sequence
  source: /note="Description of Artificial Sequence: Synthetic polypeptide"
  source: /note="p.P596L"
CTGRGPDNCIQCAHYIDGPHCVKTCLLAGVMGENNTLVWKYADAGHVCHLCH

SEQ ID NO: 979 - protein, 52 aa, Artificial Sequence
  source: /note="Description of Artificial Sequence: Synthetic polypeptide"
  source: /note="p.G598A"
GRGPDNCIQCAHYIDGPHCVKTCPAAAVMGENNTLVWKYADAGHVCHLCHPN

SEQ ID NO: 980 - protein, 52 aa, Artificial Sequence
  source: /note="Description of Artificial Sequence: Synthetic polypeptide"
  source: /note="p.G598V"
GRGPDNCIQCAHYIDGPHCVKTCPAVVVMGENNTLVWKYADAGHVCHLCHPN

SEQ ID NO: 981 - protein, 52 aa, Artificial Sequence
  source: /note="Description of Artificial Sequence: Synthetic polypeptide"
  source: /note="p.L62R"
KLTQLGTFEDHFLSLQRMFNNCEVVRRGNLEITYVQRNYDLSFLKTIQEVAG

SEQ ID NO: 982 - protein, 52 aa, Artificial Sequence
  source: /note="Description of Artificial Sequence: Synthetic polypeptide"
  source: /note="p.E709K"
QERELVEPLTPSGEAPNQALLRILKKKTEFKKIKVLGSGAFGTVYKGLWIPE

SEQ ID NO: 983 - protein, 52 aa, Artificial Sequence
  source: /note="Description of Artificial Sequence: Synthetic polypeptide"
  source: /note="p.G719A"
PSGEAPNQALLRILKETEFKKIKVLAASGAFGTVYKGLWIPEGEKVKIPVAI

SEQ ID NO: 984 - protein, 65 aa, Artificial Sequence
  source: /note="Description of Artificial Sequence: Synthetic polypeptide"
  source: /note="p.ELREA746del"
GAFGTVYKGLWIPEGEKVKIPVAIKTSPKANKEILDEAYVMASVDNPHVCRLLGICLTSTVQLIT

SEQ ID NO: 985 - protein, 52 aa, Artificial Sequence
  source: /note="Description of Artificial Sequence: Synthetic polypeptide"
  source: /note="p.S768I"
AIKELREATSPKANKEILDEAYVMAIIVDNPHVCRLLGICLTSTVQLITQLM

SEQ ID NO: 986 - protein, 52 aa, Artificial Sequence
  source: /note="Description of Artificial Sequence: Synthetic polypeptide"
  source: /note="p.L838M"
YLLNWCVQIAKGMNYLEDRRLVHRDMMAARNVLVKTPQHVKITDFGLAKLLG

SEQ ID NO: 987 - protein, 52 aa, Artificial Sequence
  source: /note="Description of Artificial Sequence: Synthetic polypeptide"
  source: /note="p.L858R"
LVHRDLAARNVLVKTPQHVKITDFGRRAKLLGAEEKEYHAEGGKVPIKWMAL

SEQ ID NO: 988 - protein, 52 aa, Artificial Sequence
  source: /note="Description of Artificial Sequence: Synthetic polypeptide"
  source: /note="p.L861Q"
RDLAARNVLVKTPQHVKITDFGLAKQQLGAEEKEYHAEGGKVPIKWMALESI

SEQ ID NO: 989 - protein, 52 aa, Artificial Sequence
  source: /note="Description of Artificial Sequence: Synthetic polypeptide"
  source: /note="p.R108K"
QEVAGYVLIALNTVERIPLENLQIIKKGNMYYENSYALAVLSNYDANKTGLK

SEQ ID NO: 990 - protein, 52 aa, Artificial Sequence
  source: /note="Description of Artificial Sequence: Synthetic polypeptide"
  source: /note="p.R252C"
SPSDCCHNQCAAGCTGPRESDCLVCCCKFRDEATCKDTCPPLMLYNPTTYQM

SEQ ID NO: 991 - protein, 52 aa, Artificial Sequence
  source: /note="Description of Artificial Sequence: Synthetic polypeptide"
  source: /note="p.A289T"
CPPLMLYNPTTYQMDVNPEGKYSFGTTTCVKKCPRNYVVTDHGSCVRACGAD

SEQ ID NO: 992 - protein, 52 aa, Artificial Sequence
  source: /note="Description of Artificial Sequence: Synthetic polypeptide"
  source: /note="p.A289D"
CPPLMLYNPTTYQMDVNPEGKYSFGDDTCVKKCPRNYVVTDHGSCVRACGAD

SEQ ID NO: 993 - protein, 52 aa, Artificial Sequence
  source: /note="Description of Artificial Sequence: Synthetic polypeptide"
  source: /note="p.A289V"
CPPLMLYNPTTYQMDVNPEGKYSFGVVTCVKKCPRNYVVTDHGSCVRACGAD

SEQ ID NO: 994 - protein, 52 aa, Artificial Sequence
  source: /note="Description of Artificial Sequence: Synthetic polypeptide"
  source: /note="p.H304Y"
VNPEGKYSFGATCVKKCPRNYVVTDYYGSCVRACGADSYEMEEDGVRKCKKC

SEQ ID NO: 995 - protein, 35 aa, Artificial Sequence
  source: /note="Description of Artificial Sequence: Synthetic polypeptide"
  source: /note="p.Q9H"
MAAAKAEMHHLMSPLQISDPFGSFPHSPTMDNYPK

SEQ ID NO: 996 - protein, 222 aa, Artificial Sequence
  source: /note="Description of Artificial Sequence: Synthetic polypeptide"
  source: /note="p.P332fs"
TSYQSQLIKPSRMRKYPNRPSKTPPTNALTLAQWSPVIAASPAPTSSPATSASTQARSPSSAASACATSAAATTSPPTSAPTQAKSPSPATSVEESLPGAMNARGIPRSTCGRRTRKQTKVLWPLRPPPLSLPTRPRLLPLTRPRLLPLIHPRPPPHTHPLCPPPSPLPAPRPTHPLCTVASPPRRWPPRTPLFPLLSRPRSAASLPQLSPTPSAPPQGFRT

SEQ ID NO: 997 - protein, 52 aa, Artificial Sequence
  source: /note="Description of Artificial Sequence: Synthetic polypeptide"
  source: /note="p.E369K"
SKTPVHERPYPCPAEGCDRRFSRSDKKLTRHIRIHTGHKPFQCRICMRNFSR

SEQ ID NO: 998 - protein, 52 aa, Artificial Sequence
  source: /note="Description of Artificial Sequence: Synthetic polypeptide"
  source: /note="p.R390H"
SRSDELTRHIRIHTGHKPFQCRICMHHNFSRSDHLTTHIRTHTGEKPFACDY

SEQ ID NO: 999 - protein, 52 aa, Artificial Sequence
  source: /note="Description of Artificial Sequence: Synthetic polypeptide"
  source: /note="p.H397N"
RHIRIHTGHKPFQCRICMRNFSRSDNNLTTHIRTHTGEKPFACDYCGRKFAR

SEQ ID NO: 1000 - protein, 52 aa, Artificial Sequence
  source: /note="Description of Artificial Sequence: Synthetic polypeptide"
  source: /note="p.E44K"
QTVSEGLKKLYKSKLLPLEEHYRFHKKFHSPALEDADFDNKPMVLLVGQYST

SEQ ID NO: 1001 - protein, 46 aa, Artificial Sequence
  source: /note="Description of Artificial Sequence: Synthetic polypeptide"
  source: /note="p.Q704H"
LQKYYRQNPDIPQLEPSDYLKKLASHHGNPPLKEWQSLAGSPSSKL

SEQ ID NO: 1002 - protein, 35 aa, Artificial Sequence
  source: /note="Description of Artificial Sequence: Synthetic polypeptide"
  source: /note="p.G9D"
MPKNKGKGDDKNRRRGKNENESEKRELVFKEDGQE

SEQ ID NO: 1003 - protein, 52 aa, Artificial Sequence
  source: /note="Description of Artificial Sequence: Synthetic polypeptide"
  source: /note="p.R139Q"
EVTIPGEGKDRIFKVSIKWLAIVSWQQMLHEALVSGQIPVPLESVQALDVAM

SEQ ID NO: 1004 - protein, 34 aa, Artificial Sequence
  source: /note="Description of Artificial Sequence: Synthetic polypeptide"
  source: /note="p.A8G"
MAAAAAAGGGDSDSWDADAFSVEDPVRKVGGGGT

SEQ ID NO: 1005 - protein, 34 aa, Artificial Sequence
  source: /note="Description of Artificial Sequence: Synthetic polypeptide"
  source: /note="p.R8H"
MNSQPQTHHSPFFQRPQIQPPRATIPNSSPSIRP

SEQ ID NO: 1006 - protein, 52 aa, Artificial Sequence
  source: /note="Description of Artificial Sequence: Synthetic polypeptide"
  source: /note="p.L263F"
RLDNLLNMAYGVKRFSPMTIDGMTSFFAGINIPGHPGTGWCIFVYNLAPDAD

SEQ ID NO: 1007 - protein, 43 aa, Artificial Sequence
  source: /note="Description of Artificial Sequence: Synthetic polypeptide"
  source: /note="p.F305fs"
DILIHPELNEGLMKWENRHEGVFKFCAPRLWPNYGAKRKRTAT

SEQ ID NO: 1008 - protein, 52 aa, Artificial Sequence
  source: /note="Description of Artificial Sequence: Synthetic polypeptide"
  source: /note="p.S415L"
KLTKAVSASSVPSNIHLGVAPVGSGLLALTLQTIPLTTVLTNGPPASTTAPT

SEQ ID NO: 1009 - protein, 52 aa, Artificial Sequence
  source: /note="Description of Artificial Sequence: Synthetic polypeptide"
  source: /note="p.T141M"
RKRPYDSDNLQHEELLMKLWNLLMPMMKKLNARISKQWAEIGFQGDDPKTDF

SEQ ID NO: 1010 - protein, 27 aa, Artificial Sequence
  source: /note="Description of Artificial Sequence: Synthetic peptide"
  source: /note="p.D570H"
IGPELSRRIYLQMTTLQPHLSLDSAHH

SEQ ID NO: 1011 - protein, 52 aa, Artificial Sequence
  source: /note="Description of Artificial Sequence: Synthetic polypeptide"
  source: /note="p.R27G"
APRTLWSCYLCCLLTAAAGAASYPPGGGFSLYTGSSGALSPGGPQAQIAPRP

SEQ ID NO: 1012 - protein, 52 aa, Artificial Sequence
  source: /note="Description of Artificial Sequence: Synthetic polypeptide"
  source: /note="p.K805R"
FSADGKCLVSVGLDDFHSIVFWDWKRRGEKIATTRGHKDKIFVVKCNPHHVD

SEQ ID NO: 1013 - protein, 52 aa, Artificial Sequence
  source: /note="Description of Artificial Sequence: Synthetic polypeptide"
  source: /note="p.R493H"
EESESTETTGVAFVSFVGMESVLNEHHFFKDHQAPLTTSEIKLKMNSRVVGG

SEQ ID NO: 1014 - protein, 52 aa, Artificial Sequence
  source: /note="Description of Artificial Sequence: Synthetic polypeptide"
  source: /note="p.R631Q"
SHVGIIISLVCLVLAIATFLLCRSIQQNHNTYLHLHLCVCLLLAKTLFLAGI

SEQ ID NO: 1015 - protein, 52 aa, Artificial Sequence
  source: /note="Description of Artificial Sequence: Synthetic polypeptide"
  source: /note="p.S75L"
GFSSFSEIITTPMETCDDINECATLLLKVSCGKFSDCWNTEGSYDCVCSPGY

SEQ ID NO: 1016 - protein, 52 aa, Artificial Sequence
  source: /note="Description of Artificial Sequence: Synthetic polypeptide"
  source: /note="p.R514L"
TPEPTRKPWERTNTMNGSKSPVISRLLDSPRKNQIVFDNRSYDSLHRPKSTP

SEQ ID NO: 1017 - protein, 52 aa, Artificial Sequence
  source: /note="Description of Artificial Sequence: Synthetic polypeptide"
  source: /note="p.R373H"
PFYRNQQVQRGPRWNFFAWERKQVAHHPGNPVYHKAYPPTSRGNYPNYAGNP

SEQ ID NO: 1018 - protein, 52 aa, Artificial Sequence
  source: /note="Description of Artificial Sequence: Synthetic polypeptide"
  source: /note="p.R356W"
QFEQIVAVYHSASKQKAWDHFTKAQWWKNISVWCKQAEEIRNIHNDELMGIR

SEQ ID NO: 1019 - protein, 52 aa, Artificial Sequence
  source: /note="Description of Artificial Sequence: Synthetic polypeptide"
  source: /note="p.F289C"
EESVDDKWTRTTFEKSVPMSTYLVCCCAVHQFDSVKRISNSGKPLTIYVQPE

SEQ ID NO: 1020 - protein, 52 aa, Artificial Sequence
  source: /note="Description of Artificial Sequence: Synthetic polypeptide"
  source: /note="p.G738E"
YQDFRIPLSPVHKCSFYKNNTKVSYEEFLSPPQLNKNSSGIYSEALLTTNIV

SEQ ID NO: 1021 - protein, 195 aa, Artificial Sequence
  source: /note="Description of Artificial Sequence: Synthetic polypeptide"
  source: /note="p.G204fs"
NFIKYGWVGRWFRPRKGTLGAMDLGVPLPRSLLRQPVQLRTEPARSSCISTASTTESTPTASSAMAVTRSSRGCWPAPSRPTASTPAGRGAFPPKCCSGMCTSHHAPWPSGPRTSTAVPGSACQGAVTPTSAEIWFLGSSASPPAPSPDALSMGSSSPQWLGTLWPSLPSSTLWTFCGLRWGCPWPPCSSWRQPQ

SEQ ID NO: 1022 - protein, 52 aa, Artificial Sequence
  source: /note="Description of Artificial Sequence: Synthetic polypeptide"
  source: /note="p.E327K"
HTEHVYRVYVTTFLGFGGNFARQRYKKDLVLNETLNKNRLLGQKTGLSPDNP

SEQ ID NO: 1023 - protein, 28 aa, Artificial Sequence
  source: /note="Description of Artificial Sequence: Synthetic peptide"
  source: /note="p.G332fs"
LNPTAHYNVFVEVVLADPNHWRFQGANG

SEQ ID NO: 1024 - protein, 52 aa, Artificial Sequence
  source: /note="Description of Artificial Sequence: Synthetic polypeptide"
  source: /note="p.C1164Y"
YKYCSKLSEVFEQEIDPVMQSLGYCYYGRKLEFSPQTLCCYGKQLCTIPRDA

SEQ ID NO: 1025 - protein, 52 aa, Artificial Sequence
  source: /note="Description of Artificial Sequence: Synthetic polypeptide"
  source: /note="p.D1399N"
FGMHVQEYGSDCPPPNQRRVYISYLNNSVHFFRPKCLRTAVYHEILIGYLEY

SEQ ID NO: 1026 - protein, 52 aa, Artificial Sequence
  source: /note="Description of Artificial Sequence: Synthetic polypeptide"
  source: /note="p.A896S"
SYSAGDSGDAAAQPAFTGIKGKEGSSSLTEGAKEEGGEEVAKAVLEQEETAA

SEQ ID NO: 1027 - protein, 52 aa, Artificial Sequence
  source: /note="Description of Artificial Sequence: Synthetic polypeptide"
  source: /note="p.D369N"
KVFSYHRYQRVEMNENALVELKKLFNNAKSEHLHQTLALHSYTSVLSRLQVE

SEQ ID NO: 1028 - protein, 52 aa, Artificial Sequence
  source: /note="Description of Artificial Sequence: Synthetic polypeptide"
  source: /note="p.R2289L"
MALSSLFMEVLMMMNNATIPTAEFLLLGSIRTWIGQKMHGLVVLPLLTAACQ

SEQ ID NO: 1029 - protein, 52 aa, Artificial Sequence
  source: /note="Description of Artificial Sequence: Synthetic polypeptide"
  source: /note="p.G111V"
IYRGEEASRVHVELQFTVRDCKSFPVVGAGPLGCKETFNLLYMESDQDVGIQ

SEQ ID NO: 1030 - protein, 52 aa, Artificial Sequence
  source: /note="Description of Artificial Sequence: Synthetic polypeptide"
  source: /note="p.A184T"
LVSGSVKLNVERCSLGRLTRRGLYLTTFHNPGACVALVSVRVFYQRCPETLN

SEQ ID NO: 1031 - protein, 34 aa, Artificial Sequence
  source: /note="Description of Artificial Sequence: Synthetic polypeptide"
  source: /note="p.P868fs"
ERPYWDMSGQDVIKAVEDGFRLPPPGTVLTFCTD

SEQ ID NO: 1032 - protein, 57 aa, Artificial Sequence
  source: /note="Description of Artificial Sequence: Synthetic polypeptide"
  source: /note="p.P460fs"
NQTEPPKVRLEGRSTTSLSVSWSIPRRSRAECGSTRSLTARRETPTATMCAAPRVSP

SEQ ID NO: 1033 - protein, 52 aa, Artificial Sequence
  source: /note="Description of Artificial Sequence: Synthetic polypeptide"
  source: /note="p.T802R"
AAYTTRGGKIPIRWTSPEAIAYRKFRRSASDVWSYGIVLWEVMSYGERPYWE

SEQ ID NO: 1034 - protein, 52 aa, Artificial Sequence
  source: /note="Description of Artificial Sequence: Synthetic polypeptide"
  source: /note="p.D952H"
TTGGKIPIRWTAPEAIAYRKFSSASHHAWSYGIVMWEVMSYGERPYWEMSNQ

SEQ ID NO: 1035 - protein, 52 aa, Artificial Sequence
  source: /note="Description of Artificial Sequence: Synthetic polypeptide"
  source: /note="p.R392H"
SGRGACTRCGDNVQYAPRQLGLTEPHHIYISDLLAHTQYTFEIQAVNGVTDQ

SEQ ID NO: 1036 - protein, 52 aa, Artificial Sequence
  source: /note="Description of Artificial Sequence: Synthetic polypeptide"
  source: /note="p.R337H"
KACQACPRGLYKSSAGNAPCSPCPAHHSHAPNPAAPVCPCLEGFYRASSDPP

SEQ ID NO: 1037 - protein, 28 aa, Artificial Sequence
  source: /note="Description of Artificial Sequence: Synthetic peptide"
  source: /note="p.G54fs"
ALEEVLLDTTGETSEIGWLTYPPGGGTR

SEQ ID NO: 1038 - protein, 36 aa, Artificial Sequence
  source: /note="Description of Artificial Sequence: Synthetic polypeptide"
  source: /note="p.P132fs"
ILNRYPHFKTKIEGLDIHFIHVKPPSCPQAIPRSPC

SEQ ID NO: 1039 - protein, 52 aa, Artificial Sequence
  source: /note="Description of Artificial Sequence: Synthetic polypeptide"
  source: /note="p.R282Q"
TTEDLEAYIYVFSQPGALSGPINHYQQNIFSCLPLKHHMVTTPTLLLWGEND

SEQ ID NO: 1040 - protein, 60 aa, Artificial Sequence
  source: /note="Description of Artificial Sequence: Synthetic polypeptide"
  source: /note="p.G2015fs"
FQAMQKQLIEKAEALRLLEVQVATGVSSTHSTTTGSHWKQPTDGAVCTRTSMRSFPTRST

SEQ ID NO: 1041 - protein, 52 aa, Artificial Sequence
  source: /note="Description of Artificial Sequence: Synthetic polypeptide"
  source: /note="p.D2378H"
HSHRVPVDVAYRRGYFDEEMNRVLAHHPSDDTKGFFDPNTHENLTYLQLLQR

SEQ ID NO: 1042 - protein, 52 aa, Artificial Sequence
  source: /note="Description of Artificial Sequence: Synthetic polypeptide"
  source: /note="p.V1151L"
MYPAYAKWVQSHRDLPIKLNQWCNVLLRWEFKHPQPFLRTREFLWQEGHSAF

SEQ ID NO: 1043 - protein, 52 aa, Artificial Sequence
  source: /note="Description of Artificial Sequence: Synthetic polypeptide"
  source: /note="p.L1335I"
GITNALSEEDKEALIAKCNDYRRRLIISVNIRVRADLRDNYSPGWKFNHWEL

SEQ ID NO: 1044 - protein, 52 aa, Artificial Sequence
  source: /note="Description of Artificial Sequence: Synthetic polypeptide"
  source: /note="p.L755S"
AFGTVYKGIWIPDGENVKIPVAIKVSSRENTSPKANKEILDEAYVMAGVGSP

SEQ ID NO: 1045 - protein, 52 aa, Artificial Sequence
  source: /note="Description of Artificial Sequence: Synthetic polypeptide"
  source: /note="p.D769Y"
ENVKIPVAIKVLRENTSPKANKEILYYEAYVMAGVGSPYVSRLLGICLTSTV

SEQ ID NO: 1046 - protein, 66 aa, Artificial Sequence
  source: /note="Description of Artificial Sequence: Synthetic polypeptide"
  source: /note="p.774_775insAYVM"
AIKVLRENTSPKANKEILDEAYVMAAYVMYVMAGVGSPYVSRLLGICLTSTVQLVTQLMPYGCLLD

SEQ ID NO: 1047 - protein, 55 aa, Artificial Sequence
  source: /note="Description of Artificial Sequence: Synthetic polypeptide"
  source: /note="p.776_776G>VC"
AIKVLRENTSPKANKEILDEAYVMAVCVCVGSPYVSRLLGICLTSTVQLVTQLMP

SEQ ID NO: 1048 - protein, 52 aa, Artificial Sequence
  source: /note="Description of Artificial Sequence: Synthetic polypeptide"
  source: /note="p.V842I"
LGSQDLLNWCMQIAKGMSYLEDVRLIIHRDLAARNVLVKSPNHVKITDFGLA

SEQ ID NO: 1049 - protein, 52 aa, Artificial Sequence
  source: /note="Description of Artificial Sequence: Synthetic polypeptide"
  source: /note="p.M916I"
LESILRRRFTHQSDVWSYGVTVWELIITFGAKPYDGIPAREIPDLLEKGERL

SEQ ID NO: 1050 - protein, 52 aa, Artificial Sequence
  source: /note="Description of Artificial Sequence: Synthetic polypeptide"
  source: /note="p.S310Y"
PEGRYTFGASCVTACPYNYLSTDVGYYCTLVCPLHNQEVTAEDGTQRCEKCS

SEQ ID NO: 1051 - protein, 52 aa, Artificial Sequence
  source: /note="Description of Artificial Sequence: Synthetic polypeptide"
  source: /note="p.S310F"
PEGRYTFGASCVTACPYNYLSTDVGFFCTLVCPLHNQEVTAEDGTQRCEKCS

SEQ ID NO: 1052 - protein, 52 aa, Artificial Sequence
  source: /note="Description of Artificial Sequence: Synthetic polypeptide"
  source: /note="p.M91I"
VLTGHNADLSFLQWIREVTGYVLVAIINEFSTLPLPNLRVVRGTQVYDGKFA

SEQ ID NO: 1053 - protein, 52 aa, Artificial Sequence
  source: /note="Description of Artificial Sequence: Synthetic polypeptide"
  source: /note="p.V104M"
WIREVTGYVLVAMNEFSTLPLPNLRMMVRGTQVYDGKFAIFVMLNYNTNSSH

SEQ ID NO: 1054 - protein, 52 aa, Artificial Sequence
  source: /note="Description of Artificial Sequence: Synthetic polypeptide"
  source: /note="p.V104L"
WIREVTGYVLVAMNEFSTLPLPNLRLLVRGTQVYDGKFAIFVMLNYNTNSSH

SEQ ID NO: 1055 - protein, 52 aa, Artificial Sequence
  source: /note="Description of Artificial Sequence: Synthetic polypeptide"
  source: /note="p.D297Y"
LEPNPHTKYQYGGVCVASCPHNFVVYYQTSCVRACPPDKMEVDKNGLKMCEP

SEQ ID NO: 1056 - protein, 52 aa, Artificial Sequence
  source: /note="Description of Artificial Sequence: Synthetic polypeptide"
  source: /note="p.K692R"
DLSEKEASLLDLKEHASSLASSGLKRRDSRLKTLEIALEQKKEECLKMESQL

SEQ ID NO: 1057 - protein, 40 aa, Artificial Sequence
  source: /note="Description of Artificial Sequence: Synthetic polypeptide"
  source: /note="p.Y14C"
MKLNVDGLLVYFPCCDYIYPEQFSYMRELKRTLDAKGHGV

SEQ ID NO: 1058 - protein, 52 aa, Artificial Sequence
  source: /note="Description of Artificial Sequence: Synthetic polypeptide"
  source: /note="p.N238S"
LDPKIADLVSKELARKAVVVFDEAHSSIDNVCIDSMSVNLTRRTLDRCQGNL

SEQ ID NO: 1059 - protein, 52 aa, Artificial Sequence
  source: /note="Description of Artificial Sequence: Synthetic polypeptide"
  source: /note="p.D312N"
RLVEGLREASAARETDAHLANPVLPNNEVLQEAVPGSIRTAEHFLGFLRRLL

SEQ ID NO: 1060 - protein, 52 aa, Artificial Sequence
  source: /note="Description of Artificial Sequence: Synthetic polypeptide"
  source: /note="p.V780I"
SLPDKNEQVLFCRLTDEQHKVYQNFIIDSKEVYRILNGEMQIFSGLIALRKI

SEQ ID NO: 1061 - protein, 52 aa, Artificial Sequence
  source: /note="Description of Artificial Sequence: Synthetic polypeptide"
  source: /note="p.R505Q"
LVFSQSRQILNIIERLLKNRHFKTLQQIDGTVTHLLEREKRINLFQQNKDYS

SEQ ID NO: 1062 - protein, 52 aa, Artificial Sequence
  source: /note="Description of Artificial Sequence: Synthetic polypeptide"
  source: /note="p.L445I"
LGDTSILDDLFKSHGNSPTQLPKKVIISGPMEKAKQRPKDFWDILNEQNDES

SEQ ID NO: 1063 - protein, 52 aa, Artificial Sequence
  source: /note="Description of Artificial Sequence: Synthetic polypeptide"
  source: /note="p.T295K"
TQDLGVPVMGVYTWHQDGLRQLPHLKKLARDTLHFLALRWGHIRLPASGPRD

SEQ ID NO: 1064 - protein, 52 aa, Artificial Sequence
  source: /note="Description of Artificial Sequence: Synthetic polypeptide"
  source: /note="p.A421T"
LLPERPPYLDKYEKFFREAEETNGGTTQIQPLPADCGISSATEKPDSKTKMD

SEQ ID NO: 1065 - protein, 52 aa, Artificial Sequence
  source: /note="Description of Artificial Sequence: Synthetic polypeptide"
  source: /note="p.R300Q"
TLPKSPQPSVPEQSDNELEQAGKSKQQGSILQLCEEIAGEIESDNVEVKKES

SEQ ID NO: 1066 - protein, 36 aa, Artificial Sequence
  source: /note="Description of Artificial Sequence: Synthetic polypeptide"
  source: /note="p.T99fs"
LSDSDSNLSGEDSKALSQKKIKKKKPRLKKKSIQKI

SEQ ID NO: 1067 - protein, 113 aa, Artificial Sequence
  source: /note="Description of Artificial Sequence: Synthetic polypeptide"
  source: /note="p.PPPPPPSFPPPPPPPGTQLPP430del"
QSYMDMLNPELGLPRGTIGKPTPPPGYPAPKPPVGPQAADIYMQTKNKLRHVETEALKKELSSCDGHDGLRRQDSSRKPRAFSKQPSTGDYYRQLGRCPGETLAARPGMAHSE

SEQ ID NO: 1068 - protein, 33 aa, Artificial Sequence
  source: /note="Description of Artificial Sequence: Synthetic polypeptide"
  source: /note="p.R627Q"
EEEQRWKEEEEARLASMPAWRWDLLQQKKLEEE

SEQ ID NO: 1069 - protein, 91 aa, Artificial Sequence
  source: /note="Description of Artificial Sequence: Synthetic polypeptide"
  source: /note="p.H64fs"
PLYLACQEGHLEVTQYLVQECGADPRPRRHDPTARRGADGPQPGHRVVGELHRREPVGAGQRRRHRHALRGEPRPQQGAQLAAAARRGDLG

SEQ ID NO: 1070 - protein, 114 aa, Artificial Sequence
  source: /note="Description of Artificial Sequence: Synthetic polypeptide"
  source: /note="p.296_317PPPPSFPPPPPPPGTQLPPPPP>P"
QSYMDMLNPELGLPWGTIGKPIPPPPSYPSPKPPVGPQAADIYMQTKNKLRHVETEALKKEPSSCDGHDGLRRQDSSRKPRAFSKQPSTGDYYRQLGRCPGETLVARPGMAHRE

SEQ ID NO: 1071 - protein, 52 aa, Artificial Sequence
  source: /note="Description of Artificial Sequence: Synthetic polypeptide"
  source: /note="p.D219N"
VNALVSHLLVVEPEKLYAMPDPAGPNNGHLPAVATLCDLFDREIVVTISWAK

SEQ ID NO: 1072 - protein, 52 aa, Artificial Sequence
  source: /note="Description of Artificial Sequence: Synthetic polypeptide"
  source: /note="p.R816W"
LQVNSLIQTQKSAELAAALLSIYMEWWAEDLPLRKGTKHLSPYATLTVGDSS

SEQ ID NO: 1073 - protein, 52 aa, Artificial Sequence
  source: /note="Description of Artificial Sequence: Synthetic polypeptide"
  source: /note="p.S574F"
QILPYADLTLEQRFQLDHSGLDSLIFFMRLVLRFLQVEERELGSPYTGPEAL

SEQ ID NO: 1074 - protein, 52 aa, Artificial Sequence
  source: /note="Description of Artificial Sequence: Synthetic polypeptide"
  source: /note="p.I281F"
LYKKFDLRANCEPQTYGIGLKELWVFFDEKNWKPGRVDHTVGWPLDRHTYGG

SEQ ID NO: 1075 - protein, 52 aa, Artificial Sequence
  source: /note="Description of Artificial Sequence: Synthetic polypeptide"
  source: /note="p.R369W"
YVYQLLSDSRYENFIRWEDKESKIFWWIVDPNGLARLWGNHKNRTNMTYEKM

SEQ ID NO: 1076 - protein, 52 aa, Artificial Sequence
  source: /note="Description of Artificial Sequence: Synthetic polypeptide"
  source: /note="p.R588C"
QHNCGTPLPVSSEKDMIRQMMIKIFCCCIEPELNNLIALGDKIDSFNSLYML

SEQ ID NO: 1077 - protein, 37 aa, Artificial Sequence
  source: /note="Description of Artificial Sequence: Synthetic polypeptide"
  source: /note="p.R11P"
MAMEMRLPVAPPKPLSERLGRDTKKHLVVPGDTITTD

SEQ ID NO: 1078 - protein, 33 aa, Artificial Sequence
  source: /note="Description of Artificial Sequence: Synthetic polypeptide"
  source: /note="p.L160fs"
CDLICLDYDGNILDACTFALLAALKMYSCLKLL

SEQ ID NO: 1079 - protein, 52 aa, Artificial Sequence
  source: /note="Description of Artificial Sequence: Synthetic polypeptide"
  source: /note="p.K510R"
VDTPPRKKKRKHRLWAAHCRKIQLKRRDGSSNHVYNYQPCDHPRQPCDSSCP

SEQ ID NO: 1080 - protein, 52 aa, Artificial Sequence
  source: /note="Description of Artificial Sequence: Synthetic polypeptide"
  source: /note="p.Y641F"
LAPSDVAGWGIFIKDPVQKNEFISEFFCGEIISQDEADRRGKVYDKYMCSFL

SEQ ID NO: 1081 - protein, 52 aa, Artificial Sequence
  source: /note="Description of Artificial Sequence: Synthetic polypeptide"
  source: /note="p.E117K"
TSPCQNQGKCKDGLGEYTCTCLEGFKKGKNCELFTRKLCSLDNGDCDQFCHE

SEQ ID NO: 1082 - protein, 52 aa, Artificial Sequence
  source: /note="Description of Artificial Sequence: Synthetic polypeptide"
  source: /note="p.Q426L"
DESFTKHTVNPNMKEDGILGPIIRALLVRDTLKIVFKNMASRPYSIYPHGVT

SEQ ID NO: 1083 - protein, 52 aa, Artificial Sequence
  source: /note="Description of Artificial Sequence: Synthetic polypeptide"
  source: /note="p.L1332P"
LSQTNLSPALGQMPISPDLSHTTLSPPDFSQTNLSPELSQTNLSPALGQMPL

SEQ ID NO: 1084 - protein, 52 aa, Artificial Sequence
  source: /note="Description of Artificial Sequence: Synthetic polypeptide"
  source: /note="p.S2269Y"
NPKEWLQVDFQKTMKVTGVTTQGVKYYLLTSMYVKEFLISSSQDGHQWTLFF

SEQ ID NO: 1085 - protein, 52 aa, Artificial Sequence
  source: /note="Description of Artificial Sequence: Synthetic polypeptide"
  source: /note="p.D75H"
SSSRINIPERASGPEGNLNQIVTEPHHANFPQFLHEGLSKPVYVINWFMSFG

SEQ ID NO: 1086 - protein, 52 aa, Artificial Sequence
  source: /note="Description of Artificial Sequence: Synthetic polypeptide"
  source: /note="p.H126N"
AREWKGETPRNKLMRKAYEELFWRHNNIKCVRQVRRDNYDALRSVLFQIFSQ

SEQ ID NO: 1087 - protein, 59 aa, Artificial Sequence
  source: /note="Description of Artificial Sequence: Synthetic polypeptide"
  source: /note="p.GGG156del"
LSRASFDYLRLVVRELEQQLAAVRGMALPQPQPQSLPLPPSLPSALAPVPSLPSAPAPV

SEQ ID NO: 1088 - protein, 50 aa, Artificial Sequence
  source: /note="Description of Artificial Sequence: Synthetic polypeptide"
  source: /note="p.S269fs"
KIYGKQSMVDEVSGKVLEMDISKKKHYNRKISIKKLNRMKVPLMKLITRV

SEQ ID NO: 1089 - protein, 27 aa, Artificial Sequence
  source: /note="Description of Artificial Sequence: Synthetic peptide"
  source: /note="p.L441fs"
IKQLQKGVQQKRPSEAQSVILRRYFWN

SEQ ID NO: 1090 - protein, 52 aa, Artificial Sequence
  source: /note="Description of Artificial Sequence: Synthetic polypeptide"
  source: /note="p.P467H"
DSEPRQEVPMYTGSEPRQEVPMYTGHHESRQEVPMYTGPESRQEVLIRTDPE

SEQ ID NO: 1091 - protein, 52 aa, Artificial Sequence
  source: /note="Description of Artificial Sequence: Synthetic polypeptide"
  source: /note="p.R382H"
LSSQPIGTKPSSSSQRGSLRKVATGHHSAKDKETASAIKSSESPRDSVVRKQ

SEQ ID NO: 1092 - protein, 52 aa, Artificial Sequence
  source: /note="Description of Artificial Sequence: Synthetic polypeptide"
  source: /note="p.F52L"
IPFPETFDGDTDRLPEFIVQTSSYMLLVDENTFSNDALKVTFLITRLTGPAL

SEQ ID NO: 1093 - protein, 52 aa, Artificial Sequence
  source: /note="Description of Artificial Sequence: Synthetic polypeptide"
  source: /note="p.S645R"
KGIDQEGKMVLLSLKLTPSEPCDPLRRSTLREPLDIRSSLKDSHTEEQEELS

SEQ ID NO: 1094 - protein, 52 aa, Artificial Sequence
  source: /note="Description of Artificial Sequence: Synthetic polypeptide"
  source: /note="p.L648M"
DQEGKMVLLSLKLTPSEPCDPLSSTMMREPLDIRSSLKDSHTEEQEELSVLS

SEQ ID NO: 1095 - protein, 52 aa, Artificial Sequence
  source: /note="Description of Artificial Sequence: Synthetic polypeptide"
  source: /note="p.R884H"
GHCLPDGRTENTPGVETKGLNLKIPHHVIALENPRTRSLHRALEETPKGMPK

SEQ ID NO: 1096 - protein, 52 aa, Artificial Sequence
  source: /note="Description of Artificial Sequence: Synthetic polypeptide"
  source: /note="p.W240C"
GYCKPTSSEGSFYITSENCMQHAHKCCHRDLCLLLLHAYRGLRLHFLVIMRD

SEQ ID NO: 1097 - protein, 52 aa, Artificial Sequence
  source: /note="Description of Artificial Sequence: Synthetic polypeptide"
  source: /note="p.Q285H"
LVIMRDIPELPHTELEALAVEETLSHHLCSELQMLNNPEKIAEQISKDLAWL

SEQ ID NO: 1098 - protein, 67 aa, Artificial Sequence
  source: /note="Description of Artificial Sequence: Synthetic polypeptide"
  source: /note="p.P117fs"
LEADVNVEGLGTANETGVPIMAHPPLSTVTTHWSSGWTLCWALPKRASNWTSRTSRQWAPPWTSCGS

SEQ ID NO: 1099 - protein, 52 aa, Artificial Sequence
  source: /note="Description of Artificial Sequence: Synthetic polypeptide"
  source: /note="p.Q95R"
KEHQQQQRQQQQQQQQQRQRQQQQQRRRRQQEPSWPALLASMGESSPAAQAH

SEQ ID NO: 1100 - protein, 52 aa, Artificial Sequence
  source: /note="Description of Artificial Sequence: Synthetic polypeptide"
  source: /note="p.E158K"
VCGGVPEPTGLDAACTKLQSLQRLFKKPTTPAPPLRPPDSLSRAPAEFPSAK

SEQ ID NO: 1101 - protein, 52 aa, Artificial Sequence
  source: /note="Description of Artificial Sequence: Synthetic polypeptide"
  source: /note="p.K165N"
NDRPRQPAPGDGSKERMCGEELEDTNNDDPECGVEEEDAGLAGQPPGKLTRS

SEQ ID NO: 1102 - protein, 52 aa, Artificial Sequence
  source: /note="Description of Artificial Sequence: Synthetic polypeptide"
  source: /note="p.E56K"
DALQPGSTRVAKGWSQGVGEVTSTSKKYCSCVSSSRKLIHSGIQRIHRDSPQ

SEQ ID NO: 1103 - protein, 52 aa, Artificial Sequence
  source: /note="Description of Artificial Sequence: Synthetic polypeptide"
  source: /note="p.D459N"
SYSPQKKEPSKAETEERVSMVKTRDNNFKIYNEDVSFLSVNQNNYSRNPTQS

SEQ ID NO: 1104 - protein, 52 aa, Artificial Sequence
  source: /note="Description of Artificial Sequence: Synthetic polypeptide"
  source: /note="p.A831T"
QVFDAFTPRLQDSNKKVNQWALESFTTKMIPLLRESLHPMLLSIIITVADNL

SEQ ID NO: 1105 - protein, 52 aa, Artificial Sequence
  source: /note="Description of Artificial Sequence: Synthetic polypeptide"
  source: /note="p.R109H"
KAALDKSAPCRRSVDHRKYLQKQLKHHFSQKYSRLPRGLPGRAAEPYLKRGS

SEQ ID NO: 1106 - protein, 52 aa, Artificial Sequence
  source: /note="Description of Artificial Sequence: Synthetic polypeptide"
  source: /note="p.R784W"
RALGRQQASSQCPGDSKDHIIATEEWWGGPGQAGSPPGAAGQGSGEGCGLWE

SEQ ID NO: 1107 - protein, 86 aa, Artificial Sequence
  source: /note="Description of Artificial Sequence: Synthetic polypeptide"
  source: /note="p.IPPQAQELEIPL1556del"
LIPPQAQELGIPLTPQQVQALGIPLTPQQAQALGIPLTPQQAQELGIPLTPQQAQELGIPLTPQQAQAQGIPLTPQQAQALGISLT

SEQ ID NO: 1108 - protein, 52 aa, Artificial Sequence
  source: /note="Description of Artificial Sequence: Synthetic polypeptide"
  source: /note="p.C51Y"
PRKAKIRHPVASFFHLFFRVSAIIVYYLLCELLSSSFITCMVTIILLLSCDF

SEQ ID NO: 1109 - protein, 27 aa, Artificial Sequence
  source: /note="Description of Artificial Sequence: Synthetic peptide"
  source: /note="p.D428fs"
NYRRRCACDDCSLSHILTCGIMDPPRH

SEQ ID NO: 1110 - protein, 105 aa, Artificial Sequence
  source: /note="Description of Artificial Sequence: Synthetic polypeptide"
  source: /note="p.D428fs"
NYRRRCACDDCSLSHILTCGIMDPPSLMTSTFTSSHFKWILLLTILLRGARPVCHLQARGPAPALPSQFSSTPGSSSQTVARHQLFVVMMKMLHHCQPNLLIFIH

SEQ ID NO: 1111 - protein, 68 aa, Artificial Sequence
  source: /note="Description of Artificial Sequence: Synthetic polypeptide"
  source: /note="p.EEEEYL135del"
IEEEEYLGKEGYLEEEEYLGKEEHLGKEGYLEKEDYIEEVDYLGKKAYLEEEEYLGKKSYLEEEKALE

SEQ ID NO: 1112 - protein, 52 aa, Artificial Sequence
  source: /note="Description of Artificial Sequence: Synthetic polypeptide"
  source: /note="p.Y139H"
EYLGKEGYLEEEEYLGKEEHLEEEEHHLGKEGYLEKEDYIEEVDYLGKKAYL

SEQ ID NO: 1113 - protein, 52 aa, Artificial Sequence
  source: /note="Description of Artificial Sequence: Synthetic polypeptide"
  source: /note="p.L112F"
QQLKKIFQEYGTVGVSLHIGISLISFFGIFYMVVSSGVDMPAILLKLGFKES

SEQ ID NO: 1114 - protein, 49 aa, Artificial Sequence
  source: /note="Description of Artificial Sequence: Synthetic polypeptide"
  source: /note="p.A42fs"
GPSQPPVRQGALQGGLLMGYSPAGGRHPPGSTRYPSFPLRLVPLSLIGP

SEQ ID NO: 1115 - protein, 52 aa, Artificial Sequence
  source: /note="Description of Artificial Sequence: Synthetic polypeptide"
  source: /note="p.P36S"
RGLGAAEMPGQGPGSDWTERSSSAESSPAVAGTEGGGGGSAGYSCYQNSKGS

SEQ ID NO: 1116 - protein, 49 aa, Artificial Sequence
  source: /note="Description of Artificial Sequence: Synthetic polypeptide"
  source: /note="p.P1231S"
DMDDIFSSGIQAKTTKPKSRSAQAASSEPRFEHKVSNIFDDPLNAFGGQ

SEQ ID NO: 1117 - protein, 41 aa, Artificial Sequence
  source: /note="Description of Artificial Sequence: Synthetic polypeptide"
  source: /note="p.P690fs"
PGGRGPQGALQSPSAQKRGLSPSPSCQQVQEATSLWKPIPC

SEQ ID NO: 1118 - protein, 53 aa, Artificial Sequence
  source: /note="Description of Artificial Sequence: Synthetic polypeptide"
  source: /note="p.S691del"
SPGGRGPQGALQSPSAQKRGLSPSPPASKSKKRPLFGSPSPAEKTPHPGPGLR

SEQ ID NO: 1119 - protein, 35 aa, Artificial Sequence
  source: /note="Description of Artificial Sequence: Synthetic polypeptide"
  source: /note="p.K9R"
MEAYEQVQRRGPLKLKGVAELGVTKRKKKKKDKDK

SEQ ID NO: 1120 - protein, 52 aa, Artificial Sequence
  source: /note="Description of Artificial Sequence: Synthetic polypeptide"
  source: /note="p.R740C"
LQTKYLGRQWRKSNMKTMSAIYQKVCCHRMNDDWAYGNDIDARPWDFQAEEC

SEQ ID NO: 1121 - protein, 36 aa, Artificial Sequence
  source: /note="Description of Artificial Sequence: Synthetic polypeptide"
  source: /note="p.H416R"
RPPGTDGVVPATVNYYVTPVQPLLARRAYPTWLPCN

SEQ ID NO: 1122 - protein, 52 aa, Artificial Sequence
  source: /note="Description of Artificial Sequence: Synthetic polypeptide"
  source: /note="p.G372W"
GSSLRSEPSETGVSRLRLAPPKTRRWWSSLHAEPSKTGVSHLSPEPPKTEVS

SEQ ID NO: 1123 - protein, 52 aa, Artificial Sequence
  source: /note="Description of Artificial Sequence: Synthetic polypeptide"
  source: /note="p.R690L"
EDKFFSQEKYWGRKFHTPSNSYTAQLLVKMKYGAWYLKPKLWKKLRSDEPLI

SEQ ID NO: 1124 - protein, 52 aa, Artificial Sequence
  source: /note="Description of Artificial Sequence: Synthetic polypeptide"
  source: /note="p.L567F"
QRGRIRYGPWYFEPKLGKKLRSDEPFFIDPKPVLEKPDEPDILDGLYGPIAF

SEQ ID NO: 1125 - protein, 52 aa, Artificial Sequence
  source: /note="Description of Artificial Sequence: Synthetic polypeptide"
  source: /note="p.W163C"
GKDMPPDLLLQVLKQLDPERKLEDACCARCEAREKTTEVPTESGKYPCGESC

SEQ ID NO: 1126 - protein, 52 aa, Artificial Sequence
  source: /note="Description of Artificial Sequence: Synthetic polypeptide"
  source: /note="p.P388S"
VSPLRQLPPEAGVSHLCPEPPKTRVSSPLRPETPKNGVSPLFPEPPKTRISN

SEQ ID NO: 1127 - protein, 52 aa, Artificial Sequence
  source: /note="Description of Artificial Sequence: Synthetic polypeptide"
  source: /note="p.I499V"
ISSGNSFPPQQAGSPLKRPFSAAAAVVAAAAAAAAAAAAAAAAAAPAPALAA

SEQ ID NO: 1128 - protein, 52 aa, Artificial Sequence
  source: /note="Description of Artificial Sequence: Synthetic polypeptide"
  source: /note="p.A516P"
RPFSAAAAIAAAAAAAAAAAAAAAAPPAPAPALAAAAAPALAAAAAPALAAA

SEQ ID NO: 1129 - protein, 49 aa, Artificial Sequence
  source: /note="Description of Artificial Sequence: Synthetic polypeptide"
  source: /note="p.H317R"
SDATVEKDESHAGKVVLRSWYEKNKRRIFPASRWEPYDPEKKWDKYTIR

SEQ ID NO: 1130 - protein, 52 aa, Artificial Sequence
  source: /note="Description of Artificial Sequence: Synthetic polypeptide"
  source: /note="p.A70T"
LGMQSIPIATACTIYPKFFCETILDTTFDPYLIAMSSIYLAGKVEEQPLWAH

SEQ ID NO: 1131 - protein, 52 aa, Artificial Sequence
  source: /note="Description of Artificial Sequence: Synthetic polypeptide"
  source: /note="p.R402C"
AGLKVLFKKTHRILRRLFNLCKRCHCCQPRFRLPKERSLSYWWNRIQSLLYC

SEQ ID NO: 1132 - protein, 52 aa, Artificial Sequence
  source: /note="Description of Artificial Sequence: Synthetic polypeptide"
  source: /note="p.S425W"
WLTRIQSFLYCNENGLLGSFSEETHWWCTCPNDQVVCTAFLPCTVGDASACL

SEQ ID NO: 1133 - protein, 52 aa, Artificial Sequence
  source: /note="Description of Artificial Sequence: Synthetic polypeptide"
  source: /note="p.R457G"
QVVCTAFLPCTVGDASACLTCAPDNGGTRCGTCNTGYMLSQGLCKPEVAEST

SEQ ID NO: 1134 - protein, 45 aa, Artificial Sequence
  source: /note="Description of Artificial Sequence: Synthetic polypeptide"
  source: /note="p.S19L"
MQPPVPGPLGLLDPAEGLLLRRKKTSLWFVGSLLLVSVLIVTVGL

SEQ ID NO: 1135 - protein, 52 aa, Artificial Sequence
  source: /note="Description of Artificial Sequence: Synthetic polypeptide"
  source: /note="p.P277T"
GFRLTPEPVPTCSSYPLPLQPCSRFTTVAPSSALASSEDLQPPSPSSSGSGL

SEQ ID NO: 1136 - protein, 52 aa, Artificial Sequence
  source: /note="Description of Artificial Sequence: Synthetic polypeptide"
  source: /note="p.H445D"
PSAEVWNENKERREKKDRHPSRKSSDDHRKAGESHRRRAGDKNQKASSHRSA

SEQ ID NO: 1137 - protein, 49 aa, Artificial Sequence
  source: /note="Description of Artificial Sequence: Synthetic polypeptide"
  source: /note="p.L583M"
VDIVAKMVEKQNIEAKVEKAQGGQEMMEMISGTMTSEKTEMIVFETKSI

SEQ ID NO: 1138 - protein, 49 aa, Artificial Sequence
  source: /note="Description of Artificial Sequence: Synthetic polypeptide"
  source: /note="p.G23V"
MSDCCSAPGISWEAGVGRPAVPVVLELQIRRGAMSEETVSESQFSLKTA

SEQ ID NO: 1139 - protein, 52 aa, Artificial Sequence
  source: /note="Description of Artificial Sequence: Synthetic polypeptide"
  source: /note="p.P54L"
FLTLVFALGFFFLLLPYLSYFHCDDLLPSPSPGKRKCPVGRRRRPRGRMKNH

SEQ ID NO: 1140 - protein, 52 aa, Artificial Sequence
  source: /note="Description of Artificial Sequence: Synthetic polypeptide"
  source: /note="p.R304S"
ASSRWQETARTSCAFNSSVQQDPLSSSHPPETCQMEAGSLFLLSSDGQNVVG

SEQ ID NO: 1141 - protein, 52 aa, Artificial Sequence
  source: /note="Description of Artificial Sequence: Synthetic polypeptide"
  source: /note="p.R1265S"
NSQGISSGDMGTSQVVHVHLEDSGISSVAQKQEPRVPTCVLQKCQVTNFPPA

SEQ ID NO: 1142 - protein, 52 aa, Artificial Sequence
  source: /note="Description of Artificial Sequence: Synthetic polypeptide"
  source: /note="p.L222P"
PPQPVSPLDSKFPIDHSLPQQLPSPPPFPPHHIQRAEPSLQPEASLSLNTVF

SEQ ID NO: 1143 - protein, 52 aa, Artificial Sequence
  source: /note="Description of Artificial Sequence: Synthetic polypeptide"
  source: /note="p.W192L"
TWAVPVSESNVAKLTNIYRDQSFTTLLLVATNTSTNDMIILQTLHWRMQLSI

SEQ ID NO: 1144 - protein, 52 aa, Artificial Sequence
  source: /note="Description of Artificial Sequence: Synthetic polypeptide"
  source: /note="p.R206Q"
DESNFNHFLNMTEKQGCSVQRLRNIQQVRTVKGQDYLSKTGAKFHGKMEQKF

SEQ ID NO: 1145 - protein, 52 aa, Artificial Sequence
  source: /note="Description of Artificial Sequence: Synthetic polypeptide"
  source: /note="p.A141T"
SGGSVTLSESTAIISYGTTGLVTWDTTALYLAEWAIENPAVFTNRTVLELGS

SEQ ID NO: 1146 - protein, 38 aa, Artificial Sequence
  source: /note="Description of Artificial Sequence: Synthetic polypeptide"
  source: /note="p.C120Y"
RASCSPLSYAGLGSDGKWNLVMTRNYYFPTKSTWRWQC

SEQ ID NO: 1147 - protein, 52 aa, Artificial Sequence
  source: /note="Description of Artificial Sequence: Synthetic polypeptide"
  source: /note="p.S383L"
KVQFERKHSKIHSIRSLASQPTELNLLEVLEQSQQSTSLTFGEGAESPGGQS

SEQ ID NO: 1148 - protein, 52 aa, Artificial Sequence
  source: /note="Description of Artificial Sequence: Synthetic polypeptide"
  source: /note="p.R299L"
KRFLIKLRPDANSAYQDTLEFLMASLLDFCKSFWKICVEHHAFFRLFEEPKP

SEQ ID NO: 1149 - protein, 52 aa, Artificial Sequence
  source: /note="Description of Artificial Sequence: Synthetic polypeptide"
  source: /note="p.E261K"
IAGVMTLSQVKGFVRKNGVNEAKIDKKIKNDNVQDTAEQKVQLLRNWHQLHG

SEQ ID NO: 1150 - protein, 36 aa, Artificial Sequence
  source: /note="Description of Artificial Sequence: Synthetic polypeptide"
  source: /note="p.K3fs"
MKKNTCFPRVIGYKYASSKSYLSILLESVSISTHQL

SEQ ID NO: 1151 - protein, 52 aa, Artificial Sequence
  source: /note="Description of Artificial Sequence: Synthetic polypeptide"
  source: /note="p.Q625E"
RFCSNSKHLLGKEAIKQRHLQLLGYEEVVQIPYHEIGMLKSRRELVEYLQRK

SEQ ID NO: 1152 - protein, 52 aa, Artificial Sequence
  source: /note="Description of Artificial Sequence: Synthetic polypeptide"
  source: /note="p.R4359L"
TKVVDLDPCLSKKPLEEKPSQPYSALLESLSEVQSLSSFQSESCDDNGYHWD

SEQ ID NO: 1153 - protein, 52 aa, Artificial Sequence
  source: /note="Description of Artificial Sequence: Synthetic polypeptide"
  source: /note="p.H3574N"
PTAIPLEIFIVTMEDDFPGGVIGKINNATDQDMYDVLTFALKSEQKSLFKVN

SEQ ID NO: 1154 - protein, 52 aa, Artificial Sequence
  source: /note="Description of Artificial Sequence: Synthetic polypeptide"
  source: /note="p.A4159T"
GLRPVVVPNIQAGHSYVGKEELIGITTVVLFVIFILVVLFIVFRKKVFRKNY

SEQ ID NO: 1155 - protein, 52 aa, Artificial Sequence
  source: /note="Description of Artificial Sequence: Synthetic polypeptide"
  source: /note="p.R1266H"
VVQVLDENDNKPQFPEKVYQIKLPEHHDRKKRGEPIYRAFAFDRDEGPNAEI

SEQ ID NO: 1156 - protein, 52 aa, Artificial Sequence
  source: /note="Description of Artificial Sequence: Synthetic polypeptide"
  source: /note="p.G1899V"
TDVNDNPPVFTQAVFETILLLPTYVVVVEVLKVSATDPDSEVPPELTYSLME

SEQ ID NO: 1157 - protein, 52 aa, Artificial Sequence
  source: /note="Description of Artificial Sequence: Synthetic polypeptide"
  source: /note="p.A836V"
GRSGAPAEREAEPRVKESRSPAKEEVVAKMPARASPPHSKAAPGDVKVKEER

SEQ ID NO: 1158 - protein, 52 aa, Artificial Sequence
  source: /note="Description of Artificial Sequence: Synthetic polypeptide"
  source: /note="p.S102R"
RIQQIIYCHKLTIILTKWRNTARHKRRKKKEDELILKHELQLKKWKNRLILK

SEQ ID NO: 1159 - protein, 52 aa, Artificial Sequence
  source: /note="Description of Artificial Sequence: Synthetic polypeptide"
  source: /note="p.V48G"
RDKGRAAQVCTAWRDAAYHKSVWRGGGEAKLHLRRANPSLFPSLQARGIRRV

SEQ ID NO: 1160 - protein, 52 aa, Artificial Sequence
  source: /note="Description of Artificial Sequence: Synthetic polypeptide"
  source: /note="p.M144I"
KQPCTNDMAKSNSVGQDSCQDSEGDIIIFPAESSCALPQEGSAGPGSPGSAP

SEQ ID NO: 1161 - protein, 33 aa, Artificial Sequence
  source: /note="Description of Artificial Sequence: Synthetic polypeptide"
  source: /note="p.F144fs"
KRFFSEHVPCNGFSDIENLEGPEIFLRMNWCVS

SEQ ID NO: 1162 - protein, 52 aa, Artificial Sequence
  source: /note="Description of Artificial Sequence: Synthetic polypeptide"
  source: /note="p.M553V"
HLPASRVVGTPEPSLGARAPQDPGGVVAQACEEYLSQIHSCQTLQDRTEKMK

SEQ ID NO: 1163 - protein, 38 aa, Artificial Sequence
  source: /note="Description of Artificial Sequence: Synthetic polypeptide"
  source: /note="p.G443fs"
TPGEDGGEPGDAVAAAEQPAQCGQGAAVRAARGRELQE

SEQ ID NO: 1164 - protein, 52 aa, Artificial Sequence
  source: /note="Description of Artificial Sequence: Synthetic polypeptide"
  source: /note="p.G423V"
SDDNTLKVWSAVTGKCLRTLVGHTGVVVWSSQMRDNIIISGSTDRTLKVWNA

SEQ ID NO: 1165 - protein, 52 aa, Artificial Sequence
  source: /note="Description of Artificial Sequence: Synthetic polypeptide"
  source: /note="p.R465C"
DRTLKVWNAETGECIHTLYGHTSTVCCCMHLHEKRVVSGSRDATLRVWDIET

SEQ ID NO: 1166 - protein, 52 aa, Artificial Sequence
  source: /note="Description of Artificial Sequence: Synthetic polypeptide"
  source: /note="p.R465H"
DRTLKVWNAETGECIHTLYGHTSTVHHCMHLHEKRVVSGSRDATLRVWDIET

SEQ ID NO: 1167 - protein, 52 aa, Artificial Sequence
  source: /note="Description of Artificial Sequence: Synthetic polypeptide"
  source: /note="p.R479Q"
IHTLYGHTSTVRCMHLHEKRVVSGSQQDATLRVWDIETGQCLHVLMGHVAAV

SEQ ID NO: 1168 - protein, 52 aa, Artificial Sequence
  source: /note="Description of Artificial Sequence: Synthetic polypeptide"
  source: /note="p.R505G"
DATLRVWDIETGQCLHVLMGHVAAVGGCVQYDGRRVVSGAYDFMVKVWDPET

SEQ ID NO: 1169 - protein, 52 aa, Artificial Sequence
  source: /note="Description of Artificial Sequence: Synthetic polypeptide"
  source: /note="p.R505C"
DATLRVWDIETGQCLHVLMGHVAAVCCCVQYDGRRVVSGAYDFMVKVWDPET

SEQ ID NO: 1170 - protein, 52 aa, Artificial Sequence
  source: /note="Description of Artificial Sequence: Synthetic polypeptide"
  source: /note="p.S546L"
FMVKVWDPETETCLHTLQGHTNRVYLLLQFDGIHVVSGSLDTSIRVWDVETG

SEQ ID NO: 1171 - protein, 52 aa, Artificial Sequence
  source: /note="Description of Artificial Sequence: Synthetic polypeptide"
  source: /note="p.S582L"
GSLDTSIRVWDVETGNCIHTLTGHQLLLTSGMELKDNILVSGNADSTVKIWD

SEQ ID NO: 1172 - protein, 45 aa, Artificial Sequence
  source: /note="Description of Artificial Sequence: Synthetic polypeptide"
  source: /note="p.R689W"
ESGGSGGVVWRIRASNTKLVCAVGSWWNGTEETKLLVLDFDVDMK

SEQ ID NO: 1173 - protein, 40 aa, Artificial Sequence
  source: /note="Description of Artificial Sequence: Synthetic polypeptide"
  source: /note="p.R14Q"
MNQELLSVGSKRRQQTGGSLRGNPSSSQVDEEQMNRVVEE

SEQ ID NO: 1174 - protein, 30 aa, Artificial Sequence
  source: /note="Description of Artificial Sequence: Synthetic polypeptide"
  source: /note="p.G298fs"
YDKKVTIYDPRDRMETRDALMGWGGAFEGL

SEQ ID NO: 1175 - protein, 52 aa, Artificial Sequence
  source: /note="Description of Artificial Sequence: Synthetic polypeptide"
  source: /note="p.V233M"
SNALELVVTDSIHQDYTTQNLIRMAMMAGLVLVALLAILVENWHSHTALNKE

SEQ ID NO: 1176 - protein, 52 aa, Artificial Sequence
  source: /note="Description of Artificial Sequence: Synthetic polypeptide"
  source: /note="p.V4019M"
VYYEPEQTVLIDNCRQQCTCHVGKVMMVCQEHSCKPGQVCQPSGGILSCVTK

SEQ ID NO: 1177 - protein, 52 aa, Artificial Sequence
  source: /note="Description of Artificial Sequence: Synthetic polypeptide"
  source: /note="p.A1022S"
EALCGLCGNFNGDPADDLALRGGGQSSANALAFGNSWQEETRPGCGATEPGD

SEQ ID NO: 1178 - protein, 52 aa, Artificial Sequence
  source: /note="Description of Artificial Sequence: Synthetic polypeptide"
  source: /note="p.A2493V"
RFDFMGTCVYVLAQTCGTRPGLHRFVVVLQENVAWGNGRVSVTRVITVQVAN

SEQ ID NO: 1179 - protein, 52 aa, Artificial Sequence
  source: /note="Description of Artificial Sequence: Synthetic polypeptide"
  source: /note="p.V222G"
SSKPVTITVQVPSMGSSSPMGIIVAGGVIATAVAAIVAAVVALIYCRKKRIS

SEQ ID NO: 1180 - protein, 52 aa, Artificial Sequence
  source: /note="Description of Artificial Sequence: Synthetic polypeptide"
  source: /note="p.P40A"
LFLLPGSLGAESHLSLLYHLTAVSSAAAPGTPAFWVSGWLGPQQYLSYNSLR

SEQ ID NO: 1181 - protein, 30 aa, Artificial Sequence
  source: /note="Description of Artificial Sequence: Synthetic polypeptide"
  source: /note="p.V505L"
MQQPESSANIRTLLENKDSQVIYSSLLKKS

SEQ ID NO: 1182 - protein, 52 aa, Artificial Sequence
  source: /note="Description of Artificial Sequence: Synthetic polypeptide"
  source: /note="p.L620M"
AIMNALIEAGAHMDATNAFKKTAYEMMLDEKLLARGTMQPFNYVTLQCLAAR

SEQ ID NO: 1183 - protein, 77 aa, Artificial Sequence
  source: /note="Description of Artificial Sequence: Synthetic polypeptide"
  source: /note="p.L474fs"
SEKPLAEQDWYHGAIPRIEAQELLKNKETFWCERVMGNLVNMSFLYILMDRGDILSYNMLITCIDSRALGFQTFLNL

SEQ ID NO: 1184 - protein, 52 aa, Artificial Sequence
  source: /note="Description of Artificial Sequence: Synthetic polypeptide"
  source: /note="p.P92H"
CEVDQGDGEEEEEEERGRGVSLLGRHHKRKRVITYAQRQAANIRERKRMFNL

SEQ ID NO: 1185 - protein, 52 aa, Artificial Sequence
  source: /note="Description of Artificial Sequence: Synthetic polypeptide"
  source: /note="p.P50L"
NCNASPEPGAEAGAEAGGGADGFPALLACSLEEKLSLCFRPSDPGAEPPRTA

SEQ ID NO: 1186 - protein, 52 aa, Artificial Sequence
  source: /note="Description of Artificial Sequence: Synthetic polypeptide"
  source: /note="p.E82K"
GSQGKKLLNLCSPLPCMIPLQPLGYKKVPSKTLLSYSELWKSSLRAGGGGGG

SEQ ID NO: 1187 - protein, 52 aa, Artificial Sequence
  source: /note="Description of Artificial Sequence: Synthetic polypeptide"
  source: /note="p.E339Q"
NYCGLPGEYWLGNDKISQLTRMGPTQQLLIEMEDWKGDKVKAHYGGFTVQNE

SEQ ID NO: 1188 - protein, 50 aa, Artificial Sequence
  source: /note="Description of Artificial Sequence: Synthetic polypeptide"
  source: /note="p.T229M"
KPLEVAMYREPSLHDVGETVPKPGVMMPSKSTSASAIMNGGKPVNKSKTT

SEQ ID NO: 1189 - protein, 43 aa, Artificial Sequence
  source: /note="Description of Artificial Sequence: Synthetic polypeptide"
  source: /note="p.A236V"
YREPSLHDVGETVPKPGVTPSKSTSVVSAIMNGGKPVNKSKTT

SEQ ID NO: 1190 - protein, 52 aa, Artificial Sequence
  source: /note="Description of Artificial Sequence: Synthetic polypeptide"
  source: /note="p.G380R"
VVLPAEEELVEADEAGSVYAGILSYRRVGFFLFILVVAAVTLCRLRSPPKKG

SEQ ID NO: 1191 - protein, 117 aa, Artificial Sequence
  source: /note="Description of Artificial Sequence: Synthetic polypeptide"
  source: /note="p.R571fs"
QGGPLYVLVEYAAKGNLREFLRARRAPGPGLLLRHLQAARGAAHLQGPGVLCLPGGPGHGVLGLPEVHPQGPGCPQCAGDRGQRDEDRRLRAGPGRAQPRLLQEDDQRPAAREVDGA

SEQ ID NO: 1192 - protein, 52 aa, Artificial Sequence
  source: /note="Description of Artificial Sequence: Synthetic polypeptide"
  source: /note="p.P716H"
GGSPYPGIPVEELFKLLKEGHRMDKHHANCTHDLYMIMRECWHAAPSQRPTF

SEQ ID NO: 1193 - protein, 127 aa, Artificial Sequence
  source: /note="Description of Artificial Sequence: Synthetic polypeptide"
  source: /note="p.*807S"
SSGDDSVFAHDLLPPAPPSSGGSRTSSRATGPQQCEGSLAAHPAAGAQPLPGMRLSADGETATQSFGLCVCVCVCVCVCAHPRVPVCVRILPPGAEVPWVSPLLCNGLLTGAAAPRGLCSGGTQCRM

SEQ ID NO: 1194 - protein, 52 aa, Artificial Sequence
  source: /note="Description of Artificial Sequence: Synthetic polypeptide"
  source: /note="p.R248C"
RGNYTCVVENKFGSIRQTYTLDVLECCSPHRPILQAGLPANQTAVLGSDVEF

SEQ ID NO: 1195 - protein, 52 aa, Artificial Sequence
  source: /note="Description of Artificial Sequence: Synthetic polypeptide"
  source: /note="p.S249C"
GNYTCVVENKFGSIRQTYTLDVLERCCPHRPILQAGLPANQTAVLGSDVEFH

SEQ ID NO: 1196 - protein, 90 aa, Artificial Sequence
  source: /note="Description of Artificial Sequence: Synthetic polypeptide"
  source: /note="p.H479fs"
LGPGPVAGPKLYPKLYTDIHTHTHTLSHTLTRGGQGPPAHPLSVLDGTVSAVGTGGPARQADWEDGGRSCRRRQGTHGEEEWPAPQAVCV

SEQ ID NO: 1197 - protein, 52 aa, Artificial Sequence
  source: /note="Description of Artificial Sequence: Synthetic polypeptide"
  source: /note="p.R243L"
KYTCRVSNRAGAINATYKVDVIQRTLLSKPVLTGTHPVNTTVDFGGTTSFQC

SEQ ID NO: 1198 - protein, 52 aa, Artificial Sequence
  source: /note="Description of Artificial Sequence: Synthetic polypeptide"
  source: /note="p.V274L"
TGTHPVNTTVDFGGTTSFQCKVRSDLLKPVIQWLKRVEYGAEGRHNSTIDVG

SEQ ID NO: 1199 - protein, 49 aa, Artificial Sequence
  source: /note="Description of Artificial Sequence: Synthetic polypeptide"
  source: /note="p.G138fs"
LDHRAVSQVNRINETKHSVLQYVGGGDVCGNAGPETSVAERELERDLLG

SEQ ID NO: 1200 - protein, 79 aa, Artificial Sequence
  source: /note="Description of Artificial Sequence: Synthetic polypeptide"
  source: /note="p.F100fs"
PGLPPTTHMNGYSHLGKKKRMRSFFGKLFRRSKFEAKPTSGPWQPGRNITTKLIQRPLRSSLGSRKTPPSLPFLGEEEL

SEQ ID NO: 1201 - protein, 52 aa, Artificial Sequence
  source: /note="Description of Artificial Sequence: Synthetic polypeptide"
  source: /note="p.R254W"
SGDVSKLSLADSFLYGLIQVPNYSLWWIEAMVLKKEFLPSCSSLYTDITVLR

SEQ ID NO: 1202 - protein, 52 aa, Artificial Sequence
  source: /note="Description of Artificial Sequence: Synthetic polypeptide"
  source: /note="p.D184E"
AKHCVKCNKAITSGGITYQDQPWHAEECFVCVTCSKKLAGQRFTAVEDQYYC

SEQ ID NO: 1203 - protein, 40 aa, Artificial Sequence
  source: /note="Description of Artificial Sequence: Synthetic polypeptide"
  source: /note="p.K309fs"
NGPKEDSSLPTFKTAKEQLWVDQQKSTTNLSVHQGLHMVV

SEQ ID NO: 1204 - protein, 52 aa, Artificial Sequence
  source: /note="Description of Artificial Sequence: Synthetic polypeptide"
  source: /note="p.I522K"
LKDDLTKLKSFTVMLVDERKNMMEKKKKQEERKVDGLNKNFKVEQGKVMDVT

SEQ ID NO: 1205 - protein, 52 aa, Artificial Sequence
  source: /note="Description of Artificial Sequence: Synthetic polypeptide"
  source: /note="p.E161Q"
GPPEGWTELTMGVGPWREETWGELIQQKCLESMCQGEEAELQLPGHSGPPVR

SEQ ID NO: 1206 - protein, 52 aa, Artificial Sequence
  source: /note="Description of Artificial Sequence: Synthetic polypeptide"
  source: /note="p.R320L"
AQAALGNLEKATADLKKVLAIDPKNLLAAQEELGKVVIQGKNQDAGLAQGLR

SEQ ID NO: 1207 - protein, 58 aa, Artificial Sequence
  source: /note="Description of Artificial Sequence: Synthetic polypeptide"
  source: /note="p.K159fs"
KGNKGRSKSPRETGGKRHESSSEKKKEKDIHLLIEKKNMEKTIITQVKKRKTRLKILD

SEQ ID NO: 1208 - protein, 52 aa, Artificial Sequence
  source: /note="Description of Artificial Sequence: Synthetic polypeptide"
  source: /note="p.R2886H"
ASTHADISRHSQAVQGQSEGSRRSRHHQGSSVSQDSDSEGHSEDSERWSGSA

SEQ ID NO: 1209 - protein, 52 aa, Artificial Sequence
  source: /note="Description of Artificial Sequence: Synthetic polypeptide"
  source: /note="p.P3254H"
ERWSGSASRNHRGSVQEQSRHGSRHHHRSHHEDRAGHGHSADRSRQSGTRHA

SEQ ID NO: 1210 - protein, 52 aa, Artificial Sequence
  source: /note="Description of Artificial Sequence: Synthetic polypeptide"
  source: /note="p.L572F"
GSGSSQSSGYGQYGSRETSGFGQHGFFGSGQSTGFGQYGSGSGQSSGFGQHG

SEQ ID NO: 1211 - protein, 52 aa, Artificial Sequence
  source: /note="Description of Artificial Sequence: Synthetic polypeptide"
  source: /note="p.G1545V"
HTHGQSGSQHGESESIIHDRHRITHVVQTGDTTRHSYSGHEQTTQTGSRTTG

SEQ ID NO: 1212 - protein, 54 aa, Artificial Sequence
  source: /note="Description of Artificial Sequence: Synthetic polypeptide"
  source: /note="p.H1901fs"
RRSGHSESSDSEVHSGGSHTHSGHTQPSQVSTWRVRIHSSQETPNYSWTDRRYH

SEQ ID NO: 1213 - protein, 133 aa, Artificial Sequence
  source: /note="Description of Artificial Sequence: Synthetic polypeptide"
  source: /note="p.L850fs"
SHTFQLWRALGAGQPTSHLVLTTLLGLSAGATPAHRCQRQQPLPQGEDLPAFAGCHEHAARAAVCPGVQAGRAGGLPQALPGPPHPDALCLGAEPAQRAPQAAGPGGGRAQPPKLQHVTGGTEEPAVHHGALA

SEQ ID NO: 1214 - protein, 52 aa, Artificial Sequence
  source: /note="Description of Artificial Sequence: Synthetic polypeptide"
  source: /note="p.V1240M"
GTHTITYIPLCPGAYTVTIKYGGQPMMPNFPSKLQVEPAVDTSGVQCYGPGI

SEQ ID NO: 1215 - protein, 33 aa, Artificial Sequence
  source: /note="Description of Artificial Sequence: Synthetic polypeptide"
  source: /note="p.W529fs"
LDGVYAFEYYPSTPGRYSIAITWGGTPHSKEPL

SEQ ID NO: 1216 - protein, 66 aa, Artificial Sequence
  source: /note="Description of Artificial Sequence: Synthetic polypeptide"
  source: /note="p.W529fs"
FLDGVYAFEYYPSTPGRYSIAITWGDTTFQRAPLKFKLALKRVCRKSVLGALGSMVGLSGGQRTSW

SEQ ID NO: 1217 - protein, 78 aa, Artificial Sequence
  source: /note="Description of Artificial Sequence: Synthetic polypeptide"
  source: /note="p.600_601insFREYEYD"
LQMVQVTGSSDNEYFYVDFREYEYDFREYEYDFREYEYDLKWEFPRENLEFGKVLGSGAFGKVMNATAYGISKTGVSI

SEQ ID NO: 1218 - protein, 52 aa, Artificial Sequence
  source: /note="Description of Artificial Sequence: Synthetic polypeptide"
  source: /note="p.D835H"
RDLAARNVLVTHGKVVKICDFGLARHHIMSDSNYVVRGNARLPVKWMAPESL

SEQ ID NO: 1219 - protein, 52 aa, Artificial Sequence
  source: /note="Description of Artificial Sequence: Synthetic polypeptide"
  source: /note="p.D835Y"
RDLAARNVLVTHGKVVKICDFGLARYYIMSDSNYVVRGNARLPVKWMAPESL

SEQ ID NO: 1220 - protein, 52 aa, Artificial Sequence
  source: /note="Description of Artificial Sequence: Synthetic polypeptide"
  source: /note="p.D835E"
RDLAARNVLVTHGKVVKICDFGLAREEIMSDSNYVVRGNARLPVKWMAPESL

SEQ ID NO: 1221 - protein, 52 aa, Artificial Sequence
  source: /note="Description of Artificial Sequence: Synthetic polypeptide"
  source: /note="p.S751F"
CLEALRLEEKEVRHHRILEAKSIQTFFPTEEGGVLTLPPVDGLPGRPPCPPG

SEQ ID NO: 1222 - protein, 52 aa, Artificial Sequence
  source: /note="Description of Artificial Sequence: Synthetic polypeptide"
  source: /note="p.P992T"
GIPLPPPLPGAGIPPPPPLPGAGIPTTPPPLPGAGIPPPPPLPGAGIPPPPP

SEQ ID NO: 1223 - protein, 52 aa, Artificial Sequence
  source: /note="Description of Artificial Sequence: Synthetic polypeptide"
  source: /note="p.E927Q"
HFLDKAGSVSLDSVLADVRSLQRGLQQLTQREFVRQDDCMVLKEFLRANSPT

SEQ ID NO: 1224 - protein, 49 aa, Artificial Sequence
  source: /note="Description of Artificial Sequence: Synthetic polypeptide"
  source: /note="p.F510L"
AILTQWDRSLKPMQTRVVGRLQKPCLLFFHWLKLFAIPILLIAVFLVLT

SEQ ID NO: 1225 - protein, 52 aa, Artificial Sequence
  source: /note="Description of Artificial Sequence: Synthetic polypeptide"
  source: /note="p.S331R"
QKIPPVNTNLENLYLQGNRINEFSIRRSFCTVVDVVNFSKLQVLRLDGNEIK

SEQ ID NO: 1226 - protein, 52 aa, Artificial Sequence
  source: /note="Description of Artificial Sequence: Synthetic polypeptide"
  source: /note="p.R290C"
RGEWKCERHTSVQTTSSGSGPFTDVCCAAVYQPQPHPQPPPYGHCVTDSGVV

SEQ ID NO: 1227 - protein, 56 aa, Artificial Sequence
  source: /note="Description of Artificial Sequence: Synthetic polypeptide"
  source: /note="p.TT58del"
PEPDTEPDSTAAVPSQPAPSAATTTAVTAAAASDDSPSEDEQEAVQEVPRVVQNPP

SEQ ID NO: 1228 - protein, 52 aa, Artificial Sequence
  source: /note="Description of Artificial Sequence: Synthetic polypeptide"
  source: /note="p.R652H"
QGTSHRPSLPASLNDNDLVDSDEDEHHAVGSLHPKGAFAQPRPALSPSRQSP

SEQ ID NO: 1229 - protein, 53 aa, Artificial Sequence
  source: /note="Description of Artificial Sequence: Synthetic polypeptide"
  source: /note="p.D1180del"
APGKSEPPSKRPLSSKSQQSVSAEDEEEDAGFFKGGKEDLLSSSVPKWPSSST

SEQ ID NO: 1230 - protein, 36 aa, Artificial Sequence
  source: /note="Description of Artificial Sequence: Synthetic polypeptide"
  source: /note="p.S501fs"
NLTKELKSPDEGFEGKSLYESWTKKVLPQSSVACPG

SEQ ID NO: 1231 - protein, 52 aa, Artificial Sequence
  source: /note="Description of Artificial Sequence: Synthetic polypeptide"
  source: /note="p.A643S"
HPQEMKTYSVSFDSLFSAVKNFTEISSSKFSERLQDFDKSNPIVLRMMNDQL

SEQ ID NO: 1232 - protein, 45 aa, Artificial Sequence
  source: /note="Description of Artificial Sequence: Synthetic polypeptide"
  source: /note="p.C405fs"
GQFCSNSSSIRRTAPTAALPPRARCGRAPVGLVGAAEVSGSGGGL

SEQ ID NO: 1233 - protein, 52 aa, Artificial Sequence
  source: /note="Description of Artificial Sequence: Synthetic polypeptide"
  source: /note="p.R354W"
SGIYAHITKHYPYYRTADKGWQNSIWWHNLSLNRYFIKVPRSQEEPGKGSFW

SEQ ID NO: 1234 - protein, 66 aa, Artificial Sequence
  source: /note="Description of Artificial Sequence: Synthetic polypeptide"
  source: /note="p.P96fs"
NLLKSFGESVLRSVSPVQDLDDDTPHPLPTLTCPTMPGRTPTANPPTPSAASYLWPSRTLQPSACQ

SEQ ID NO: 1235 - protein, 52 aa, Artificial Sequence
  source: /note="Description of Artificial Sequence: Synthetic polypeptide"
  source: /note="p.S135L"
RSKPYTRRPKPPYSYIALIAMAIRDLLAGGRLTLAEINEYLMGKFPFFRGSY

SEQ ID NO: 1236 - protein, 52 aa, Artificial Sequence
  source: /note="Description of Artificial Sequence: Synthetic polypeptide"
  source: /note="p.R136L"
SVGGICQQFSLPENIQLSLFSASFLLLNINEYLAVVDAPPLDLRFNPSGYLL

SEQ ID NO: 1237 - protein, 48 aa, Artificial Sequence
  source: /note="Description of Artificial Sequence: Synthetic polypeptide"
  source: /note="p.I22V"
MSRARSHLRAALFLAAASARGVVTTQVAARRGLSAWPVPQEPSMEYQD

SEQ ID NO: 1238 - protein, 52 aa, Artificial Sequence
  source: /note="Description of Artificial Sequence: Synthetic polypeptide"
  source: /note="p.R455H"
NVININHQGRDGHTGLHSACYHGHIHHLVQFLLDNGADMNLVACDPSRSSGE

SEQ ID NO: 1239 - protein, 52 aa, Artificial Sequence
  source: /note="Description of Artificial Sequence: Synthetic polypeptide"
  source: /note="p.R54Q"
PLVVLGVTFVLGVLGNGLVIWVAGFQQMTRTVTTICYLNLALADFSFTATLP

SEQ ID NO: 1240 - protein, 52 aa, Artificial Sequence
  source: /note="Description of Artificial Sequence: Synthetic polypeptide"
  source: /note="p.C382F"
FMSSNASEVKRIPEGEKWEDGPCKVFFECRGAQVTCYEPSCPPCPVGTLALE

SEQ ID NO: 1241 - protein, 53 aa, Artificial Sequence
  source: /note="Description of Artificial Sequence: Synthetic polypeptide"
  source: /note="p.E86del"
AIEMDKGTYIHALDNGLFTLGAPHKVDEGPSPPEQFTAVKLSDSRIALKSGYG

SEQ ID NO: 1242 - protein, 52 aa, Artificial Sequence
  source: /note="Description of Artificial Sequence: Synthetic polypeptide"
  source: /note="p.I34T"
RIALKSGYGKYLGINSDELVGHSDATTGPREQWEPVFQNGKMALLASNSCFI

SEQ ID NO: 1243 - protein, 52 aa, Artificial Sequence
  source: /note="Description of Artificial Sequence: Synthetic polypeptide"
  source: /note="p.R37K"
LKSGYGKYLGINSDELVGHSDAIGPKKEQWEPVFQNGKMALLASNSCFIRCN

SEQ ID NO: 1244 - protein, 52 aa, Artificial Sequence
  source: /note="Description of Artificial Sequence: Synthetic polypeptide"
  source: /note="p.Q39K"
SGYGKYLGINSDELVGHSDAIGPREKKWEPVFQNGKMALLASNSCFIRCNEA

SEQ ID NO: 1245 - protein, 52 aa, Artificial Sequence
  source: /note="Description of Artificial Sequence: Synthetic polypeptide"
  source: /note="p.P42Q"
GKYLGINSDELVGHSDAIGPREQWEQQVFQNGKMALLASNSCFIRCNEAGDI

SEQ ID NO: 1246 - protein, 52 aa, Artificial Sequence
  source: /note="Description of Artificial Sequence: Synthetic polypeptide"
  source: /note="p.M49V"
SDELVGHSDAIGPREQWEPVFQNGKVVALLASNSCFIRCNEAGDIEAKSKTA

SEQ ID NO: 1247 - protein, 52 aa, Artificial Sequence
  source: /note="Description of Artificial Sequence: Synthetic polypeptide"
  source: /note="p.A50P"
DELVGHSDAIGPREQWEPVFQNGKMPPLLASNSCFIRCNEAGDIEAKSKTAG

SEQ ID NO: 1248 - protein, 52 aa, Artificial Sequence
  source: /note="Description of Artificial Sequence: Synthetic polypeptide"
  source: /note="p.L52S"
LVGHSDAIGPREQWEPVFQNGKMALSSASNSCFIRCNEAGDIEAKSKTAGEE

SEQ ID NO: 1249 - protein, 52 aa, Artificial Sequence
  source: /note="Description of Artificial Sequence: Synthetic polypeptide"
  source: /note="p.A53T"
VGHSDAIGPREQWEPVFQNGKMALLTTSNSCFIRCNEAGDIEAKSKTAGEEE

SEQ ID NO: 1250 - protein, 52 aa, Artificial Sequence
  source: /note="Description of Artificial Sequence: Synthetic polypeptide"
  source: /note="p.N55D"
HSDAIGPREQWEPVFQNGKMALLASDDSCFIRCNEAGDIEAKSKTAGEEEMI

SEQ ID NO: 1251 - protein, 52 aa, Artificial Sequence
  source: /note="Description of Artificial Sequence: Synthetic polypeptide"
  source: /note="p.I59V"
IGPREQWEPVFQNGKMALLASNSCFVVRCNEAGDIEAKSKTAGEEEMIKSLS

SEQ ID NO: 1252 - protein, 52 aa, Artificial Sequence
  source: /note="Description of Artificial Sequence: Synthetic polypeptide"
  source: /note="p.G65E"
WEPVFQNGKMALLASNSCFIRCNEAEEDIEAKSKTAGEEEMIKSLSHSLPSS

SEQ ID NO: 1253 - protein, 36 aa, Artificial Sequence
  source: /note="Description of Artificial Sequence: Synthetic polypeptide"
  source: /note="p.I10T"
MAVKLSDSRTTALKSGYGKYLGINSDELVGHSDAIG

SEQ ID NO: 1254 - protein, 37 aa, Artificial Sequence
  source: /note="Description of Artificial Sequence: Synthetic polypeptide"
  source: /note="p.A11T"
MAVKLSDSRITTLKSGYGKYLGINSDELVGHSDAIGP

SEQ ID NO: 1255 - protein, 39 aa, Artificial Sequence
  source: /note="Description of Artificial Sequence: Synthetic polypeptide"
  source: /note="p.K13N"
MAVKLSDSRIALNNSGYGKYLGINSDELVGHSDAIGPRE

SEQ ID NO: 1256 - protein, 46 aa, Artificial Sequence
  source: /note="Description of Artificial Sequence: Synthetic polypeptide"
  source: /note="p.L20P"
MAVKLSDSRIALKSGYGKYPPGINSDELVGHSDAIGPREQWEPVFQ

SEQ ID NO: 1257 - protein, 52 aa, Artificial Sequence
  source: /note="Description of Artificial Sequence: Synthetic polypeptide"
  source: /note="p.D32V"
DSRIALKSGYGKYLGINSDELVGHSVVAIGPREQWEPVFQNGKMALLASNSC

SEQ ID NO: 1258 - protein, 52 aa, Artificial Sequence
  source: /note="Description of Artificial Sequence: Synthetic polypeptide"
  source: /note="p.D142Y"
ECSLSLNKKSRSSTPVHNSEIQETCYYAHHRGRSRACTGRSKRHRSRALGVQ

SEQ ID NO: 1259 - protein, 32 aa, Artificial Sequence
  source: /note="Description of Artificial Sequence: Synthetic polypeptide"
  source: /note="p.P1005fs"
CKATSAALPQSQRSSTPSSEIGATPQAAPTTS

SEQ ID NO: 1260 - protein, 52 aa, Artificial Sequence
  source: /note="Description of Artificial Sequence: Synthetic polypeptide"
  source: /note="p.E1093Q"
APKYTEPLLSPRDEPRSDECGINPGQQKIASIPTKEEPQGQLSLERDREVTN

SEQ ID NO: 1261 - protein, 52 aa, Artificial Sequence
  source: /note="Description of Artificial Sequence: Synthetic polypeptide"
  source: /note="p.L47S"
KVINVDDDGNELGSGIMELTDTELISSYTRKRDSVKWHYLCLRRYGYDSNLF

SEQ ID NO: 1262 - protein, 52 aa, Artificial Sequence
  source: /note="Description of Artificial Sequence: Synthetic polypeptide"
  source: /note="p.T43N"
CNSCELTNITIAIEKEECRFCISINNNTWCAGYCYTRDLVYKDPARPKIQKT

SEQ ID NO: 1263 - protein, 52 aa, Artificial Sequence
  source: /note="Description of Artificial Sequence: Synthetic polypeptide"
  source: /note="p.R430C"
QSGARIELQRNPPPNADPNMKLFTICCGTPQQIDYARQLIEEKIGGPVNPLG

SEQ ID NO: 1264 - protein, 282 aa, Artificial Sequence
  source: /note="Description of Artificial Sequence: Synthetic polypeptide"
  source: /note="p.S140fs"
NPSAQLPRSPRRQGQRWIWFSMESPKPLLAAESHGRILQSHHVLPQRLRHLHALRLAGAVVRPACPPTAQPLGQDRAGGLGSVQLGAKLRQGALLPEPAGPSQGGRVRTLPQAPAPGNHDGDAVPVQVLSGLRELLAPRLHHREAVEERPGGLGRARGAGPQQKQLREVPATRRLHPRGRLPEPQGPGPVPAGAGQGPRPLPELLSLAGDAAASLLQLGTRFLQGLLETAGGIQVPDTRHSGLVHLRGWCGAWAARNLIFLGPHLSGGLIYLRTRLPEASPA

SEQ ID NO: 1265 - protein, 68 aa, Artificial Sequence
  source: /note="Description of Artificial Sequence: Synthetic polypeptide"
  source: /note="p.G324fs"
NQEELASGTPPARFPKAPSKLTVGGHGAKVRKRKRETRIQPPRNRSHCLPCLPWVHLHQNPTDHQMLT

SEQ ID NO: 1266 - protein, 52 aa, Artificial Sequence
  source: /note="Description of Artificial Sequence: Synthetic polypeptide"
  source: /note="p.D367N"
LTIILLAMNKIEGDNISGVCFVGLYNNVDALRYFVLAPLCLYVVVGVSLLLA

SEQ ID NO: 1267 - protein, 52 aa, Artificial Sequence
  source: /note="Description of Artificial Sequence: Synthetic polypeptide"
  source: /note="p.R416Q"
ISLNHVRQVIQHDGRNQEKLKKFMIQQIGVFSGLYLVPLVTLLGCYVYEQVN

SEQ ID NO: 1268 - protein, 52 aa, Artificial Sequence
  source: /note="Description of Artificial Sequence: Synthetic polypeptide"
  source: /note="p.R73H"
LSPKHAPDIPDDSTDNITIFTRILDHHLLDGYDNRLRPGLGDAVTEVKTDIY

SEQ ID NO: 1269 - protein, 52 aa, Artificial Sequence
  source: /note="Description of Artificial Sequence: Synthetic polypeptide"
  source: /note="p.R460Q"
PFSRANAAETISAARALPSASPTSIQQTGYMPRKASVGSASTRHVFGSRLQR

SEQ ID NO: 1270 - protein, 52 aa, Artificial Sequence
  source: /note="Description of Artificial Sequence: Synthetic polypeptide"
  source: /note="p.S126N"
RQSWKDERLRFKGPMQRLPLNNLLANNKIWTPDTFFHNGKKSIAHNMTTPNK

SEQ ID NO: 1271 - protein, 52 aa, Artificial Sequence
  source: /note="Description of Artificial Sequence: Synthetic polypeptide"
  source: /note="p.Q224K"
SEVVYVWTNGSTKSVVVAEDGSRLNKKYHLMGQTVGTENISTSTGEYTIMTA

SEQ ID NO: 1272 - protein, 52 aa, Artificial Sequence
  source: /note="Description of Artificial Sequence: Synthetic polypeptide"
  source: /note="p.V314I"
SARHSLPKVSYATAMDWFIAVCFAFIIFSALIEFAAVNYFTNLQTQKAKRKA

SEQ ID NO: 1273 - protein, 52 aa, Artificial Sequence
  source: /note="Description of Artificial Sequence: Synthetic polypeptide"
  source: /note="p.R416C"
KATMYSYDSASIQYRKPLSSREAYGCCALDRHGVPSKGRIRRRASQLKVKIP

SEQ ID NO: 1274 - protein, 52 aa, Artificial Sequence
  source: /note="Description of Artificial Sequence: Synthetic polypeptide"
  source: /note="p.D500N"
RSLPHKKTHLRRRSSQLKIKIPDLTNNVNAIDRWSRIVFPFTFSLFNLVYWL

SEQ ID NO: 1275 - protein, 119 aa, Artificial Sequence
  source: /note="Description of Artificial Sequence: Synthetic polypeptide"
  source: /note="p.Q412fs"
GSYRSVGVETGETKKEGAARSGGQGASVPGSGPSTQTPLTFTPALCSLRRLRPSMSSTGRHTPCEHRTQATLACPGARRQLPRNFLGERALGLPSPLRVSKWDDSRPRKTRGSLGLPEL

SEQ ID NO: 1276 - protein, 52 aa, Artificial Sequence
  source: /note="Description of Artificial Sequence: Synthetic polypeptide"
  source: /note="p.E205K"
LRLTINAECYLQLHNFPMDEHSCPLKKFSSYGYPKNEIEYKWKKPSVEVADP

SEQ ID NO: 1277 - protein, 52 aa, Artificial Sequence
  source: /note="Description of Artificial Sequence: Synthetic polypeptide"
  source: /note="p.A368V"
VSYVKAVDIYLWVSFVFVFLSVLEYVVAVNYLTTVQERKERKLREKFPCMCG

SEQ ID NO: 1278 - protein, 52 aa, Artificial Sequence
  source: /note="Description of Artificial Sequence: Synthetic polypeptide"
  source: /note="p.L352I"
VAWNPHKMLMAGIQCCALLVKDKSDIILKKCYSAKASYLFQQDKFYDVSYDT

SEQ ID NO: 1279 - protein, 52 aa, Artificial Sequence
  source: /note="Description of Artificial Sequence: Synthetic polypeptide"
  source: /note="p.A271S"
ESLVLLRRLLAWDLDDVLYAKLNARSSASSRLAAIPAALARAARTWNALDAG

SEQ ID NO: 1280 - protein, 52 aa, Artificial Sequence
  source: /note="Description of Artificial Sequence: Synthetic polypeptide"
  source: /note="p.G358C"
LEIVTCSHVGHVFRKATPYTFPGGTCCHVINKNNRRLAEVWMDEFKDFFYII

SEQ ID NO: 1281 - protein, 52 aa, Artificial Sequence
  source: /note="Description of Artificial Sequence: Synthetic polypeptide"
  source: /note="p.D234E"
VNRDWLQPLLHRVKEDYTRVVCPVIEEIINLDTFTYIESASELRGGFDWSLH

SEQ ID NO: 1282 - protein, 28 aa, Artificial Sequence
  source: /note="Description of Artificial Sequence: Synthetic peptide"
  source: /note="p.W317fs"
GIFVIDKSWFNHLGKYDAQMDIWGGREF

SEQ ID NO: 1283 - protein, 52 aa, Artificial Sequence
  source: /note="Description of Artificial Sequence: Synthetic polypeptide"
  source: /note="p.E395K"
AMDRHYFQNTGAYDSLMSLRGGENLKKLSFKAWLCGGSVEILPCSRVGHIYQ

SEQ ID NO: 1284 - protein, 52 aa, Artificial Sequence
  source: /note="Description of Artificial Sequence: Synthetic polypeptide"
  source: /note="p.A45T"
TALLFIYLHHNHVSSWQKKSQEPLSTTWSPGKKVHQQIIYGSEQIPKPHVIV

SEQ ID NO: 1285 - protein, 52 aa, Artificial Sequence
  source: /note="Description of Artificial Sequence: Synthetic polypeptide"
  source: /note="p.R262I"
LEPLLHAIAKDPKMVVCPLIDVIDDIITLEYKPSPLVRGTFDWNLQFKWDNV

SEQ ID NO: 1286 - protein, 53 aa, Artificial Sequence
  source: /note="Description of Artificial Sequence: Synthetic polypeptide"
  source: /note="p.K567del"
WGYRKDRTLFHPVSNSCMDCNPAEKIFMARCDPLSETQQWIFEHINMTVLEKF

SEQ ID NO: 1287 - protein, 52 aa, Artificial Sequence
  source: /note="Description of Artificial Sequence: Synthetic polypeptide"
  source: /note="p.P42A"
LLLLPPRLLARPSLLLRRSLSAASCAAPISLPAAASRSSMDGAGAEEVLAPL

SEQ ID NO: 1288 - protein, 31 aa, Artificial Sequence
  source: /note="Description of Artificial Sequence: Synthetic polypeptide"
  source: /note="p.K807fs"
IESMQINGSVLKNGSLTNHFSFEKKRPEWLS

SEQ ID NO: 1289 - protein, 52 aa, Artificial Sequence
  source: /note="Description of Artificial Sequence: Synthetic polypeptide"
  source: /note="p.D189A"
AAPTLVQLEEEIEEEVRRELALPPPAAPSPPAPPRRQPCHFRNLDQMVQSLV

SEQ ID NO: 1290 - protein, 73 aa, Artificial Sequence
  source: /note="Description of Artificial Sequence: Synthetic polypeptide"
  source: /note="p.G150fs"
CDRKGTQACQDLMGNFFCLCKAGWGAGSATKMSTNAARRTGAASRSATTSRVASTVPATAASSSPLMAGPAKT

SEQ ID NO: 1291 - protein, 52 aa, Artificial Sequence
  source: /note="Description of Artificial Sequence: Synthetic polypeptide"
  source: /note="p.R313S"
EEMSEMQKQLANYERDKQILLCTKASSLKVREKELKDLQWEHEVLEQRFTKV

SEQ ID NO: 1292 - protein, 41 aa, Artificial Sequence
  source: /note="Description of Artificial Sequence: Synthetic polypeptide"
  source: /note="p.N334fs"
ARRAGTSCANCQTTTTTLWRRNANGGPCLQCLWALLQASQY

SEQ ID NO: 1293 - protein, 131 aa, Artificial Sequence
  source: /note="Description of Artificial Sequence: Synthetic polypeptide"
  source: /note="p.H400fs"
CKKVHDSLEDFPKNSSFNPAALSRHNVLPEPHLALQPLQPHADHAHADAPAIQPVLWTTPPLQHGHRHGLEPCSMLTGPPARVPAVPFDLHFCRSSIMKPKRDGYMFLKAESKIMFATLQRSSLWCLCSNH

SEQ ID NO: 1294 - protein, 123 aa, Artificial Sequence
  source: /note="Description of Artificial Sequence: Synthetic polypeptide"
  source: /note="p.S408fs"
EDFPKNSSFNPAALSRHMSSLSHISALQPLQPHADHAHADAPAIQPVLWTTPPLQHGHRHGLEPCSMLTGPPARVPAVPFDLHFCRSSIMKPKRDGYMFLKAESKIMFATLQRSSLWCLCSNH

SEQ ID NO: 1295 - protein, 123 aa, Artificial Sequence; identical to SEQ ID NO: 1294
  source: /note="Description of Artificial Sequence: Synthetic polypeptide"
  source: /note="p.S408fs"

SEQ ID NO: 1296 - protein, 100 aa, Artificial Sequence
  source: /note="Description of Artificial Sequence: Synthetic polypeptide"
  source: /note="p.S430fs"
ISPFSHSSHMLTTPTPMHPPSSLSFWTTPPLQHGHRHGLEPCSMLTGPPARVPAVPFDLHFCRSSIMKPKRDGYMFLKAESKIMFATLQRSSLWCLCSNH

SEQ ID NO: 1297 - protein, 97 aa, Artificial Sequence
  source: /note="Description of Artificial Sequence: Synthetic polypeptide"
  source: /note="p.H434fs"
FSHSSHMLTTPTPMHPPSSLSFGPHPPLQHGHRHGLEPCSMLTGPPARVPAVPFDLHFCRSSIMKPKRDGYMFLKAESKIMFATLQRSSLWCLCSNH

SEQ ID NO: 1298 - protein, 95 aa, Artificial Sequence
  source: /note="Description of Artificial Sequence: Synthetic polypeptide"
  source: /note="p.H435fs"
HSSHMLTTPTPMHPPSSLSFGPHHPLQHGHRHGLEPCSMLTGPPARVPAVPFDLHFCRSSIMKPKRDGYMFLKAESKIMFATLQRSSLWCLCSNH

SEQ ID NO: 1299 - protein, 28 aa, Artificial Sequence
  source: /note="Description of Artificial Sequence: Synthetic peptide"
  source: /note="p.M443I"
TTPTPMHPPSSLSFGPHHPSSMVTAIIG

SEQ ID NO: 1300 - protein, 48 aa, Artificial Sequence
  source: /note="Description of Artificial Sequence: Synthetic polypeptide"
  source: /note="p.L328fs"
RRLSAARRAGTSCANCQTTTTTLWRLEEECQWGPCLQCLWALLQASQY

SEQ ID NO: 1301 - protein, 36 aa, Artificial Sequence
  source: /note="Description of Artificial Sequence: Synthetic polypeptide"
  source: /note="p.G431fs"
QAELKRLSELLTESISRGTFFVPGGAQYLLRSKKED

SEQ ID NO: 1302 - protein, 33 aa, Artificial Sequence
  source: /note="Description of Artificial Sequence: Synthetic polypeptide"
  source: /note="p.L389fs"
VSLLKRNNCGKALDIARQARDMLGGMGFLTSIT

SEQ ID NO: 1303 - protein, 52 aa, Artificial Sequence
  source: /note="Description of Artificial Sequence: Synthetic polypeptide"
  source: /note="p.R82C"
EEQLTTDEILIRDTFRTYCQERLMPCCILLANRNEVFHREIISEMGELGVLG

SEQ ID NO: 1304 - protein, 52 aa, Artificial Sequence
  source: /note="Description of Artificial Sequence: Synthetic polypeptide"
  source: /note="p.T307A"
RVLKRKTFNKVLGHVNNILISAVLPAAAFRVAKKRAPKVLGTTLVVGLLAGV

SEQ ID NO: 1305 - protein, 103 aa, Artificial Sequence
  source: /note="Description of Artificial Sequence: Synthetic polypeptide"
  source: /note="p.E105fs"
GQTGGLTQPKKDEPKKLPPRPGGPETQARTPSPNKAGYSPDCDPKRTASRRQGTPKSRICPQLLPAEEGQGARAPTRAQGAVSPTPHHTPRVHALAVQDAVRC

SEQ ID NO: 1306 - protein, 88 aa, Artificial Sequence
  source: /note="Description of Artificial Sequence: Synthetic polypeptide"
  source: /note="p.G593fs"
SVCSDNSYDTYANSTATPVGPRGGGQPHQDPHRAEWALAEDMSVPPVPDTEAGEPRRAGGSVSELGVLWERAPQPPCGLQPLVSRSLS

SEQ ID NO: 1307 - protein, 52 aa, Artificial Sequence
  source: /note="Description of Artificial Sequence: Synthetic polypeptide"
  source: /note="p.R268L"
RDSKEKNERRLAYQKRKESMPRKARLLFWGKIVAKNNKNMAFKLKSKSCHDL

SEQ ID NO: 1308 - protein, 52 aa, Artificial Sequence
  source: /note="Description of Artificial Sequence: Synthetic polypeptide"
  source: /note="p.S509L"
VMSFQSHMTLKPTCEIFHKQNSKLNLLGISPDPTLPQESISASLNSLLLPKN

SEQ ID NO: 1309 - protein, 28 aa, Artificial Sequence
  source: /note="Description of Artificial Sequence: Synthetic peptide"
  source: /note="p.A17fs"
MRLLGAAAVAALGRGRAPRLPRLAEEAG

SEQ ID NO: 1310 - protein, 52 aa, Artificial Sequence
  source: /note="Description of Artificial Sequence: Synthetic polypeptide"
  source: /note="p.Q308K"
LGTVLQVQCTCRTITQSEESLCKIFKKHMLHRKSCFNYPTLSNVKGMALYTR

SEQ ID NO: 1311 - protein, 52 aa, Artificial Sequence
  source: /note="Description of Artificial Sequence: Synthetic polypeptide"
  source: /note="p.A63V"
MSEQDWSAIQNFCEQVNTDPNGPTHVVPWLLAHKIQSPQEKEALYALTVLEM

SEQ ID NO: 1312 - protein, 52 aa, Artificial Sequence
  source: /note="Description of Artificial Sequence: Synthetic polypeptide"
  source: /note="p.R227H"
PNFEEGGPTSVGRKHEFIRSESENWHHIFREEQNGEDEDGGWRLAGSRRDGE

SEQ ID NO: 1313 - protein, 52 aa, Artificial Sequence
  source: /note="Description of Artificial Sequence: Synthetic polypeptide"
  source: /note="p.V276fs"
LLKLKYDEKIKNIREEAERNIFKDVLIGFGRCFQKYGIGFCRNVSFILPNLL

SEQ ID NO: 1314 - protein, 52 aa, Artificial Sequence
  source: /note="Description of Artificial Sequence: Synthetic polypeptide"
  source: /note="p.A544S"
SCCEKGDTFFVLVFQLGRFTEEDKTSSVAKLEAIFGADFTKYAIMLFTRKED

SEQ ID NO: 1315 - protein, 79 aa, Artificial Sequence
  source: /note="Description of Artificial Sequence: Synthetic polypeptide"
  source: /note="p.G227fs"
SRSSKCPVEAKVTSGRETLRLRSGGLPQWRKRPVSLRRRHLGRLMTCWKATWAFGTPSWRPPWWRRPRRQRAPRSLHAV

SEQ ID NO: 1316 - protein, 52 aa, Artificial Sequence
  source: /note="Description of Artificial Sequence: Synthetic polypeptide"
  source: /note="p.R123L"
KVHPNKAEFIRAKYQMLAFVHRLPCLLDDDSVTAKDLSKQLHSSVRTGNLET

SEQ ID NO: 1317 - protein, 61 aa, Artificial Sequence
  source: /note="Description of Artificial Sequence: Synthetic polypeptide"
  source: /note="p.A311fs"
YKLVTGDRNNSSCRNYNKQASEQNWVITVQNKIEWGRREAPSLTPMHSLLISPMITRILKN

SEQ ID NO: 1318 - protein, 52 aa, Artificial Sequence
  source: /note="Description of Artificial Sequence: Synthetic polypeptide"
  source: /note="p.R160H"
LIFKLIIEFLFLYLLHTLWHGFNMPHHLVQCANVAPCPNIVDCYIARPTEKK

SEQ ID NO: 1319 - protein, 48 aa, Artificial Sequence
  source: /note="Description of Artificial Sequence: Synthetic polypeptide"
  source: /note="p.R22S"
MNWAFLQGLLSGVNKYSTVLSSSIWLSVVFIFRVLVYVVAAEEVWDDE

SEQ ID NO: 1320 - protein, 52 aa, Artificial Sequence
  source: /note="Description of Artificial Sequence: Synthetic polypeptide"
  source: /note="p.I407M"
KMPYEPLTPVLYLSLWDALKYLGEPMMKSEKPINMENLPVNGGNGQSFGYIL

SEQ ID NO: 1321 - protein, 30 aa, Artificial Sequence
  source: /note="Description of Artificial Sequence: Synthetic polypeptide"
  source: /note="p.W272fs"
QEQLVHHINSEHIHGERKEFVCHWGAAPGS

SEQ ID NO: 1322 - protein, 52 aa, Artificial Sequence
  source: /note="Description of Artificial Sequence: Synthetic polypeptide"
  source: /note="p.P998L"
VHAPRRCSDGGAHGYGRRHLQPHDALLGHGVRRASDPVRTGSEGLALPRVPR

SEQ ID NO: 1323 - protein, 70 aa, Artificial Sequence
  source: /note="Description of Artificial Sequence: Synthetic polypeptide"
  source: /note="p.P1033fs"
PVRTGSEGLALPRVPRFSSLSSCNPRRWPRPRRSAVSCFRITRGPRAASPETSTRPPVLPASPRTSPWSP

SEQ ID NO: 1324 - protein, 129 aa, Artificial Sequence
  source: /note="Description of Artificial Sequence: Synthetic polypeptide"
  source: /note="p.G92fs"
IPRGSNLRFMTWDVALSRTARAWGKNVCLRIIFIYKMYKWSILNFMVLVKICGSALKMNLLQVLLSEVGMQRRKCTILKMAVALETVLIIFSLFGTTLTKLVVLLLHVQKLDILYMQQFSYATMRQEEH

SEQ ID NO: 1325 - protein, 66 aa, Artificial Sequence
  source: /note="Description of Artificial Sequence: Synthetic polypeptide"
  source: /note="p.Q223fs"
KLELQGVKGGVDHAAAFGRIAFSCPPERVARLRRLDEKGEPEDSDSPGEPGHPRESNSTGGHSGRP

SEQ ID NO: 1326 - protein, 37 aa, Artificial Sequence
  source: /note="Description of Artificial Sequence: Synthetic polypeptide"
  source: /note="p.L454I"
DTISRACFPLAFLIFNIFYWVIYKIIIRHEDIHQQQD

SEQ ID NO: 1327 - protein, 52 aa, Artificial Sequence
  source: /note="Description of Artificial Sequence: Synthetic polypeptide"
  source: /note="p.F132L"
AYSEYPDDSLDLDPSMLDSIWKPDLLLFANEKGANFHEVTTDNKLLRIFKNG

SEQ ID NO: 1328 - protein, 52 aa, Artificial Sequence
  source: /note="Description of Artificial Sequence: Synthetic polypeptide"
  source: /note="p.A178V"
IYLDDDVIVQGDIQELYDTTLALGHVVAAFSDDCDLPSAQDINRLVGLQNTY

SEQ ID NO: 1329 - protein, 52 aa, Artificial Sequence
  source: /note="Description of Artificial Sequence: Synthetic polypeptide"
  source: /note="p.Q389R"
RHQELFRLRGIKAQVALRLAELARRRRRRRQARREAEADKPRRLGRLKYQAP

SEQ ID NO: 1330 - protein, 39 aa, Artificial Sequence
  source: /note="Description of Artificial Sequence: Synthetic polypeptide"
  source: /note="p.G380fs"
CYVDMSTVDADTVTELAQVIVSRGGALSGSPRLRESAAV

SEQ ID NO: 1331 - protein, 52 aa, Artificial Sequence
  source: /note="Description of Artificial Sequence: Synthetic polypeptide"
  source: /note="p.R200G"
KYFLDNLDKLGEPDYIPSQQDILLAGGRPTKGIHEYDFEIKNVPFKMVDVGG

SEQ ID NO: 1332 - protein, 52 aa, Artificial Sequence
  source: /note="Description of Artificial Sequence: Synthetic polypeptide"
  source: /note="p.P283Q"
KWFTDTSIILFLNKKDIFEEKIKKSQQLTICFPEYTGPSAFTEAVAYIQAQY

SEQ ID NO: 1333 - protein, 52 aa, Artificial Sequence
  source: /note="Description of Artificial Sequence: Synthetic polypeptide"
  source: /note="p.R844C"
QYFLDKIDVIKQADYVPSDQDLLRCCCVLTSGIFETKFQVDKVNFHMFDVGG

SEQ ID NO: 1334 - protein, 52 aa, Artificial Sequence
  source: /note="Description of Artificial Sequence: Synthetic polypeptide"
  source: /note="p.R844H"
QYFLDKIDVIKQADYVPSDQDLLRCHHVLTSGIFETKFQVDKVNFHMFDVGG

SEQ ID NO: 1335 - protein, 52 aa, Artificial Sequence
  source: /note="Description of Artificial Sequence: Synthetic polypeptide"
  source: /note="p.I80T"
LAKIYAMHWGTDSRLLVSASQDGKLTTIWDSYTTNKVHAIPLRSSWVMTCAY

SEQ ID NO: 1336 - protein, 46 aa, Artificial Sequence
  source: /note="Description of Artificial Sequence: Synthetic polypeptide"
  source: /note="p.T68fs"
CEEHARSDPLLIGIPTSENPFKDKKLASSYSGIEKQLLASSQQRKL

SEQ ID NO: 1337 - protein, 31 aa, Artificial Sequence
  source: /note="Description of Artificial Sequence: Synthetic polypeptide"
  source: /note="p.F54fs"
AISPTHPGEGLVLRPLCTADLNRGFLRYWVS

SEQ ID NO: 1338 - protein, 52 aa, Artificial Sequence
  source: /note="Description of Artificial Sequence: Synthetic polypeptide"
  source: /note="p.R1189Q"
VKAVLRDFYESMFPIPSQFELPREYQQNRFLHMHELQEWRAYRDKLKFWTHC

SEQ ID NO: 1339 - protein, 52 aa, Artificial Sequence
  source: /note="Description of Artificial Sequence: Synthetic polypeptide"
  source: /note="p.Q1536H"
KKESNLETELKSQTARIMELEDHITHHKTIEIESLNEVLKNYNQQKDIEHKE

SEQ ID NO: 1340 - protein, 52 aa, Artificial Sequence
  source: /note="Description of Artificial Sequence: Synthetic polypeptide"
  source: /note="p.L492I"
ELEELRHEKEMQREEIQKLMGQIHQIIRSELQDMEAQQVNEAESAREQLQDL

SEQ ID NO: 1341 - protein, 52 aa, Artificial Sequence
  source: /note="Description of Artificial Sequence: Synthetic polypeptide"
  source: /note="p.R355W"
ILNTPDLRKQWLQEVKVMADRIIGMWWTQLVSNLKKEGSTHNWQHITDQIGM

SEQ ID NO: 1342 - protein, 52 aa, Artificial Sequence
  source: /note="Description of Artificial Sequence: Synthetic polypeptide"
  source: /note="p.S41L"
LALVSCILTQASAVQRGYGNPIEASLLYGLDLDCGAPGTPEAHVCFDPCQNY

SEQ ID NO: 1343 - protein, 40 aa, Artificial Sequence
  source: /note="Description of Artificial Sequence: Synthetic polypeptide"
  source: /note="p.K210fs"
FLARLKGQDPGAPQLQSESKPPKKKEKEKEAERGGRSYSI

SEQ ID NO: 1344 - protein, 97 aa, Artificial Sequence
  source: /note="Description of Artificial Sequence: Synthetic polypeptide"
  source: /note="p.K210fs"
AFLARLKGQDPGAPQLQSESKPPKKRKRKGGRKRRKKLQHLKGMMQMRSTQNMLSRTSEKARRRKGDIKKERSQMKERVQLKGMRRRTLQEQVGLGN

SEQ ID NO: 1345 - protein, 52 aa, Artificial Sequence
  source: /note="Description of Artificial Sequence: Synthetic polypeptide"
  source: /note="p.R347L"
LVNDAVLQAHLNGQKLLEQVNRICGLLPVRTPTQSPRCSFDQSKEKHGMKTT

SEQ ID NO: 1346 - protein, 52 aa, Artificial Sequence
  source: /note="Description of Artificial Sequence: Synthetic polypeptide"
  source: /note="p.A214T"
CVSKYTDQLKPFGDVPRKLKIQVTRTTFIAARTFVQGLTVGREVANRVSKVS

SEQ ID NO: 1347 - protein, 52 aa, Artificial Sequence
  source: /note="Description of Artificial Sequence: Synthetic polypeptide"
  source: /note="p.R717Q"
TRMYALTSDAQPLLLSTFSGDRRFSQQFGGVLHLSDLDDDGLDEIIMAAPLR

SEQ ID NO: 1348 - protein, 52 aa, Artificial Sequence
  source: /note="Description of Artificial Sequence: Synthetic polypeptide"
  source: /note="p.A50V"
IPYASLIATILLYAGVALFCGCGHEVVLSGTVNILQTYFEMARTAGDTLDVF

SEQ ID NO: 1349 - protein, 52 aa, Artificial Sequence
  source: /note="Description of Artificial Sequence: Synthetic polypeptide"
  source: /note="p.I174M"
GQSHHNVFPDGKPFPHHPGWRRWNFMMYVFHTLGQYFQKLGRCSVRVSVNTA

SEQ ID NO: 1350 - protein, 18 aa, Artificial Sequence
  source: /note="Description of Artificial Sequence: Synthetic peptide"
  source: /note="p.C3fs"
MECLLFPGISAPGCKIAT

SEQ ID NO: 1351 - protein, 52 aa, Artificial Sequence
  source: /note="Description of Artificial Sequence: Synthetic polypeptide"
  source: /note="p.R443G"
TALPLNFSRKFIDWKGIPVNKSQLKGGGYSYQIKMCPQNTSIPIRGRVLIGS

SEQ ID NO: 1352 - protein, 52 aa, Artificial Sequence
  source: /note="Description of Artificial Sequence: Synthetic polypeptide"
  source: /note="p.S1283Y"
KDQMTISLGKTPRTMEVTEMSPSKNYYFISYSRGTPSLEMTDTGFPETTKIS

SEQ ID NO: 1353 - protein, 52 aa, Artificial Sequence
  source: /note="Description of Artificial Sequence: Synthetic polypeptide"
  source: /note="p.L630P"
PRTPHCVGKKVPQPVGAADLAPDTSPPCRKEGSSASRSCRPGPGHLTRREED

SEQ ID NO: 1354 - protein, 52 aa, Artificial Sequence
  source: /note="Description of Artificial Sequence: Synthetic polypeptide"
  source: /note="p.R113Q"
LSNNKISELKNGSFSGLSLLERLDLQQNNLISSIDPGAFWGLSSLKRLDLTN

SEQ ID NO: 1355 - protein, 52 aa, Artificial Sequence
  source: /note="Description of Artificial Sequence: Synthetic polypeptide"
  source: /note="p.G240C"
KISKMSLANIYLESKGSSVCQVTAICCVTVILLYTSRACYNLFILSFSQNKS

SEQ ID NO: 1356 - protein, 52 aa, Artificial Sequence
  source: /note="Description of Artificial Sequence: Synthetic polypeptide"
  source: /note="p.F754L"
PVPSGCASLSSQHSYFDTESSSSDELLFCRCHRPYCEICFQSSSDSSDSGTS

SEQ ID NO: 1357 - protein, 52 aa, Artificial Sequence
  source: /note="Description of Artificial Sequence: Synthetic polypeptide"
  source: /note="p.D566N"
LIGWTSSVCQNLEKQISLIGQGKTSNNHLIFNMCLIDRWDYMTAVAEFLFLL

SEQ ID NO: 1358 - protein, 52 aa, Artificial Sequence
  source: /note="Description of Artificial Sequence: Synthetic polypeptide"
  source: /note="p.P762T"
NPHLQKKRCSKKGLGRSIMRRITEITTETVSRQCSKEDKEGADHGTAKGTAL

SEQ ID NO: 1359 - protein, 37 aa, Artificial Sequence
  source: /note="Description of Artificial Sequence: Synthetic polypeptide"
  source: /note="p.G517fs"
AEAKINLFGEEALPGVLVTARTVPGAASGAAEAAELL

SEQ ID NO: 1360 - protein, 52 aa, Artificial Sequence
  source: /note="Description of Artificial Sequence: Synthetic polypeptide"
  source: /note="p.R216H"
FTLFIVMMLYAPAALIVCFTYFNIFHHICQQHTKDISERQARFSSQSGETGE

SEQ ID NO: 1361 - protein, 110 aa, Artificial Sequence
  source: /note="Description of Artificial Sequence: Synthetic polypeptide"
  source: /note="p.AAAAATAAGGPDTGEWGPPA36del"
AAMNASAASLNDSQVVVVAAEGAAALGAGGGANGSLELSSQLSAGPPGLLLPAVNPWDVLLCVSGTVIAGENALVVALIASTPALRTPMFVLVGSLATADLLAGCGLILH

SEQ ID NO: 1362 - protein, 52 aa, Artificial Sequence
  source: /note="Description of Artificial Sequence: Synthetic polypeptide"
  source: /note="p.R4142W"
RFTIQLISIDEVEISPVKGSASIIIWWGDKRASGEVGIAPSSRHILIGEPSA

SEQ ID NO: 1363 - protein, 52 aa, Artificial Sequence
  source: /note="Description of Artificial Sequence: Synthetic polypeptide"
  source: /note="p.G4307W"
QRVNITIIRSSGDFGHVRLWYKTMSWWTAEAGLDFVPAAGELLFEAGEMRKS

SEQ ID NO: 1364 - protein, 52 aa, Artificial Sequence
  source: /note="Description of Artificial Sequence: Synthetic polypeptide"
  source: /note="p.Y6152F"
AYRHFWMLVLFVIFNSLQGLYVFMVFFFILHNQMCCPMKASYTVEMNGHPGP

SEQ ID NO: 1365 - protein, 52 aa, Artificial Sequence
  source: /note="Description of Artificial Sequence: Synthetic polypeptide"
  source: /note="p.S706L"
KEPCMYPAGGGSWKSRPEEEEDIVNLLWFWSRKYTKPEAIIGSWLWATEESN

SEQ ID NO: 1366 - protein, 52 aa, Artificial Sequence
  source: /note="Description of Artificial Sequence: Synthetic polypeptide"
  source: /note="p.V30I"
VPDGCRNGLKSKYYRLCDKAEAWGIIILETVATAGVVTSVAFMLTLPILVCK

SEQ ID NO: 1367 - protein, 75 aa, Artificial Sequence
  source: /note="Description of Artificial Sequence: Synthetic polypeptide"
  source: /note="p.231_239RKEDPGSLR>R"
KEDLGSLGKVDPLCSSKTYTVSPRKRVDPVSSDKVDPVFPRKEEPRYSGKEHPVSSEKVAPTSAEKVDLVLSGKR

SEQ ID NO: 1368 - protein, 39 aa, Artificial Sequence
  source: /note="Description of Artificial Sequence: Synthetic polypeptide"
  source: /note="p.R446H"
APASEDSLSVEGRRGPLRAVMQSLRHHPSCCGCSGAAPE

SEQ ID NO: 1369 - protein, 52 aa, Artificial Sequence
  source: /note="Description of Artificial Sequence: Synthetic polypeptide"
  source: /note="p.T100P"
ARASGPKARPSAGGHWWSSTVGNVSPPMGGSDLCRLRAPSAAAMQRSHSDLV

SEQ ID NO: 1370 - protein, 52 aa, Artificial Sequence
  source: /note="Description of Artificial Sequence: Synthetic polypeptide"
  source: /note="p.V241M"
KAAEQLATTTCHALPPAALLCGMREMMRAGGCCHALPATGILAFPKLVASVS

SEQ ID NO: 1371 - protein, 39 aa, Artificial Sequence
  source: /note="Description of Artificial Sequence: Synthetic polypeptide"
  source: /note="p.R633fs"
PSDPMGDSSPGSGKKTPSRSVKASPPGPAASASSSRSKS

SEQ ID NO: 1372 - protein, 36 aa, Artificial Sequence
  source: /note="Description of Artificial Sequence: Synthetic polypeptide"
  source: /note="p.R10P"
MQRAAALVRPPGCGPRTPSSWGRSQSSAAAEASAVL

SEQ ID NO: 1373 - protein, 52 aa, Artificial Sequence
  source: /note="Description of Artificial Sequence: Synthetic polypeptide"
  source: /note="p.I123M"
DFLLQGRLYISPNWLCFHASLFGKDMMKVVIPVVSVQMIKKHKMARLLPNGL

SEQ ID NO: 1374 - protein, 52 aa, Artificial Sequence
  source: /note="Description of Artificial Sequence: Synthetic polypeptide"
  source: /note="p.E69D"
GYVPKNFIDIQFPKWFHEGLSRHQADDNLLMGKEVGFFIIRASQSSPGDFSI

SEQ ID NO: 1375 - protein, 52 aa, Artificial Sequence
  source: /note="Description of Artificial Sequence: Synthetic polypeptide"
  source: /note="p.A300T"
RHLQFFSEFGNSDIYVSLAGKKKHGTTPTNYGFCFKPNKAGGPRDLKMLCAE

SEQ ID NO: 1376 - protein, 52 aa, Artificial Sequence
  source: /note="Description of Artificial Sequence: Synthetic polypeptide"
  source: /note="p.R239L"
ISHEDLIQNFLNAGSFPEIQGFLQLLLGSGRKLWKRFFCFLRRSGLYYSTKG

SEQ ID NO: 1377 - protein, 52 aa, Artificial Sequence
  source: /note="Description of Artificial Sequence: Synthetic polypeptide"
  source: /note="p.S344Y"
ESPSAPDGGCPQGGGNRAKYESAGMYYCVPQVGLVGPASVTFPVVASGEPVS

SEQ ID NO: 1378 - protein, 37 aa, Artificial Sequence
  source: /note="Description of Artificial Sequence: Synthetic polypeptide"
  source: /note="p.G608W"
LVNMDDNIVKHYSNEDTFQLQIEEAWWGSYKLTLTEI

SEQ ID NO: 1379 - protein, 52 aa, Artificial Sequence
  source: /note="Description of Artificial Sequence: Synthetic polypeptide"
  source: /note="p.R218C"
EGYRMLFQDLEKKKERLVVVDCESECCLNAILGQIIKLEKNGIGYHYILANL

SEQ ID NO: 1380 - protein, 52 aa, Artificial Sequence
  source: /note="Description of Artificial Sequence: Synthetic polypeptide"
  source: /note="p.R845Q"
LVGGLGLAMLVALIEFCYKSRAEAKQQMKVAKNAQNINPSSSQNSQNFATYK

SEQ ID NO: 1381 - protein, 52 aa, Artificial Sequence
  source: /note="Description of Artificial Sequence: Synthetic polypeptide"
  source: /note="p.E622K"
PRPSASATLHSAIWIVYGAFVQQGGKKSSVNSMAMRIVMGSWWLFTLIVCSS

SEQ ID NO: 1382 - protein, 52 aa, Artificial Sequence
  source: /note="Description of Artificial Sequence: Synthetic polypeptide"
  source: /note="p.R683L"
VSRMDNPIRTFQDLSKQVEMSYGTVLLDSAVYEYFRAKGTNPLEQDSTFAEL

SEQ ID NO: 1383 - protein, 58 aa, Artificial Sequence
  source: /note="Description of Artificial Sequence: Synthetic polypeptide"
  source: /note="p.T649fs"
YTTLATRMMMGAWWLFALIVISSYTQTSLLSSLLHALKVPSSLSRTFPSKQKSLMAQS

SEQ ID NO: 1384 - protein, 52 aa, Artificial Sequence
  source: /note="Description of Artificial Sequence: Synthetic polypeptide"
  source: /note="p.R368Q"
VSSLQCHRHKPWRLGPRFMNLIKEAQQWDGLTGHITFNKTNGLRKDFDLDII

SEQ ID NO: 1385 - protein, 52 aa, Artificial Sequence
  source: /note="Description of Artificial Sequence: Synthetic polypeptide"
  source: /note="p.R519Q"
WNGMIGEVVMKRAYMAVGSLTINEEQQSEVVDFSVPFIETGISVMVSRSNGT

SEQ ID NO: 1386 - protein, 26 aa, Artificial Sequence
  source: /note="Description of Artificial Sequence: Synthetic peptide"
  source: /note="p.K22fs"
MELENIVANSLLLKARQGGYGKKKWS

SEQ ID NO: 1387 - protein, 52 aa, Artificial Sequence
  source: /note="Description of Artificial Sequence: Synthetic polypeptide"
  source: /note="p.F682L"
SALLTKTNCIARIFDGVKNGAQRPKLLISPSSQVFICLGLILVQIVMVSVWL

SEQ ID NO: 1388 - protein, 52 aa, Artificial Sequence
  source: /note="Description of Artificial Sequence: Synthetic polypeptide"
  source: /note="p.R183C"
ANLLRLFQIPQISYASTSAKLSDKSCCYDYFARTVPPDFYQAKAMAEILRFF

SEQ ID NO: 1389 - protein, 50 aa, Artificial Sequence
  source: /note="Description of Artificial Sequence: Synthetic polypeptide"
  source: /note="p.P895fs"
SSGETLRYKDRRLAQHKSEIECFTPQREYGEWWESNNEQFQWKIRHVGPE

SEQ ID NO: 1390 - protein, 52 aa, Artificial Sequence
  source: /note="Description of Artificial Sequence: Synthetic polypeptide"
  source: /note="p.E363D"
GFDQYFMTRSLENNRRNIWFAEFWEDDNFNCKLTSSGTQSDDSTRKCTGEER

SEQ ID NO: 1391 - protein, 33 aa, Artificial Sequence
  source: /note="Description of Artificial Sequence: Synthetic polypeptide"
  source: /note="p.A718fs"
SPTSQLVITFSLTSLQVVGMIAWLGGPAPTQRD

SEQ ID NO: 1392 - protein, 52 aa, Artificial Sequence
  source: /note="Description of Artificial Sequence: Synthetic polypeptide"
  source: /note="p.R679Q"
VCSFRRVFLGLGMCISYAALLTKTNQQIYRIFEQGKKSVTAPRLISPTSQLA

SEQ ID NO: 1393 - protein, 52 aa, Artificial Sequence
  source: /note="Description of Artificial Sequence: Synthetic polypeptide"
  source: /note="p.R852C"
SVSLGMLYMPKVYIIIFHPEQNVQKCCKRSFKAVVTAATMQSKLIQKGNDRP

SEQ ID NO: 1394 - protein, 52 aa, Artificial Sequence
  source: /note="Description of Artificial Sequence: Synthetic polypeptide"
  source: /note="p.R192L"
AMPKKDARTLLARFNEQIEPIYALLLLETEDVNLAYEILEPEPTEIPALKQS

SEQ ID NO: 1395 - protein, 52 aa, Artificial Sequence
  source: /note="Description of Artificial Sequence: Synthetic polypeptide"
  source: /note="p.K306N"
HAGCGKTFAMKQSLTRHAVVHDPDKNNKMKLKVKKSREKRSLASHLSGYIPP

SEQ ID NO: 1396 - protein, 31 aa, Artificial Sequence
  source: /note="Description of Artificial Sequence: Synthetic polypeptide"
  source: /note="p.S767fs"
KEGPSGSGDSQLSASSRSESGRMKKVIIKWA

SEQ ID NO: 1397 - protein, 42 aa, Artificial Sequence
  source: /note="Description of Artificial Sequence: Synthetic polypeptide"
  source: /note="p.E562fs"
LIDLVRWKILKDKHIPQFLQEALEKRLKAVESPIFGVLSFSS

SEQ ID NO: 1398 - protein, 52 aa, Artificial Sequence
  source: /note="Description of Artificial Sequence: Synthetic polypeptide"
  source: /note="p.G549C"
NFTEKQKIELNKLLQIDYYNLTKFYCCTVKLDTMIFGVIEYCERGSLREVLN

SEQ ID NO: 1399 - protein, 52 aa, Artificial Sequence
  source: /note="Description of Artificial Sequence: Synthetic polypeptide"
  source: /note="p.C500R"
PSRPVTFVSNSNYAADKGAPYVDVIRRLNSYYSWYHDYGHLELIQLQLATQF

SEQ ID NO: 1400 - protein, 52 aa, Artificial Sequence
  source: /note="Description of Artificial Sequence: Synthetic polypeptide"
  source: /note="p.L501V"
SRPVTFVSNSNYAADKGAPYVDVICVVNSYYSWYHDYGHLELIQLQLATQFE

SEQ ID NO: 1401 - protein, 29 aa, Artificial Sequence
  source: /note="Description of Artificial Sequence: Synthetic peptide"
  source: /note="p.L223fs"
SQRLFLPLILKEVDSLLYVDTDILFFTTS

SEQ ID NO: 1402 - protein, 61 aa, Artificial Sequence
  source: /note="Description of Artificial Sequence: Synthetic polypeptide"
  source: /note="p.A214fs"
PGAATEKARKQGGAAKDTRAQSGEAKEGAPQARQGHAGTFQCWWAQQEGKGQRQQEQPRRC

SEQ ID NO: 1403 - protein, 30 aa, Artificial Sequence
  source: /note="Description of Artificial Sequence: Synthetic polypeptide"
  source: /note="p.Q125R"
LIKATIAGGGVIPHIHKSLIGKKGQRRKTA

SEQ ID NO: 1404 - protein, 77 aa, Artificial Sequence
  source: /note="Description of Artificial Sequence: Synthetic polypeptide"
  source: /note="p.K144fs"
GKSETILSPPPEKRGRKATSGKKGGRNPRLPNHGRPKSPNQRTAIKKELQIPPLKMGQGMDSPFCLLRALFWDRSCP

SEQ ID NO: 1405 - protein, 31 aa, Artificial Sequence
  source: /note="Description of Artificial Sequence: Synthetic polypeptide"
  source: /note="p.R131L"
DTNLCAIHAKRVTIMPKDIQLARRILLGERA

SEQ ID NO: 1406 - protein, 52 aa, Artificial Sequence
  source: /note="Description of Artificial Sequence: Synthetic polypeptide"
  source: /note="p.R172C"
AEKMGYKAIFVTVDTPYLGNRLDDVCCNRFKLPPQLRMKNFETSTLSFSPEE

SEQ ID NO: 1407 - protein, 38 aa, Artificial Sequence
  source: /note="Description of Artificial Sequence: Synthetic polypeptide"
  source: /note="p.H12N"
MSLVCLTDFQANNAREQLSKSTRDFIEGGADDSITRDD

SEQ ID NO: 1408 - protein, 52 aa, Artificial Sequence
  source: /note="Description of Artificial Sequence: Synthetic polypeptide"
  source: /note="p.R168H"
NKVKKMKRYHVGKVWRRESPTIVQGHHYREFCQCDFDIAGQFDPMIPDAECL

SEQ ID NO: 1409 - protein, 36 aa, Artificial Sequence
  source: /note="Description of Artificial Sequence: Synthetic polypeptide"
  source: /note="p.S530fs"
ENSPLSDVAKNTESSAFGGSLPAKKVIHFKKSKIIW

SEQ ID NO: 1410 - protein, 52 aa, Artificial Sequence
  source: /note="Description of Artificial Sequence: Synthetic polypeptide"
  source: /note="p.F42L"
GKVNVDEVGGEALGRLLVVYPWTQRLLFESFGDLSTPDAVMGNPKVKAHGKK

SEQ ID NO: 1411 - protein, 52 aa, Artificial Sequence
  source: /note="Description of Artificial Sequence: Synthetic polypeptide"
  source: /note="p.F86C"
VKAHGKKVLGAFSDGLAHLDNLKGTCCATLSELHCDKLHVDPENFRLLGNVL

SEQ ID NO: 1412 - protein, 52 aa, Artificial Sequence
  source: /note="Description of Artificial Sequence: Synthetic polypeptide"
  source: /note="p.G499V"
PLFANADPNFVTAMLSKLRFEVFQPVVDYIIREGAVGKKMYFIQHGVAGVIT

SEQ ID NO: 1413 - protein, 52 aa, Artificial Sequence
  source: /note="Description of Artificial Sequence: Synthetic polypeptide"
  source: /note="p.R659L"
QAIAPINYPQMTTLNSTSSTTTPTSLLMRTQSPPVYTATSLSHSNLHSPSPS

SEQ ID NO: 1414 - protein, 52 aa, Artificial Sequence
  source: /note="Description of Artificial Sequence: Synthetic polypeptide"
  source: /note="p.A714S"
QPSAILSPCSYTTAVCSPPVQSPLASSRTFHYASPTASQLSLMQQQPQQQVQ

SEQ ID NO: 1415 - protein, 52 aa, Artificial Sequence
  source: /note="Description of Artificial Sequence: Synthetic polypeptide"
  source: /note="p.P231Q"
IILDPKVIKMNYLKSWFVVDFISSIQQVDYIFLIVEKGMDSEVYKTARALRI

SEQ ID NO: 1416 - protein, 52 aa, Artificial Sequence
  source: /note="Description of Artificial Sequence: Synthetic polypeptide"
  source: /note="p.P326T"
LIGMMLLLCHWDGCLQFLVPLLQDFTTPDCWVSLNEMVNDSWGKQYSYALFK

SEQ ID NO: 1417 - protein, 52 aa, Artificial Sequence
  source: /note="Description of Artificial Sequence: Synthetic polypeptide"
  source: /note="p.R525H"
IVGATCYAMFIGHATALIQSLDSSRHHQYQEKYKQVEQYMSFHKLPPDTRQR

SEQ ID NO: 1418 - protein, 22 aa, Artificial Sequence
  source: /note="Description of Artificial Sequence: Synthetic peptide"
  source: /note="p.S9fs"
MSGTKLEDSPPLSQLVICFGAE

SEQ ID NO: 1419 - protein, 20 aa, Artificial Sequence
  source: /note="Description of Artificial Sequence: Synthetic peptide"
  source: /note="p.S9fs"
MSGTKLEDSPLVATGHLLRS

SEQ ID NO: 1420 - protein, 52 aa, Artificial Sequence
  source: /note="Description of Artificial Sequence: Synthetic polypeptide"
  source: /note="p.D100Y"
VCVAVWKNHHMRTVTNYFIVNLSLAYYVLVTITCLPATLVVDITETWFFGQS

SEQ ID NO: 1421 - protein, 79 aa, Artificial Sequence
  source: /note="Description of Artificial Sequence: Synthetic polypeptide"
  source: /note="p.P901fs"
PDEVGTGPGVGFNVNMAFTGGLDPPWETLSTWRPSERWSCRSPASLPRMWCWCHQASMPWRATPPLLGATTSPPDASGT

SEQ ID NO: 1422 - protein, 52 aa, Artificial Sequence
  source: /note="Description of Artificial Sequence: Synthetic polypeptide"
  source: /note="p.A1044T"
CVSALLSVELQPLDEAVLQQKPNINTTVATLEKVIEIQSKHWSCVQKFAAGL

SEQ ID NO: 1423 - protein, 52 aa, Artificial Sequence
  source: /note="Description of Artificial Sequence: Synthetic polypeptide"
  source: /note="p.R503C"
SNLIRIEGDPQGVQQAKRELLELASCCMENERTKDLIIEQRFHRTIIGQKGE

SEQ ID NO: 1424 - protein, 51 aa, Artificial Sequence
  source: /note="Description of Artificial Sequence: Synthetic polypeptide"
  source: /note="p.G747fs"
EKQTKSFTVDIRAKPEYHKFLIGKGAAKFARCATALEHVSSSLRLRTRTRT

SEQ ID NO: 1425 - protein, 52 aa, Artificial Sequence
  source: /note="Description of Artificial Sequence: Synthetic polypeptide"
  source: /note="p.E1109K"
TVVVNLLQKPLPFDRDTKTLWKALAKKKPASSGKLLQALIDKLETELEDDIA

SEQ ID NO: 1426 - protein, 49 aa, Artificial Sequence
  source: /note="Description of Artificial Sequence: Synthetic polypeptide"
  source: /note="p.R333fs"
MAGGHVFRNAHFDYSPAGLAVHRGGTLRHPRAVPSAAGPLRTPHSHPQA

SEQ ID NO: 1427 - protein, 45 aa, Artificial Sequence
  source: /note="Description of Artificial Sequence: Synthetic polypeptide"
  source: /note="p.P19A"
MSEAVRVPSPATPLVVAAAAAPEERKGKESEREKLPPIVSAGAGA

SEQ ID NO: 1428 - protein, 52 aa, Artificial Sequence
  source: /note="Description of Artificial Sequence: Synthetic polypeptide"
  source: /note="p.A183S"
ICFKYYHGVSGALRATTPSVTVKNSSSAPIFKSIGADETVQGQGSRRLISFS

SEQ ID NO: 1429 - protein, 52 aa, Artificial Sequence
  source: /note="Description of Artificial Sequence: Synthetic polypeptide"
  source: /note="p.R2330H"
PVLAVIGGVDAGLRVGGRCVHKQTGHHHATLLGVVKEGSTSAKVQWDEAEIT

SEQ ID NO: 1430 - protein, 52 aa, Artificial Sequence
  source: /note="Description of Artificial Sequence: Synthetic polypeptide"
  source: /note="p.S329F"
SQMLSAILLLLQLWDSGAQETDNERFFAQGTSAPLLPLLQRFQSIICRKDAP

SEQ ID NO: 1431 - protein, 52 aa, Artificial Sequence
  source: /note="Description of Artificial Sequence: Synthetic polypeptide"
  source: /note="p.P96T"
SCLPGVSQLLRRGDEVGSGLRCPLVTTESAAGSTMDSAGLGQEAPALFRPCT

SEQ ID NO: 1432 - protein, 52 aa, Artificial Sequence
  source: /note="Description of Artificial Sequence: Synthetic polypeptide"
  source: /note="p.T482P"
CRSWRLPCSWLSTRMPWRSGWRKTCPPPACSGCKLCCRTSARCLPPRCHPPA

SEQ ID NO: 1433 - protein, 52 aa, Artificial Sequence
  source: /note="Description of Artificial Sequence: Synthetic polypeptide"
  source: /note="p.S467Y"
NPDDDAHGPWCYTGNPLIPWDYCPIYYRCEGDTTPTIVNLDHPVISCAKTKQ

SEQ ID NO: 1434 - protein, 52 aa, Artificial Sequence
  source: /note="Description of Artificial Sequence: Synthetic polypeptide"
  source: /note="p.M686T"
AEKIGSGPCEGDYGGPLVCEQHKMRTTVLGVIVPGRGCAIPNRPGIFVRVAY

SEQ ID NO: 1435 - protein, 52 aa, Artificial Sequence
  source: /note="Description of Artificial Sequence: Synthetic polypeptide"
  source: /note="p.G229A"
PQCSEVECMTCNGESYRGLMDHTESAAKICQRWDHQTPHRHKFLPERYPDKG

SEQ ID NO: 1436 - protein, 52 aa, Artificial Sequence
  source: /note="Description of Artificial Sequence: Synthetic polypeptide"
  source: /note="p.V692A"
AFRDGEVRLVRPAGLSSGSGRVEVFAAGGRWGTVCDDSWNISGAAVVCRQLG

SEQ ID NO: 1437 - protein, 52 aa, Artificial Sequence
  source: /note="Description of Artificial Sequence: Synthetic polypeptide"
  source: /note="p.A72T"
VSAHLDKASIMRLTISYLRMHRLCATTGEWNQVGAGGEPLDACYLKALEGFV

SEQ ID NO: 1438 - protein, 52 aa, Artificial Sequence
  source: /note="Description of Artificial Sequence: Synthetic polypeptide"
  source: /note="p.R940L"
AQLVAASKVKADKDSPNLAQLQQASLLGVNQATAGVVASTISGKSQIEETDN

SEQ ID NO: 1439 - protein, 52 aa, Artificial Sequence
  source: /note="Description of Artificial Sequence: Synthetic polypeptide"
  source: /note="p.R280H"
PDAANPWQLKSSADYLAETKVRPLEHHRKYMLKSLDQIETVNGGSVASRLTF

SEQ ID NO: 1440 - protein, 52 aa, Artificial Sequence
  source: /note="Description of Artificial Sequence: Synthetic polypeptide"
  source: /note="p.K188N"
AAAGVKKVAKSPKKAKAAAKPKKATNNSPAKPKAVKPKAAKPKAAKPKAAKP

SEQ ID NO: 1441 - protein, 52 aa, Artificial Sequence
  source: /note="Description of Artificial Sequence: Synthetic polypeptide"
  source: /note="p.A65V"
VSELITKAVAASKERSGVSLAALKKVVLAAAGYDVEKNNSRIKLGLKSLVSK

SEQ ID NO: 1442 - protein, 52 aa, Artificial Sequence
  source: /note="Description of Artificial Sequence: Synthetic polypeptide"
  source: /note="p.I81M"
SGVSLAALKKALAAAGYDVEKNNSRMMKLGLKSLVSKGTLVQTKGTGASGSF

SEQ ID NO: 1443 - protein, 52 aa, Artificial Sequence
  source: /note="Description of Artificial Sequence: Synthetic polypeptide"
  source: /note="p.G133A"
NKKAASGEAKPKAKKAGAAKAKKPAAAAAKKPKKATGAATPKKSAKKTPKKA

SEQ ID NO: 1444 - protein, 51 aa, Artificial Sequence
  source: /note="Description of Artificial Sequence: Synthetic polypeptide"
  source: /note="p.R25P"
MSETAPAAPAAPAPAEKTPVKKKAPPKSAGAAKRKASGPPVSELITKAVAA

SEQ ID NO: 1445 - protein, 52 aa, Artificial Sequence
  source: /note="Description of Artificial Sequence: Synthetic polypeptide"
  source: /note="p.R30P"
GKQGGKARAKAKTRSSRAGLQFPVGPPVHRLLRKGNYAERVGAGAPVYLAAV

SEQ ID NO: 1446 - protein, 52 aa, Artificial Sequence
  source: /note="Description of Artificial Sequence: Synthetic polypeptide"
  source: /note="p.E77K"
DTGISSKAMGIMNSFVNDIFERIAGKKASRLAHYNKRSTITSREIQTAVRLL

SEQ ID NO: 1447 - protein, 39 aa, Artificial Sequence
  source: /note="Description of Artificial Sequence: Synthetic polypeptide"
  source: /note="p.K13R"
MPEPAKSAPAPKRRGSKKAVTKAQKKDGKKRKRSRKESY

SEQ ID NO: 1448 - protein, 52 aa, Artificial Sequence
  source: /note="Description of Artificial Sequence: Synthetic polypeptide"
  source: /note="p.A48S"
TKAARKSAPATGGVKKPHRYRPGTVSSLREIRRYQKSTELLIRKLPFQRLVR

SEQ ID NO: 1449 - protein, 52 aa, Artificial Sequence
  source: /note="Description of Artificial Sequence: Synthetic polypeptide"
  source: /note="p.E74K"
LREIRRYQKSTELLIRKLPFQRLVRKKIAQDFKTDLRFQSSAVMALQEACEA

SEQ ID NO: 1450 - protein, 52 aa, Artificial Sequence
  source: /note="Description of Artificial Sequence: Synthetic polypeptide"
  source: /note="p.K37M"
TGGKAPRKQLATKAARKSAPATGGVMMKPHRYRPGTVALREIRRYQKSTELL

SEQ ID NO: 1451 - protein, 52 aa, Artificial Sequence
  source: /note="Description of Artificial Sequence: Synthetic polypeptide"
  source: /note="p.R68P"
GVKRISGLIYEETRGVLKVFLENVIPPDAVTYTEHAKRKTVTAMDVVYALKR

SEQ ID NO: 1452 - protein, 52 aa, Artificial Sequence
  source: /note="Description of Artificial Sequence: Synthetic polypeptide"
  source: /note="p.R30P"
GKQGGKARAKAKSRSSRAGLQFPVGPPVHRLLRKGNYAERVGAGAPVYMAAV

SEQ ID NO: 1453 - protein, 52 aa, Artificial Sequence
  source: /note="Description of Artificial Sequence: Synthetic polypeptide"
  source: /note="p.G54D"
KRKRSRKESYSIYVYKVLKQVHPDTDDISSKAMGIMNSFVNDIFERIAGEAS

SEQ ID NO: 1454 - protein, 29 aa, Artificial Sequence
  source: /note="Description of Artificial Sequence: Synthetic peptide"
  source: /note="p.P534fs"
LSSHSEKTKPEQSLLSLQHPPSTAPLCLS

SEQ ID NO: 1455 - protein, 44 aa, Artificial Sequence
  source: /note="Description of Artificial Sequence: Synthetic polypeptide"
  source: /note="p.H554fs"
PSTAPPVPLLRSHSMPSAACTISTPTTPSEVATPSMTISPTPKP

SEQ ID NO: 1456 - protein, 52 aa, Artificial Sequence
  source: /note="Description of Artificial Sequence: Synthetic polypeptide"
  source: /note="p.Q78R"
DDTQFVRFDSDAASQRMEPRAPWIERREGPEYWDQETRNVKAQSQTDRVDLG

SEQ ID NO: 1457 - protein, 52 aa, Artificial Sequence
  source: /note="Description of Artificial Sequence: Synthetic polypeptide"
  source: /note="p.N104K"
EGPEYWDRNTQIYKAQAQTDRESLRKKLRGYYNQSEAGSHTLQSMYGCDVGP

SEQ ID NO: 1458 - protein, 52 aa, Artificial Sequence
  source: /note="Description of Artificial Sequence: Synthetic polypeptide"
  source: /note="p.E84K"
LSEAYDEDQLFFFDFSQNTRVPRLPKKFADWAQEQGDAPAILFDKEFCEWMI

SEQ ID NO: 1459 - protein, 50 aa, Artificial Sequence
  source: /note="Description of Artificial Sequence: Synthetic polypeptide"
  source: /note="p.A236fs"
YTAIAYWVPRNALPSDLLENVLCGVGLWPGCAGHHRGHCSHHLLPEALLR

SEQ ID NO: 1460 - protein, 36 aa, Artificial Sequence
  source: /note="Description of Artificial Sequence: Synthetic polypeptide"
  source: /note="p.G114fs"
NSQKDILEEKRAVPDRMCRHNYELGEAHDPAAPSPA

SEQ ID NO: 1461 - protein, 52 aa, Artificial Sequence
  source: /note="Description of Artificial Sequence: Synthetic polypeptide"
  source: /note="p.R247H"
AQSKMLSGIGGFVLGLIFLGLGLIIHHHRGQKGPRGPPPAGNISAMIQSGER

SEQ ID NO: 1462 - protein, 52 aa, Artificial Sequence
  source: /note="Description of Artificial Sequence: Synthetic polypeptide"
  source: /note="p.G250S"
KMLSGIGGFVLGLIFLGLGLIIRHRSSQKGPRGPPPAGNISAMIQSGERAQA

SEQ ID NO: 1463 - protein, 52 aa, Artificial Sequence
  source: /note="Description of Artificial Sequence: Synthetic polypeptide"
  source: /note="p.E362K"
LPPSSNIVQTPEDFNLLKSSNFRRYKKVLREILTTLGLSCDMKQVPALTPLY

SEQ ID NO: 1464 - protein, 38 aa, Artificial Sequence
  source: /note="Description of Artificial Sequence: Synthetic polypeptide"
  source: /note="p.S12T"
MFAAGLAPFYATTNFSLWSAAYCSSAGPGGCSFPLDPA

SEQ ID NO: 1465 - protein, 52 aa, Artificial Sequence
  source: /note="Description of Artificial Sequence: Synthetic polypeptide"
  source: /note="p.N231K"
GRPAGVHLSGLQPSAGQFFASLDPIKKEASAILSPLNSNPRNSVQHQFQDTF

SEQ ID NO: 1466 - protein, 52 aa, Artificial Sequence
  source: /note="Description of Artificial Sequence: Synthetic polypeptide"
  source: /note="p.S133Y"
RELYVQGGGDCPEMSIGAIKIALEIYYLPGSFIYVFTDARSKDYRLTHEVLQ

SEQ ID NO: 1467 - protein, 52 aa, Artificial Sequence
  source: /note="Description of Artificial Sequence: Synthetic polypeptide"
  source: /note="p.E248D"
EEFLNHSKAREAELRQLRKSNMEFEDDRNAALQKHVESMRTAVEKLEVDVIQ

SEQ ID NO: 1468 - protein, 52 aa, Artificial Sequence
  source: /note="Description of Artificial Sequence: Synthetic polypeptide"
  source: /note="p.T417M"
GHNLLSPDGKMISVSGGGLPPVSTLMMNIHSLSHHNPQQSQNLIMTPLSGVM

SEQ ID NO: 1469 - protein, 52 aa, Artificial Sequence
  source: /note="Description of Artificial Sequence: Synthetic polypeptide"
  source: /note="p.N302K"
GVSPSKAHGLGSNLVTEVRVYNWFAKKRRKEEAFRQKLAMDAYSSNQTHSLN

SEQ ID NO: 1470 - protein, 32 aa, Artificial Sequence
  source: /note="Description of Artificial Sequence: Synthetic polypeptide"
  source: /note="p.L361fs"
QVKTLQETNMMYMHNTVSLEEELKKQMQHVHN

SEQ ID NO: 1471 - protein, 37 aa, Artificial Sequence
  source: /note="Description of Artificial Sequence: Synthetic polypeptide"
  source: /note="p.G11C"
MSSYFVNSFCCCRYPNGPDYQLHNYGDHSSVSEQFRD

SEQ ID NO: 1472 - protein, 52 aa, Artificial Sequence
  source: /note="Description of Artificial Sequence: Synthetic polypeptide"
  source: /note="p.Y151C"
AEVPSYQRLVPESCPVENPEVPVPGCCFRLSQTYATGKTQEYNNSPEGSSTV

SEQ ID NO: 1473 - protein, 52 aa, Artificial Sequence
  source: /note="Description of Artificial Sequence: Synthetic polypeptide"
  source: /note="p.Q67H"
GRHAAAAAALQLYGNSAAGFPHAPPHHAHAHPHPSPPPSGTGCGGREGRGQE

SEQ ID NO: 1474 - protein, 77 aa, Artificial Sequence
  source: /note="Description of Artificial Sequence: Synthetic polypeptide"
  source: /note="p.P122fs"
GSPAAAYQAAPPPPPHPPPPPPPPPAAGLPVTGSPRSFTDTITYRDSRFLRPSKRPSWYNILTVNRPVVILARTQTT

SEQ ID NO: 1475 - protein, 54 aa, Artificial Sequence
  source: /note="Description of Artificial Sequence: Synthetic polypeptide"
  source: /note="p.R284fs"
GGAGVQHIALKTEDIITAIRHLRERPGVLICSLHVLQTTAGEAEDGQDQGEGEH

SEQ ID NO: 1476 - protein, 52 aa, Artificial Sequence
  source: /note="Description of Artificial Sequence: Synthetic polypeptide"
  source: /note="p.S468L"
NHIILLTKAEPEAIPERRQSPKRLLLLRKDTSVKIKIPPVAEAGWNLYIVNT

SEQ ID NO: 1477 - protein, 52 aa, Artificial Sequence
  source: /note="Description of Artificial Sequence: Synthetic polypeptide"
  source: /note="p.K812N"
VACLPDVVLQELFFKLTSQYIWRLSNNRQPPDTTPLRTSEDLINACSHYGLI

SEQ ID NO: 1478 - protein, 52 aa, Artificial Sequence
  source: /note="Description of Artificial Sequence: Synthetic polypeptide"
  source: /note="p.K58N"
LHLSLSSQAGDRRPLPVDRAAGLKENNTLILLDVSTKNPVRTVNENFLSLQL

SEQ ID NO: 1479 - protein, 52 aa, Artificial Sequence
  source: /note="Description of Artificial Sequence: Synthetic polypeptide"
  source: /note="p.Q61K"
IEDSYRKQVVIDGETCLLDILDTAGKKEEYSAMRDQYMRTGEGFLCVFAINN

SEQ ID NO: 1480 - protein, 52 aa, Artificial Sequence
  source: /note="Description of Artificial Sequence: Synthetic polypeptide"
  source: /note="p.Q61R"
IEDSYRKQVVIDGETCLLDILDTAGRREEYSAMRDQYMRTGEGFLCVFAINN

SEQ ID NO: 1481 - protein, 38 aa, Artificial Sequence
  source: /note="Description of Artificial Sequence: Synthetic polypeptide"
  source: /note="p.G12S"
MTEYKLVVVGASSGVGKSALTIQLIQNHFVDEYDPTIE

SEQ ID NO: 1482 - protein, 38 aa, Artificial Sequence
  source: /note="Description of Artificial Sequence: Synthetic polypeptide"
  source: /note="p.G12D"
MTEYKLVVVGADDGVGKSALTIQLIQNHFVDEYDPTIE

SEQ ID NO: 1483 - protein, 38 aa, Artificial Sequence
  source: /note="Description of Artificial Sequence: Synthetic polypeptide"
  source: /note="p.G12A"
MTEYKLVVVGAAAGVGKSALTIQLIQNHFVDEYDPTIE

SEQ ID NO: 1484 - protein, 39 aa, Artificial Sequence
  source: /note="Description of Artificial Sequence: Synthetic polypeptide"
  source: /note="p.G13V"
MTEYKLVVVGAGVVVGKSALTIQLIQNHFVDEYDPTIED

SEQ ID NO: 1485 - protein, 33 aa, Artificial Sequence
  source: /note="Description of Artificial Sequence: Synthetic polypeptide"
  source: /note="p.P439fs"
PHHHHHRVPREEDEEVSAELGHQAPQPQAKPPR

SEQ ID NO: 1486 - protein, 50 aa, Artificial Sequence
  source: /note="Description of Artificial Sequence: Synthetic polypeptide"
  source: /note="p.H92P"
LGIFHHHRHPGHVSHVPNVGLHHHHPPPRHTPHHLHHHHHPHRHHPRHAR

SEQ ID NO: 1487 - protein, 27 aa, Artificial Sequence
  source: /note="Description of Artificial Sequence: Synthetic peptide"
  source: /note="p.M1fs"
CLNSYKASSLSSMFSTNMPPSMGSMIR

SEQ ID NO: 1488 - protein, 52 aa, Artificial Sequence
  source: /note="Description of Artificial Sequence: Synthetic polypeptide"
  source: /note="p.G2539S"
QHGSGSSQSSGYGRQGSGSGQSPGHSSQRGSGSRQSPSYGRHGSGSGRSSSS

SEQ ID NO: 1489 - protein, 44 aa, Artificial Sequence
  source: /note="Description of Artificial Sequence: Synthetic polypeptide"
  source: /note="p.R120Q"
IYKQYFKSNFPARAAYQVAALPKGSQQIEIEAVAIQGPLTTASL

SEQ ID NO: 1490 - protein, 47 aa, Artificial Sequence
  source: /note="Description of Artificial Sequence: Synthetic polypeptide"
  source: /note="p.E287K"
RDRCLHESKGRAHPQVDPKLLNKLHKKYFHEPNKKFFELVGRTFDWH

SEQ ID NO: 1491 - protein, 34 aa, Artificial Sequence
  source: /note="Description of Artificial Sequence: Synthetic polypeptide"
  source: /note="p.G399W"
EIDREVVRRLREFYRPFNLKFYQMTWWHDFGWDG

SEQ ID NO: 1492 - protein, 42 aa, Artificial Sequence
  source: /note="Description of Artificial Sequence: Synthetic polypeptide"
  source: /note="p.G313S"
VPAKAEAGAEAGGGAGPGAEDEAGRSSAVGDPELGDPPAAPQ

SEQ ID NO: 1493 - protein, 52 aa, Artificial Sequence
  source: /note="Description of Artificial Sequence: Synthetic polypeptide"
  source: /note="p.F209L"
EAFSDILRREIQHFGVKISIVEPGYLLRTGMTNMTQSLERMKQSWKEAPKHI

SEQ ID NO: 1494 - protein, 52 aa, Artificial Sequence
  source: /note="Description of Artificial Sequence: Synthetic polypeptide"
  source: /note="p.R169W"
QALRGVQESTEARLRELRQQNEILWWWEVVTLRQSHGQQHRVIGKLIQCLFG

SEQ ID NO: 1495 - protein, 52 aa, Artificial Sequence
  source: /note="Description of Artificial Sequence: Synthetic polypeptide"
  source: /note="p.V85L"
DENGHISIPSMVSFTDNDVYVGYESLLELADSNPQNTIYDAKRFIGKIFTAE

SEQ ID NO: 1496 - protein, 52 aa, Artificial Sequence
  source: /note="Description of Artificial Sequence: Synthetic polypeptide"
  source: /note="p.R483C"
RIGSFTIQNVFPQSDGDSSKVKVKVCCVNIHGIFSVASASVIEKQNLEGDHS

SEQ ID NO: 1497 - protein, 52 aa, Artificial Sequence
  source: /note="Description of Artificial Sequence: Synthetic polypeptide"
  source: /note="p.R282L"
HYVESIDPVTVSINSWIELEEDHLALLVEEAITRMLVCALKTAENPQNTRAW

SEQ ID NO: 1498 - protein, 52 aa, Artificial Sequence
  source: /note="Description of Artificial Sequence: Synthetic polypeptide"
  source: /note="p.S219L"
LKIIAVWTISVGISMPIPVFGLQDDLLKVFKEGSCLLADDNFVLIGSFVSFF

SEQ ID NO: 1499 - protein, 52 aa, Artificial Sequence
  source: /note="Description of Artificial Sequence: Synthetic polypeptide"
  source: /note="p.R236C"
SVSSTYSILQSSAGGFAQIQFNVVMCCRHPLVYVVSLLIPSIFLMLVDLGSF

SEQ ID NO: 1500 - protein, 52 aa, Artificial Sequence
  source: /note="Description of Artificial Sequence: Synthetic polypeptide"
  source: /note="p.R152C"
ASIWNVTAIALDRYWSITRHMEYTLCCTRKCVSNVMIALTWALSAVISLAPL

SEQ ID NO: 1501 - protein, 52 aa, Artificial Sequence
  source: /note="Description of Artificial Sequence: Synthetic polypeptide"
  source: /note="p.W298C"
DTWREQKEQRAALMVGILIGVFVLCCCIPFFLTELISPLCSCDIPAIWKSIF

SEQ ID NO: 1502 - protein, 52 aa, Artificial Sequence
  source: /note="Description of Artificial Sequence: Synthetic polypeptide"
  source: /note="p.Q403R"
DFPEVSSGIYVQEVAPNSPSQRGGIRRDGDIIVKVNGRPLVDSSELQEAVLT

SEQ ID NO: 1503 - protein, 52 aa, Artificial Sequence
  source: /note="Description of Artificial Sequence: Synthetic polypeptide"
  source: /note="p.D222N"
AFMKETIKLGIKSRPKGLWGYYLYPNNCHNYNVYAPNYSGSCPEDEVLRNNE

SEQ ID NO: 1504 - protein, 52 aa, Artificial Sequence
  source: /note="Description of Artificial Sequence: Synthetic polypeptide"
  source: /note="p.R451Q"
NPLEAKLYQQTIYCDILGREIRLPLQQIKGEGMGPKIHFNFELLDIGKVFTG

SEQ ID NO: 1505 - protein, 52 aa, Artificial Sequence
  source: /note="Description of Artificial Sequence: Synthetic polypeptide"
  source: /note="p.R939Q"
PELNLGAHFSLDTHYYHFKLINKGRQQIQQLFWMNDSFRPQAKLSKKGRVKK

SEQ ID NO: 1506 - protein, 52 aa, Artificial Sequence
  source: /note="Description of Artificial Sequence: Synthetic polypeptide"
  source: /note="p.R1187C"
VHYPNLSFETKELDFGCILNDTELICCYVTITNCSPLVVKFRWFFLVNDEEN

SEQ ID NO: 1507 - protein, 52 aa, Artificial Sequence
  source: /note="Description of Artificial Sequence: Synthetic polypeptide"
  source: /note="p.R158C"
TVHFQISSQLQFSPEEVLGMVLNYSCCSLAEDFAEQPIKDAVITVPVFFNQA

SEQ ID NO: 1508 - protein, 52 aa, Artificial Sequence
  source: /note="Description of Artificial Sequence: Synthetic polypeptide"
  source: /note="p.R832C"
YCEKENDPKRRSCQTALVEILDVIVCCSFAPILPHLAEEVFQHIPYIKEPKS

SEQ ID NO: 1509 - protein, 52 aa, Artificial Sequence
  source: /note="Description of Artificial Sequence: Synthetic polypeptide"
  source: /note="p.S130R"
RTLYDVILYGLQEHSEVSGFLLECDRRSVQGALQKHLALYRIRRKVTVEPHP

SEQ ID NO: 1510 - protein, 74 aa, Artificial Sequence
  source: /note="Description of Artificial Sequence: Synthetic polypeptide"
  source: /note="p.K1213fs"
PVNAWASSLHSVSSKSFRDFLLEEKSLLLAIVQAIMSKKFLLKELKILRHQKLSDALPMVPQDQKATIFQIYHF

SEQ ID NO: 1511 - protein, 30 aa, Artificial Sequence
  source: /note="Description of Artificial Sequence: Synthetic polypeptide"
  source: /note="p.K37fs"
ALPSTFRSVLGARLPPPERLCGFQKRLTAK

SEQ ID NO: 1512 - protein, 52 aa, Artificial Sequence
  source: /note="Description of Artificial Sequence: Synthetic polypeptide"
  source: /note="p.R132G"
VFREAIICKNIPRLVSGWVKPIIIGGGHAYGDQYRATDFVVPGPGKVEITYT

SEQ ID NO: 1513 - protein, 52 aa, Artificial Sequence
  source: /note="Description of Artificial Sequence: Synthetic polypeptide"
  source: /note="p.R132C"
VFREAIICKNIPRLVSGWVKPIIIGCCHAYGDQYRATDFVVPGPGKVEITYT

SEQ ID NO: 1514 - protein, 52 aa, Artificial Sequence
  source: /note="Description of Artificial Sequence: Synthetic polypeptide"
  source: /note="p.R132H"
VFREAIICKNIPRLVSGWVKPIIIGHHHAYGDQYRATDFVVPGPGKVEITYT

SEQ ID NO: 1515 - protein, 52 aa, Artificial Sequence
  source: /note="Description of Artificial Sequence: Synthetic polypeptide"
  source: /note="p.R140Q"
TITPDEARVEEFKLKKMWKSPNGTIQQNILGGTVFREPIICKNIPRLVPGWT

SEQ ID NO: 1516 - protein, 52 aa, Artificial Sequence
  source: /note="Description of Artificial Sequence: Synthetic polypeptide"
  source: /note="p.R172K"
VFREPIICKNIPRLVPGWTKPITIGKKHAHGDQYKATDFVADRAGTFKMVFT

SEQ ID NO: 1517 - protein, 52 aa, Artificial Sequence
  source: /note="Description of Artificial Sequence: Synthetic polypeptide"
  source: /note="p.T374P"
DNAFLSYHPHPFAQRTLTARFQVNNPPRPPHVQLLRKPVLTAMGLLALLDEE

SEQ ID NO: 1518 - protein, 52 aa, Artificial Sequence
  source: /note="Description of Artificial Sequence: Synthetic polypeptide"
  source: /note="p.H33Q"
AALLALLASLLAAPPVAPAEAPHLVQQVDAARALWPLRRFWRSTGFCPPLPH

SEQ ID NO: 1519 - protein, 52 aa, Artificial Sequence
  source: /note="Description of Artificial Sequence: Synthetic polypeptide"
  source: /note="p.R194G"
SRAARRPCGCPLGGEDPPGTPAATPGGAACCCAPQPAEDEPPAPPAVCPRKR

SEQ ID NO: 1520 - protein, 52 aa, Artificial Sequence
  source: /note="Description of Artificial Sequence: Synthetic polypeptide"
  source: /note="p.V79A"
KDRHDFRIPQEEFDGNQFQKAQAISAALHEMIQQTFNLFSTEDSSAAWEQSL

SEQ ID NO: 1521 - protein, 52 aa, Artificial Sequence
  source: /note="Description of Artificial Sequence: Synthetic polypeptide"
  source: /note="p.L80F"
DRHDFRIPQEEFDGNQFQKAQAISVFFHEMIQQTFNLFSTEDSSAAWEQSLL

SEQ ID NO: 1522 - protein, 52 aa, Artificial Sequence
  source: /note="Description of Artificial Sequence: Synthetic polypeptide"
  source: /note="p.E664K"
VDEGLKNYVPVNHFWDQSEPRLFVCKKAVQETPRSQPQSANGQPQDGRAGPA

SEQ ID NO: 1523 - protein, 52 aa, Artificial Sequence
  source: /note="Description of Artificial Sequence: Synthetic polypeptide"
  source: /note="p.A837T"
YERAGDLFEKIHNPQKALECYRKGNTTFMKAVELARLAFPVEVVKLEEAWGD

SEQ ID NO: 1524 - protein, 52 aa, Artificial Sequence
  source: /note="Description of Artificial Sequence: Synthetic polypeptide"
  source: /note="p.A944V"
AQHYASLQEYEIAEELYTKGDRTKDVVIDMYTQAGRWEQAHKLAMKCMRPED

SEQ ID NO: 1525 - protein, 52 aa, Artificial Sequence
  source: /note="Description of Artificial Sequence: Synthetic polypeptide"
  source: /note="p.T186S"
SSPSPPQRAQRGDHSSREQGHAPGGSSSQARQIDFPLRILVPTQFVGAIIGK

SEQ ID NO: 1526 - protein, 29 aa, Artificial Sequence
  source: /note="Description of Artificial Sequence: Synthetic peptide"
  source: /note="p.T1314fs"
HKVAGLLTQKLTYENGLLKMNFTGGGHLP

SEQ ID NO: 1527 - protein, 52 aa, Artificial Sequence
  source: /note="Description of Artificial Sequence: Synthetic polypeptide"
  source: /note="p.R615S"
FLAEDRRINVAVTRARRHVAVICDSSSTVNNHAFLKTLVEYFTQHGEVRTAF

SEQ ID NO: 1528 - protein, 52 aa, Artificial Sequence
  source: /note="Description of Artificial Sequence: Synthetic polypeptide"
  source: /note="p.R77Q"
KCARITSRIIRSSEDPNEDIVERNIQQIIVPLNNRENISDPTSPLRTRFVYH

SEQ ID NO: 1529 - protein, 45 aa, Artificial Sequence
  source: /note="Description of Artificial Sequence: Synthetic polypeptide"
  source: /note="p.E90fs"
DPAARRRKKKSYYAKLRQQEIERERASREVPGSCQGTERWSEQRL

SEQ ID NO: 1530 - protein, 52 aa, Artificial Sequence
  source: /note="Description of Artificial Sequence: Synthetic polypeptide"
  source: /note="p.L162R"
KRSHTGERPFQCNQCGASFTQKGNLRRRHIKLHTGEKPFKCHLCNYACQRRD

SEQ ID NO: 1531 - protein, 52 aa, Artificial Sequence
  source: /note="Description of Artificial Sequence: Synthetic polypeptide"
  source: /note="p.R34W"
FLLTISIFLGLGQPRSPKSKRKGQGWWPGPLAPGPHQVPLDLVSRMKPYARM

SEQ ID NO: 1532 - protein, 99 aa, Artificial Sequence
  source: /note="Description of Artificial Sequence: Synthetic polypeptide"
  source: /note="p.Q803fs"
PYEEEQRQSVQSDQGYISRSSPQPPRGTHGNGGRGGRGAGPREAGPATLSRGPGEPEEPPAAAAFPPAAEELGLGHDGVRVRGAQCMRAAPQGPPRSQL

SEQ ID NO: 1533 - protein, 59 aa, Artificial Sequence
  source: /note="Description of Artificial Sequence: Synthetic polypeptide"
  source: /note="p.L364fs"
KEASSTFSWGIVLAPLSLAFLVLGGNMDAQTVQTQNWKSRWSDCAMASSSRLSILSQVK

SEQ ID NO: 1534 - protein, 52 aa, Artificial Sequence
  source: /note="Description of Artificial Sequence: Synthetic polypeptide"
  source: /note="p.F50C"
DDWGLDTMRQIQVFEDEPARIKCPLCCEHFLKFNYSTAHSAGLTLIWYWTRQ

SEQ ID NO: 1535 - protein, 52 aa, Artificial Sequence
  source: /note="Description of Artificial Sequence: Synthetic polypeptide"
  source: /note="p.T647M"
KHEIPATTLPVPSLGNHHTYCNLPLMMLLNGQLPLNNTLKDTQEFHRNSSLL

SEQ ID NO: 1536 - protein, 52 aa, Artificial Sequence
  source: /note="Description of Artificial Sequence: Synthetic polypeptide"
  source: /note="p.R103M"
CLEEELKPLEEVLNLAQSKNFHLRPMMDLISNINVIVLELKGSETTFMCEYA

SEQ ID NO: 1537 - protein, 65 aa, Artificial Sequence
  source: /note="Description of Artificial Sequence: Synthetic polypeptide"
  source: /note="p.C168fs"
HGEKGTHKGYCLERRLYRVSLACVCAAPCDGLAGPAGGWSLFGKPGARCTTTCHEGPGCPDAWPL

SEQ ID NO: 1538 - protein, 52 aa, Artificial Sequence
  source: /note="Description of Artificial Sequence: Synthetic polypeptide"
  source: /note="p.A90T"
DILMENNLRRPNLEAFNRAVKSLQNTTSAIESILKNLLPCLPLATAAPTRHP

SEQ ID NO: 1539 - protein, 46 aa, Artificial Sequence
  source: /note="Description of Artificial Sequence: Synthetic polypeptide"
  source: /note="p.P215T"
LWKQFQSFCCSLSELFMSSFQSYGATTRGDKEELTPQKCSEPQSSK

SEQ ID NO: 1540 - protein, 36 aa, Artificial Sequence
  source: /note="Description of Artificial Sequence: Synthetic polypeptide"
  source: /note="p.D218fs"
QFQSFCCSLSELFMSSFQSYGAPRGEQGGADTPEVL

SEQ ID NO: 1541 - protein, 52 aa, Artificial Sequence
  source: /note="Description of Artificial Sequence: Synthetic polypeptide"
  source: /note="p.L47I"
LLPDEKISLLPPVNFTIKVTGLAQVIILQWKPNPDQEQRNVNLEYQVKINAP

SEQ ID NO: 1542 - protein, 52 aa, Artificial Sequence
  source: /note="Description of Artificial Sequence: Synthetic polypeptide"
  source: /note="p.P216H"
FVNIEVWVEAENALGKVTSDHINFDHHVYKVKPNPPHNLSVINSEELSSILK

SEQ ID NO: 1543 - protein, 52 aa, Artificial Sequence
  source: /note="Description of Artificial Sequence: Synthetic polypeptide"
  source: /note="p.S54L"
DLEDAELDDYSFSCYSQLEVNGSQHLLLTCAFEDPDVNITNLEFEICGALVE

SEQ ID NO: 1544 - protein, 52 aa, Artificial Sequence
  source: /note="Description of Artificial Sequence: Synthetic polypeptide"
  source: /note="p.E484K"
VKVLQDMGLPTGAEGRDSSKGEDSAKKETEAKPAVVAPAPVVEAVSTPSAAF

SEQ ID NO: 1545 - protein, 52 aa, Artificial Sequence
  source: /note="Description of Artificial Sequence: Synthetic polypeptide"
  source: /note="p.P1340A"
KLVFIRNEDAVNQMAVTPFPVPSSSAASSIEDQSGTEPISSEEDGSVEVGIK

SEQ ID NO: 1546 - protein, 52 aa, Artificial Sequence
  source: /note="Description of Artificial Sequence: Synthetic polypeptide"
  source: /note="p.S527fs"
PLLPGMGWGPPPPPPPLLPCTCSPPWREAWRRSSWPRWTMAWAQHGSPAIGG

SEQ ID NO: 1547 - protein, 52 aa, Artificial Sequence
  source: /note="Description of Artificial Sequence: Synthetic polypeptide"
  source: /note="p.A220S"
DECYERFSRETDGAQKRRMLHCVQRSSLIRSQELGDEKIQIVSQMVELVENR

SEQ ID NO: 1548 - protein, 52 aa, Artificial Sequence
  source: /note="Description of Artificial Sequence: Synthetic polypeptide"
  source: /note="p.G56V"
PSPEAEMLKFNLECLHKTFGPGGLQVVDTLIDIGSGPTIYQVLAACDSFQDI

SEQ ID NO: 1549 - protein, 52 aa, Artificial Sequence
  source: /note="Description of Artificial Sequence: Synthetic polypeptide"
  source: /note="p.S212F"
LKPGGHLVTTVTLRLPSYMVGKREFFFCVALEKEEVEQAVLDAGFDIEQLLH

SEQ ID NO: 1550 - protein, 52 aa, Artificial Sequence
  source: /note="Description of Artificial Sequence: Synthetic polypeptide"
  source: /note="p.R523Q"
SFMFNGTSLGFVNSHLTSGSEKKLRQQNQNYMNILRFLALGDKKLSPFNITH

SEQ ID NO: 1551 - protein, 52 aa, Artificial Sequence
  source: /note="Description of Artificial Sequence: Synthetic polypeptide"
  source: /note="p.R263C"
EGRLLFPPTYKFDRNSNDYDTSEKKCCKPAWTDRILWRLKRQPCAGPDTPIP

SEQ ID NO: 1552 - protein, 52 aa, Artificial Sequence
  source: /note="Description of Artificial Sequence: Synthetic polypeptide"
  source: /note="p.T493M"
VFGTQENSVGDREWLDLLRGGLKELMMDLDYRPIAMQSLWNIKVAVLVKPEH

SEQ ID NO: 1553 - protein, 179 aa, Artificial Sequence
  source: /note="Description of Artificial Sequence: Synthetic polypeptide"
  source: /note="p.A974fs"
APREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 1554 - protein, 70 aa, Artificial Sequence
  source: /note="Description of Artificial Sequence: Synthetic polypeptide"
  source: /note="p.P1154fs"
SEVDYAPAGPARSALLPGPLELQPPGDCPRTMAGPSASLHPASGRASRKTWQRRLRACRAGGPAGWARQA

SEQ ID NO: 1555 - protein, 27 aa, Artificial Sequence
  source: /note="Description of Artificial Sequence: Synthetic peptide"
  source: /note="p.M1V"
VVAATVNLELDPIFLKALGFLHSKSKD

SEQ ID NO: 1556 - protein, 52 aa, Artificial Sequence
  source: /note="Description of Artificial Sequence: Synthetic polypeptide"
  source: /note="p.S460A"
MRKISNNITLREDQLDTVLAVLEDSAARDIREALHELLCCTNVSTKEGIHLA

SEQ ID NO: 1557 - protein, 49 aa, Artificial Sequence
  source: /note="Description of Artificial Sequence: Synthetic polypeptide"
  source: /note="p.R940C"
GIVWKTGPRTTIFVKSLEDPYSQQICCLQQQQAQQPLQQQQQRNAYTRF

SEQ ID NO: 1558 - protein, 52 aa, Artificial Sequence
  source: /note="Description of Artificial Sequence: Synthetic polypeptide"
  source: /note="p.R106I"
LCVLKVTQQSEKHLEKILNVDEFVKIIIFSVIHSNDPVARAITLRMLGSLAS

SEQ ID NO: 1559 - protein, 52 aa, Artificial Sequence
  source: /note="Description of Artificial Sequence: Synthetic polypeptide"
  source: /note="p.R799K"
WKPSRRHDTEPKAKCAPQKRRTQELKKGGRCSPAGSSRPGSARGEAVHAGQN

SEQ ID NO: 1560 - protein, 43 aa, Artificial Sequence
  source: /note="Description of Artificial Sequence: Synthetic polypeptide"
  source: /note="p.R815fs"
KRRTQELRGGRCSPAGSSRPGSARGRRSMLGRILPTIVHQETK

SEQ ID NO: 1561 - protein, 46 aa, Artificial Sequence
  source: /note="Description of Artificial Sequence: Synthetic polypeptide"
  source: /note="p.S844fs"
ERYPVVMSTYLGVMGRVLLQNTSFFLHYLMRWPINLIRRWTSFWEI

SEQ ID NO: 1562 - protein, 52 aa, Artificial Sequence
  source: /note="Description of Artificial Sequence: Synthetic polypeptide"
  source: /note="p.R267Q"
PYMRNGTLFDRLQCVGDTAPLPWHIQQIGILIGISKAIHYLHNVQPCSVICG

SEQ ID NO: 1563 - protein, 52 aa, Artificial Sequence
  source: /note="Description of Artificial Sequence: Synthetic polypeptide"
  source: /note="p.R419Q"
HLEHTGFSKAKLESMETYLKAVKLFQQNDQNSSGEPEYSQVIQINLNSIVPS

SEQ ID NO: 1564 - protein, 52 aa, Artificial Sequence
  source: /note="Description of Artificial Sequence: Synthetic polypeptide"
  source: /note="p.K123R"
RCALNKSNDFEELVERSQLDISDPYRRVYRIVPEGAKKGAKQLTLEDPQMSM

SEQ ID NO: 1565 - protein, 36 aa, Artificial Sequence
  source: /note="Description of Artificial Sequence: Synthetic polypeptide"
  source: /note="p.G591fs"
GHGSGGGQGPGDGHGSGGGKNSGGGQRLRKWERIRW

SEQ ID NO: 1566 - protein, 53 aa, Artificial Sequence
  source: /note="Description of Artificial Sequence: Synthetic polypeptide"
  source: /note="p.21_22AA>A"
MASCSFTRDQATRRLRGAAAAAAAALAAVVTTPLLSSGTPTALIGTGSSCPGA

SEQ ID NO: 1567 - protein, 52 aa, Artificial Sequence
  source: /note="Description of Artificial Sequence: Synthetic polypeptide"
  source: /note="p.L422P"
LVSAPLGKFPAWTNRPFPGPPPGPRPPHPLSLLGSAPPHLLGLPGAAGHPAA

SEQ ID NO: 1568 - protein, 48 aa, Artificial Sequence
  source: /note="Description of Artificial Sequence: Synthetic polypeptide"
  source: /note="p.A425V"
CDESSCIPKAFGNPKFALQGLPLNCVVPCPRRSEPVVQCQYPSGAEAG

SEQ ID NO: 1569 - protein, 52 aa, Artificial Sequence
  source: /note="Description of Artificial Sequence: Synthetic polypeptide"
  source: /note="p.R86C"
AASGSGLEKPPKDQPQEGRKSKRRVCCTTFTTEQLHELEKIFHFTHYPDVHI

SEQ ID NO: 1570 - protein, 28 aa, Artificial Sequence
  source: /note="Description of Artificial Sequence: Synthetic peptide"
  source: /note="p.C2F"
MFFAEVGPALCRGMERNSLGCCEAPKKL

SEQ ID NO: 1571 - protein, 52 aa, Artificial Sequence
  source: /note="Description of Artificial Sequence: Synthetic polypeptide"
  source: /note="p.R669Q"
PIVHLTPSLEVTPQAISVVQRDCRRQQGQEAVCLTAALCFQVTSRTPGRWDH

SEQ ID NO: 1572 - protein, 52 aa, Artificial Sequence
  source: /note="Description of Artificial Sequence: Synthetic polypeptide"
  source: /note="p.T673M"
YLAVGSMKTLMLNVSLFNAGDDAYEMMTLHVKLPVGLYFIKILELEEKQINC

SEQ ID NO: 1573 - protein, 52 aa, Artificial Sequence
  source: /note="Description of Artificial Sequence: Synthetic polypeptide"
  source: /note="p.F900L"
GIVRFLSKTDKRLLYCIKADPHCLNLLLCNFGKMESGKEASVHIQLEGRPSI

SEQ ID NO: 1574 - protein, 52 aa, Artificial Sequence
  source: /note="Description of Artificial Sequence: Synthetic polypeptide"
  source: /note="p.A48D"
PPLLPLLLLLLPPPPRVGGFNLDAEDDPAVLSGPPGSFFGFSVEFYRPGTDG

SEQ ID NO: 1575 - protein, 52 aa, Artificial Sequence
  source: /note="Description of Artificial Sequence: Synthetic polypeptide"
  source: /note="p.G616C"
TEFRDKLSPINISLNYSLDESTFKECCLEVKPILNYYRENIVSEQAHILVDC

SEQ ID NO: 1576 - protein, 52 aa, Artificial Sequence
  source: /note="Description of Artificial Sequence: Synthetic polypeptide"
  source: /note="p.R685H"
KRSKNLLGSRDLQSSVTLDLALDPGHHLSPRATFQETKNRSLSRVRVLGLKA

SEQ ID NO: 1577 - protein, 52 aa, Artificial Sequence
  source: /note="Description of Artificial Sequence: Synthetic polypeptide"
  source: /note="p.R283H"
TDGKKEGDSLDYKDVIPMADAAGIIHHYAIGVGLAFQNRNSWKELNDIASKP

SEQ ID NO: 1578 - protein, 52 aa, Artificial Sequence
  source: /note="Description of Artificial Sequence: Synthetic polypeptide"
  source: /note="p.L378I"
PKSAVGTLSANSSNVIQLIIDAYNSIISSEVILENGKLSEGVTISYKSYCKN

SEQ ID NO: 1579 - protein, 52 aa, Artificial Sequence
  source: /note="Description of Artificial Sequence: Synthetic polypeptide"
  source: /note="p.D158N"
LKFKRAEDYPIDLYYLMDLSYSMKDNNLENVKSLGTDLMNEMRRITSDFRIG

SEQ ID NO: 1580 - protein, 42 aa, Artificial Sequence
  source: /note="Description of Artificial Sequence: Synthetic polypeptide"
  source: /note="p.A7fs"
MCGSALAFFYRCICLPAKRPARSRLVPLGSLGVFTCSWTGPR

SEQ ID NO: 1581 - protein, 52 aa, Artificial Sequence
  source: /note="Description of Artificial Sequence: Synthetic polypeptide"
  source: /note="p.G254W"
KGHVLFRPTVSQQQSCPTCSTSLLNWWHFKVTYDVSRDKICDLLVANNHFAH

SEQ ID NO: 1582 - protein, 52 aa, Artificial Sequence
  source: /note="Description of Artificial Sequence: Synthetic polypeptide"
  source: /note="p.L842V"
TLDKEMSFSVLLHRVWKKHPVNVDFVVGIYIPPTNKFSPKAHGLIGQFMQEP

SEQ ID NO: 1583 - protein, 52 aa, Artificial Sequence
  source: /note="Description of Artificial Sequence: Synthetic polypeptide"
  source: /note="p.E196K"
PEETVVIALYDYQTNDPQELALRRNKKEYCLLDSSEIHWWRVQDRNGHEGYV

SEQ ID NO: 1584 - protein, 52 aa, Artificial Sequence
  source: /note="Description of Artificial Sequence: Synthetic polypeptide"
  source: /note="p.R29L"
FILLEEQLIKKSQQKRRTSPSNFKVLLFFVLTKASLAYFEDRHGKKRTLKGS

SEQ ID NO: 1585 - protein, 52 aa, Artificial Sequence
  source: /note="Description of Artificial Sequence: Synthetic polypeptide"
  source: /note="p.E167K"
ADIIHDFQRGLTAYHDISLDKCYVIKKLNTTIVLPPRNFWELLMNVKRGTYL

SEQ ID NO: 1586 - protein, 52 aa, Artificial Sequence
  source: /note="Description of Artificial Sequence: Synthetic polypeptide"
  source: /note="p.M1569I"
CGLERDKFDNKTVTFEEHIKEEHNMICHYLCFIVLVKVKDSTEYTGPESYVA

SEQ ID NO: 1587 - protein, 52 aa, Artificial Sequence
  source: /note="Description of Artificial Sequence: Synthetic polypeptide"
  source: /note="p.P358Q"
RDGVPPTSKKKRQAGEKIMYTLVSVQQHGNDIASLFELDATTLQRADCLVPR

SEQ ID NO: 1588 - protein, 31 aa, Artificial Sequence
  source: /note="Description of Artificial Sequence: Synthetic polypeptide"
  source: /note="p.S802fs"
FQATSKKGISRLDKQMRKFTDIRKKADLHTQ

SEQ ID NO: 1589 - protein, 52 aa, Artificial Sequence
  source: /note="Description of Artificial Sequence: Synthetic polypeptide"
  source: /note="p.A462T"
DCLPGWMGQNCDININDCLGQCQNDTTSCRDLVNGYRCICPPGYAGDHCERD

SEQ ID NO: 1590 - protein, 52 aa, Artificial Sequence
  source: /note="Description of Artificial Sequence: Synthetic polypeptide"
  source: /note="p.V310I"
IFETSMLLISSENEMNWFHSNDGGNIILYYEVMVTGNLGIQWRHKPNVVSVE

SEQ ID NO: 1591 - protein, 52 aa, Artificial Sequence
  source: /note="Description of Artificial Sequence: Synthetic polypeptide"
  source: /note="p.R283I"
MSSPKREIPGRAGDGSEHCSSPDLRIINQKRIAELNATIRKLEDRNTLLGDE

SEQ ID NO: 1592 - protein, 49 aa, Artificial Sequence
  source: /note="Description of Artificial Sequence: Synthetic polypeptide"
  source: /note="p.G394fs"
VNHTISGKTESSNAKTRKQVLSLGGGVQVHWARRQWPQGQWQVEPKVMH

SEQ ID NO: 1593 - protein, 60 aa, Artificial Sequence
  source: /note="Description of Artificial Sequence: Synthetic polypeptide"
  source: /note="p.V422fs"
TGPAVNGLKVSGRLNPKSCTKEVGGGSCGRACSCGRGCGTPRGDWKRHTRRRSRSRPPRR

SEQ ID NO: 1594 - protein, 65 aa, Artificial Sequence
  source: /note="Description of Artificial Sequence: Synthetic polypeptide"
  source: /note="p.R97fs"
HHAVDIDLYHCPNCAVLHGSSLMKKGGTGTDMTTQKLMMVPNQCKLELELSLRNYALESSQVPMK

SEQ ID NO: 1595 - protein, 52 aa, Artificial Sequence
  source: /note="Description of Artificial Sequence: Synthetic polypeptide"
  source: /note="p.R313H"
TSVWYHVLWGEKIFYLIKPTDENLAHHYESWSSSVTQSEVFFGDKVDKCYKC

SEQ ID NO: 1596 - protein, 52 aa, Artificial Sequence
  source: /note="Description of Artificial Sequence: Synthetic polypeptide"
  source: /note="p.R1198S"
SHSVTTFRNDCRSPTHLTVSSTNTLSSSMPALHRAPVFHPPIHHSLERKEGS

SEQ ID NO: 1597 - protein, 37 aa, Artificial Sequence
  source: /note="Description of Artificial Sequence: Synthetic polypeptide"
  source: /note="p.A11V"
MRAGPEPQALVVGQKRGALRLLVPRLVLTVSAPAEVR

SEQ ID NO: 1598 - protein, 86 aa, Artificial Sequence
  source: /note="Description of Artificial Sequence: Synthetic polypeptide"
  source: /note="p.PPPPPPPPPPPP811del"
LNNNLEPCSVTINPLPSPLPPTPPPLPVAKDSGPETLEKDLPRKEGNEKRIPKSASAPSAHLFDSSQLVSARKKLRKTAEGLQRRR

SEQ ID NO: 1599 - protein, 52 aa, Artificial Sequence
  source: /note="Description of Artificial Sequence: Synthetic polypeptide"
  source: /note="p.A395T"
ARTKVEIANSRTAHARAKADAADQATTLAARQECDIARAVARELSPDFYQPG

SEQ ID NO: 1600 - protein, 52 aa, Artificial Sequence
  source: /note="Description of Artificial Sequence: Synthetic polypeptide"
  source: /note="p.Q433H"
EARIARITAKEFSPSFQHRENGLEYHHRPKRQTSCDDIEVLSTGTPLQQESP

SEQ ID NO: 1601 - protein, 52 aa, Artificial Sequence
  source: /note="Description of Artificial Sequence: Synthetic polypeptide"
  source: /note="p.V92A"
EKEPAARGTPGTGKERLKAGASPRSAAPARKKAQTAPPLQPPPPPPALSEEL

SEQ ID NO: 1602 - protein, 52 aa, Artificial Sequence
  source: /note="Description of Artificial Sequence: Synthetic polypeptide"
  source: /note="p.S627L"
RVAAGVLCELAQDKEAADAIDAEGALLAPLMELLHSRNEGTATYAAAVLFRI

SEQ ID NO: 1603 - protein, 52 aa, Artificial Sequence
  source: /note="Description of Artificial Sequence: Synthetic polypeptide"
  source: /note="p.V303I"
SKHFRSSKDPSAPPAPANLRLANSTIINSDGSVTVTIVWDLPEEPDIPVHHY

SEQ ID NO: 1604 - protein, 52 aa, Artificial Sequence
  source: /note="Description of Artificial Sequence: Synthetic polypeptide"
  source: /note="p.R359H"
VEADAWVTEALLGLPAAAERELELLHHASLEHQRGVSELLRGRLRELEEARE

SEQ ID NO: 1605 - protein, 52 aa, Artificial Sequence
  source: /note="Description of Artificial Sequence: Synthetic polypeptide"
  source: /note="p.S253P"
VQEGAEPPEGVVKVPNHLPLPGPPFPPFQNVLVVLEDKEDEHNAREAEVLFT

SEQ ID NO: 1606 - protein, 52 aa, Artificial Sequence
  source: /note="Description of Artificial Sequence: Synthetic polypeptide"
  source: /note="p.G376E"
IGWNTGALVACHVSVMEYVTAVVCLEEFPLLTVDGPRGDVDDPLLDMKTPVL

SEQ ID NO: 1607 - protein, 52 aa, Artificial Sequence
  source: /note="Description of Artificial Sequence: Synthetic polypeptide"
  source: /note="p.A81V"
GGFRATLQVLRGDRPALAAEDELLQVVVECAAFLQAPALARFLEHNLTSDNC

SEQ ID NO: 1608 - protein, 32 aa, Artificial Sequence
  source: /note="Description of Artificial Sequence: Synthetic polypeptide"
  source: /note="p.G442fs"
LADRLLCREGMDVAYLNGYIYILGGARPYYWS

SEQ ID NO: 1609 - protein, 52 aa, Artificial Sequence
  source: /note="Description of Artificial Sequence: Synthetic polypeptide"
  source: /note="p.V549I"
YLKLVLFQNKLHLFVRATQVTVEEHIIFRTSRKNSLYQYDDIADQWMKVYET

SEQ ID NO: 1610 - protein, 52 aa, Artificial Sequence
  source: /note="Description of Artificial Sequence: Synthetic polypeptide"
  source: /note="p.G376C"
EAESHFSSIPDAFWWAVVSMTTVGYCCDMYPVTIGGKIVGSLCAIAGVLTIA

SEQ ID NO: 1611 - protein, 52 aa, Artificial Sequence
  source: /note="Description of Artificial Sequence: Synthetic polypeptide"
  source: /note="p.A415V"
TLKASMRELGLLIFFLFIGVILFSSVVVYFAEADDPTSGFSSIPDAFWWAVV

SEQ ID NO: 1612 - protein, 52 aa, Artificial Sequence
  source: /note="Description of Artificial Sequence: Synthetic polypeptide"
  source: /note="p.R231H"
STIALSLNTLPELQETDEFGQLNDNHHQLAHVEAVCIAWFTMEYLLRFLSSP

SEQ ID NO: 1613 - protein, 44 aa, Artificial Sequence
  source: /note="Description of Artificial Sequence: Synthetic polypeptide"
  source: /note="p.K455fs"
VPVIVNNFGMYYSLAMAKQKLPKKKRSIFRGHRSWDLPIIVNLS

SEQ ID NO: 1614 - protein, 52 aa, Artificial Sequence
  source: /note="Description of Artificial Sequence: Synthetic polypeptide"
  source: /note="p.S438L"
NQRADKRRAQKKARLARIRVAKTGSLLNAYLHSKRNGLLNEALELTGTPEEE

SEQ ID NO: 1615 - protein, 52 aa, Artificial Sequence
  source: /note="Description of Artificial Sequence: Synthetic polypeptide"
  source: /note="p.G149A"
MFILNFEVVMEKDMVGSPAHDTNHRAAPPTSWLAPGRAKTFRLKLPALLALT

SEQ ID NO: 1616 - protein, 52 aa, Artificial Sequence
  source: /note="Description of Artificial Sequence: Synthetic polypeptide"
  source: /note="p.M455I"
SSLTSVGFGNVSANTDAEKIFSICTIILIGALMHALVFGNVTAIIQRMYSRW

SEQ ID NO: 1617 - protein, 120 aa, Artificial Sequence
  source: /note="Description of Artificial Sequence: Synthetic polypeptide"
  source: /note="p.P102fs"
GTWFLFGVVWYLVAVAHGDLLELDPRPTTPPVWYRCTHSLEPSSSPLNPKPPLAMASATSVRNVHWPLCFLLPSWCSPPSWKSSSQVPSWRRLPGPRSGLRPFVSASMQLWPPTMASPAS

SEQ ID NO: 1618 - protein, 52 aa, Artificial Sequence
  source: /note="Description of Artificial Sequence: Synthetic polypeptide"
  source: /note="p.L430F"
KITGREDFPKKLLRMSSTTSEKAYSFFGDLPMKLQRISSVPGNSEEKLVSKT

SEQ ID NO: 1619 - protein, 47 aa, Artificial Sequence
  source: /note="Description of Artificial Sequence: Synthetic polypeptide"
  source: /note="p.S21G"
MYRPRARAAPEGRVRGCAVPGGTVLLLLAYLAYLALGTGVFWTLEGR

SEQ ID NO: 1620 - protein, 49 aa, Artificial Sequence
  source: /note="Description of Artificial Sequence: Synthetic polypeptide"
  source: /note="p.G23V"
MEVSGHPQARRCCPEALGKLFPVVLCFLCFLVTYALVGAVVFSAIEDGQ

SEQ ID NO: 1621 - protein, 32 aa, Artificial Sequence
  source: /note="Description of Artificial Sequence: Synthetic polypeptide"
  source: /note="p.S6W"
MLPSAWWRERPGYRAGVAAPDLLDPKSAAQNS

SEQ ID NO: 1622 - protein, 52 aa, Artificial Sequence
  source: /note="Description of Artificial Sequence: Synthetic polypeptide"
  source: /note="p.R166L"
HWDLGSSFFFAGTVITTIGFGNISPLLTEGGKIFCIIYALLGIPLFGFLLAG

SEQ ID NO: 1623 - protein, 52 aa, Artificial Sequence
  source: /note="Description of Artificial Sequence: Synthetic polypeptide"
  source: /note="p.N151K"
KLLLYHTEETIKINQKCSYIPKCGKKKFEESMSLVNVVMENFRKYQHFSCYS

SEQ ID NO: 1624 - protein, 52 aa, Artificial Sequence
  source: /note="Description of Artificial Sequence: Synthetic polypeptide"
  source: /note="p.D211N"
SRVFSILSILVVMGSIITMCLNSLPNNFQIPDSQGNPGEDPRFEIVEHFGIA

SEQ ID NO: 1625 - protein, 88 aa, Artificial Sequence
  source: /note="Description of Artificial Sequence: Synthetic polypeptide"
  source: /note="p.L314fs"
KLYRFFKYIENRDVAKTVLKERGLKTFALELKVTLPVKKKLREGLAAGLKSSIIMYNAPSSRCHGKRKKGRVAMWISSVFEANPSRIW

SEQ ID NO: 1626 - protein, 32 aa, Artificial Sequence
  source: /note="Description of Artificial Sequence: Synthetic polypeptide"
  source: /note="p.T6M"
MSDPIMMLNVGGKLYTTSLATLTSFPDSMLGA

SEQ ID NO: 1627 - protein, 52 aa, Artificial Sequence
  source: /note="Description of Artificial Sequence: Synthetic polypeptide"
  source: /note="p.L447I"
LKWAKDHDEEAKKIAKAGQEFARNNIIMGDDIFCYYFKLFQEYANLQVSEPQ

SEQ ID NO: 1628 - protein, 52 aa, Artificial Sequence
  source: /note="Description of Artificial Sequence: Synthetic polypeptide"
  source: /note="p.F361L"
HLSNLEYACGSNLHQVSARSWDHNELLFAQFAGDHTLLTPGYSVIIEKLAEG

SEQ ID NO: 1629 - protein, 34 aa, Artificial Sequence
  source: /note="Description of Artificial Sequence: Synthetic polypeptide"
  source: /note="p.P1316fs"
SLRDLLHSGPGKLPQTPLDTGIPFPRSSLHPQQE

SEQ ID NO: 1630 - protein, 52 aa, Artificial Sequence
  source: /note="Description of Artificial Sequence: Synthetic polypeptide"
  source: /note="p.P423S"
VSSIEEDVIVEYGADISSKDFGSGFSSVKDGRRKILPEEEEYALSGWNLNNM

SEQ ID NO: 1631 - protein, 52 aa, Artificial Sequence
  source: /note="Description of Artificial Sequence: Synthetic polypeptide"
  source: /note="p.R470C"
PERDEWHLVAPMLTRRIGVGVAVLNCCLLYAVGGFDGTNRLNSAECYYPERN

SEQ ID NO: 1632 - protein, 52 aa, Artificial Sequence
  source: /note="Description of Artificial Sequence: Synthetic polypeptide"
  source: /note="p.G480W"
PMLTRRIGVGVAVLNRLLYAVGGFDWWTNRLNSAECYYPERNEWRMITAMNT

SEQ ID NO: 1633 - protein, 48 aa, Artificial Sequence
  source: /note="Description of Artificial Sequence: Synthetic polypeptide"
  source: /note="p.G603W"
LDSVECYDPDTDTWSEVTRMTSGRSWWVGVAVTMEPCRKQIDQQNCTC

SEQ ID NO: 1634 - protein, 52 aa, Artificial Sequence
  source: /note="Description of Artificial Sequence: Synthetic polypeptide"
  source: /note="p.S144F"
GMEVVSIEGIHPKVMERLIEFAYTAFFISMGEKCVLHVMNGAVMYQIDSVVR

SEQ ID NO: 1635 - protein, 52 aa, Artificial Sequence
  source: /note="Description of Artificial Sequence: Synthetic polypeptide"
  source: /note="p.V155F"
PKVMERLIEFAYTASISMGEKCVLHFFMNGAVMYQIDSVVRACSDFLVQQLD

SEQ ID NO: 1636 - protein, 52 aa, Artificial Sequence
  source: /note="Description of Artificial Sequence: Synthetic polypeptide"
  source: /note="p.R260L"
DDLNVRCESEVFHACINWVKYDCEQLLRFYVQALLRAVRCHSLTPNFLQMQL

SEQ ID NO: 1637 - protein, 52 aa, Artificial Sequence
  source: /note="Description of Artificial Sequence: Synthetic polypeptide"
  source: /note="p.V411M"
RKLSQKLRELTEQPPMPARPRWMKCMMEETGTFFEPTLAALFVREAFGPSTR

SEQ ID NO: 1638 - protein, 52 aa, Artificial Sequence
  source: /note="Description of Artificial Sequence: Synthetic polypeptide"
  source: /note="p.S203L"
LNGSEDSGRGRGIRGRGIRIAPTAPLLRGRGGAIPPPPPPGRGVLTPRGSTV

SEQ ID NO: 1639 - protein, 52 aa, Artificial Sequence
  source: /note="Description of Artificial Sequence: Synthetic polypeptide"
  source: /note="p.K63R"
RKVAKEGGPKVTSRNFEKSITKLGKRRGVKQFKNKQQGDKSPKNKFQPANKF

SEQ ID NO: 1640 - protein, 41 aa, Artificial Sequence
  source: /note="Description of Artificial Sequence: Synthetic polypeptide"
  source: /note="p.T120fs"
STPKRVPMGPIIVPPGGHSVPSTPPRGDHRSNQNREWCLEE

SEQ ID NO: 1641 - protein, 37 aa, Artificial Sequence
  source: /note="Description of Artificial Sequence: Synthetic polypeptide"
  source: /note="p.I902fs"
GLETGWNCHISLTPNGDMPGSEIPPPAPATQAPCMMT

SEQ ID NO: 1642 - protein, 32 aa, Artificial Sequence
  source: /note="Description of Artificial Sequence: Synthetic polypeptide"
  source: /note="p.K895fs"
PMNHDQFHLVPNHIVVSAEGNISKKQNALAEH

SEQ ID NO: 1643 - protein, 52 aa, Artificial Sequence
  source: /note="Description of Artificial Sequence: Synthetic polypeptide"
  source: /note="p.R181Q"
YRAVIIHGFVEELVVNEDPEYQWIDQQIRTPRASNEARQRLISLMSGELQRK

SEQ ID NO: 1644 - protein, 52 aa, Artificial Sequence
  source: /note="Description of Artificial Sequence: Synthetic polypeptide"
  source: /note="p.R1082W"
SHSITIDFTHPCHVALIRIWNYNKSWWIHSFRGVKDITMLLDTQCIFEGEIA

SEQ ID NO: 1645 - protein, 52 aa, Artificial Sequence
  source: /note="Description of Artificial Sequence: Synthetic polypeptide"
  source: /note="p.L330I"
FPDQERMCSRPGSRRERPLSATRKTIICEAEYPEEDASAVLQAIQVENAALQ

SEQ ID NO: 1646 - protein, 51 aa, Artificial Sequence
  source: /note="Description of Artificial Sequence: Synthetic polypeptide"
  source: /note="p.A1592fs"
PRWESSATLRFTDAPCQDVSDAAVSDLEDCSQSLSLSTMQEDMESSGADTF

SEQ ID NO: 1647 - protein, 52 aa, Artificial Sequence
  source: /note="Description of Artificial Sequence: Synthetic polypeptide"
  source: /note="p.Q446P"
GQSPMGGPFIPAAPVKTALPAGPQPPPPQPQPPLPSQPQAQKRRFTEELPDE

SEQ ID NO: 1648 - protein, 45 aa, Artificial Sequence
  source: /note="Description of Artificial Sequence: Synthetic polypeptide"
  source: /note="p.R516fs"
TGFSSQNEIEGAGSKPASSSGKEREGQAVDASTSLSSDWNKNRVR

SEQ ID NO: 1649 - protein, 52 aa, Artificial Sequence
  source: /note="Description of Artificial Sequence: Synthetic polypeptide"
  source: /note="p.L4680P"
SMSLHGNHMTLACFHGPNFRSKSWAPPFHLEEPNIAFWTEAQKIWEDGSSDH

SEQ ID NO: 1650 - protein, 52 aa, Artificial Sequence
  source: /note="Description of Artificial Sequence: Synthetic polypeptide"
  source: /note="p.S4937Y"
ITYTTVDWRDFMCNTWHLEPTLRLIYYWTGRKIDPVGVDYILQKLGFHHART

SEQ ID NO: 1651 - protein, 35 aa, Artificial Sequence
  source: /note="Description of Artificial Sequence: Synthetic polypeptide"
  source: /note="p.E1588fs"
ANSLLDRGMQLSGSTSNTPYTPLEKNSLITQMMKH

SEQ ID NO: 1652 - protein, 52 aa, Artificial Sequence
  source: /note="Description of Artificial Sequence: Synthetic polypeptide"
  source: /note="p.A149V"
YFRKGPFFGLACFANMPVESELERGVVRMKSVGILSPSYTLLYRYMHFLENQ

SEQ ID NO: 1653 - protein, 52 aa, Artificial Sequence
  source: /note="Description of Artificial Sequence: Synthetic polypeptide"
  source: /note="p.P1203Q"
SVTVEISDSAPPAPLVKEVTKRFSTQQDAAPVSTEPAWLALAKRKAKAWSDC

SEQ ID NO: 1654 - protein, 139 aa, Artificial Sequence
  source: /note="Description of Artificial Sequence: Synthetic polypeptide"
  source: /note="p.R308fs"
ERAPREEQQRSLEAPGWEDAERRERRSASAWRRRRSEGVCRPRPKRRRGGGWRRTPGWRSGGGRRRRKEDARRSSKGRRRRRLRDGKSWNSRRRRCRGRPRRWRRLGRAGGARRRRIWGKRRRRARRTWRTGGGSSVSF

SEQ ID NO: 1655 - protein, 82 aa, Artificial Sequence
  source: /note="Description of Artificial Sequence: Synthetic polypeptide"
  source: /note="p.E309fs"
RAPREEQQRSLEAPGWEDAERREREGARAPGGGGGAKASAGPGPSGGEAAAGGGRQAGGAEAAGGGGRKMRGGAQKAGGGGG

SEQ ID NO: 1656 - protein, 52 aa, Artificial Sequence
  source: /note="Description of Artificial Sequence: Synthetic polypeptide"
  source: /note="p.S138F"
LRGWYNCLTLAIYGSVDRVISHDRDFFPPPPPPPPPPPQPQPSLKRNPKHAD

SEQ ID NO: 1657 - protein, 52 aa, Artificial Sequence
  source: /note="Description of Artificial Sequence: Synthetic polypeptide"
  source: /note="p.D1526N"
VLSAPESLQNLFNNRTAYVLADVMDNNQLKSMWFTPFQAEEIDTDLDLVKVD

SEQ ID NO: 1658 - protein, 52 aa, Artificial Sequence
  source: /note="Description of Artificial Sequence: Synthetic polypeptide"
  source: /note="p.L1272F"
DGERLSAVKSSDLINKMDLQRAAIIFFGYRIQGVIAQPVDRVKRPSPESQSN

SEQ ID NO: 1659 - protein, 52 aa, Artificial Sequence
  source: /note="Description of Artificial Sequence: Synthetic polypeptide"
  source: /note="p.L63F"
LQEAEDDVDPGHSSSVKELDTDADKFFKKKTAEDRTQAFHLRQNLSALDKMH

SEQ ID NO: 1660 - protein, 52 aa, Artificial Sequence
  source: /note="Description of Artificial Sequence: Synthetic polypeptide"
  source: /note="p.K97N"
TQAFHLRQNLSALDKMHEEQELFTENNMRGELRACRQRRDLIDKQQEAVAAE

SEQ ID NO: 1661 - protein, 52 aa, Artificial Sequence
  source: /note="Description of Artificial Sequence: Synthetic polypeptide"
  source: /note="p.Q108H"
CLRDEVVVHLAPLNPLLLRQGDFYLHHVEPQEEQSVCIMIKCLSLDLCTVDK

SEQ ID NO: 1662 - protein, 52 aa, Artificial Sequence
  source: /note="Description of Artificial Sequence: Synthetic polypeptide"
  source: /note="p.V474M"
AALQQKSQEELLKRREQQLAEREIDMMLERELNILIFQLNQEKPKVKKRKGK

SEQ ID NO: 1663 - protein, 52 aa, Artificial Sequence
  source: /note="Description of Artificial Sequence: Synthetic polypeptide"
  source: /note="p.R477W"
QQKSQEELLKRREQQLAEREIDVLEWWELNILIFQLNQEKPKVKKRKGKFKR

SEQ ID NO: 1664 - protein, 113 aa, Artificial Sequence
  source: /note="Description of Artificial Sequence: Synthetic polypeptide"
  source: /note="p.P415fs"
TGIDLSGCTKWWRFAEFQYLQPGPPGGFRQWWCTCRMSGPSCLLWRSGRPCASRKLQRQLPQPRRHKGKRSLLNRHLMPWSKQQTLLDGTQKLQRPPHSRKRTLISQRPLHPP

SEQ ID NO: 1665 - protein, 52 aa, Artificial Sequence
  source: /note="Description of Artificial Sequence: Synthetic polypeptide"
  source: /note="p.C345F"
NVRDKTTLLMQEDAQFNFFPSVFTTFFPKRESKSGALKQSSDFSQFKVPDVS

SEQ ID NO: 1666 - protein, 52 aa, Artificial Sequence
  source: /note="Description of Artificial Sequence: Synthetic polypeptide"
  source: /note="p.R574C"
PAKMILDNHDISVEMGVKSNYEIRICCRPCEIKKTDCCKENLEKPRSPGEVT

SEQ ID NO: 1667 - protein, 27 aa, Artificial Sequence
  source: /note="Description of Artificial Sequence: Synthetic peptide"
  source: /note="p.K690fs"
LEQSLQSHKKLKLTKMRAKKKKKKKRN

SEQ ID NO: 1668 - protein, 52 aa, Artificial Sequence
  source: /note="Description of Artificial Sequence: Synthetic polypeptide"
  source: /note="p.N851S"
SNINGHDYMRNIVHLPVFLNSRGLSSSARKFLVTSATNGDVPCSDTTGIQED

SEQ ID NO: 1669 - protein, 47 aa, Artificial Sequence
  source: /note="Description of Artificial Sequence: Synthetic polypeptide"
  source: /note="p.K1115fs"
LNCVRERWSDALIKRREYLDEQIKKSAIKQRKQRTMWSGKPSLWSSG

SEQ ID NO: 1670 - protein, 52 aa, Artificial Sequence
  source: /note="Description of Artificial Sequence: Synthetic polypeptide"
  source: /note="p.R598Q"
VFTLVMTQTKTEFVEGEEHDHRITSQQINLIDLAGSERCSTAHTNGDRLKEG

SEQ ID NO: 1671 - protein, 52 aa, Artificial Sequence
  source: /note="Description of Artificial Sequence: Synthetic polypeptide"
  source: /note="p.E252Q"
TSMNRESSRSHAVFTITIESMEKSNQQIVNIRTSLLNLVDLAGSERQKDTHA

SEQ ID NO: 1672 - protein, 52 aa, Artificial Sequence
  source: /note="Description of Artificial Sequence: Synthetic polypeptide"
  source: /note="p.R145Q"
GLIPRICEGLFSRINETTRWDEASFQQTEVSYLEIYNERVRDLLRRKSSKTF

SEQ ID NO: 1673 - protein, 43 aa, Artificial Sequence
  source: /note="Description of Artificial Sequence: Synthetic polypeptide"
  source: /note="p.R17C"
MSVTEEDLCHHMKVVVCCVRPENTKEKAAGFHKVVHVVDKHIL

SEQ ID NO: 1674 - protein, 52 aa, Artificial Sequence
  source: /note="Description of Artificial Sequence: Synthetic polypeptide"
  source: /note="p.R1320W"
TVTIIHEKGSELHWKDVRELVVGRIWWNKPEVDEAAVDAILSLNIISAKYLK

SEQ ID NO: 1675 - protein, 52 aa, Artificial Sequence
  source: /note="Description of Artificial Sequence: Synthetic polypeptide"
  source: /note="p.E54K"
NFDGIKLDLSHEFSLVAPNTEANSFKKSKDYLQVCLRIRPFTQSEKELESEG

SEQ ID NO: 1676 - protein, 52 aa, Artificial Sequence
  source: /note="Description of Artificial Sequence: Synthetic polypeptide"
  source: /note="p.E991K"
NEIETATRSITNNVSQIKLMHTKIDKKLRTLDSVSQISNIDLLNLRDLSNGS

SEQ ID NO: 1677 - protein, 52 aa, Artificial Sequence
  source: /note="Description of Artificial Sequence: Synthetic polypeptide"
  source: /note="p.E350K"
KEQITISQLSLVDLAGSERTNRTRAKKGNRLREAGNINQSLMTLRTCMDVLR

SEQ ID NO: 1678 - protein, 52 aa, Artificial Sequence
  source: /note="Description of Artificial Sequence: Synthetic polypeptide"
  source: /note="p.R150Q"
SPGEGGLLPRCLDMIFNSIGSFQAKQQYVFKSNDRNSMDIQCEVDALLERQK

SEQ ID NO: 1679 - protein, 29 aa, Artificial Sequence
  source: /note="Description of Artificial Sequence: Synthetic peptide"
  source: /note="p.W3R"
MTRRTSGQLQREKQARPGSGAVLAFPDDK

SEQ ID NO: 1680 - protein, 89 aa, Artificial Sequence
  source: /note="Description of Artificial Sequence: Synthetic polypeptide"
  source: /note="p.S1065fs"
SLQSSRESLNSCGFVEGKPRPMGSPGWASPACPRPRSTSHPALLPRDAKSTPRRGSCRLPPHCLPRARIPAWRLGSPCCSPRCVRPRLE

SEQ ID NO: 1681 - protein, 52 aa, Artificial Sequence
  source: /note="Description of Artificial Sequence: Synthetic polypeptide"
  source: /note="p.V1113M"
RCKVYTQKGVLPSPAPLPPSSKDSGMMASRESLLQPEVRTPPVGMSPQVLKK

SEQ ID NO: 1682 - protein, 52 aa, Artificial Sequence
  source: /note="Description of Artificial Sequence: Synthetic polypeptide"
  source: /note="p.A1114V"
CKVYTQKGVLPSPAPLPPSSKDSGVVVSRESLLQPEVRTPPVGMSPQVLKKS

SEQ ID NO: 1683 - protein, 52 aa, Artificial Sequence
  source: /note="Description of Artificial Sequence: Synthetic polypeptide"
  source: /note="p.A2033T"
SKEAMCFNAKLKILEHRQQRIAEVRTTKYEWLMKELEATKQYLMLDPNKWLS

SEQ ID NO: 1684 - protein, 52 aa, Artificial Sequence
  source: /note="Description of Artificial Sequence: Synthetic polypeptide"
  source: /note="p.K925N"
LDACNLKRRKGSFGSIDHLQKLDEQNNKWLDEEVEKVLNQRQELEELEADLK

SEQ ID NO: 1685 - protein, 52 aa, Artificial Sequence
  source: /note="Description of Artificial Sequence: Synthetic polypeptide"
  source: /note="p.G480R"
ISAIQKAGLVDVDGHLVGEPEGQNFRRLGVAPFSTKPGKKAKSKKTFKEPLS

SEQ ID NO: 1686 - protein, 52 aa, Artificial Sequence
  source: /note="Description of Artificial Sequence: Synthetic polypeptide"
  source: /note="p.R594Q"
IRPDTPPSKPVAFEEFKNEQGSEINQQIFKENKSILNERRKRASETTQHINA

SEQ ID NO: 1687 - protein, 38 aa, Artificial Sequence
  source: /note="Description of Artificial Sequence: Synthetic polypeptide"
  source: /note="p.P335fs"
VDPKPTTTDIGSDVTLTCVWVGNPPSLSPGPKRTQIWS

SEQ ID NO: 1688 - protein, 52 aa, Artificial Sequence
  source: /note="Description of Artificial Sequence: Synthetic polypeptide"
  source: /note="p.G604C"
VDLKQDLRCDTIDTREEYEMKDPTNCCYYNVRAHEDRPSSRAVLYADYRAPG

SEQ ID NO: 1689 - protein, 103 aa, Artificial Sequence
  source: /note="Description of Artificial Sequence: Synthetic polypeptide"
  source: /note="p.V649fs"
PPSPLGPPGTPTFYDFNPHLGMVPPADFTEPGQAISPHPTLELSPATSNPHPLGPQIWPPGLPPSHMLPSPHLATRVSRLTCDIFPMEESWDLQLAIMDCSDF

SEQ ID NO: 1690 - protein, 52 aa, Artificial Sequence
  source: /note="Description of Artificial Sequence: Synthetic polypeptide"
  source: /note="p.W557G"
VAGMMCIIVMILTYKYLQKPMYEVQGGKVVEEINGNNYVYIDPTQLPYDHKW

SEQ ID NO: 1691 - protein, 52 aa, Artificial Sequence
  source: /note="Description of Artificial Sequence: Synthetic polypeptide"
  source: /note="p.D816H"
RDLAARNILLTHGRITKICDFGLARHHIKNDSNYVVKGNARLPVKWMAPESI

SEQ ID NO: 1692 - protein, 52 aa, Artificial Sequence
  source: /note="Description of Artificial Sequence: Synthetic polypeptide"
  source: /note="p.D816Y"
RDLAARNILLTHGRITKICDFGLARYYIKNDSNYVVKGNARLPVKWMAPESI

SEQ ID NO: 1693 - protein, 52 aa, Artificial Sequence
  source: /note="Description of Artificial Sequence: Synthetic polypeptide"
  source: /note="p.D816V"
RDLAARNILLTHGRITKICDFGLARVVIKNDSNYVVKGNARLPVKWMAPESI

SEQ ID NO: 1694 - protein, 52 aa, Artificial Sequence
  source: /note="Description of Artificial Sequence: Synthetic polypeptide"
  source: /note="p.N822Y"
NILLTHGRITKICDFGLARDIKNDSYYYVVKGNARLPVKWMAPESIFNCVYT

SEQ ID NO: 1695 - protein, 52 aa, Artificial Sequence
  source: /note="Description of Artificial Sequence: Synthetic polypeptide"
  source: /note="p.N822K"
NILLTHGRITKICDFGLARDIKNDSKKYVVKGNARLPVKWMAPESIFNCVYT

SEQ ID NO: 1696 - protein, 32 aa, Artificial Sequence
  source: /note="Description of Artificial Sequence: Synthetic polypeptide"
  source: /note="p.T568fs"
SFGKLRDALRRSSEMLVKKLQGGTPRSPLTPG

SEQ ID NO: 1697 - protein, 45 aa, Artificial Sequence
  source: /note="Description of Artificial Sequence: Synthetic polypeptide"
  source: /note="p.I104fs"
SLKFPSSHRRASPGLSMPSSSPPIKNTHPLLQACSPSACRCPCHQ

SEQ ID NO: 1698 - protein, 61 aa, Artificial Sequence
  source: /note="Description of Artificial Sequence: Synthetic polypeptide"
  source: /note="p.S224fs"
GIEPQRTDYYPEEMSPPLMNSVSPPASIVARESPFGHRAAWEETFTCGIPGYSKEAEDTQM

SEQ ID NO: 1699 - protein, 52 aa, Artificial Sequence
  source: /note="Description of Artificial Sequence: Synthetic polypeptide"
  source: /note="p.K434Q"
GRRSWPRKRTATHTCDYAGCGKTYTQQSSHLKAHLRTHTGEKPYHCDWDGCG

SEQ ID NO: 1700 - protein, 52 aa, Artificial Sequence
  source: /note="Description of Artificial Sequence: Synthetic polypeptide"
  source: /note="p.E419Q"
LRTHTGEKPYKCTWEGCDWRFARSDQQLTRHYRKHTGAKPFQCGVCNRSFSR

SEQ ID NO: 1701 - protein, 52 aa, Artificial Sequence
  source: /note="Description of Artificial Sequence: Synthetic polypeptide"
  source: /note="p.S118L"
EKYLTPQLPPVPIIPEHKKYRRDSALLVVDQFFTDTEGLPYSINMNVFLPDI

SEQ ID NO: 1702 - protein, 52 aa, Artificial Sequence
  source: /note="Description of Artificial Sequence: Synthetic polypeptide"
  source: /note="p.W321S"
DAWTYCISKNEWIQFNHPYTEKPRLSSHTACASDEGEVIVFGGCANNLLVHH

SEQ ID NO: 1703 - protein, 52 aa, Artificial Sequence
  source: /note="Description of Artificial Sequence: Synthetic polypeptide"
  source: /note="p.E635K"
DRWDFAPPLPSDTFALAHTATVRAKKKIFVTGGSLRFLLFRFSAQEQRWWAG

SEQ ID NO: 1704 - protein, 52 aa, Artificial Sequence
  source: /note="Description of Artificial Sequence: Synthetic polypeptide"
  source: /note="p.E213K"
FLISGVTLDNCVEVGRIANTYNLTEKMDKYVNSFVLKNFPALLSTGEFLKLP

SEQ ID NO: 1705 - protein, 54 aa, Artificial Sequence
  source: /note="Description of Artificial Sequence: Synthetic polypeptide"
  source: /note="p.P231fs"
KYLVEDVLLLNFEEMRALLDSLPPPWSRSWRSSRCPCCGWSTTARPACSMRLTS

SEQ ID NO: 1706 - protein, 52 aa, Artificial Sequence
  source: /note="Description of Artificial Sequence: Synthetic polypeptide"
  source: /note="p.D185G"
DNFVPLMSRPDFLSYLSFEKLMSYLGGNDHLSRFPEIELYEAVQSWLRHDRR

SEQ ID NO: 1707 - protein, 52 aa, Artificial Sequence
  source: /note="Description of Artificial Sequence: Synthetic polypeptide"
  source: /note="p.E33K"
YMLANLTHLHSEQLLQGLNLLRQHHKKLCDIILRVGDVKIHAHKVVLASVSP

SEQ ID NO: 1708 - protein, 52 aa, Artificial Sequence
  source: /note="Description of Artificial Sequence: Synthetic polypeptide"
  source: /note="p.R326C"
QLSQVVEACCKFLMKQLHPSNCLGICCSFADAQGCTDLHKVAHNYTMEHFME

SEQ ID NO: 1709 - protein, 52 aa, Artificial Sequence
  source: /note="Description of Artificial Sequence: Synthetic polypeptide"
  source: /note="p.P57T"
EKHSQPWQVAVYSHGWAHCGGVLVHTTQWVLTAAHCLKKNSQVWLGRHNLFE

SEQ ID NO: 1710 - protein, 52 aa, Artificial Sequence
  source: /note="Description of Artificial Sequence: Synthetic polypeptide"
  source: /note="p.E161K"
VKVLGLPTQEPALGTTCYASGWGSIKKPEEFLRPRSLQCVSLHLLSNDMCAR

SEQ ID NO: 1711 - protein, 52 aa, Artificial Sequence
  source: /note="Description of Artificial Sequence: Synthetic polypeptide"
  source: /note="p.R120H"
QSSVVRAVIHPDYDAASHDQDIMLLHHLARPAKLSELIQPLPLERDCSANTT

SEQ ID NO: 1712 - protein, 52 aa, Artificial Sequence
  source: /note="Description of Artificial Sequence: Synthetic polypeptide"
  source: /note="p.R29Q"
NEKLDNQRLKNFKNKGRDLETMRRQQQNEVVVELRKNKRDEHLLKRRNVPHE

SEQ ID NO: 1713 - protein, 55 aa, Artificial Sequence
  source: /note="Description of Artificial Sequence: Synthetic polypeptide"
  source: /note="p.E553fs"
YCGPSSYNQGQESGAGCGPGDVFPEPEGSGWPWRPRQCLCWSERGSKECLFLKER

SEQ ID NO: 1714 - protein, 52 aa, Artificial Sequence
  source: /note="Description of Artificial Sequence: Synthetic polypeptide"
  source: /note="p.A59G"
PTIEDSYRKQVVIDGETCLLDILDTGGGQEEYSAMRDQYMRTGEGFLCVFAI

SEQ ID NO: 1715 - protein, 53 aa, Artificial Sequence
  source: /note="Description of Artificial Sequence: Synthetic polypeptide"
  source: /note="p.Q61K"
IEDSYRKQVVIDGETCLLDILDTAGKKEEYSAMRDQYMRTGEGFLCVFAINNT

SEQ ID NO: 1716 - protein, 52 aa, Artificial Sequence; identical to SEQ ID NO: 1480
  source: /note="Description of Artificial Sequence: Synthetic polypeptide"
  source: /note="p.Q61R"

SEQ ID NO: 1717 - protein, 52 aa, Artificial Sequence
  source: /note="Description of Artificial Sequence: Synthetic polypeptide"
  source: /note="p.Q61L"
IEDSYRKQVVIDGETCLLDILDTAGLLEEYSAMRDQYMRTGEGFLCVFAINN

SEQ ID NO: 1718 - protein, 52 aa, Artificial Sequence
  source: /note="Description of Artificial Sequence: Synthetic polypeptide"
  source: /note="p.Q61H"
IEDSYRKQVVIDGETCLLDILDTAGHHEEYSAMRDQYMRTGEGFLCVFAINN

SEQ ID NO: 1719 - protein, 52 aa, Artificial Sequence; identical to SEQ ID NO: 1718
  source: /note="Description of Artificial Sequence: Synthetic polypeptide"
  source: /note="p.Q61H"

SEQ ID NO: 1720 - protein, 38 aa, Artificial Sequence; identical to SEQ ID NO: 1481
  source: /note="Description of Artificial Sequence: Synthetic polypeptide"
  source: /note="p.G12S"

SEQ ID NO: 1721 - protein, 38 aa, Artificial Sequence
  source: /note="Description of Artificial Sequence: Synthetic polypeptide"
  source: /note="p.G12R"
MTEYKLVVVGARRGVGKSALTIQLIQNHFVDEYDPTIE

SEQ ID NO: 1722 - protein, 38 aa, Artificial Sequence
  source: /note="Description of Artificial Sequence: Synthetic polypeptide"
  source: /note="p.G12C"
MTEYKLVVVGACCGVGKSALTIQLIQNHFVDEYDPTIE

SEQ ID NO: 1723 - protein, 38 aa, Artificial Sequence; identical to SEQ ID NO: 1482
  source: /note="Description of Artificial Sequence: Synthetic polypeptide"
  source: /note="p.G12D"

SEQ ID NO: 1724 - protein, 38 aa, Artificial Sequence; identical to SEQ ID NO: 1483
  source: /note="Description of Artificial Sequence: Synthetic polypeptide"
  source: /note="p.G12A"

SEQ ID NO: 1725 - protein, 38 aa, Artificial Sequence
  source: /note="Description of Artificial Sequence: Synthetic polypeptide"
  source: /note="p.G12V"
MTEYKLVVVGAVVGVGKSALTIQLIQNHFVDEYDPTIE

SEQ ID NO: 1726 - protein, 39 aa, Artificial Sequence
  source: /note="Description of Artificial Sequence: Synthetic polypeptide"
  source: /note="p.G13C"
MTEYKLVVVGAGCCVGKSALTIQLIQNHFVDEYDPTIED

SEQ ID NO: 1727 - protein, 39 aa, Artificial Sequence
  source: /note="Description of Artificial Sequence: Synthetic polypeptide"
  source: /note="p.G13D"
MTEYKLVVVGAGDDVGKSALTIQLIQNHFVDEYDPTIED

SEQ ID NO: 1728 - protein, 52 aa, Artificial Sequence
  source: /note="Description of Artificial Sequence: Synthetic polypeptide"
  source: /note="p.A146T"
PSRTVDTKQAQDLARSYGIPFIETSTTKTRQRVEDAFYTLVREIRQYRLKKI

SEQ ID NO: 1729 - protein, 52 aa, Artificial Sequence
  source: /note="Description of Artificial Sequence: Synthetic polypeptide"
  source: /note="p.R839G"
DRLATALAGLAQEVATMRTQVNRLGGGRPQGPGPMGQASWMWTLPRGPRWAH

SEQ ID NO: 1730 - protein, 52 aa, Artificial Sequence
  source: /note="Description of Artificial Sequence: Synthetic polypeptide"
  source: /note="p.L299W"
KRTAAENDFVTLKKDVDNAYMIKVEWWQSKVDLLNQEIEFLKVLYDAEISQI

SEQ ID NO: 1731 - protein, 40 aa, Artificial Sequence
  source: /note="Description of Artificial Sequence: Synthetic polypeptide"
  source: /note="p.F154fs"
RGNKSISMSVAGSRQGACFGGAGGFRHWWLWWWIWGLLQW

SEQ ID NO: 1732 - protein, 52 aa, Artificial Sequence
  source: /note="Description of Artificial Sequence: Synthetic polypeptide"
  source: /note="p.L197P"
NKFASFIDKVRFLEQQNKVLDTKWTPPLQEQGTKTVRQNLEPLFEQYINNLR

SEQ ID NO: 1733 - protein, 52 aa, Artificial Sequence
  source: /note="Description of Artificial Sequence: Synthetic polypeptide"
  source: /note="p.S59A"
TQKSYKVSTSGPRAFSSRSYTSGPGAARISSSSFSRVGSSNFRGGLGGGYGG

SEQ ID NO: 1734 - protein, 52 aa, Artificial Sequence
  source: /note="Description of Artificial Sequence: Synthetic polypeptide"
  source: /note="p.I116V"
CGTGCGIGGGIGYGQEGSSGAVSTRVVRWCRPDCRVEGTCLPPCCVVSCTPP

SEQ ID NO: 1735 - protein, 52 aa, Artificial Sequence
  source: /note="Description of Artificial Sequence: Synthetic polypeptide"
  source: /note="p.M124I"
ACQSESSSAGLACVSQPCQSESTQQIIGFVAQSCQPASLKGNSCPPKTSKSK

SEQ ID NO: 1736 - protein, 52 aa, Artificial Sequence
  source: /note="Description of Artificial Sequence: Synthetic polypeptide"
  source: /note="p.S48R"
TCCRPSCCETTCCRTTYCRPSCCVSRRCCRPQCCQSVCCQPTCCRPRCCISS

SEQ ID NO: 1737 - protein, 52 aa, Artificial Sequence
  source: /note="Description of Artificial Sequence: Synthetic polypeptide"
  source: /note="p.S74C"
VCYQPTCCHPSCCISSCCRPYCCESCCCCRPCCCQTTCCRTTCCRTTCCCPS

SEQ ID NO: 1738 - protein, 52 aa, Artificial Sequence
  source: /note="Description of Artificial Sequence: Synthetic polypeptide"
  source: /note="p.C91F"
CRPYCCESSCCRPCCCQTTCCRTTCFFRTTCCCPSCCVSSCCRPQCCQSVCC

SEQ ID NO: 1739 - protein, 52 aa, Artificial Sequence
  source: /note="Description of Artificial Sequence: Synthetic polypeptide"
  source: /note="p.T63S"
TCYRPSYSVSCCCRPQCCQSVCCQPSSCCRPSCCVSSCCKPQCCQSVCCQPT

SEQ ID NO: 1740 - protein, 44 aa, Artificial Sequence
  source: /note="Description of Artificial Sequence: Synthetic polypeptide"
  source: /note="p.D18V"
MVSSCCGSVCSDQGCGQVVLCQETCCRPSCCETTCCRTTCCRPS

SEQ ID NO: 1741 - protein, 52 aa, Artificial Sequence
  source: /note="Description of Artificial Sequence: Synthetic polypeptide"
  source: /note="p.S193Y"
GSCGGSKGGCGSCGGCKGGCGSCGGYYKGGCGSGCGGCGSGCGVPVCCCSCS

SEQ ID NO: 1742 - protein, 52 aa, Artificial Sequence
  source: /note="Description of Artificial Sequence: Synthetic polypeptide"
  source: /note="p.T555M"
FNLPASHYYKYKQQFIFPDVVPVPEMMPTRAPQVILHPVTSNPILEGNPLLQ

SEQ ID NO: 1743 - protein, 52 aa, Artificial Sequence
  source: /note="Description of Artificial Sequence: Synthetic polypeptide"
  source: /note="p.R632S"
LVVGSPGPVPRLVLSDLHLLTQSQVSSVSWSPAEDHNAPIEKYDIEFEDKEM

SEQ ID NO: 1744 - protein, 52 aa, Artificial Sequence
  source: /note="Description of Artificial Sequence: Synthetic polypeptide"
  source: /note="p.T186M"
PPSAEPLRIYWMNSKILHIKQDERVMMMGQNGNLYFANVLTSDNHSDYICHA

SEQ ID NO: 1745 - protein, 47 aa, Artificial Sequence
  source: /note="Description of Artificial Sequence: Synthetic polypeptide"
  source: /note="p.P441del"
VEDFVFDAGVGDIGNRILHVRNAPSAATSSIAISGMIADEVQQRFEL

SEQ ID NO: 1746 - protein, 52 aa, Artificial Sequence
  source: /note="Description of Artificial Sequence: Synthetic polypeptide"
  source: /note="p.W162L"
HPVGWCEKTKHELHIPKGYRKDKFVLLMDYLKACKLQNAPKKLFRNRSPNGP

SEQ ID NO: 1747 - protein, 31 aa, Artificial Sequence
  source: /note="Description of Artificial Sequence: Synthetic polypeptide"
  source: /note="p.M5L"
MYRLLLSAVTARAAAPGGLASSCGRRGVHQR

SEQ ID NO: 1748 - protein, 52 aa, Artificial Sequence
  source: /note="Description of Artificial Sequence: Synthetic polypeptide"
  source: /note="p.A41T"
AILAKQFTKCELSQLLKDIDGYGGITTLPELICTMFHTSGYDTQAIVENNES

SEQ ID NO: 1749 - protein, 52 aa, Artificial Sequence
  source: /note="Description of Artificial Sequence: Synthetic polypeptide"
  source: /note="p.D1030Y"
NTCDPETGECVCPPHTQGVKCEECEYYGHWGYDAEVGCQACNCSLVGSTHHR

SEQ ID NO: 1750 - protein, 52 aa, Artificial Sequence
  source: /note="Description of Artificial Sequence: Synthetic polypeptide"
  source: /note="p.A558V"
SLSTSADSLTTPRLTLSELDDIIKNVVSGIYAEIDGAKSELQVKLSNLSNLS

SEQ ID NO: 1751 - protein, 52 aa, Artificial Sequence
  source: /note="Description of Artificial Sequence: Synthetic polypeptide"
  source: /note="p.E639K"
NGLVQKALDASNVYENIVNYVSEANKKTAEFALNTTDRIYDAVSGIDTQIIY

SEQ ID NO: 1752 - protein, 52 aa, Artificial Sequence
  source: /note="Description of Artificial Sequence: Synthetic polypeptide"
  source: /note="p.M1293I"
PNGLLFYYASGSDVFSISLDNGTVIIIDVKGIKVQSVDKQYNDGLSHFVISS

SEQ ID NO: 1753 - protein, 52 aa, Artificial Sequence
  source: /note="Description of Artificial Sequence: Synthetic polypeptide"
  source: /note="p.L2223R"
SSMAWARLHRLNASIADLQSQLRSPRRGPRHETAQQLEVLEQQSTSLGQDAR

SEQ ID NO: 1754 - protein, 52 aa, Artificial Sequence
  source: /note="Description of Artificial Sequence: Synthetic polypeptide"
  source: /note="p.G588W"
GLAPLGSETFGQSPAVHVVLGEPVPWWNPVTWTGPGFARVLPGAGLRFAVNN

SEQ ID NO: 1755 - protein, 52 aa, Artificial Sequence
  source: /note="Description of Artificial Sequence: Synthetic polypeptide"
  source: /note="p.G1239W"
EADFKDLRGNVSEIERILKHPVFPSWWKFLKVKDYHDSVRRQIMQLNEQLKA

SEQ ID NO: 1756 - protein, 53 aa, Artificial Sequence
  source: /note="Description of Artificial Sequence: Synthetic polypeptide"
  source: /note="p.P174Q"
KRSRADGPWEPYQFYSASCQKTYGRQQEGQYLRPGEDERVAFCTSEFSDISPL

SEQ ID NO: 1757 - protein, 43 aa, Artificial Sequence
  source: /note="Description of Artificial Sequence: Synthetic polypeptide"
  source: /note="p.A223fs"
PRHIPANRGEIKGSESATYVPVAPPHPSLATRDQTGACLARPG

SEQ ID NO: 1758 - protein, 71 aa, Artificial Sequence
  source: /note="Description of Artificial Sequence: Synthetic polypeptide"
  source: /note="p.T163fs"
PENSETGGNESQPDSQEDPREVLKKHWNSAYLGRTLLVTCILYHRWIVTSMCQSQRWLTSTTSRSSALMWT

SEQ ID NO: 1759 - protein, 48 aa, Artificial Sequence
  source: /note="Description of Artificial Sequence: Synthetic polypeptide"
  source: /note="p.P185fs"
MKSLGLSDEEIVKFSEAEHWLDYFPATGYSGFKKNGFEGRLASFLHHH

SEQ ID NO: 1760 - protein, 44 aa, Artificial Sequence
  source: /note="Description of Artificial Sequence: Synthetic polypeptide"
  source: /note="p.L18W"
MSSGTELLWPGAALLVLWWGVAASLCVRCSRPGAKRSEKIYQQR

SEQ ID NO: 1761 - protein, 52 aa, Artificial Sequence
  source: /note="Description of Artificial Sequence: Synthetic polypeptide"
  source: /note="p.R176W"
SPADRDQIAQQLGLTNAQVITWFQNWWRAKLKRDLEEMKADVESAKKLGPSG

SEQ ID NO: 1762 - protein, 37 aa, Artificial Sequence
  source: /note="Description of Artificial Sequence: Synthetic polypeptide"
  source: /note="p.P445fs"
SDALVIFQLYEKIKVPVDWNRVNKPAIPQTGRQYEEA

SEQ ID NO: 1763 - protein, 42 aa, Artificial Sequence
  source: /note="Description of Artificial Sequence: Synthetic polypeptide"
  source: /note="p.L16Q"
MKQRFSALQLLKLLLQQLQPPLPRALREALCPEPCNCVPDGA

SEQ ID NO: 1764 - protein, 52 aa, Artificial Sequence
  source: /note="Description of Artificial Sequence: Synthetic polypeptide"
  source: /note="p.H410Y"
SPVTSAHSGTYRCYGSLSSNPYLLSYYPSDSLELMVSGAAETLSPPQNKSDS

SEQ ID NO: 1765 - protein, 53 aa, Artificial Sequence
  source: /note="Description of Artificial Sequence: Synthetic polypeptide"
  source: /note="p.L479del"
GLGRHLGVVIGILVAVILLLLLLLLFLILRHRRQGKHWTSTQRKADFQHPAGA

SEQ ID NO: 1766 - protein, 51 aa, Artificial Sequence
  source: /note="Description of Artificial Sequence: Synthetic polypeptide"
  source: /note="p.S598P"
TKDRQAEEDRQMDTERVLSSPGPQAPPPPPPRSLPLTLPRCRLLHLKPPRM

SEQ ID NO: 1767 - protein, 52 aa, Artificial Sequence
  source: /note="Description of Artificial Sequence: Synthetic polypeptide"
  source: /note="p.S150T"
IMAFAHQPTFSRISRPFSAGIMFFSTTTLFVVLALAIYTGVTVSFLGRRFGD

SEQ ID NO: 1768 - protein, 52 aa, Artificial Sequence
  source: /note="Description of Artificial Sequence: Synthetic polypeptide"
  source: /note="p.R203H"
TTVQVKEVNRMHISPNNRNAIHPGDHHILEINGTPVRTLRVEEVEDAISQTS

SEQ ID NO: 1769 - protein, 52 aa, Artificial Sequence
  source: /note="Description of Artificial Sequence: Synthetic polypeptide"
  source: /note="p.R183W"
FCVCLKESFPNLKTRKLTRVEWGKIWWRLMGKPRRCSSAFFEEERSALKQKR

SEQ ID NO: 1770 - protein, 52 aa, Artificial Sequence
  source: /note="Description of Artificial Sequence: Synthetic polypeptide"
  source: /note="p.E231K"
QKRQKIRLLQQRKVADVSQFKDLPDKKIPLPLVIGTKVTARLRGVHDGLFTG

SEQ ID NO: 1771 - protein, 52 aa, Artificial Sequence
  source: /note="Description of Artificial Sequence: Synthetic polypeptide"
  source: /note="p.P410T"
PDTIRERSFKDFHSTALSFYFTCKKTTKIREKKLQHLLVDEGQTVQLECSAD

SEQ ID NO: 1772 - protein, 52 aa, Artificial Sequence
  source: /note="Description of Artificial Sequence: Synthetic polypeptide"
  source: /note="p.P236Q"
GSKLCPLQIFDKICLNILFMMFGYDQQKNLNMSRLDVYFSHNPAGTSVQNML

SEQ ID NO: 1773 - protein, 35 aa, Artificial Sequence
  source: /note="Description of Artificial Sequence: Synthetic polypeptide"
  source: /note="p.P955fs"
PRCLVDSAETKNHRPGNGAGPKKAPEPSQELRDSE

SEQ ID NO: 1774 - protein, 52 aa, Artificial Sequence
  source: /note="Description of Artificial Sequence: Synthetic polypeptide"
  source: /note="p.G199C"
PVIVPEEHLQQCRVYRGGKWPHGAVCCVPDQEGISDADFVLYVGALATERCS

SEQ ID NO: 1775 - protein, 53 aa, Artificial Sequence
  source: /note="Description of Artificial Sequence: Synthetic polypeptide"
  source: /note="p.Q285del"
RHQQQQEQQNSQRLGQGEPGPGQGLQEVLSSRMEGMMASYTPLAPPQQQIVAM

SEQ ID NO: 1776 - protein, 52 aa, Artificial Sequence
  source: /note="Description of Artificial Sequence: Synthetic polypeptide"
  source: /note="p.T532P"
ADDNLKTPSERQLTALPPSADDNIKPPPAERLRGPLPPSADDNLKTPSERQL

SEQ ID NO: 1777 - protein, 52 aa, Artificial Sequence
  source: /note="Description of Artificial Sequence: Synthetic polypeptide"
  source: /note="p.P90S"
AEGIAMLLGTAGPSRLPAAPDASQASSLRSPWALSVAAALCSPVSCHPCGRH

SEQ ID NO: 1778 - protein, 52 aa, Artificial Sequence
  source: /note="Description of Artificial Sequence: Synthetic polypeptide"
  source: /note="p.L144M"
CVLAPGSGSRPTPHIVYSVPAARTCMMGAPGSLSPCHLCVHICAHTYSGTPV

SEQ ID NO: 1779 - protein, 61 aa, Artificial Sequence
  source: /note="Description of Artificial Sequence: Synthetic polypeptide"
  source: /note="p.RAPWMEQ147del"
LSVGDVDDTQCVRLDSDATSPRMEPEGPEYWEEETGTAKAKAQFYRVNLRTLSGYYNQSEA

SEQ ID NO: 1780 - protein, 52 aa, Artificial Sequence
  source: /note="Description of Artificial Sequence: Synthetic polypeptide"
  source: /note="p.G93E"
AGEDGRMIASQVVDINLAAEPKVNREENAGVKRSAAEMYGSSFDLDYGFQRD

SEQ ID NO: 1781 - protein, 52 aa, Artificial Sequence
  source: /note="Description of Artificial Sequence: Synthetic polypeptide"
  source: /note="p.F906I"
EFIFLIGIDKTKYAIACPIFAGLLHIIFFLAAFAWMCLEGVQLYLMLVEVFE

SEQ ID NO: 1782 - protein, 52 aa, Artificial Sequence
  source: /note="Description of Artificial Sequence: Synthetic polypeptide"
  source: /note="p.E740D"
FPENMGHGSTIQLSANTLKQNGRNGDDIRVAFVLYNNLGPYLSTENASMKLG

SEQ ID NO: 1783 - protein, 52 aa, Artificial Sequence
  source: /note="Description of Artificial Sequence: Synthetic polypeptide"
  source: /note="p.R826H"
VFTVKHIKQSEENFNPNCSFWSYSKHHTMTGYWSTQGCRLLTTNKTHTTCSC

SEQ ID NO: 1784 - protein, 52 aa, Artificial Sequence
  source: /note="Description of Artificial Sequence: Synthetic polypeptide"
  source: /note="p.R1183Q"
SGSRTPGRYSTGSQSRIRRMWNDTVQQKQSESSFITGDINSSASLNREGLLN

SEQ ID NO: 1785 - protein, 28 aa, Artificial Sequence
  source: /note="Description of Artificial Sequence: Synthetic peptide"
  source: /note="p.S974L"
SDTFSNFTFWREPLPPFENQDIHSALLA

SEQ ID NO: 1786 - protein, 52 aa, Artificial Sequence
  source: /note="Description of Artificial Sequence: Synthetic polypeptide"
  source: /note="p.A186S"
TDQGACAGSPSLVAAARRAFPCKDASSLCAYAVTYTAMYVTLVFRVKGSRLV

SEQ ID NO: 1787 - protein, 52 aa, Artificial Sequence
  source: /note="Description of Artificial Sequence: Synthetic polypeptide"
  source: /note="p.R527S"
LKIQPGAVPGCNNSMPGGPRVSIQSSSPGSSQLVHIPEETQENISTSPKSSS

SEQ ID NO: 1788 - protein, 52 aa, Artificial Sequence
  source: /note="Description of Artificial Sequence: Synthetic polypeptide"
  source: /note="p.E2103K"
VSLSTPAQLVAPSVVVKGTLSVTSSKKLYFEVDEEDPNFKKIDPKILAYTEG

SEQ ID NO: 1789 - protein, 52 aa, Artificial Sequence
  source: /note="Description of Artificial Sequence: Synthetic polypeptide"
  source: /note="p.D717G"
SIHVPSPAVPKLSMAKCRRNVENFLGGACKKLGVSQERLCLPHHILEERGLV

SEQ ID NO: 1790 - protein, 52 aa, Artificial Sequence
  source: /note="Description of Artificial Sequence: Synthetic polypeptide"
  source: /note="p.N132K"
NSNRLTKITNDMFSGLSNLHHLILNKKNQLTLISSTAFDDVFALEELDLSYN

SEQ ID NO: 1791 - protein, 50 aa, Artificial Sequence
  source: /note="Description of Artificial Sequence: Synthetic polypeptide"
  source: /note="p.L24V"
MARPVRGGLGAPRRSPCLLLLWLVVLLRLEPVTAAAGPRAPCAAACTCAG

SEQ ID NO: 1792 - protein, 52 aa, Artificial Sequence
  source: /note="Description of Artificial Sequence: Synthetic polypeptide"
  source: /note="p.L26V"
MARPVRGGLGAPRRSPCLLLLWLLLVVRLEPVTAAAGPRAPCAAACTCAGDS

SEQ ID NO: 1793 - protein, 52 aa, Artificial Sequence
  source: /note="Description of Artificial Sequence: Synthetic polypeptide"
  source: /note="p.P1058T"
TCDGDNDCGDYSDETHANCTNQATRTTPGGCHTDEFQCRLDGLCIPLRWRCD

SEQ ID NO: 1794 - protein, 30 aa, Artificial Sequence
  source: /note="Description of Artificial Sequence: Synthetic polypeptide"
  source: /note="p.G1488fs"
GSGHMEVLRGHEFLSHPFAVTLYGGGGLLD

SEQ ID NO: 1795 - protein, 104 aa, Artificial Sequence
  source: /note="Description of Artificial Sequence: Synthetic polypeptide"
  source: /note="p.G1488fs"
GSGHMEVLRGHEFLSHPFAVTLYGGRSTGLTGEQTHWLRPTSGPATMSPWYRGPTPSPLTCRCTTPPASPWLPIPVRPMGARAPAPTCVSSTTTGPCPAPAPTS

SEQ ID NO: 1796 - protein, 38 aa, Artificial Sequence
  source: /note="Description of Artificial Sequence: Synthetic polypeptide"
  source: /note="p.L11del"
MLLATLLLLLGGALAHPDRIIFPNHACEDPPAVLLEVQ

SEQ ID NO: 1797 - protein, 52 aa, Artificial Sequence
  source: /note="Description of Artificial Sequence: Synthetic polypeptide"
  source: /note="p.P92R"
QQERPQEELELELRAGGGPQEDCPGRRGSGGYSAMPDAIIRTKDSLAAGASF

SEQ ID NO: 1798 - protein, 52 aa, Artificial Sequence
  source: /note="Description of Artificial Sequence: Synthetic polypeptide"
  source: /note="p.G310C"
CTWLIDTGDHRKVILRFTDFKLDGTCCYGDYVKIYDGLEENPHKLLRVLTAF

SEQ ID NO: 1799 - protein, 52 aa, Artificial Sequence
  source: /note="Description of Artificial Sequence: Synthetic polypeptide"
  source: /note="p.G3563C"
FDCADGSDERNCETSCSKDQFRCSNCCQCIPAKWKCDGHEDCKYGEDEKSCE

SEQ ID NO: 1800 - protein, 52 aa, Artificial Sequence
  source: /note="Description of Artificial Sequence: Synthetic polypeptide"
  source: /note="p.L1392F"
SLRTTLIAGAMEHPRAIALDPRYGIFFFWTDWDANFPRIESASMSGAGRKTI

SEQ ID NO: 1801 - protein, 52 aa, Artificial Sequence
  source: /note="Description of Artificial Sequence: Synthetic polypeptide"
  source: /note="p.M4039I"
FGTCPQHCRNTKGSYECVCADGFTSIISDRPGKRCAAEGSSPLLLLPDNVRI

SEQ ID NO: 1802 - protein, 52 aa, Artificial Sequence
  source: /note="Description of Artificial Sequence: Synthetic polypeptide"
  source: /note="p.A516V"
IDMVNLDGSYRVTLITENLGHPRGIVVVDPTVGYLFFSDWESLSGEPKLERA

SEQ ID NO: 1803 - protein, 52 aa, Artificial Sequence
  source: /note="Description of Artificial Sequence: Synthetic polypeptide"
  source: /note="p.S737L"
IFSSQVAIRGIPFTLSTQEDVMVPVLLGNPSFFVGIDFDAQDSTIFFSDMSK

SEQ ID NO: 1804 - protein, 52 aa, Artificial Sequence
  source: /note="Description of Artificial Sequence: Synthetic polypeptide"
  source: /note="p.R2432I"
NHSPPFQTINVERTVMSLDYDSVSDIIIYFTQNLASGVGQISYATLSSGIHT

SEQ ID NO: 1805 - protein, 52 aa, Artificial Sequence
  source: /note="Description of Artificial Sequence: Synthetic polypeptide"
  source: /note="p.R3043C"
CGDYSDERGCLYQTCQQNQFTCQNGCCCISKTFVCDEDNDCGDGSDELMHLC

SEQ ID NO: 1806 - protein, 33 aa, Artificial Sequence
  source: /note="Description of Artificial Sequence: Synthetic polypeptide"
  source: /note="p.S1609P"
LSAEDSCPPSPATERSYFHLFPPPPPPPCTDSS

SEQ ID NO: 1807 - protein, 52 aa, Artificial Sequence
  source: /note="Description of Artificial Sequence: Synthetic polypeptide"
  source: /note="p.R675Q"
NNNNVAIPLTGVKEASALDFDVTDNQQIYWTDISLKTISRAFMNGSALEHVV

SEQ ID NO: 1808 - protein, 52 aa, Artificial Sequence
  source: /note="Description of Artificial Sequence: Synthetic polypeptide"
  source: /note="p.D227N"
LDHRDLIPIIAALEYNQWFTKLSSKNNLKLSTDVCEQILRVVSRSNRLEELV

SEQ ID NO: 1809 - protein, 52 aa, Artificial Sequence
  source: /note="Description of Artificial Sequence: Synthetic polypeptide"
  source: /note="p.R787W"
AVDKELQVILESMVSLTQELCPVAMWWVAEGHNKMLSNVAERVTVPRNFIRG

SEQ ID NO: 1810 - protein, 52 aa, Artificial Sequence
  source: /note="Description of Artificial Sequence: Synthetic polypeptide"
  source: /note="p.R218W"
RRLENLYVVEEKDLCAACLRKCQNAWWDNLNRIKNMATTTPRKTIFPNLISP

SEQ ID NO: 1811 - protein, 49 aa, Artificial Sequence
  source: /note="Description of Artificial Sequence: Synthetic polypeptide"
  source: /note="p.K23T"
RKKTSSEGETKPQTSTVNKFLRTASNAESRKEDNDLKTSDSQPSDWIQK

SEQ ID NO: 1812 - protein, 52 aa, Artificial Sequence
  source: /note="Description of Artificial Sequence: Synthetic polypeptide"
  source: /note="p.T102S"
ELEQPHTQQGPEKLAGNAIYTKPSFSSQEHKAAVSVLTPFSKGAPSTSSPAK

SEQ ID NO: 1813 - protein, 52 aa, Artificial Sequence
  source: /note="Description of Artificial Sequence: Synthetic polypeptide"
  source: /note="p.A406D"
ETPGQPPEHHEVTVSPPGHHQTHHLDDSPSVSVKPPDVQLTIAAEPSAEVGT

SEQ ID NO: 1814 - protein, 34 aa, Artificial Sequence
  source: /note="Description of Artificial Sequence: Synthetic polypeptide"
  source: /note="p.D558fs"
KEPAKEWKVLKKKKEPPKELRQDPPSSRCWAGAW

SEQ ID NO: 1815 - protein, 52 aa, Artificial Sequence
  source: /note="Description of Artificial Sequence: Synthetic polypeptide"
  source: /note="p.R1389H"
VPPDTITKKAGSHIQTLMGSQSLQHHHSREQQPYEGNINKVTIQQFQSPLPI

SEQ ID NO: 1816 - protein, 32 aa, Artificial Sequence
  source: /note="Description of Artificial Sequence: Synthetic polypeptide"
  source: /note="p.A6V"
MEAAAVVVVAAEAEVENEDGDSSCGDVCFMDK

SEQ ID NO: 1817 - protein, 52 aa, Artificial Sequence
  source: /note="Description of Artificial Sequence: Synthetic polypeptide"
  source: /note="p.W792L"
RKRPVKCPANMTPALDKLEILRCGPLLDTLQQVTTVTFQDLPGCVLSTLAEC

SEQ ID NO: 1818 - protein, 31 aa, Artificial Sequence
  source: /note="Description of Artificial Sequence: Synthetic polypeptide"
  source: /note="p.K244fs"
LIVQRWIRGFLVRKNLSPVFFHKKKTAGKNY

SEQ ID NO: 1819 - protein, 52 aa, Artificial Sequence
  source: /note="Description of Artificial Sequence: Synthetic polypeptide"
  source: /note="p.S243Y"
SKINFAHFPRLFNLRSIYLQWNRIRYYISQGLTWTWSSLHNLDLSGNDIQGI

SEQ ID NO: 1820 - protein, 52 aa, Artificial Sequence
  source: /note="Description of Artificial Sequence: Synthetic polypeptide"
  source: /note="p.S139L"
DLTNLTELQLRNNSIRTLDRDLLRHLLPLLRHLDLSINGLAQLPPGLFDGLL

SEQ ID NO: 1821 - protein, 52 aa, Artificial Sequence
  source: /note="Description of Artificial Sequence: Synthetic polypeptide"
  source: /note="p.L176V"
GLAQLPPGLFDGLLALRSLSLRSNRVVQNLDRLTFEPLANLQLLQVGDNPWE

SEQ ID NO: 1822 - protein, 52 aa, Artificial Sequence
  source: /note="Description of Artificial Sequence: Synthetic polypeptide"
  source: /note="p.R517L"
ITPREDEDPHRPPTSEELLTAYGYMLLGFMTAHGQPDQPRSARYILKDYVSG

SEQ ID NO: 1823 - protein, 52 aa, Artificial Sequence
  source: /note="Description of Artificial Sequence: Synthetic polypeptide"
  source: /note="p.F107L"
YKGSPMEISLPIALSKNQEIVIEISLLETSPKSSALQWLTPEQTSGKEHPYL

SEQ ID NO: 1824 - protein, 52 aa, Artificial Sequence
  source: /note="Description of Artificial Sequence: Synthetic polypeptide"
  source: /note="p.F73L"
QKRSVTALMVLNLALADLAVLLTAPLLFLHFLAQGTWSFGLAGCRLCHYVCG

SEQ ID NO: 1825 - protein, 52 aa, Artificial Sequence
  source: /note="Description of Artificial Sequence: Synthetic polypeptide"
  source: /note="p.S148T"
GKNEEKIQVLTDKIDVLLQQIEELGTTEGKVEEAQGMMKLVEQLKEERELLR

SEQ ID NO: 1826 - protein, 52 aa, Artificial Sequence
  source: /note="Description of Artificial Sequence: Synthetic polypeptide"
  source: /note="p.R310L"
QLEKFDIKSFCKILGPLSYSKIKHLLLLDGNRISETSLPPDMYECLRVANEV

SEQ ID NO: 1827 - protein, 35 aa, Artificial Sequence
  source: /note="Description of Artificial Sequence: Synthetic polypeptide"
  source: /note="p.R330C"
KIKHLRLDGNRISETSLPPDMYECLCCVANEVTLN

SEQ ID NO: 1828 - protein, 52 aa, Artificial Sequence
  source: /note="Description of Artificial Sequence: Synthetic polypeptide"
  source: /note="p.I69L"
RASGKDSAPTVVSGILGGSVTLPLNLLSVDTEIENVIWIGPKNALAFARPKE

SEQ ID NO: 1829 - protein, 52 aa, Artificial Sequence
  source: /note="Description of Artificial Sequence: Synthetic polypeptide"
  source: /note="p.T64K"
AVAFHNWKWLLMRNMVCKLQEGCEEKKLVFIETGTARGVVGFKGCSSSSSYP

SEQ ID NO: 1830 - protein, 52 aa, Artificial Sequence
  source: /note="Description of Artificial Sequence: Synthetic polypeptide"
  source: /note="p.Q710H"
DLLWKWDALKAYQNFVFEEDRLHSIHHIANHICNLIQKGNIVVQWKLYNYIF

SEQ ID NO: 1831 - protein, 98 aa, Artificial Sequence
  source: /note="Description of Artificial Sequence: Synthetic polypeptide"
  source: /note="p.RTQDLEGALRTKGLEL432del"
AKASEILGLKAQLKDTRGKLEGLELEVCENELQRKKNEAELLREKVNLLEQELQELRAQAALARDMGPPTFPEDVPALQRELERLRAELREERQGHDQ

SEQ ID NO: 1832 - protein, 65 aa, Artificial Sequence
  source: /note="Description of Artificial Sequence: Synthetic polypeptide"
  source: /note="p.P100fs"
VPPRKAVPVTSFTYINEDFRTESPPAQAVMLRMPESSGHTMPTSAAHHQSSSLSLESWRRTWRRS

SEQ ID NO: 1833 - protein, 52 aa, Artificial Sequence
  source: /note="Description of Artificial Sequence: Synthetic polypeptide"
  source: /note="p.R345C"
EAHVPLQDYEASNSVTPKMVVLDAGCCYQKLRVGSSGFSHFNSSNEEQRSNT

SEQ ID NO: 1834 - protein, 32 aa, Artificial Sequence
  source: /note="Description of Artificial Sequence: Synthetic polypeptide"
  source: /note="p.G53fs"
MKFEVKKEPVETDRIISQCGRLIAGARCPPPP

SEQ ID NO: 1835 - protein, 52 aa, Artificial Sequence
  source: /note="Description of Artificial Sequence: Synthetic polypeptide"
  source: /note="p.L609H"
PQGEDSLSPHYFPQSPPQGEDSMSPHHYFPQSPLQGEEFQSSLQSPVSICSS

SEQ ID NO: 1836 - protein, 53 aa, Artificial Sequence
  source: /note="Description of Artificial Sequence: Synthetic polypeptide"
  source: /note="p.P239del"
FQSSPERTQSTFEGFAQSPLQIPVSSSSSTLLSLFQSFSERTQSTFEGFAQSS

SEQ ID NO: 1837 - protein, 52 aa, Artificial Sequence
  source: /note="Description of Artificial Sequence: Synthetic polypeptide"
  source: /note="p.V380M"
SVLPIPGEGLSTSVPPTASDGSDTSMMPPTPGEGASTLVQPTAPDGPGSSVL

SEQ ID NO: 1838 - protein, 51 aa, Artificial Sequence
  source: /note="Description of Artificial Sequence: Synthetic polypeptide"
  source: /note="p.Q45fs"
GDGRGEIQATNASGSPTSMLVVDAPSALRRQSTLSVSTLPRPFRTRMTWRS

SEQ ID NO: 1839 - protein, 52 aa, Artificial Sequence
  source: /note="Description of Artificial Sequence: Synthetic polypeptide"
  source: /note="p.G1156V"
KGFGFSLRGGREYNMDLYVLRLAEDVVPAERCGKMRIGDEILEINGETTKNM

SEQ ID NO: 1840 - protein, 52 aa, Artificial Sequence
  source: /note="Description of Artificial Sequence: Synthetic polypeptide"
  source: /note="p.R1198C"
INGETTKNMKHSRAIELIKNGGRRVCCLFLKRGDGSVPEYDPSSDRHGPATG

SEQ ID NO: 1841 - protein, 52 aa, Artificial Sequence
  source: /note="Description of Artificial Sequence: Synthetic polypeptide"
  source: /note="p.L450M"
LSTTLKKSNMGFGFTIIGGDEPDEFMMQVKSVIPDGPAAQDGKMETGDVIVY

SEQ ID NO: 1842 - protein, 52 aa, Artificial Sequence
  source: /note="Description of Artificial Sequence: Synthetic polypeptide"
  source: /note="p.P1044T"
PSSEKQSPMAQQSPLAQQSPLAQPSTTATPNSPIAQPAPPQPLQLQGHENSY

SEQ ID NO: 1843 - protein, 52 aa, Artificial Sequence
  source: /note="Description of Artificial Sequence: Synthetic polypeptide"
  source: /note="p.Q591K"
QANQQMPSVLPSQNKPSLLHYTQQQKKQQQQQQQQQQQQQQQQQQQQQQQQQ

SEQ ID NO: 1844 - protein, 52 aa, Artificial Sequence
  source: /note="Description of Artificial Sequence: Synthetic polypeptide"
  source: /note="p.Q572L"
YLQQPTPTQASSATASSTATATLQLLLQQQQQQQQQPDHSSFLLQQMMQQPQ

SEQ ID NO: 1845 - protein, 33 aa, Artificial Sequence
  source: /note="Description of Artificial Sequence: Synthetic polypeptide"
  source: /note="p.P162fs"
QPHPRMKPSPLTPCPPGVPSPSPPPTQVGTSDP

SEQ ID NO: 1846 - protein, 91 aa, Artificial Sequence
  source: /note="Description of Artificial Sequence: Synthetic polypeptide"
  source: /note="p.G431fs"
MEAKNMYYEALEAIETYLLNVSPGGADLHCRVARGDSGPQDGAPGLFLRGHDRPWRRGCQGRKEGPLPRARSPDHQDVSRVIRPLRHQTWA

SEQ ID NO: 1847 - protein, 29 aa, Artificial Sequence
  source: /note="Description of Artificial Sequence: Synthetic peptide"
  source: /note="p.P2063fs"
GPTVPPRPEPGPSMEPSLTPPAVPPVLLS

SEQ ID NO: 1848 - protein, 52 aa, Artificial Sequence
  source: /note="Description of Artificial Sequence: Synthetic polypeptide"
  source: /note="p.E2046D"
EGYSYETSTKTTRTPDTSTYCYETADDKITRTPQASTYSYETSDLCYTAEKK

SEQ ID NO: 1849 - protein, 52 aa, Artificial Sequence
  source: /note="Description of Artificial Sequence: Synthetic polypeptide"
  source: /note="p.S411C"
EKMGVGRLDMYVLHPPSAGAERTLACCVCALLVWHPAGPGEKVVRVLFPGCT

SEQ ID NO: 1850 - protein, 52 aa, Artificial Sequence
  source: /note="Description of Artificial Sequence: Synthetic polypeptide"
  source: /note="p.K530N"
QAVTDSAMTSKTLEKAMTEPSALIENNSSIQELFEMRVDDKDKIEGVGAATS

SEQ ID NO: 1851 - protein, 46 aa, Artificial Sequence
  source: /note="Description of Artificial Sequence: Synthetic polypeptide"
  source: /note="p.K1472fs"
EPSTVSRDEVRRKKAVYKKAELAKKNRSSGPLSLQEIHFKTCYQIY

SEQ ID NO: 1852 - protein, 52 aa, Artificial Sequence
  source: /note="Description of Artificial Sequence: Synthetic polypeptide"
  source: /note="p.K57N"
ALQKKLEELELDEQQRKRLEAFLTQNNQKVGELKDDDFEKISELGAGNGGVV

SEQ ID NO: 1853 - protein, 52 aa, Artificial Sequence; identical to SEQ ID NO: 1852
  source: /note="Description of Artificial Sequence: Synthetic polypeptide"
  source: /note="p.K57N"

SEQ ID NO: 1854 - protein, 52 aa, Artificial Sequence
  source: /note="Description of Artificial Sequence: Synthetic polypeptide"
  source: /note="p.P124S"
IHLEIKPAIRNQIIRELQVLHECNSSSYIVGFYGAFYSDGEISICMEHMDGG

SEQ ID NO: 1855 - protein, 52 aa, Artificial Sequence
  source: /note="Description of Artificial Sequence: Synthetic polypeptide"
  source: /note="p.S184L"
PYIVQFYGALFREGDCWICMELMSTLLFDKFYKYVYSVLDDVIPEEILGKIT

SEQ ID NO: 1856 - protein, 52 aa, Artificial Sequence
  source: /note="Description of Artificial Sequence: Synthetic polypeptide"
  source: /note="p.S251I"
IHRDIKPSNILLDRSGNIKLCDFGIIIGQLVDSIAKTRDAGCRPYMAPERID

SEQ ID NO: 1857 - protein, 28 aa, Artificial Sequence
  source: /note="Description of Artificial Sequence: Synthetic peptide"
  source: /note="p.T261fs"
DRSGNIKLCDFGISGQLVDSIAKTRCWL

SEQ ID NO: 1858 - protein, 52 aa, Artificial Sequence
  source: /note="Description of Artificial Sequence: Synthetic polypeptide"
  source: /note="p.R287H"
RDAGCRPYMAPERIDPSASRQGYDVHHSDVWSLGITLYELATGRFPYPKWNS

SEQ ID NO: 1859 - protein, 30 aa, Artificial Sequence
  source: /note="Description of Artificial Sequence: Synthetic polypeptide"
  source: /note="p.Q445R"
VQFNDGNAAVVSMWVCRALEERRSQRRGPP

SEQ ID NO: 1860 - protein, 59 aa, Artificial Sequence
  source: /note="Description of Artificial Sequence: Synthetic polypeptide"
  source: /note="p.I761fs"
LNCILGNQTESNNWQELLGRLCLIDCCWNFLLNFILILSVLMFHKLSLLKSGIRSCCPS

SEQ ID NO: 1861 - protein, 53 aa, Artificial Sequence
  source: /note="Description of Artificial Sequence: Synthetic polypeptide"
  source: /note="p.V1346del"
LFIEWMAGGSVAHLLSKYGAFKESVINYTEQLLRGLSYLHENQIIHRDVKGAN

SEQ ID NO: 1862 - protein, 59 aa, Artificial Sequence
  source: /note="Description of Artificial Sequence: Synthetic polypeptide"
  source: /note="p.L1384fs"
LHENQIIHRDVKGANLLIDSTGQRLKNCRFWSCSQVGIKRNWCRRVSGTITGDNCIYGT

SEQ ID NO: 1863 - protein, 31 aa, Artificial Sequence
  source: /note="Description of Artificial Sequence: Synthetic polypeptide"
  source: /note="p.L318fs"
DGFSPYSPEETNRRVNKVMRARLYLTAADRA

SEQ ID NO: 1864 - protein, 52 aa, Artificial Sequence
  source: /note="Description of Artificial Sequence: Synthetic polypeptide"
  source: /note="p.P324L"
YSPEETNRRVNKVMRARLYLLQQIGLLNSFLIGGDSPDNKYRVFIGPQNCSC

SEQ ID NO: 1865 - protein, 53 aa, Artificial Sequence
  source: /note="Description of Artificial Sequence: Synthetic polypeptide"
  source: /note="p.R449del"
KLHFEKIKSEGTCLHRLEEELVMRREELRHALDIREHYERKLERANNLYMELN

SEQ ID NO: 1866 - protein, 52 aa, Artificial Sequence
  source: /note="Description of Artificial Sequence: Synthetic polypeptide"
  source: /note="p.R275Q"
ENTSGFWLNRSNELIWLELQAWHAGQQTINDQDFFLYTARQAIPDIINEILT

SEQ ID NO: 1867 - protein, 52 aa, Artificial Sequence
  source: /note="Description of Artificial Sequence: Synthetic polypeptide"
  source: /note="p.E524Q"
AYLTLDHQLQPLAPCPNSKESMAVFQQQHCKMAQEYMKVQTEIALLLQRKQE

SEQ ID NO: 1868 - protein, 52 aa, Artificial Sequence
  source: /note="Description of Artificial Sequence: Synthetic polypeptide"
  source: /note="p.R341G"
SRGQHGPAERTPSEIQFHQVKFGAPGGRKETDPLNEPWEEEWTLLGKEELSG

SEQ ID NO: 1869 - protein, 46 aa, Artificial Sequence
  source: /note="Description of Artificial Sequence: Synthetic polypeptide"
  source: /note="p.P657fs"
LFDYARQMQKLPVAIPAHKLPDRILQGNFLYQQKSLKPNGARSVVL

SEQ ID NO: 1870 - protein, 32 aa, Artificial Sequence
  source: /note="Description of Artificial Sequence: Synthetic polypeptide"
  source: /note="p.A80fs"
ATSSKQLPLEPESPSGQVGPRPAPPAGRVPFL

SEQ ID NO: 1871 - protein, 52 aa, Artificial Sequence
  source: /note="Description of Artificial Sequence: Synthetic polypeptide"
  source: /note="p.R487C"
ERLEKEEQDRLEREELKRKAEEERLCCLEEEARKQEEERKRQEEEKKKQEGE

SEQ ID NO: 1872 - protein, 26 aa, Artificial Sequence
  source: /note="Description of Artificial Sequence: Synthetic peptide"
  source: /note="p.Q308fs"
PQTKVEESPLEKVETPPKASVDAPPR

SEQ ID NO: 1873 - protein, 52 aa, Artificial Sequence
  source: /note="Description of Artificial Sequence: Synthetic polypeptide"
  source: /note="p.K485N"
QKKAAKREEALASFEAWKAMKEKEANNKIAAKKRLEEKNKKKTEEENAARKG

SEQ ID NO: 1874 - protein, 52 aa, Artificial Sequence
  source: /note="Description of Artificial Sequence: Synthetic polypeptide"
  source: /note="p.E322K"
NPHKRIEVEQALAHPYLEQYYDPSDKKPIAEAPFKFDMELDDLPKEKLKELI

SEQ ID NO: 1875 - protein, 52 aa, Artificial Sequence
  source: /note="Description of Artificial Sequence: Synthetic polypeptide"
  source: /note="p.E315K"
ELDVDKRLTAAQALTHPFFEPFRDPKKEETEAQQPFDDSLEHEKLTVDEWKQ

SEQ ID NO: 1876 - protein, 127 aa, Artificial Sequence
  source: /note="Description of Artificial Sequence: Synthetic polypeptide"
  source: /note="p.Q511fs"
PPRLPPEARPGRRMFSTSALQGAQGVPGLCLEATPKPTGLSATRHWATCPCWRGTMCEPPYSLHLALCSCPSPFPRPLSSLLHPLALPALPGPLKFQGACPGLLGGADEGPAPAPLTSSNKVMSAPN

SEQ ID NO: 1877 - protein, 52 aa, Artificial Sequence
  source: /note="Description of Artificial Sequence: Synthetic polypeptide"
  source: /note="p.V100M"
DNIVKVYEVLGPKGTDLQGELFKFSMMAYIVQEYMETDLARLLEQGTLAEEH

SEQ ID NO: 1878 - protein, 52 aa, Artificial Sequence
  source: /note="Description of Artificial Sequence: Synthetic polypeptide"
  source: /note="p.A501D"
KAALKAALLKSLRSRLRDGPSAPLEDDPEPRKPVTAQERQREREEKRRRRQE

SEQ ID NO: 1879 - protein, 81 aa, Artificial Sequence
  source: /note="Description of Artificial Sequence: Synthetic polypeptide"
  source: /note="p.L217fs"
SSSPLKTGEQTPPHEHICLSDELPPPRAAPPPPQIEAPPPTALAAAAQPPRWHLRVVPLLPRLGVGATRIETESTTRPMCD

SEQ ID NO: 1880 - protein, 51 aa, Artificial Sequence
  source: /note="Description of Artificial Sequence: Synthetic polypeptide"
  source: /note="p.T214fs"
ENLLYTSKRPNAILKLTDFGFAKETHQPQLFDHSLLYTVLCGSRSAGSREV

SEQ ID NO: 1881 - protein, 52 aa, Artificial Sequence
  source: /note="Description of Artificial Sequence: Synthetic polypeptide"
  source: /note="p.R193L"
PICKICFQGAEQGELLNPCRCDGSVLLYTHQLCLLKWISERGSWTCELCCYR

SEQ ID NO: 1882 - protein, 52 aa, Artificial Sequence
  source: /note="Description of Artificial Sequence: Synthetic polypeptide"
  source: /note="p.R170C"
GLPTIPVMLILGKMIRWEDYVLRLWCCKYSNKLQILNSIFPGIGCPVPRIPA

SEQ ID NO: 1883 - protein, 36 aa, Artificial Sequence
  source: /note="Description of Artificial Sequence: Synthetic polypeptide"
  source: /note="p.K152fs"
ASSTSSPKAEDGATPSPSNETPKKKRSAFPSRSLSS

SEQ ID NO: 1884 - protein, 52 aa, Artificial Sequence
  source: /note="Description of Artificial Sequence: Synthetic polypeptide"
  source: /note="p.R481Q"
LPKQVADHYDNFRIYKALEAVSSCVQQQTNGFVQRHAPWKLNWESPVDAPWL

SEQ ID NO: 1885 - protein, 52 aa, Artificial Sequence
  source: /note="Description of Artificial Sequence: Synthetic polypeptide"
  source: /note="p.R324G"
ISLFLIINSSANPIIYFFVGSLRKKGGLKESLRVILQRALADKPEVGRNKKA

SEQ ID NO: 1886 - protein, 52 aa, Artificial Sequence
  source: /note="Description of Artificial Sequence: Synthetic polypeptide"
  source: /note="p.E166G"
YATDETEECMPLTIVLAHKLNAKLAGGLRRNGTLPWLRPDSKTQVTVQYMQD

SEQ ID NO: 1887 - protein, 52 aa, Artificial Sequence
  source: /note="Description of Artificial Sequence: Synthetic polypeptide"
  source: /note="p.R36W"
SDEEQPRFQSAADKRAHHNALERKRWWDHIKDSFHSLRDSVPSLQGEKASRA

SEQ ID NO: 1888 - protein, 52 aa, Artificial Sequence
  source: /note="Description of Artificial Sequence: Synthetic polypeptide"
  source: /note="p.H28R"
DNDDIEVESDEEQPRFQSAADKRAHRRNALERKRRDHIKDSFHSLRDSVPSL

SEQ ID NO: 1889 - protein, 52 aa, Artificial Sequence
  source: /note="Description of Artificial Sequence: Synthetic polypeptide"
  source: /note="p.Q311E"
EWRLSFARSEVQLKKCISSSLMQAYEEACKAIIIKLLSRPKAISPYHLRSMM

SEQ ID NO: 1890 - protein, 42 aa, Artificial Sequence
  source: /note="Description of Artificial Sequence: Synthetic polypeptide"
  source: /note="p.P732fs"
SVTTATTDPGASSLGKAPSNSGRPPNSLALCWVPACWVTCLH

SEQ ID NO: 1891 - protein, 34 aa, Artificial Sequence
  source: /note="Description of Artificial Sequence: Synthetic polypeptide"
  source: /note="p.G780fs"
LPSLLQPPGPLLSGQLGLQLLPGGGSSSTPLRGF

SEQ ID NO: 1892 - protein, 52 aa, Artificial Sequence
  source: /note="Description of Artificial Sequence: Synthetic polypeptide"
  source: /note="p.R43Q"
AVQLPIDQVNFVVCQLFALLAAIWFQQTYLHSSKTSSFIRHVVATLLGLYLA

SEQ ID NO: 1893 - protein, 52 aa, Artificial Sequence
  source: /note="Description of Artificial Sequence: Synthetic polypeptide"
  source: /note="p.R424W"
HWFLKMRAYDYMCMGFVLLSLADTLWWYWASIYFCIHFLALAALGLGLALGG

SEQ ID NO: 1894 - protein, 52 aa, Artificial Sequence
  source: /note="Description of Artificial Sequence: Synthetic polypeptide"
  source: /note="p.A109T"
LVSMSSAWETITIYLLNNKHLVIADTTFVRHIDNVFDSMICISVVASMCSLL

SEQ ID NO: 1895 - protein, 52 aa, Artificial Sequence
  source: /note="Description of Artificial Sequence: Synthetic polypeptide"
  source: /note="p.R926Q"
KTMKLMTLSIRQLGRGSHRKFEIASQQNGLEKYILQAASKEIRDCWFSEISK

SEQ ID NO: 1896 - protein, 52 aa, Artificial Sequence
  source: /note="Description of Artificial Sequence: Synthetic polypeptide"
  source: /note="p.S306F"
QFFLAFALPFVVITAAYVRILQRMTFFSVAPASQRSIRLRTKRVTRTAIAIC

SEQ ID NO: 1897 - protein, 52 aa, Artificial Sequence
  source: /note="Description of Artificial Sequence: Synthetic polypeptide"
  source: /note="p.V141I"
VYTQSDVYDQLIFAVNQYLQLYNVSIIGNHAYENKGTKQSAMAICQHFYKRG

SEQ ID NO: 1898 - protein, 52 aa, Artificial Sequence
  source: /note="Description of Artificial Sequence: Synthetic polypeptide"
  source: /note="p.R915Q"
SELLQSVPSMFNFRAPPNALPENLLQQKGKERYTCRYCGKIFPRSANLTRHL

SEQ ID NO: 1899 - protein, 52 aa, Artificial Sequence
  source: /note="Description of Artificial Sequence: Synthetic polypeptide"
  source: /note="p.R969C"
TGEQPYRCKYCDRSFSISSNLQRHVCCNIHNKEKPFKCHLCDRCFGQQTNLD

SEQ ID NO: 1900 - protein, 52 aa, Artificial Sequence
  source: /note="Description of Artificial Sequence: Synthetic polypeptide"
  source: /note="p.L36R"
HRPLKRPRLGPPDVYPQDPKQKEDERRTALNVKQGFNNQPAVSGDEHGSAKN

SEQ ID NO: 1901 - protein, 52 aa, Artificial Sequence
  source: /note="Description of Artificial Sequence: Synthetic polypeptide"
  source: /note="p.G44S"
LGPPDVYPQDPKQKEDELTALNVKQSSFNNQPAVSGDEHGSAKNVSFNPAKI

SEQ ID NO: 1902 - protein, 52 aa, Artificial Sequence
  source: /note="Description of Artificial Sequence: Synthetic polypeptide"
  source: /note="p.L1224F"
IRSSCDRHLLAASQNRIVDGAVFAVFFKAVFVLGDAELKGSGFTVTGGTEEL

SEQ ID NO: 1903 - protein, 52 aa, Artificial Sequence
  source: /note="Description of Artificial Sequence: Synthetic polypeptide"
  source: /note="p.C1292Y"
LCTDKELILDPVLSNMQAQKLLQLIYYYPHGIKECTEGDNLQRQHIKRILQN

SEQ ID NO: 1904 - protein, 52 aa, Artificial Sequence
  source: /note="Description of Artificial Sequence: Synthetic polypeptide"
  source: /note="p.P2071S"
QDPMRPRQPQVRQQQRLLQMQQPQQSSQPQQPPQPQQSSQSQSQTLGLQAMQ

SEQ ID NO: 1905 - protein, 53 aa, Artificial Sequence
  source: /note="Description of Artificial Sequence: Synthetic polypeptide"
  source: /note="p.Q2115del"
LGLQAMQPQQPLFPRQGLQQTQQQQTAALVRQLQKQLSSNQPQQGVTPYGHPS

SEQ ID NO: 1906 - protein, 52 aa, Artificial Sequence
  source: /note="Description of Artificial Sequence: Synthetic polypeptide"
  source: /note="p.S35I"
WRSTAFRQKLVSQIEDAMRKAGVAHIIKSSKDMESHVFLKAKTRDEYLSLVA

SEQ ID NO: 1907 - protein, 52 aa, Artificial Sequence
  source: /note="Description of Artificial Sequence: Synthetic polypeptide"
  source: /note="p.H449Q"
TAGPAVHLKAMQLSWTSLALVGIDSQQGKLSVLRLSPSMGHPLEVGLALRHL

SEQ ID NO: 1908 - protein, 52 aa, Artificial Sequence
  source: /note="Description of Artificial Sequence: Synthetic polypeptide"
  source: /note="p.P99S"
EPHESRTNSDIVEALNKKEHRGCDSSSDPDTSYVLTPHTEEKYKKINEEFDN

SEQ ID NO: 1909 - protein, 52 aa, Artificial Sequence
  source: /note="Description of Artificial Sequence: Synthetic polypeptide"
  source: /note="p.R127Q"
DTSYVLTPHTEEKYKKINEEFDNMMQQNHKIAPGLPPQNFSMSVTVPVTSPN

SEQ ID NO: 1910 - protein, 52 aa, Artificial Sequence
  source: /note="Description of Artificial Sequence: Synthetic polypeptide"
  source: /note="p.R377H"
CPRCQDSHERKSPGSLSPQPLPQCKHHHLKQVQLLFCEDHDEPICLICSLSQ

SEQ ID NO: 1911 - protein, 52 aa, Artificial Sequence
  source: /note="Description of Artificial Sequence: Synthetic polypeptide"
  source: /note="p.S1053L"
NPYATIKDPPVLIPKSSECGYVEMKLLPARRDSPYAEINNSTSANRNVYEVE

SEQ ID NO: 1912 - protein, 52 aa, Artificial Sequence
  source: /note="Description of Artificial Sequence: Synthetic polypeptide"
  source: /note="p.Y393C"
RTCIDVDDCADSPCCQQVCTNNPGGCCECGCYAGYRLSADGCGCEDVDECAS

SEQ ID NO: 1913 - protein, 35 aa, Artificial Sequence
  source: /note="Description of Artificial Sequence: Synthetic polypeptide"
  source: /note="p.A582fs"
DTFGKNCSFSCSCQNGGTCDSVTGALPLPPGCQWN

SEQ ID NO: 1914 - protein, 52 aa, Artificial Sequence
  source: /note="Description of Artificial Sequence: Synthetic polypeptide"
  source: /note="p.H1094Y"
VVIGPSSLIVHFNEVIGRGHFGCVYYYGTLLDNDGKKIHCAVKSLNRITDIG

SEQ ID NO: 1915 - protein, 52 aa, Artificial Sequence
  source: /note="Description of Artificial Sequence: Synthetic polypeptide"
  source: /note="p.M1250T"
LARDMYDKEYYSVHNKTGAKLPVKWTTALESLQTQKFTTKSDVWSFGVLLWE

SEQ ID NO: 1916 - protein, 52 aa, Artificial Sequence
  source: /note="Description of Artificial Sequence: Synthetic polypeptide"
  source: /note="p.Q53E"
VWPNRIHTTAEKYREYEAREQTDQTEEAQELHRSQDRDFETMAKLHIPVMVD

SEQ ID NO: 1917 - protein, 52 aa, Artificial Sequence
  source: /note="Description of Artificial Sequence: Synthetic polypeptide"
  source: /note="p.R200Q"
EIIYDFCMCNPPFFANQLEAKGVNSQQNPRRPPPSSVNTGGITEIMAEGGEL

SEQ ID NO: 1918 - protein, 52 aa, Artificial Sequence
  source: /note="Description of Artificial Sequence: Synthetic polypeptide"
  source: /note="p.R174Q"
EETFTDLLQTLEHLCSNHSVILLACQQIRYERDNNFLAMLERQFTVRKVHYD

SEQ ID NO: 1919 - protein, 52 aa, Artificial Sequence
  source: /note="Description of Artificial Sequence: Synthetic polypeptide"
  source: /note="p.F56L"
DFKQQKLEQEAQKNWDLFYKRNSTNLLFKDRHWTTREFEELRSCREFEDQKL

SEQ ID NO: 1920 - protein, 52 aa, Artificial Sequence
  source: /note="Description of Artificial Sequence: Synthetic polypeptide"
  source: /note="p.Y57F"
LYVNMTSGPGGPAAAAGGRKENHQWFFVCNREKLCESLQAVFVQSYLDQGTQ

SEQ ID NO: 1921 - protein, 52 aa, Artificial Sequence
  source: /note="Description of Artificial Sequence: Synthetic polypeptide"
  source: /note="p.R534S"
IWTPFEPVNPLSGFGSDPSGNMKTQSSRGSQPSTPRLSPTFPESIEHPLARR

SEQ ID NO: 1922 - protein, 60 aa, Artificial Sequence
  source: /note="Description of Artificial Sequence: Synthetic polypeptide"
  source: /note="p.179_182AAAA>A"
IPGGSLGSVLLPAARFDAREAAAAAAGVLYGGDDAQGMMAAMLSHAYGPGGCGAAAAALN

SEQ ID NO: 1923 - protein, 34 aa, Artificial Sequence
  source: /note="Description of Artificial Sequence: Synthetic polypeptide"
  source: /note="p.S7F"
MSKGTSFFDTSLGRVSRAAFPSPTAAEMAEISRI

SEQ ID NO: 1924 - protein, 52 aa, Artificial Sequence
  source: /note="Description of Artificial Sequence: Synthetic polypeptide"
  source: /note="p.R162C"
TTPQNEEIRAVGRLKRERSMSENAVCCQNGQLVRNDSLWHRSDSAPRNKISR

SEQ ID NO: 1925 - protein, 52 aa, Artificial Sequence
  source: /note="Description of Artificial Sequence: Synthetic polypeptide"
  source: /note="p.D170N"
GASRLASHEYLKAFKVAYSLNGHEFNNFIHDVNKKHKEFVGNWNKNAVHVNL

SEQ ID NO: 1926 - protein, 52 aa, Artificial Sequence
  source: /note="Description of Artificial Sequence: Synthetic polypeptide"
  source: /note="p.R280Q"
FEAWYIHEHVERHDFPAEWIPATFAQQAAFWNHVLAVVAGVAAEAVASWIGL

SEQ ID NO: 1927 - protein, 52 aa, Artificial Sequence
  source: /note="Description of Artificial Sequence: Synthetic polypeptide"
  source: /note="p.R2435Q"
WSDKLQKEAEAFAYYRRTHTANERRQQRGEMRDLFEKLKITLGLLHSSKVSK

SEQ ID NO: 1928 - protein, 52 aa, Artificial Sequence
  source: /note="Description of Artificial Sequence: Synthetic polypeptide"
  source: /note="p.T444P"
STSLKTYQHFTLEKAYLREDFFWAFPPPAAGDFIRFRFFQPLRLERFFFRSG

SEQ ID NO: 1929 - protein, 52 aa, Artificial Sequence
  source: /note="Description of Artificial Sequence: Synthetic polypeptide"
  source: /note="p.T345M"
LAQKNVIRFKPSLFQHMGYYSSYKGMMENKLKDDDFEEESFDIPDNPPASLY

SEQ ID NO: 1930 - protein, 32 aa, Artificial Sequence
  source: /note="Description of Artificial Sequence: Synthetic polypeptide"
  source: /note="p.K102fs"
FATCLGLVYIYGRHLYFWGYSEAAKNGSPVSD

SEQ ID NO: 1931 - protein, 48 aa, Artificial Sequence
  source: /note="Description of Artificial Sequence: Synthetic polypeptide"
  source: /note="p.G143fs"
SIALLGLVGTTVCSAFQHLGWVKSGFGQWTQMLPLKNYRGLKTLIHFK

SEQ ID NO: 1932 - protein, 51 aa, Artificial Sequence
  source: /note="Description of Artificial Sequence: Synthetic polypeptide"
  source: /note="p.G318fs"
HPVPSGKVLVLQSHWQTFHVSAVAALLFLLLLFSMSVVVRRKHQLQRVQSS

SEQ ID NO: 1933 - protein, 52 aa, Artificial Sequence
  source: /note="Description of Artificial Sequence: Synthetic polypeptide"
  source: /note="p.L131F"
ESEGGDVAPNLPDMTLDKEQIAKDLFFSGEEEEETQSSADDLTPSVTSHEAS

SEQ ID NO: 1934 - protein, 52 aa, Artificial Sequence
  source: /note="Description of Artificial Sequence: Synthetic polypeptide"
  source: /note="p.R1081S"
REPAGDGKSIRTFKESPKQILDPAASSVTGMKKWPRTPKEEAQSLEDLAGFK

SEQ ID NO: 1935 - protein, 34 aa, Artificial Sequence
  source: /note="Description of Artificial Sequence: Synthetic polypeptide"
  source: /note="p.T1664fs"
VGVKEELLAVGKLTQTSGETTHTHTKSQQEMVRA

SEQ ID NO: 1936 - protein, 34 aa, Artificial Sequence
  source: /note="Description of Artificial Sequence: Synthetic polypeptide"
  source: /note="p.T1664fs"
VGVKEELLAVGKLTQTSGETTHTHTQSQQEMVRA

SEQ ID NO: 1937 - protein, 52 aa, Artificial Sequence
  source: /note="Description of Artificial Sequence: Synthetic polypeptide"
  source: /note="p.H2213D"
AQPLEDLAGLKELFQTPICTDKPTTDDEKTTKIACRSPQPDPVGTPTIFKPQ

SEQ ID NO: 1938 - protein, 54 aa, Artificial Sequence
  source: /note="Description of Artificial Sequence: Synthetic polypeptide"
  source: /note="p.P307fs"
HHNYQAILPAPPKSAGEALGSSGTPQYAASPLPIAAPARAPLGPVGWHVRTAPH

SEQ ID NO: 1939 - protein, 52 aa, Artificial Sequence
  source: /note="Description of Artificial Sequence: Synthetic polypeptide"
  source: /note="p.F485L"
CMLFHSKNRCLYVFGGQRSKTYLNDLLFSYDVDSDHVDIISDGTKKDSGMVP

SEQ ID NO: 1940 - protein, 52 aa, Artificial Sequence
  source: /note="Description of Artificial Sequence: Synthetic polypeptide"
  source: /note="p.P448H"
PEGWGDEPPGPGGGSFSAYWHQLVEHHVRMGEGNMLYKSIKKELVVLRLASL

SEQ ID NO: 1941 - protein, 52 aa, Artificial Sequence
  source: /note="Description of Artificial Sequence: Synthetic polypeptide"
  source: /note="p.G270V"
YYASRGVCFRGESCMYLHGDICDMCVVLQTLHPMDAAQREEHMRACIEAHEK

SEQ ID NO: 1942 - protein, 26 aa, Artificial Sequence
  source: /note="Description of Artificial Sequence: Synthetic peptide"
  source: /note="p.P647fs"
ASRLSPPPEDSPMSPPPEESPMSPPT

SEQ ID NO: 1943 - protein, 307 aa, Artificial Sequence
  source: /note="Description of Artificial Sequence: Synthetic polypeptide"
  source: /note="p.P647fs"
EASRLSPPPEDSPMSPPPEESPMSPHLRYRAYPPCLWCHACLHRLRNLPCPHRLRSLPRPLHLRLHASPHHLRTPPHPHHLRTHLLPHHRRTRSCPCRWRSHPCCHYLRSRNSAPGPRGRTCHPGLRSRTCPPGLRSHTYLRRLRSHTCPPSLRSHAYALCLRSHTCPPRLRDHICPLSLRNCTCPPRLRSRTCLLCLRSHACPPNLRNHTCPPSLRSHACPPGLRNRICPLSLRSHPCPLGLKSPLRSQANALHLRSCPCSLPLGNHPYLPCLESQPCLSLGNHLCPLCPRSCRCPHLGSHPCRLS

SEQ ID NO: 1944 - protein, 298 aa, Artificial Sequence
  source: /note="Description of Artificial Sequence: Synthetic polypeptide"
  source: /note="p.L656fs"
EDSPMSPPPEESPMSPPPEVSRLSPCLWCHACLHRLRNLPCPHRLRSLPRPLHLRLHASPHHLRTPPHPHHLRTHLLPHHRRTRSCPCRWRSHPCCHYLRSRNSAPGPRGRTCHPGLRSRTCPPGLRSHTYLRRLRSHTCPPSLRSHAYALCLRSHTCPPRLRDHICPLSLRNCTCPPRLRSRTCLLCLRSHACPPNLRNHTCPPSLRSHACPPGLRNRICPLSLRSHPCPLGLKSPLRSQANALHLRSCPCSLPLGNHPYLPCLESQPCLSLGNHLCPLCPRSCRCPHLGSHPCRLS

SEQ ID NO: 1945 - protein, 54 aa, Artificial Sequence
  source: /note="Description of Artificial Sequence: Synthetic polypeptide"
  source: /note="p.P2354fs"
APLTPRASQVEPQSPGLGLRPQEPPLPRLWHLLLQVTQTSFALAPTLTHMLSPH

SEQ ID NO: 1946 - protein, 52 aa, Artificial Sequence
  source: /note="Description of Artificial Sequence: Synthetic polypeptide"
  source: /note="p.Q356K"
IDQAPERSKEDANCAVCDSPGDLLDKKFFCTTCGQHYHGMCLDIAVTPLKRA

SEQ ID NO: 1947 - protein, 52 aa, Artificial Sequence
  source: /note="Description of Artificial Sequence: Synthetic polypeptide"
  source: /note="p.N393K"
GMCLDIAVTPLKRAGWQCPECKVCQKKCKQSGEDSKMLVCDTCDKGYHTFCL

SEQ ID NO: 1948 - protein, 45 aa, Artificial Sequence
  source: /note="Description of Artificial Sequence: Synthetic polypeptide"
  source: /note="p.F4496fs"
TSGCHRFRCTNIYHFTCAIKAQCMFLRTKLCFAPCTNQREFMSKN

SEQ ID NO: 1949 - protein, 52 aa, Artificial Sequence
  source: /note="Description of Artificial Sequence: Synthetic polypeptide"
  source: /note="p.Y66C"
YPHQLYTSSSHHSHSYIGLPYADHNCCGARPPPTPPASPPPSVLISKNEVGI

SEQ ID NO: 1950 - protein, 52 aa, Artificial Sequence
  source: /note="Description of Artificial Sequence: Synthetic polypeptide"
  source: /note="p.S790R"
NWKFWVFSILIRPLFESFNGMVSTARRVHTLRQTSLAWLDQYCSLPALRPTV

SEQ ID NO: 1951 - protein, 52 aa, Artificial Sequence
  source: /note="Description of Artificial Sequence: Synthetic polypeptide"
  source: /note="p.R326C"
RIQAEYVSALKLLRKRSQVWKPKVICCISARSGEGISEMWDKMKDFQDLMLA

SEQ ID NO: 1952 - protein, 36 aa, Artificial Sequence
  source: /note="Description of Artificial Sequence: Synthetic polypeptide"
  source: /note="p.I64fs"
ENYYDLKKDVKQFVRRKDSGPVVKKSEKCRSSLDWR

SEQ ID NO: 1953 - protein, 52 aa, Artificial Sequence
  source: /note="Description of Artificial Sequence: Synthetic polypeptide"
  source: /note="p.F917L"
QALQLQVLNSRFKALEAKSIHLSINLLFSLNKTLHEVLTMCHNASTSVSELN

SEQ ID NO: 1954 - protein, 52 aa, Artificial Sequence
  source: /note="Description of Artificial Sequence: Synthetic polypeptide"
  source: /note="p.A1013S"
RSLPGSLANVVKSQKQVKSLPKKINSSLKKPTVNLTTVLIGRTQRNTDNIIY

SEQ ID NO: 1955 - protein, 52 aa, Artificial Sequence
  source: /note="Description of Artificial Sequence: Synthetic polypeptide"
  source: /note="p.D1005N"
ALTRLPTPVLLPYKPQVIRALAKPLNNDKKRLVRKEAVSARGEWFLLGSPGS

SEQ ID NO: 1956 - protein, 52 aa, Artificial Sequence
  source: /note="Description of Artificial Sequence: Synthetic polypeptide"
  source: /note="p.S472L"
APPYMNVAKRPRFDFPGSAGVDRCALLWNGSMHNGALDNHLSPSAYPGLPGE

SEQ ID NO: 1957 - protein, 52 aa, Artificial Sequence
  source: /note="Description of Artificial Sequence: Synthetic polypeptide"
  source: /note="p.S849P"
NQHVFQKLSESRETKVNFGMYLMHAPPLDLSSPCFLSVGSQVLPVLKENVEG

SEQ ID NO: 1958 - protein, 22 aa, Artificial Sequence
  source: /note="Description of Artificial Sequence: Synthetic peptide"
  source: /note="p.P22fs"
MSSLEISSSCFSLETKLPLSPH

SEQ ID NO: 1959 - protein, 52 aa, Artificial Sequence
  source: /note="Description of Artificial Sequence: Synthetic polypeptide"
  source: /note="p.Q66fs"
TRFWLLTVLYAAWWYLDRDKPRQGGPAHPGHQVLDYMEVHEGLFPHLAGQDC

SEQ ID NO: 1960 - protein, 52 aa, Artificial Sequence
  source: /note="Description of Artificial Sequence: Synthetic polypeptide"
  source: /note="p.D113Y"
KRLSTLKFIGQYGNGLKSGSMRIGKYYFILFTKKEETMTCVFFSQTFCEEES

SEQ ID NO: 1961 - protein, 52 aa, Artificial Sequence
  source: /note="Description of Artificial Sequence: Synthetic polypeptide"
  source: /note="p.R740H"
SDSAGEEDSADLKRAQKDKGLHVEVHHVNREWYTGRVTAVEVGKHVVRWKVK

SEQ ID NO: 1962 - protein, 52 aa, Artificial Sequence
  source: /note="Description of Artificial Sequence: Synthetic polypeptide"
  source: /note="p.L804I"
VRIGVAKPLPLSPEEGYVSAKEDSFIIYPPHSCEEAGLADKPLFRADLALVG

SEQ ID NO: 1963 - protein, 31 aa, Artificial Sequence
  source: /note="Description of Artificial Sequence: Synthetic polypeptide"
  source: /note="p.K1582fs"
KLTIHAENPDSQAVPSAAGAASGEKRTAPSL

SEQ ID NO: 1964 - protein, 54 aa, Artificial Sequence
  source: /note="Description of Artificial Sequence: Synthetic polypeptide"
  source: /note="p.A351fs"
SSDTRQGRSEKRAFPRKRDFTNEAPQLLSQTPRLPPCLHTEEPSHWTGGPRSPP

SEQ ID NO: 1965 - protein, 52 aa, Artificial Sequence
  source: /note="Description of Artificial Sequence: Synthetic polypeptide"
  source: /note="p.S46L"
DSRTHSLRYFRLGVSDPIHGVPEFILLVGYVDSHPITTYDSVTRQKEPRAPW

SEQ ID NO: 1966 - protein, 43 aa, Artificial Sequence
  source: /note="Description of Artificial Sequence: Synthetic polypeptide"
  source: /note="p.L234I"
LRLEREKRARIKARKENLERKKAKIIILKKFPHLAEAQKSSLV

SEQ ID NO: 1967 - protein, 53 aa, Artificial Sequence
  source: /note="Description of Artificial Sequence: Synthetic polypeptide"
  source: /note="p.E119del"
SNKEIMEHIRKILGKNEETLREEEEKKQLSHPANFGPRKYCLRECICEVEGQV

SEQ ID NO: 1968 - protein, 52 aa, Artificial Sequence
  source: /note="Description of Artificial Sequence: Synthetic polypeptide"
  source: /note="p.V99M"
ALMSLSMGITMMCMASNTYGSNPISMMYIGYTIWGSVMFIISGSLSIAAGIR

SEQ ID NO: 1969 - protein, 29 aa, Artificial Sequence
  source: /note="Description of Artificial Sequence: Synthetic peptide"
  source: /note="p.S3L"
MNLLMTSAVPVANSVLVVAPHNGYPVTPG

SEQ ID NO: 1970 - protein, 52 aa, Artificial Sequence
  source: /note="Description of Artificial Sequence: Synthetic polypeptide"
  source: /note="p.K464N"
KNCNTPLLRAYYGSLEDKRFGIILENNIKTVINDDARYMKGCLNMRTQKCYA

SEQ ID NO: 1971 - protein, 52 aa, Artificial Sequence
  source: /note="Description of Artificial Sequence: Synthetic polypeptide"
  source: /note="p.E730K"
YVPAEYSSFRIAKQIFTRISTDDDIKKTNSSTFMKEMKEIAYILHNANDKSL

SEQ ID NO: 1972 - protein, 52 aa, Artificial Sequence
  source: /note="Description of Artificial Sequence: Synthetic polypeptide"
  source: /note="p.D576A"
GHTRAYGVCFVDTSLGKFFIGQFSDAARHCSRFRTLVAHYPPVQVLFEKGNL

SEQ ID NO: 1973 - protein, 29 aa, Artificial Sequence
  source: /note="Description of Artificial Sequence: Synthetic peptide"
  source: /note="p.T1085fs"
LANYSRGGDGPMCRPVILLPEDTPPLLRA

SEQ ID NO: 1974 - protein, 52 aa, Artificial Sequence
  source: /note="Description of Artificial Sequence: Synthetic polypeptide"
  source: /note="p.R1095H"
GDGPMCRPVILLPEDTPPFLELKGSHHHPCITKTFFGDDFIPNDILIGCEEE

SEQ ID NO: 1975 - protein, 52 aa, Artificial Sequence
  source: /note="Description of Artificial Sequence: Synthetic polypeptide"
  source: /note="p.T68P"
MTSARRRTDVGPRVAFTYPCTQLSPPPRAHRHLPVHTVTYPCTQLSPTRAHS

SEQ ID NO: 1976 - protein, 115 aa, Artificial Sequence
  source: /note="Description of Artificial Sequence: Synthetic polypeptide"
  source: /note="p.N435fs"
AETPHKPQFTFTSEPHAQLEENFCRTQMGIAMGPGATRWTQGPHSTTVPCDAALMTSRHQSWTPQTRCSLRSVARGWIGWISGVPSCAWLGAIRATHPGQSACGIGRASISAGGL

SEQ ID NO: 1977 - protein, 52 aa, Artificial Sequence
  source: /note="Description of Artificial Sequence: Synthetic polypeptide"
  source: /note="p.M464V"
FNGLLGPVQVTALYVTRLDNVTVAHVVGTMDGRILQVELVRSLNYLLYVSNF

SEQ ID NO: 1978 - protein, 32 aa, Artificial Sequence
  source: /note="Description of Artificial Sequence: Synthetic polypeptide"
  source: /note="p.L105fs"
LNKMDLADLTEQQKIMQHLEGEGLKMSFLPTV

SEQ ID NO: 1979 - protein, 52 aa, Artificial Sequence
  source: /note="Description of Artificial Sequence: Synthetic polypeptide"
  source: /note="p.H327fs"
DFLQTFRRGLLGSVMLDLDVLRGHPRLRLCPELVRVGRAGGMWPPRPPDLGG

SEQ ID NO: 1980 - protein, 34 aa, Artificial Sequence
  source: /note="Description of Artificial Sequence: Synthetic polypeptide"
  source: /note="p.N109fs"
STKSKKVVEVWIGMTIEELARAMEKTQIMYMKLY

SEQ ID NO: 1981 - protein, 28 aa, Artificial Sequence
  source: /note="Description of Artificial Sequence: Synthetic peptide"
  source: /note="p.K193fs"
DEALRKVATFRHGGRFPVLSYYHKKMGW

SEQ ID NO: 1982 - protein, 52 aa, Artificial Sequence
  source: /note="Description of Artificial Sequence: Synthetic polypeptide"
  source: /note="p.L1460P"
YAMKHFGELEIQATWYEKLHEWEDAPPVAYDKKMDTNKDDPELMLGRMRCLE

SEQ ID NO: 1983 - protein, 52 aa, Artificial Sequence
  source: /note="Description of Artificial Sequence: Synthetic polypeptide"
  source: /note="p.C1483F"
DALVAYDKKMDTNKDDPELMLGRMRFFLEALGEWGQLHQQCCEKWTLVNDET

SEQ ID NO: 1984 - protein, 52 aa, Artificial Sequence
  source: /note="Description of Artificial Sequence: Synthetic polypeptide"
  source: /note="p.S2215Y"
EDLRQDERVMQLFGLVNTLLANDPTYYLRKNLSIQRYAVIPLSTNSGLIGWV

SEQ ID NO: 1985 - protein, 52 aa, Artificial Sequence
  source: /note="Description of Artificial Sequence: Synthetic polypeptide"
  source: /note="p.R1005W"
YPKQRTAAARNGFPPKPDPQAREAEWWQLVLRLKERCEQQTRQLGVAQGELK

SEQ ID NO: 1986 - protein, 52 aa, Artificial Sequence
  source: /note="Description of Artificial Sequence: Synthetic polypeptide"
  source: /note="p.P5119S"
LPNFSSTSDKILATSKDSKDTKEIFSSSINTEETNVKANNSGHESHSPALAD

SEQ ID NO: 1987 - protein, 52 aa, Artificial Sequence
  source: /note="Description of Artificial Sequence: Synthetic polypeptide"
  source: /note="p.A6156T"
PDISPEASSSHSNSPPLTISTHKTITTTQTGPSGVTSLGQLTLDTSTIATSA

SEQ ID NO: 1988 - protein, 52 aa, Artificial Sequence
  source: /note="Description of Artificial Sequence: Synthetic polypeptide"
  source: /note="p.R8606H"
ESISSSPHPVTALLTLGPVKTTDMLHHTSSEPETSSPPNLSSTSAEILATSE

SEQ ID NO: 1989 - protein, 34 aa, Artificial Sequence
  source: /note="Description of Artificial Sequence: Synthetic polypeptide"
  source: /note="p.P10452fs"
GIMEHITKIPNEAAHRGTIRPVKGPSDIHFACQS

SEQ ID NO: 1990 - protein, 52 aa, Artificial Sequence
  source: /note="Description of Artificial Sequence: Synthetic polypeptide"
  source: /note="p.T11005I"
VLPEVPGMVTSLVASSRAVTSTTLPIILTLSPGEPETTPSMATSHGAEASST

SEQ ID NO: 1991 - protein, 52 aa, Artificial Sequence
  source: /note="Description of Artificial Sequence: Synthetic polypeptide"
  source: /note="p.P11260A"
IDSWVAHPGTEASSVVPTLTVSTGEAAFTNISLVTHPAESSSTLPRTTSRFS

SEQ ID NO: 1992 - protein, 52 aa, Artificial Sequence
  source: /note="Description of Artificial Sequence: Synthetic polypeptide"
  source: /note="p.N11594K"
YEPETTATWLTHPAETSTTVSGTIPKKFSHRGSDTAPSMVTSPGVDTRSGVP

SEQ ID NO: 1993 - protein, 52 aa, Artificial Sequence
  source: /note="Description of Artificial Sequence: Synthetic polypeptide"
  source: /note="p.R12774H"
SGCRLTLLRSEKDGAATGVDAICTHHHLDPKSPGVDREQLYWELSQLTNGIK

SEQ ID NO: 1994 - protein, 52 aa, Artificial Sequence
  source: /note="Description of Artificial Sequence: Synthetic polypeptide"
  source: /note="p.R4415H"
LVYGLVGAGVVLMLIILVALLMLVFHHSKREVKRQKYRLSQLYKWQEEDSGP

SEQ ID NO: 1995 - protein, 52 aa, Artificial Sequence
  source: /note="Description of Artificial Sequence: Synthetic polypeptide"
  source: /note="p.V77M"
CQQLSQHVRTGSAANTATGTTSTNVMMEPRMYLSCSTNPEMTSIESSVTSDT

SEQ ID NO: 1996 - protein, 33 aa, Artificial Sequence
  source: /note="Description of Artificial Sequence: Synthetic polypeptide"
  source: /note="p.R1227fs"
PTAEVTSMPTSTPGERSTPLTSMPVSTHASGQF

SEQ ID NO: 1997 - protein, 47 aa, Artificial Sequence
  source: /note="Description of Artificial Sequence: Synthetic polypeptide"
  source: /note="p.H1228fs"
TAEVTSMPTSTPGERSTPLTSMPVRPRQWPVLRLAPFQHLPLTPAHL

SEQ ID NO: 1998 - protein, 52 aa, Artificial Sequence
  source: /note="Description of Artificial Sequence: Synthetic polypeptide"
  source: /note="p.T2279N"
STEATSSPTTAEGTSIPTSTLSEGTNNPLTSIPVSHTLVANSEVSTLSTTPV

SEQ ID NO: 1999 - protein, 52 aa, Artificial Sequence
  source: /note="Description of Artificial Sequence: Synthetic polypeptide"
  source: /note="p.T1568M"
TTTVTPTPTPTGTQTPTTTPITTTTMMVTPTPTPTGTQTPTSTPITTTTTVT

SEQ ID NO: 2000 - protein, 52 aa, Artificial Sequence
  source: /note="Description of Artificial Sequence: Synthetic polypeptide"
  source: /note="p.T1580N"
TQTPTTTPITTTTTVTPTPTPTGTQNNPTSTPITTTTTVTPTPTPTGTQTPT

SEQ ID NO: 2001 - protein, 52 aa, Artificial Sequence
  source: /note="Description of Artificial Sequence: Synthetic polypeptide"
  source: /note="p.T1582R"
TPTTTPITTTTTVTPTPTPTGTQTPRRSTPITTTTTVTPTPTPTGTQTPTTT

SEQ ID NO: 2002 - protein, 52 aa, Artificial Sequence
  source: /note="Description of Artificial Sequence: Synthetic polypeptide"
  source: /note="p.T1597I"
TPTPTGTQTPTSTPITTTTTVTPTPIIPTGTQTPTTTPITTTTTVTPTPTPT

SEQ ID NO: 2003 - protein, 52 aa, Artificial Sequence
  source: /note="Description of Artificial Sequence: Synthetic polypeptide"
  source: /note="p.T1704I"
TTTTTVTPTPTPTGTQTPTSTPITTIITTVTPTPTPTGTQTPTPTPISTTTT

SEQ ID NO: 2004 - protein, 52 aa, Artificial Sequence
  source: /note="Description of Artificial Sequence: Synthetic polypeptide"
  source: /note="p.T1706M"
TTTVTPTPTPTGTQTPTSTPITTTTMMVTPTPTPTGTQTPTPTPISTTTTVT

SEQ ID NO: 2005 - protein, 52 aa, Artificial Sequence
  source: /note="Description of Artificial Sequence: Synthetic polypeptide"
  source: /note="p.G1715S"
PTGTQTPTSTPITTTTTVTPTPTPTSSTQTPTPTPISTTTTVTPTPTPTGTQ

SEQ ID NO: 2006 - protein, 52 aa, Artificial Sequence
  source: /note="Description of Artificial Sequence: Synthetic polypeptide"
  source: /note="p.T1722I"
TSTPITTTTTVTPTPTPTGTQTPTPIIPISTTTTVTPTPTPTGTQTPTTTPI

SEQ ID NO: 2007 - protein, 52 aa, Artificial Sequence
  source: /note="Description of Artificial Sequence: Synthetic polypeptide"
  source: /note="p.S681G"
YMGIFLVIETHGMAVSWDRKTSVFIGGLHQDYKGRVCGLCGNFDDNAINDFA

SEQ ID NO: 2008 - protein, 52 aa, Artificial Sequence
  source: /note="Description of Artificial Sequence: Synthetic polypeptide"
  source: /note="p.D682G"
MGIFLVIETHGMAVSWDRKTSVFIRGRHQDYKGRVCGLCGNFDDNAINDFAT

SEQ ID NO: 2009 - protein, 160 aa, Artificial Sequence
  source: /note="Description of Artificial Sequence: Synthetic polypeptide"
  source: /note="p.P1569fs"
ITPNPTSTRTRTPVAHTNSATSSRPTTTLHHTLPTYREQSLLFHRSHDGNILQDHHYLSNPITPSDHTSHSRSTFLHLFGDSKYSHSHHPYPCTDGHFCLHPLNANRHDSSTDNAQGHRVHPHSANNDADHQRDQPSPELIKHSQNLYIPTFTHFLHTPC

SEQ ID NO: 2010 - protein, 52 aa, Artificial Sequence
  source: /note="Description of Artificial Sequence: Synthetic polypeptide"
  source: /note="p.P1977H"
AHTTSASSSRLPTPFTTHSPPTGSSHHFSSTGPMTATSFQTTTTYPTPSHPQ

SEQ ID NO: 2011 - protein, 52 aa, Artificial Sequence
  source: /note="Description of Artificial Sequence: Synthetic polypeptide"
  source: /note="p.H2000Q"
SSPFSSTGPMTATSFQTTTTYPTPSQQPQTTLPTHVPPFSTSLVTPSTHTVI

SEQ ID NO: 2012 - protein, 54 aa, Artificial Sequence
  source: /note="Description of Artificial Sequence: Synthetic polypeptide"
  source: /note="p.2129_2130SS>S"
SPITTQLPHLSSATTPVSTTNQLSSSFSPSPSAPSTVSSYVPSSHSSPQTSSPS

SEQ ID NO: 2013 - protein, 52 aa, Artificial Sequence
  source: /note="Description of Artificial Sequence: Synthetic polypeptide"
  source: /note="p.S336L"
PNSSPTTLAPDTSETSAAPTHQTTTLLVTTQTTTTKQPTSAPGQNKISRFLL

SEQ ID NO: 2014 - protein, 42 aa, Artificial Sequence
  source: /note="Description of Artificial Sequence: Synthetic polypeptide"
  source: /note="p.P138fs"
YLSICRKQRALPSLDIVVWSELPPGRAWAPAPPTRCVWQQPS

SEQ ID NO: 2015 - protein, 52 aa, Artificial Sequence
  source: /note="Description of Artificial Sequence: Synthetic polypeptide"
  source: /note="p.D324Y"
EEDGGSQLILEKFQLPQWSISLNMTYYEHGNMVNLVCDIKKPMDVYKIHLNQ

SEQ ID NO: 2016 - protein, 32 aa, Artificial Sequence
  source: /note="Description of Artificial Sequence: Synthetic polypeptide"
  source: /note="p.R481fs"
ESSLDPPKVLPPARHSTIPLVILRKNGARPAP

SEQ ID NO: 2017 - protein, 52 aa, Artificial Sequence
  source: /note="Description of Artificial Sequence: Synthetic polypeptide"
  source: /note="p.R646H"
TNPVGEDVASIFLQVVDVPDPPEAVHHITSVGEDWAILVWEPPMYDGGKPVT

SEQ ID NO: 2018 - protein, 52 aa, Artificial Sequence
  source: /note="Description of Artificial Sequence: Synthetic polypeptide"
  source: /note="p.M240T"
TCVWSIASELIEKRLARRPRGGCRRTTVVVVSDDYLQSKECDFQTKFALSLS

SEQ ID NO: 2019 - protein, 52 aa, Artificial Sequence
  source: /note="Description of Artificial Sequence: Synthetic polypeptide"
  source: /note="p.S251N"
EKRLARRPRGGCRRMVVVVSDDYLQNNKECDFQTKFALSLSPGAHQKRLIPI

SEQ ID NO: 2020 - protein, 52 aa, Artificial Sequence
  source: /note="Description of Artificial Sequence: Synthetic polypeptide"
  source: /note="p.L273P"
YLQSKECDFQTKFALSLSPGAHQKRPPIPIKYKAMKKEFPSILRFITVCDYT

SEQ ID NO: 2021 - protein, 52 aa, Artificial Sequence
  source: /note="Description of Artificial Sequence: Synthetic polypeptide"
  source: /note="p.K323E"
LFDRPMHVKMDDKSVPHEEYRSHDGEETPQLPRGLGGIGMGLGPGGQPISAS

SEQ ID NO: 2022 - protein, 90 aa, Artificial Sequence
  source: /note="Description of Artificial Sequence: Synthetic polypeptide"
  source: /note="p.L269fs"
CSTWGLPLRVAGSWLTVVTVEALGGGAWELGGLARWGPLCTHPQCQVLLLSSSTTSSSSSSSSSSLVEDVLCAKWFICPASFNPQNDSMR

SEQ ID NO: 2023 - protein, 38 aa, Artificial Sequence
  source: /note="Description of Artificial Sequence: Synthetic polypeptide"
  source: /note="p.L302H"
RRTGQVGPTMHPPPVSGASPLLLHHHHLLLLLIIILTC

SEQ ID NO: 2024 - protein, 44 aa, Artificial Sequence
  source: /note="Description of Artificial Sequence: Synthetic polypeptide"
  source: /note="p.L1091fs"
MISDLEERLKKEEKTRQELEKAKRKPRRGDDRPAGPDRRAAGAD

SEQ ID NO: 2025 - protein, 52 aa, Artificial Sequence
  source: /note="Description of Artificial Sequence: Synthetic polypeptide"
  source: /note="p.E993K"
EEEAARQKLQLEKVTAEAKIKKLEDKKILVMDDQNNKLSKERKLLEERISDL

SEQ ID NO: 2026 - protein, 53 aa, Artificial Sequence
  source: /note="Description of Artificial Sequence: Synthetic polypeptide"
  source: /note="p.K1263del"
KENADLAGELRVLGQAKQEVEHKKKLEAQVQELQSKCSDGERARAELNDKVHK

SEQ ID NO: 2027 - protein, 52 aa, Artificial Sequence
  source: /note="Description of Artificial Sequence: Synthetic polypeptide"
  source: /note="p.D311N"
HIFYQIMSNKKPELIDLLLISTNPFNNFPFVSQGEVTVASIDDSEELLATDN

SEQ ID NO: 2028 - protein, 52 aa, Artificial Sequence
  source: /note="Description of Artificial Sequence: Synthetic polypeptide"
  source: /note="p.T790M"
TKVFFKAGLLGTLEEMRDEKLAQLIMMRTQAICRGFLMRVEFRKMMERRESI

SEQ ID NO: 2029 - protein, 52 aa, Artificial Sequence
  source: /note="Description of Artificial Sequence: Synthetic polypeptide"
  source: /note="p.T847M"
AFMGVKNWPWMKLYFKIKPLLKSAEMMEKEMATMKEEFGRIKETLEKSEARR

SEQ ID NO: 2030 - protein, 52 aa, Artificial Sequence
  source: /note="Description of Artificial Sequence: Synthetic polypeptide"
  source: /note="p.A1487T"
ESQSELESSQKEARSLSTELFKLKNTTYEESLEHLETFKRENKNLQEEISDL

SEQ ID NO: 2031 - protein, 52 aa, Artificial Sequence
  source: /note="Description of Artificial Sequence: Synthetic polypeptide"
  source: /note="p.R1689C"
NDDLKENIAIVERRNNLLQAELEELCCAVVEQTERSRKLAEQELIETSERVQ

SEQ ID NO: 2032 - protein, 52 aa, Artificial Sequence
  source: /note="Description of Artificial Sequence: Synthetic polypeptide"
  source: /note="p.A785V"
KFGHTKVFFKAGLLGLLEEMRDEKLVVQIITRTQAVCRGFLMRVEYQKMLQR

SEQ ID NO: 2033 - protein, 52 aa, Artificial Sequence
  source: /note="Description of Artificial Sequence: Synthetic polypeptide"
  source: /note="p.H1006N"
LTEEMAGLDETIAKLSKEKKALQETNNQQTLDDLQAEEDKVNILTKAKTKLE

SEQ ID NO: 2034 - protein, 52 aa, Artificial Sequence
  source: /note="Description of Artificial Sequence: Synthetic polypeptide"
  source: /note="p.R1048Q"
LTKAKTKLEQQVDDLEGSLEQEKKLQQMDLERAKRKLEGDLKLAQESTMDME

SEQ ID NO: 2035 - protein, 52 aa, Artificial Sequence
  source: /note="Description of Artificial Sequence: Synthetic polypeptide"
  source: /note="p.R1117C"
NLISKIEDEQAVEIQLQKKIKELQACCIEELGEEIEAERASRAKAEKQRSDL

SEQ ID NO: 2036 - protein, 110 aa, Artificial Sequence
  source: /note="Description of Artificial Sequence: Synthetic polypeptide"
  source: /note="p.P209fs"
PRPGHRSRAPELVTKKFPVDLRLPPWCPCPHLPSGSWSCNDGPLETLASPCGAQPCWIGAPRARPVGVWSTLLSLVQAPRTWPWGWCQEIDWWRLMGTMWRASPGMRLWR

SEQ ID NO: 2037 - protein, 52 aa, Artificial Sequence
  source: /note="Description of Artificial Sequence: Synthetic polypeptide"
  source: /note="p.T109M"
AAYKAMKRRSKDTCIVISGESGAGKMMEASKYIMQYIAAITNPSQRAEVERV

SEQ ID NO: 2038 - protein, 52 aa, Artificial Sequence
  source: /note="Description of Artificial Sequence: Synthetic polypeptide"
  source: /note="p.E246K"
LQKSLSSYNYIHVGAQLKSSINDAAKKFRVVADAMKVIGFKPEEIQTVYKIL

SEQ ID NO: 2039 - protein, 52 aa, Artificial Sequence
  source: /note="Description of Artificial Sequence: Synthetic polypeptide"
  source: /note="p.N525H"
AVVGAQISEYLLEKSRVIHQAIGEKHHFHIFYYIYAGLAEKKKLAHYKLPEN

SEQ ID NO: 2040 - protein, 52 aa, Artificial Sequence
  source: /note="Description of Artificial Sequence: Synthetic polypeptide"
  source: /note="p.N525S"
AVVGAQISEYLLEKSRVIHQAIGEKSSFHIFYYIYAGLAEKKKLAHYKLPEN

SEQ ID NO: 2041 - protein, 52 aa, Artificial Sequence
  source: /note="Description of Artificial Sequence: Synthetic polypeptide"
  source: /note="p.A405V"
KLVTTSETYVKTMSLQQVINARNALVVKHIYAQLFGWIVEHINKALHTSLKQ

SEQ ID NO: 2042 - protein, 52 aa, Artificial Sequence
  source: /note="Description of Artificial Sequence: Synthetic polypeptide"
  source: /note="p.R708L"
VLETIRISAAGYPSRWAYHDFFNRYLLVLVKKRELANTDKKAICRSVLENLI

SEQ ID NO: 2043 - protein, 48 aa, Artificial Sequence
  source: /note="Description of Artificial Sequence: Synthetic polypeptide"
  source: /note="p.Q914fs"
EQIQKEYDALVKSSEELLSALQKKKTAGRGSRKAEAYSRRNGKGKKKT

SEQ ID NO: 2044 - protein, 52 aa, Artificial Sequence
  source: /note="Description of Artificial Sequence: Synthetic polypeptide"
  source: /note="p.D1180N"
IPARQREIEMNRQQRFFRIPFIRPANNQYKDPQSKKKGWWYAHFDGPWIARQ

SEQ ID NO: 2045 - protein, 52 aa, Artificial Sequence
  source: /note="Description of Artificial Sequence: Synthetic polypeptide"
  source: /note="p.P2040H"
KQTSEPSYPDVILIAINRHGVLLIHHHKTKDLLTTYPFTKISSWSSGSTYFH

SEQ ID NO: 2046 - protein, 52 aa, Artificial Sequence
  source: /note="Description of Artificial Sequence: Synthetic polypeptide"
  source: /note="p.R167Q"
QPQQKDFDDLCSLPDLNEKTLLENLQQNRFKHEKIYTYVGSILIVINPFKFL

SEQ ID NO: 2047 - protein, 52 aa, Artificial Sequence
  source: /note="Description of Artificial Sequence: Synthetic polypeptide"
  source: /note="p.R2179Q"
FLRAMGLQERKETIRGVYSVIDQLSQQTHLNTLERLIFHLVRIALQEDTNRM

SEQ ID NO: 2048 - protein, 52 aa, Artificial Sequence
  source: /note="Description of Artificial Sequence: Synthetic polypeptide"
  source: /note="p.R94L"
KESGGEEWVLDANDSPVHRVLLWPRLLAQDEHPQEDGYYFLLQERNADGTIK

SEQ ID NO: 2049 - protein, 52 aa, Artificial Sequence
  source: /note="Description of Artificial Sequence: Synthetic polypeptide"
  source: /note="p.T493M"
AGSLPDTFNDASPSFGLHPSPVHVCMMEESLMSSLNGGSVPSELDGLDSEKD

SEQ ID NO: 2050 - protein, 28 aa, Artificial Sequence
  source: /note="Description of Artificial Sequence: Synthetic peptide"
  source: /note="p.G226fs"
ENDRNDSASQPSHQSDAGKQGLGPPAPP

SEQ ID NO: 2051 - protein, 53 aa, Artificial Sequence
  source: /note="Description of Artificial Sequence: Synthetic polypeptide"
  source: /note="p.Q310del"
AYARLLQQQQLFLQLQILSQQQQQQHRFSYLGMHQAQLKEPNEQMVRNPNSSS

SEQ ID NO: 2052 - protein, 54 aa, Artificial Sequence
  source: /note="Description of Artificial Sequence: Synthetic polypeptide"
  source: /note="p.G165fs"
PGMGGDGEEDEGDEDRLDNAVRGPGAQGASWDGVGSSACSEAHQSKEQPADAVK

SEQ ID NO: 2053 - protein, 52 aa, Artificial Sequence
  source: /note="Description of Artificial Sequence: Synthetic polypeptide"
  source: /note="p.R63Q"
VYTQGSTAYSSRSSAAHRRESEAFRQQASASSSQQQASQHALSSEVSRKAAS

SEQ ID NO: 2054 - protein, 52 aa, Artificial Sequence
  source: /note="Description of Artificial Sequence: Synthetic polypeptide"
  source: /note="p.D988N"
DHSKLYLKNPDKEDLGTYSVSVSDTNNGVSSSFVLDPEELERLMALSNEIKN

SEQ ID NO: 2055 - protein, 40 aa, Artificial Sequence
  source: /note="Description of Artificial Sequence: Synthetic polypeptide"
  source: /note="p.E251K"
LSGRRSFNRTPKGWISENIPIVITTKKPTDDTTVPESEDL

SEQ ID NO: 2056 - protein, 52 aa, Artificial Sequence
  source: /note="Description of Artificial Sequence: Synthetic polypeptide"
  source: /note="p.E226K"
AAEGAASEEGEKGLFIQPEDAEEVVKKVTTERSQDLCPQSLEDAASEESSKQ

SEQ ID NO: 2057 - protein, 52 aa, Artificial Sequence
  source: /note="Description of Artificial Sequence: Synthetic polypeptide"
  source: /note="p.P351Q"
SLECLRNQCFDLARKLSETNPQERNQQQQNMNIRQHVRPEEDFPGRTPDRNY

SEQ ID NO: 2058 - protein, 52 aa, Artificial Sequence
  source: /note="Description of Artificial Sequence: Synthetic polypeptide"
  source: /note="p.R506C"
STKNKKRRKKRIFNLVPNFDLLGQSCCIGVKEREKCDLLTKNHGLKITLGEE

SEQ ID NO: 2059 - protein, 52 aa, Artificial Sequence
  source: /note="Description of Artificial Sequence: Synthetic polypeptide"
  source: /note="p.T184K"
RRQMDLKKGGYVVLGSRENQETQGSKKLSDSEEACQQKNPATEESGSDSKEP

SEQ ID NO: 2060 - protein, 27 aa, Artificial Sequence
  source: /note="Description of Artificial Sequence: Synthetic peptide"
  source: /note="p.H514fs"
CISAYQRLGRYGDALKKCHEVERHFLR

SEQ ID NO: 2061 - protein, 52 aa, Artificial Sequence
  source: /note="Description of Artificial Sequence: Synthetic polypeptide"
  source: /note="p.S807Y"
DIYELDTSGLEDTMEIQERIENSFKYYLLDQLKDVFSKCKGDLLEVKDGNLK

SEQ ID NO: 2062 - protein, 52 aa, Artificial Sequence
  source: /note="Description of Artificial Sequence: Synthetic polypeptide"
  source: /note="p.L72F"
EEFLEIMALVGMASKPLHVRRLQKAFFRDWVTNPGLFNQPLTSLPVSSIPIY

SEQ ID NO: 2063 - protein, 36 aa, Artificial Sequence
  source: /note="Description of Artificial Sequence: Synthetic polypeptide"
  source: /note="p.S183L"
KTQDTGHRRGGGGGAGFRGAGKSEPLLPSCSPSMST

SEQ ID NO: 2064 - protein, 52 aa, Artificial Sequence
  source: /note="Description of Artificial Sequence: Synthetic polypeptide"
  source: /note="p.P353R"
MIQKYDEPILKFLSDVSLKFSKPGQRRVSYTFEFHFLPNPYFRNEVLVKTYI

SEQ ID NO: 2065 - protein, 53 aa, Artificial Sequence
  source: /note="Description of Artificial Sequence: Synthetic polypeptide"
  source: /note="p.P285Q"
VTVKTIKKKQKHKGRGTVRTITKQVQQNESFFNFFNPLKASGDGESLDEDSEF

SEQ ID NO: 2066 - protein, 52 aa, Artificial Sequence
  source: /note="Description of Artificial Sequence: Synthetic polypeptide"
  source: /note="p.R121Q"
DTGSSNLWVPSRRCHFFSVPCWLHHQQFDPKASSSFQANGTKFAIQYGTGRV

SEQ ID NO: 2067 - protein, 52 aa, Artificial Sequence
  source: /note="Description of Artificial Sequence: Synthetic polypeptide"
  source: /note="p.P240R"
AFLTVSGQLHLEVMSGAFTQVFTFGRRTFRAENSQSRRHLAEFYMIEAEISF

SEQ ID NO: 2068 - protein, 52 aa, Artificial Sequence
  source: /note="Description of Artificial Sequence: Synthetic polypeptide"
  source: /note="p.I393T"
IQYIHPADAVKLGQAELVVIDEAAATTPLPLVKSLLGPYLVFMASTINGYEG

SEQ ID NO: 2069 - protein, 52 aa, Artificial Sequence
  source: /note="Description of Artificial Sequence: Synthetic polypeptide"
  source: /note="p.E810K"
SSSHVEWEDAVHIIPENESDDEEEEKKKGPVSPRNLQESEEEEVPQESWDEG

SEQ ID NO: 2070 - protein, 51 aa, Artificial Sequence
  source: /note="Description of Artificial Sequence: Synthetic polypeptide"
  source: /note="p.R25C"
MVVSAGPWSSEKAEMNILEINEKLCCPQLAENKQQFGNLKERCFVTQLAGF

SEQ ID NO: 2071 - protein, 31 aa, Artificial Sequence
  source: /note="Description of Artificial Sequence: Synthetic polypeptide"
  source: /note="p.D449fs"
RELLDEKEPEVLQDSLDRCYSTPSDILNCLT

SEQ ID NO: 2072 - protein, 52 aa, Artificial Sequence
  source: /note="Description of Artificial Sequence: Synthetic polypeptide"
  source: /note="p.D491V"
QEEEEDQGPPCPRLSRELPEVVEPEVVLQDSLDRWYSTPFSYPELPDSCQPY

SEQ ID NO: 2073 - protein, 52 aa, Artificial Sequence
  source: /note="Description of Artificial Sequence: Synthetic polypeptide"
  source: /note="p.G698C"
GYSEPTVYEFSMPPKPNIIKDTLFNCCLGLGAVIGLGVAALLLILVVTDVSC

SEQ ID NO: 2074 - protein, 52 aa, Artificial Sequence
  source: /note="Description of Artificial Sequence: Synthetic polypeptide"
  source: /note="p.R220L"
VSLVTGCCYRLLENPTINHQKNRPTLLEAITHLLGVALTRYNHMLSATVKII

SEQ ID NO: 2075 - protein, 34 aa, Artificial Sequence
  source: /note="Description of Artificial Sequence: Synthetic polypeptide"
  source: /note="p.Q909fs"
ASSADADHSPSSQGSSEAPASQPPPRSEVLSCPL

SEQ ID NO: 2076 - protein, 49 aa, Artificial Sequence
  source: /note="Description of Artificial Sequence: Synthetic polypeptide"
  source: /note="p.T466fs"
HWRFRPRRKQDAPSQSENKKKSTKKILKLTLKMILTLMYILEKQRLLLF

SEQ ID NO: 2077 - protein, 55 aa, Artificial Sequence
  source: /note="Description of Artificial Sequence: Synthetic polypeptide"
  source: /note="p.Q1253fs"
RSRELLSHHFRQQRVAMMMQQQQQQTAAAAAAAAATATATATAATAANPGLQPTS

SEQ ID NO: 2078 - protein, 52 aa, Artificial Sequence
  source: /note="Description of Artificial Sequence: Synthetic polypeptide"
  source: /note="p.R562Q"
ADWVLPGKKMGNLSQLSSGEDKWLLQQKKAQEVLLNSPLQEEHNFPPDHYGL

SEQ ID NO: 2079 - protein, 52 aa, Artificial Sequence
  source: /note="Description of Artificial Sequence: Synthetic polypeptide"
  source: /note="p.E369D"
DSRPIVPLEKSTGHTPTKPSGSSVSDDKLKKLDSSRETSHGSPTVTKLSKEP

SEQ ID NO: 2080 - protein, 52 aa, Artificial Sequence
  source: /note="Description of Artificial Sequence: Synthetic polypeptide"
  source: /note="p.R1561Q"
PGVDPVVSHSPFDPHHRGSTAGEVYQQSHLPTHLDPAMPFHRALDPAAAAYL

SEQ ID NO: 2081 - protein, 52 aa, Artificial Sequence
  source: /note="Description of Artificial Sequence: Synthetic polypeptide"
  source: /note="p.R258W"
TYLLTTETGLQKDHALWDHTAQNLLWWMGLAFLVLVALVWFLVEDWLSRKRT

SEQ ID NO: 2082 - protein, 52 aa, Artificial Sequence
  source: /note="Description of Artificial Sequence: Synthetic polypeptide"
  source: /note="p.V427I"
LNKKFALEHGIPTDMGYAVAPHHSGIIYPVHVQLYEAWKKVWNIKITSTEEY

SEQ ID NO: 2083 - protein, 53 aa, Artificial Sequence
  source: /note="Description of Artificial Sequence: Synthetic polypeptide"
  source: /note="p.P194del"
DMEHGWEVVDSNDSASQHQEELPPPLPPGWEEKVDNLGRTYYVNHNNRTTQWH

SEQ ID NO: 2084 - protein, 52 aa, Artificial Sequence
  source: /note="Description of Artificial Sequence: Synthetic polypeptide"
  source: /note="p.A798T"
RNKVMNSSNQLCEQLKTIVMATKMATTLHYPSTTALQEMVHQVTDLSRNAQL

SEQ ID NO: 2085 - protein, 52 aa, Artificial Sequence
  source: /note="Description of Artificial Sequence: Synthetic polypeptide"
  source: /note="p.A316T"
ARRHQSLSPNHPPPQLGQSVGSQNDTTYDVPRGVQFLEPPAETSEKANPQER

SEQ ID NO: 2086 - protein, 52 aa, Artificial Sequence
  source: /note="Description of Artificial Sequence: Synthetic polypeptide"
  source: /note="p.E645K"
SPVKEEAKSPAEVKSPEKAKSPTKEKKAKSPEKAKSPEKEEAKSPEKAKSPV

SEQ ID NO: 2087 - protein, 58 aa, Artificial Sequence
  source: /note="Description of Artificial Sequence: Synthetic polypeptide"
  source: /note="p.665_666insEE"
PTKEEAKSPEKAKSPEKEEAKSPEKEEEEAKSPVKAEAKSPEKAKSPVKAEAKSPEKA

SEQ ID NO: 2088 - protein, 52 aa, Artificial Sequence
  source: /note="Description of Artificial Sequence: Synthetic polypeptide"
  source: /note="p.V670E"
EAKSPEKAKSPEKEEAKSPEKAKSPEEKAEAKSPEKAKSPVKAEAKSPEKAK

SEQ ID NO: 2089 - protein, 52 aa, Artificial Sequence
  source: /note="Description of Artificial Sequence: Synthetic polypeptide"
  source: /note="p.A213V"
RFEEEARLRDDTEAAIRALRKDIEEVVSLVKVELDKKVQSLQDEVAFLRSNH

SEQ ID NO: 2090 - protein, 52 aa, Artificial Sequence
  source: /note="Description of Artificial Sequence: Synthetic polypeptide"
  source: /note="p.R608C"
EVYLARLRQIRLQNFNERQQIKAKLCCGEKKEANHSEGQEGSEEADMRRKKI

SEQ ID NO: 2091 - protein, 52 aa, Artificial Sequence
  source: /note="Description of Artificial Sequence: Synthetic polypeptide"
  source: /note="p.R374Q"
KLQAADEKARKLKKIVEEKYEENSKQQMQELRSRNFQQLSVDVLHEKTHLKG

SEQ ID NO: 2092 - protein, 52 aa, Artificial Sequence
  source: /note="Description of Artificial Sequence: Synthetic polypeptide"
  source: /note="p.R239S"
PPFTAFSQKELAGKIREGKFRRIPYSSYSDELNEIITRMLNLKDYHRPSVEE

SEQ ID NO: 2093 - protein, 35 aa, Artificial Sequence
  source: /note="Description of Artificial Sequence: Synthetic polypeptide"
  source: /note="p.V690fs"
VTSVSCCHGNTLLAVRSVTDEPVPPEAPGFTSGPP

SEQ ID NO: 2094 - protein, 52 aa, Artificial Sequence
  source: /note="Description of Artificial Sequence: Synthetic polypeptide"
  source: /note="p.G170D"
QTHLNSGVILSIHHLDHRYLELESSDDHRNEVRLHYRSGSHRPHTEVFPYIL

SEQ ID NO: 2095 - protein, 52 aa, Artificial Sequence
  source: /note="Description of Artificial Sequence: Synthetic polypeptide"
  source: /note="p.V611L"
LKSLEKENKELLKDVEVVRPLEKEALLGQLKPTGKEDTQTLQSLQKENQELM

SEQ ID NO: 2096 - protein, 45 aa, Artificial Sequence
  source: /note="Description of Artificial Sequence: Synthetic polypeptide"
  source: /note="p.T676fs"
PGASLRKGKGNSSMDSAAGCSGTPPDLPTSPDQTRSGPVHVSVEP

SEQ ID NO: 2097 - protein, 60 aa, Artificial Sequence
  source: /note="Description of Artificial Sequence: Synthetic polypeptide"
  source: /note="p.F1658fs"
AKPYEIVVDLTHTGPSNRFKTDFLSGLLFFLALLTTTSPQSISITVTPGSGSTPSIMSGC

SEQ ID NO: 2098 - protein, 52 aa, Artificial Sequence
  source: /note="Description of Artificial Sequence: Synthetic polypeptide"
  source: /note="p.V256I"
QFEEDQFQPGVWHDHSKYPGSVNSAIILRLSPYVNYQFRVIAINEVGSSHPS

SEQ ID NO: 2099 - protein, 52 aa, Artificial Sequence
  source: /note="Description of Artificial Sequence: Synthetic polypeptide"
  source: /note="p.Q906E"
QQQQQQQQVMESSAAMVMEMQQSICEEAAAQIQSELFPSTASANGNLQQSPV

SEQ ID NO: 2100 - protein, 52 aa, Artificial Sequence
  source: /note="Description of Artificial Sequence: Synthetic polypeptide"
  source: /note="p.R34G"
PGLPSQQDMDLIDILWRQDIDLGVSGGEVFDFSQRRKEYELEKQKKLEKERQ

SEQ ID NO: 2101 - protein, 52 aa, Artificial Sequence
  source: /note="Description of Artificial Sequence: Synthetic polypeptide"
  source: /note="p.R34Q"
PGLPSQQDMDLIDILWRQDIDLGVSQQEVFDFSQRRKEYELEKQKKLEKERQ

SEQ ID NO: 2102 - protein, 52 aa, Artificial Sequence
  source: /note="Description of Artificial Sequence: Synthetic polypeptide"
  source: /note="p.E79K"
LEKERQEQLQKEQEKAFFAQLQLDEKKTGEFLPIQPAQHIQSETSGSANYSQ

SEQ ID NO: 2103 - protein, 52 aa, Artificial Sequence
  source: /note="Description of Artificial Sequence: Synthetic polypeptide"
  source: /note="p.E79Q"
LEKERQEQLQKEQEKAFFAQLQLDEQQTGEFLPIQPAQHIQSETSGSANYSQ

SEQ ID NO: 2104 - protein, 52 aa, Artificial Sequence
  source: /note="Description of Artificial Sequence: Synthetic polypeptide"
  source: /note="p.G81S"
KERQEQLQKEQEKAFFAQLQLDEETSSEFLPIQPAQHIQSETSGSANYSQVA

SEQ ID NO: 2105 - protein, 52 aa, Artificial Sequence
  source: /note="Description of Artificial Sequence: Synthetic polypeptide"
  source: /note="p.D29H"
LELPPPGLPSQQDMDLIDILWRQDIHHLGVSREVFDFSQRRKEYELEKQKKL

SEQ ID NO: 2106 - protein, 52 aa, Artificial Sequence
  source: /note="Description of Artificial Sequence: Synthetic polypeptide"
  source: /note="p.L30F"
ELPPPGLPSQQDMDLIDILWRQDIDFFGVSREVFDFSQRRKEYELEKQKKLE

SEQ ID NO: 2107 - protein, 52 aa, Artificial Sequence
  source: /note="Description of Artificial Sequence: Synthetic polypeptide"
  source: /note="p.G31A"
LPPPGLPSQQDMDLIDILWRQDIDLAAVSREVFDFSQRRKEYELEKQKKLEK

SEQ ID NO: 2108 - protein, 52 aa, Artificial Sequence
  source: /note="Description of Artificial Sequence: Synthetic polypeptide"
  source: /note="p.L294F"
SVTELVRVSQTPIAAGTGPNFSLSDFFESSSYYSMSPGAMRRSLPSTSSTSS

SEQ ID NO: 2109 - protein, 52 aa, Artificial Sequence
  source: /note="Description of Artificial Sequence: Synthetic polypeptide"
  source: /note="p.R109Q"
LKDAAHPSEATFSCDCVADALILRVQQSELSGLPFYWNFHCMLASPSLVSQH

SEQ ID NO: 2110 - protein, 52 aa, Artificial Sequence
  source: /note="Description of Artificial Sequence: Synthetic polypeptide"
  source: /note="p.F204fs"
DVTITNDCHVVVTDAGDRSIKVFDFLARSSLSLEANSPYLGVWRPPLRMGLW

SEQ ID NO: 2111 - protein, 52 aa, Artificial Sequence
  source: /note="Description of Artificial Sequence: Synthetic polypeptide"
  source: /note="p.R84C"
DAEPLEIILHLPLLCEDKNVPYVFVCCSKQALGRACGVSRPVIACSVTIKEG

SEQ ID NO: 2112 - protein, 52 aa, Artificial Sequence
  source: /note="Description of Artificial Sequence: Synthetic polypeptide"
  source: /note="p.D1561N"
ATEILKSPILPKPPGELTAESPQSTNNDAHQGSQGAEALSPLSPCSPRVNAE

SEQ ID NO: 2113 - protein, 91 aa, Artificial Sequence
  source: /note="Description of Artificial Sequence: Synthetic polypeptide"
  source: /note="p.R1035fs"
EPTQRPPTICERWRENLLEHYGGTPGMTSTCPSAMTWATSSPCSATERATSAGVWTKMAERCRAPAPSQAPPLRVYPPSLHPWSGPRPGQM

SEQ ID NO: 2114 - protein, 43 aa, Artificial Sequence
  source: /note="Description of Artificial Sequence: Synthetic polypeptide"
  source: /note="p.R1366C"
VRALQATEEKQRGAEKQSRLLEEKVCCALNKLVSRIAPAALSV

SEQ ID NO: 2115 - protein, 36 aa, Artificial Sequence
  source: /note="Description of Artificial Sequence: Synthetic polypeptide"
  source: /note="p.P286fs"
AGIENYTSQFGPGSPSVAQKSELPPPHLQSHSISLP

SEQ ID NO: 2116 - protein, 29 aa, Artificial Sequence
  source: /note="Description of Artificial Sequence: Synthetic peptide"
  source: /note="p.H447del"
GYAVPVIQRHEHHHHHEHHHHHHHHFHPS

SEQ ID NO: 2117 - protein, 54 aa, Artificial Sequence
  source: /note="Description of Artificial Sequence: Synthetic polypeptide"
  source: /note="p.C190fs"
KKMPNVFQNLVSCKRVFRELKMLCFLSMIMYSLPLTYSNLHTLTILKKYMLSQN

SEQ ID NO: 2118 - protein, 52 aa, Artificial Sequence
  source: /note="Description of Artificial Sequence: Synthetic polypeptide"
  source: /note="p.E409K"
SDFIRSLDHCGDLALEGVFSHKFDFKKLQDVSSVNEDVLLTTGLLCKYTAQR

SEQ ID NO: 2119 - protein, 52 aa, Artificial Sequence
  source: /note="Description of Artificial Sequence: Synthetic polypeptide"
  source: /note="p.D593N"
KSALSQEFEAFFQGKSLYINSGNIPNNYLFDFFEHLPNCASALDFIKLDFYG

SEQ ID NO: 2120 - protein, 52 aa, Artificial Sequence
  source: /note="Description of Artificial Sequence: Synthetic polypeptide"
  source: /note="p.R288W"
ALIKENHRFKNMVIVTTTTECLRHIWWQFGALTAEVGDMTEDSAQALIREVL

SEQ ID NO: 2121 - protein, 52 aa, Artificial Sequence
  source: /note="Description of Artificial Sequence: Synthetic polypeptide"
  source: /note="p.R157C"
MKKDYRKKYRKYVRSRFQCIEDRNACCLGESVSLNKRYTRLRLIKEHRSQQE

SEQ ID NO: 2122 - protein, 52 aa, Artificial Sequence
  source: /note="Description of Artificial Sequence: Synthetic polypeptide"
  source: /note="p.V229I"
LISREWPDPAAPITEIVSQPERLLFIIIDSFEELQGGLNEPDSDLCGDLMEK

SEQ ID NO: 2123 - protein, 52 aa, Artificial Sequence
  source: /note="Description of Artificial Sequence: Synthetic polypeptide"
  source: /note="p.R392H"
LGSVLNNDTKLCKDWAEKQPPFTLIHHSLLRKVLLPESFLIVTVRDVGTEKL

SEQ ID NO: 2124 - protein, 52 aa, Artificial Sequence
  source: /note="Description of Artificial Sequence: Synthetic polypeptide"
  source: /note="p.R737W"
LPINQNLDLIASSFCLQHCPYLRKIWWVDVKGIFPRDESAEACPVVPLWMRD

SEQ ID NO: 2125 - protein, 52 aa, Artificial Sequence
  source: /note="Description of Artificial Sequence: Synthetic polypeptide"
  source: /note="p.E611G"
CPGVAPEVTEGAKGLEDTEEPEEEEGGGEEPNYPLELLYCLYETQEDAFVRQ

SEQ ID NO: 2126 - protein, 52 aa, Artificial Sequence
  source: /note="Description of Artificial Sequence: Synthetic polypeptide"
  source: /note="p.E75K"
QKMRIEVGLDLLHFALAEADRLDVLKKKYRGKCEPTFLFYAGGELVAVVRGA

SEQ ID NO: 2127 - protein, 44 aa, Artificial Sequence
  source: /note="Description of Artificial Sequence: Synthetic polypeptide"
  source: /note="p.A18E"
MLRTESCRPRSPAGQVAEEASPLLLLLLLLAWCAGACRGAPILP

SEQ ID NO: 2128 - protein, 45 aa, Artificial Sequence
  source: /note="Description of Artificial Sequence: Synthetic polypeptide"
  source: /note="p.A19E"
MLRTESCRPRSPAGQVAAEESPLLLLLLLLAWCAGACRGAPILPQ

SEQ ID NO: 2129 - protein, 52 aa, Artificial Sequence
  source: /note="Description of Artificial Sequence: Synthetic polypeptide"
  source: /note="p.E233K"
EQKFSSLPLGREAVEAAVKEAGYTIKKWFEVISQSYSSTMANNEGLFSLVAR

SEQ ID NO: 2130 - protein, 52 aa, Artificial Sequence
  source: /note="Description of Artificial Sequence: Synthetic polypeptide"
  source: /note="p.S58A"
PRRRLGSLRWCGRRRLRWRLLQAQAAAGVDWREGARQVSRAAAARRPNTATP

SEQ ID NO: 2131 - protein, 52 aa, Artificial Sequence
  source: /note="Description of Artificial Sequence: Synthetic polypeptide"
  source: /note="p.T428M"
VTTKSPAVKPAAAPKQPVGGGQKLLMMRKADSSSSEEESSSSEEEKTKKMVA

SEQ ID NO: 2132 - protein, 50 aa, Artificial Sequence
  source: /note="Description of Artificial Sequence: Synthetic polypeptide"
  source: /note="p.R24G"
MAASRSAGEAGPGGSQGRVVRMKGGRGGRGPRRGPAGGGEKALKRLKLAV

SEQ ID NO: 2133 - protein, 53 aa, Artificial Sequence
  source: /note="Description of Artificial Sequence: Synthetic polypeptide"
  source: /note="p.Q306del"
LGTETPLSTHHQMQLLQQLLQQQQQTQVAVAQVHLLKDQLAAEAAARLEAQAR

SEQ ID NO: 2134 - protein, 28 aa, Artificial Sequence
  source: /note="Description of Artificial Sequence: Synthetic peptide"
  source: /note="p.P2514fs"
SYSSPVDNTPSHQLQVPEHPFLTPSRVP

SEQ ID NO: 2135 - protein, 31 aa, Artificial Sequence
  source: /note="Description of Artificial Sequence: Synthetic polypeptide"
  source: /note="p.P6fs"
MPALRRSAVGAAGALAVLRGPRACIAVSRWL

SEQ ID NO: 2136 - protein, 45 aa, Artificial Sequence
  source: /note="Description of Artificial Sequence: Synthetic polypeptide"
  source: /note="p.C19W"
MPALRPALLWALLALWLCWWAAPAHALQCRDGYEPCVNEGMCVTY

SEQ ID NO: 2137 - protein, 52 aa, Artificial Sequence
  source: /note="Description of Artificial Sequence: Synthetic polypeptide"
  source: /note="p.R2105L"
LSPVICGPNRSFLSLKHTPMGKKSRLLPSAKSTMPTSLPNLAKEAKDAKGSR

SEQ ID NO: 2138 - protein, 52 aa, Artificial Sequence
  source: /note="Description of Artificial Sequence: Synthetic polypeptide"
  source: /note="p.R2298W"
APAEGTHPGIAPQSRPPEGKHITTPWWEPLPPIVTFQLIPKGSIAQPAGAPQ

SEQ ID NO: 2139 - protein, 47 aa, Artificial Sequence
  source: /note="Description of Artificial Sequence: Synthetic polypeptide"
  source: /note="p.C404fs"
SLPRLAVDGPFGTALTDVFHYPVCVRCRGDRSHSLRCSSEIYMVQMQ

SEQ ID NO: 2140 - protein, 34 aa, Artificial Sequence
  source: /note="Description of Artificial Sequence: Synthetic polypeptide"
  source: /note="p.P467fs"
AVCIMEVNLLPSKVTHLLIKRPPFFTIDLVTTCI

SEQ ID NO: 2141 - protein, 32 aa, Artificial Sequence
  source: /note="Description of Artificial Sequence: Synthetic polypeptide"
  source: /note="p.D6E"
MASLGEELVRAWHLGAQAVDRGDWARALHLFS

SEQ ID NO: 2142 - protein, 66 aa, Artificial Sequence
  source: /note="Description of Artificial Sequence: Synthetic polypeptide"
  source: /note="p.G3fs"
MAGPPIPSFSARGSPGADQEAPNVCLLCALVRRQRHLRAQELGRIQAAQEDPQGDLPGGGGPAAEI

SEQ ID NO: 2143 - protein, 52 aa, Artificial Sequence
  source: /note="Description of Artificial Sequence: Synthetic polypeptide"
  source: /note="p.Q201R"
DSITPLLGHLPSDVMDQNLLNFLPERREHSEVYKILSSHMLVTDSPSPEYLK

SEQ ID NO: 2144 - protein, 52 aa, Artificial Sequence
  source: /note="Description of Artificial Sequence: Synthetic polypeptide"
  source: /note="p.E451K"
GADVPFGPPLDIQILHQVLDLQIAIKKNITASYDNETVTLQDICLAPLSPYN

SEQ ID NO: 2145 - protein, 39 aa, Artificial Sequence
  source: /note="Description of Artificial Sequence: Synthetic polypeptide"
  source: /note="p.A271V"
QPPPPTQQHSIIDNSLSLKTPSELSVVHSPSTLSSTLSG

SEQ ID NO: 2146 - protein, 36 aa, Artificial Sequence
  source: /note="Description of Artificial Sequence: Synthetic polypeptide"
  source: /note="p.L287fs"
KVEAKFINYVKNCFRMTDQEAIQDLCLAVEEVSLRK

SEQ ID NO: 2147 - protein, 36 aa, Artificial Sequence
  source: /note="Description of Artificial Sequence: Synthetic polypeptide"
  source: /note="p.L287fs"
KVEAKFINYVKNCFRMTDQEAIQDLLLAVEEVSLRK

SEQ ID NO: 2148 - protein, 36 aa, Artificial Sequence; identical to SEQ ID NO: 2146
  source: /note="Description of Artificial Sequence: Synthetic polypeptide"
  source: /note="p.W288fs"

SEQ ID NO: 2149 - protein, 52 aa, Artificial Sequence
  source: /note="Description of Artificial Sequence: Synthetic polypeptide"
  source: /note="p.Y138H"
LFSLVDRVAAARGAKPDLILGPVCEHHAAAPVARLASHWDLPMLSAGALAAG

SEQ ID NO: 2150 - protein, 52 aa, Artificial Sequence
  source: /note="Description of Artificial Sequence: Synthetic polypeptide"
  source: /note="p.R235Q"
YMTIVAFLVYFIPLTIISIMYGIVIQQTIWIKSKTYETVISNCSDGKLCSSY

SEQ ID NO: 2151 - protein, 52 aa, Artificial Sequence
  source: /note="Description of Artificial Sequence: Synthetic polypeptide"
  source: /note="p.A263T"
YMYAKVKKSLPEMYAFTVCMWLKSSTTTPGVGTPFSYAVPGQANELVLIEWG

SEQ ID NO: 2152 - protein, 40 aa, Artificial Sequence
  source: /note="Description of Artificial Sequence: Synthetic polypeptide"
  source: /note="p.A371T"
DYETIAMSTMHTDVSKTSLKQASPVTTFKKINNNDDNEKI

SEQ ID NO: 2153 - protein, 52 aa, Artificial Sequence
  source: /note="Description of Artificial Sequence: Synthetic polypeptide"
  source: /note="p.S270I"
HPSGVKTESAVLMTSDKAESCQGDLIITLANVVTSLANLGKTKDLSQNSNEM

SEQ ID NO: 2154 - protein, 52 aa, Artificial Sequence
  source: /note="Description of Artificial Sequence: Synthetic polypeptide"
  source: /note="p.R314L"
RTVQKNAKYVCLANKNCPVDKRRRNLLCQYCRFQKCLAVGMVKEVVRTDSLK

SEQ ID NO: 2155 - protein, 52 aa, Artificial Sequence
  source: /note="Description of Artificial Sequence: Synthetic polypeptide"
  source: /note="p.E80K"
SHGEQGQMPENMQVSQFKMVNYSYDKKDLEELCPVCGDKVSGYHYGLLTCES

SEQ ID NO: 2156 - protein, 52 aa, Artificial Sequence
  source: /note="Description of Artificial Sequence: Synthetic polypeptide"
  source: /note="p.E327K"
YEEHRGKGSFPAMITPAYQNAKKAHKKLASDIKYRQDFNKMKGAAHYHSLPA

SEQ ID NO: 2157 - protein, 52 aa, Artificial Sequence; identical to SEQ ID NO: 1479
  source: /note="Description of Artificial Sequence: Synthetic polypeptide"
  source: /note="p.Q61K"

SEQ ID NO: 2158 - protein, 52 aa, Artificial Sequence; identical to SEQ ID NO: 1480
  source: /note="Description of Artificial Sequence: Synthetic polypeptide"
  source: /note="p.Q61R"

SEQ ID NO: 2159 - protein, 52 aa, Artificial Sequence; identical to SEQ ID NO: 1717
  source: /note="Description of Artificial Sequence: Synthetic polypeptide"
  source: /note="p.Q61L"

SEQ ID NO: 2160 - protein, 52 aa, Artificial Sequence; identical to SEQ ID NO: 1718
  source: /note="Description of Artificial Sequence: Synthetic polypeptide"
  source: /note="p.Q61H"

SEQ ID NO: 2161 - protein, 52 aa, Artificial Sequence; identical to SEQ ID NO: 1718
  source: /note="Description of Artificial Sequence: Synthetic polypeptide"
  source: /note="p.Q61H"

SEQ ID NO: 2162 - protein, 38 aa, Artificial Sequence; identical to SEQ ID NO: 1722
  source: /note="Description of Artificial Sequence: Synthetic polypeptide"
  source: /note="p.G12C"

SEQ ID NO: 2163 - protein, 38 aa, Artificial Sequence; identical to SEQ ID NO: 1482
  source: /note="Description of Artificial Sequence: Synthetic polypeptide"
  source: /note="p.G12D"

SEQ ID NO: 2164 - protein, 39 aa, Artificial Sequence
  source: /note="Description of Artificial Sequence: Synthetic polypeptide"
  source: /note="p.G13R"
MTEYKLVVVGAGRRVGKSALTIQLIQNHFVDEYDPTIED

SEQ ID NO: 2165 - protein, 39 aa, Artificial Sequence; identical to SEQ ID NO: 1727
  source: /note="Description of Artificial Sequence: Synthetic polypeptide"
  source: /note="p.G13D"

SEQ ID NO: 2166 - protein, 52 aa, Artificial Sequence
  source: /note="Description of Artificial Sequence: Synthetic polypeptide"
  source: /note="p.V481L"
VSSMTVSMPSMAVSPFMEEERPLLLLLTPPRLREKKFDHHPQQFSSFHHNPA

SEQ ID NO: 2167 - protein, 52 aa, Artificial Sequence
  source: /note="Description of Artificial Sequence: Synthetic polypeptide"
  source: /note="p.T246M"
LKKEVGKILCTDCATRPKLKKMKSQMMGQVGEKQSLKCEAAAGNPQPSYRWF

SEQ ID NO: 2168 - protein, 24 aa, Artificial Sequence
  source: /note="Description of Artificial Sequence: Synthetic peptide"
  source: /note="p.G21fs"
ANRSRRALWSQSQVVLPEWGAVVM

SEQ ID NO: 2169 - protein, 52 aa, Artificial Sequence
  source: /note="Description of Artificial Sequence: Synthetic polypeptide"
  source: /note="p.R103C"
FETPEAYISLPKWNTKRMGSISFDFCCTTEPNGLILFTHGKPQERKDARSQK

SEQ ID NO: 2170 - protein, 49 aa, Artificial Sequence
  source: /note="Description of Artificial Sequence: Synthetic polypeptide"
  source: /note="p.P23H"
MLGSDDFFYVGGSPSTADLPGSHHVSNNFMGCLKEVVYKNNDIRLELSR

SEQ ID NO: 2171 - protein, 49 aa, Artificial Sequence
  source: /note="Description of Artificial Sequence: Synthetic polypeptide"
  source: /note="p.D244N"
YFQSNAEPRCPHCNDYWPHEIPKVFNNPEKERESGVLKSNKKSLRSRQH

SEQ ID NO: 2172 - protein, 36 aa, Artificial Sequence
  source: /note="Description of Artificial Sequence: Synthetic polypeptide"
  source: /note="p.Q31fs"
SNSGSTGFISFSGVESALSSLKNFQSLYQLWYGHSF

SEQ ID NO: 2173 - protein, 29 aa, Artificial Sequence
  source: /note="Description of Artificial Sequence: Synthetic peptide"
  source: /note="p.A3P"
MRPPPSMDRAAVARVGAVASASVCALVAG

SEQ ID NO: 2174 - protein, 58 aa, Artificial Sequence
  source: /note="Description of Artificial Sequence: Synthetic polypeptide"
  source: /note="p.P206fs"
AEPTPSWEHVLFTACHNQHLQLQPPAAGCTRGRTTGRPFWTASGPAELDCASGSSVGL

SEQ ID NO: 2175 - protein, 49 aa, Artificial Sequence
  source: /note="Description of Artificial Sequence: Synthetic polypeptide"
  source: /note="p.G333C"
IMLFEVKTTALTPWKGPGAVSEVSNCCTSRRAGCVWLLPLLVLHLLLKF

SEQ ID NO: 2176 - protein, 52 aa, Artificial Sequence
  source: /note="Description of Artificial Sequence: Synthetic polypeptide"
  source: /note="p.E59K"
CNPRMGNLALGRKLWADTTCGQNATKKLYCFYSENTDLTCRQPKCDKCNAAY

SEQ ID NO: 2177 - protein, 52 aa, Artificial Sequence
  source: /note="Description of Artificial Sequence: Synthetic polypeptide"
  source: /note="p.G173C"
RRLSERETRHFFRQIVSAVHYCHKNCCVVHRDLKLENILLDDNCNIKIADFG

SEQ ID NO: 2178 - protein, 52 aa, Artificial Sequence
  source: /note="Description of Artificial Sequence: Synthetic polypeptide"
  source: /note="p.R373Q"
RLVHIKGNCGKEKVLFLRLYLLQGIQQNYHSGNDVEAYEYLNKARQLFKELY

SEQ ID NO: 2179 - protein, 52 aa, Artificial Sequence
  source: /note="Description of Artificial Sequence: Synthetic polypeptide"
  source: /note="p.S83Y"
ECAQRETWEEAALHLKNVHFASVVNYYFIEKENYHYVTILMKGEVDVTHDSE

SEQ ID NO: 2180 - protein, 71 aa, Artificial Sequence
  source: /note="Description of Artificial Sequence: Synthetic polypeptide"
  source: /note="p.W13fs"
MSVVPPNRSQTGWAPGGHSVRQQVHPADEAPHPGAHHQPVPSYQLYFWYKRAPLREGQLCCSQISAHEGRI

SEQ ID NO: 2181 - protein, 52 aa, Artificial Sequence
  source: /note="Description of Artificial Sequence: Synthetic polypeptide"
  source: /note="p.S340L"
KESLNLEDQIESDESELKKLKTEENLLFKRLMIVKKEKLATAQFKINKKHED

SEQ ID NO: 2182 - protein, 40 aa, Artificial Sequence
  source: /note="Description of Artificial Sequence: Synthetic polypeptide"
  source: /note="p.R224fs"
TNGYMGKGADNDGSGSESGYTTPKKGKLGAIVPRVVKTLI

SEQ ID NO: 2183 - protein, 53 aa, Artificial Sequence
  source: /note="Description of Artificial Sequence: Synthetic polypeptide"
  source: /note="p.Q29del"
KPGQPQPQHHHSHHHPHHHPQQQQQPHHHHHYYFYNHSHNHHHHHHHQQPHQY

SEQ ID NO: 2184 - protein, 27 aa, Artificial Sequence
  source: /note="Description of Artificial Sequence: Synthetic peptide"
  source: /note="p.L135fs"
DAIVDLIHDIQIVSTTRELYLEDSPWS

SEQ ID NO: 2185 - protein, 52 aa, Artificial Sequence
  source: /note="Description of Artificial Sequence: Synthetic polypeptide"
  source: /note="p.A302V"
FLTYISLLHSPGNIGKLLGPLPMHPVVAEDNYGYDACAVLCLPCVPNILVIA

SEQ ID NO: 2186 - protein, 40 aa, Artificial Sequence
  source: /note="Description of Artificial Sequence: Synthetic polypeptide"
  source: /note="p.E14K"
MDTEGFGELLQQAKKQLAAETEGISELPHVERNLQEIQQA

SEQ ID NO: 2187 - protein, 52 aa, Artificial Sequence
  source: /note="Description of Artificial Sequence: Synthetic polypeptide"
  source: /note="p.P480S"
DKAVSYTMVYSAVKVTTHSVLPAGPSSLGAGEPKTEKEISVLHGMLCTSSRP

SEQ ID NO: 2188 - protein, 52 aa, Artificial Sequence
  source: /note="Description of Artificial Sequence: Synthetic polypeptide"
  source: /note="p.P437L"
SSPPPPSTLYRTQSPHGYPKSHSTSLLSPVSMGRSLTPLSLKRPPPYDAVHS

SEQ ID NO: 2189 - protein, 52 aa, Artificial Sequence
  source: /note="Description of Artificial Sequence: Synthetic polypeptide"
  source: /note="p.R197Q"
RTEASAKPRPHSDEYSKKIPPPKPKQQNPNTQLSTSFDETYIKKHGPRRTSL

SEQ ID NO: 2190 - protein, 28 aa, Artificial Sequence
  source: /note="Description of Artificial Sequence: Synthetic peptide"
  source: /note="p.G113fs"
AFLGAQGLFLDCLCWSTLAYLVPGPLAP

SEQ ID NO: 2191 - protein, 52 aa, Artificial Sequence
  source: /note="Description of Artificial Sequence: Synthetic polypeptide"
  source: /note="p.R4516W"
LLLRSAQPHHAGEVTFACRDAVASAWWLTVLGLPDPPEDAEVVARSSHTVTL

SEQ ID NO: 2192 - protein, 53 aa, Artificial Sequence
  source: /note="Description of Artificial Sequence: Synthetic polypeptide"
  source: /note="p.A908T"
VSEPKVVFAKEQLARRKLQAEAGASTTTLSCEVAQAQTEVTWYKDGKKLSSSS

SEQ ID NO: 2193 - protein, 109 aa, Artificial Sequence
  source: /note="Description of Artificial Sequence: Synthetic polypeptide"
  source: /note="p.G997fs"
LDVKEPKVVFAKDQVAHSEVQAEAGGQCHAELRGGPGPDGGDVVQRWEEAELQLESACRGQGLQTEAGGAAGRQDRCRGLQLRGQGPEGLLPPAHHRAQDDVCKGAVSA

SEQ ID NO: 2194 - protein, 52 aa, Artificial Sequence
  source: /note="Description of Artificial Sequence: Synthetic polypeptide"
  source: /note="p.E1642K"
RCAARLIVREVPVTIVRGPHDLEVTKKGDTATFECELSQALADVTWEKDGNA

SEQ ID NO: 2195 - protein, 46 aa, Artificial Sequence
  source: /note="Description of Artificial Sequence: Synthetic polypeptide"
  source: /note="p.K407fs"
TTLAALKDEVVSVENELSELQEVEKNRKPLLKCIKLRYKSCKKQLK

SEQ ID NO: 2196 - protein, 52 aa, Artificial Sequence
  source: /note="Description of Artificial Sequence: Synthetic polypeptide"
  source: /note="p.E294K"
DQEAKLSETISASNAWKSHYEKIVIKKKTELEVQIETMKKQIINLLEDLKKM

SEQ ID NO: 2197 - protein, 52 aa, Artificial Sequence
  source: /note="Description of Artificial Sequence: Synthetic polypeptide"
  source: /note="p.R61C"
TGELGQDGRLLSSTLSLSSNRSLGQCCQNSPLPFQWRITHSFRWMAQVLASE

SEQ ID NO: 2198 - protein, 52 aa, Artificial Sequence
  source: /note="Description of Artificial Sequence: Synthetic polypeptide"
  source: /note="p.R366M"
HLFGLTWQLQPVEGELYANGVSKGNMMGTESMDTTYSPIGGKVSDKSEKKVF

SEQ ID NO: 2199 - protein, 52 aa, Artificial Sequence
  source: /note="Description of Artificial Sequence: Synthetic polypeptide"
  source: /note="p.R2556W"
KGIKFAIKDGIVTADIIGVANEDSRWWLAAILNNAHYLENLHFTIEGRDTHY

SEQ ID NO: 2200 - protein, 49 aa, Artificial Sequence
  source: /note="Description of Artificial Sequence: Synthetic polypeptide"
  source: /note="p.W628fs"
KAACPVLCSGNGQYSKGTCQCYSGWERCRVRRAHESVHRSFLRGPRLLH

SEQ ID NO: 2201 - protein, 52 aa, Artificial Sequence
  source: /note="Description of Artificial Sequence: Synthetic polypeptide"
  source: /note="p.P218Q"
SAQHHPSITSLNRNSLTNRRNQSPAQQPAALPAELQTTPESVQLQDSWVLGS

SEQ ID NO: 2202 - protein, 43 aa, Artificial Sequence
  source: /note="Description of Artificial Sequence: Synthetic polypeptide"
  source: /note="p.I78fs"
NYVEEMYCAWLENPKSVHKSWDIFFATRMPEPHRALPTRVPFP

SEQ ID NO: 2203 - protein, 27 aa, Artificial Sequence
  source: /note="Description of Artificial Sequence: Synthetic peptide"
  source: /note="p.Y948fs"
VAITRIEQLSPFPFDLLLKEVQKYPQC

SEQ ID NO: 2204 - protein, 52 aa, Artificial Sequence
  source: /note="Description of Artificial Sequence: Synthetic polypeptide"
  source: /note="p.A427T"
TKAEQFYRGDAQGKKVMSILVHGDATTFAGQGVVYETFHLSDLPSYTTNGTV

SEQ ID NO: 2205 - protein, 52 aa, Artificial Sequence
  source: /note="Description of Artificial Sequence: Synthetic polypeptide"
  source: /note="p.R57C"
RLLPSRLGVQAARLLAAHDVPVFGWCCSRSSGPPATFPSSKGGGGSSYMEEM

SEQ ID NO: 2206 - protein, 40 aa, Artificial Sequence
  source: /note="Description of Artificial Sequence: Synthetic polypeptide"
  source: /note="p.G477fs"
SKAEFALDLILYCGCEGWEPEYGGFFFLLLTLPKVKMKSC

SEQ ID NO: 2207 - protein, 52 aa, Artificial Sequence
  source: /note="Description of Artificial Sequence: Synthetic polypeptide"
  source: /note="p.S557T"
DEPAESPSETPGPRPAGPAGDEPAETTPSETPGPRPAGPAGDEPAESPSETP

SEQ ID NO: 2208 - protein, 52 aa, Artificial Sequence
  source: /note="Description of Artificial Sequence: Synthetic polypeptide"
  source: /note="p.R508S"
FVGKDHKEVFLHCRVLVCGVLDERSSSCAQGCHRRMRRGAGGEDSAGLQGQT

SEQ ID NO: 2209 - protein, 52 aa, Artificial Sequence
  source: /note="Description of Artificial Sequence: Synthetic polypeptide"
  source: /note="p.K132N"
HVLSQKFEKELSKVREYVQLISVYENNKLLNLTVRIDIMEKDTISYTELDFE

SEQ ID NO: 2210 - protein, 52 aa, Artificial Sequence
  source: /note="Description of Artificial Sequence: Synthetic polypeptide"
  source: /note="p.R445Q"
MEFVDSLHGQPKMPEWLSTHPSHGNQQVEYLDRLIPQALKIREMCNCPPLSN

SEQ ID NO: 2211 - protein, 52 aa, Artificial Sequence
  source: /note="Description of Artificial Sequence: Synthetic polypeptide"
  source: /note="p.L424M"
TLHAIFKENKRPSKELQITISQQLGMMELSTVSNFFMNARRRSLDKWQDEGS

SEQ ID NO: 2212 - protein, 52 aa, Artificial Sequence
  source: /note="Description of Artificial Sequence: Synthetic polypeptide"
  source: /note="p.R101C"
TSQALLTVDIVDSGNLVEITVFGRPCCVQNRVKSMLLCLAWFHREHRARAEK

SEQ ID NO: 2213 - protein, 52 aa, Artificial Sequence
  source: /note="Description of Artificial Sequence: Synthetic polypeptide"
  source: /note="p.A900D"
QQEGAVFLSFKLVQGGVFQEEAVTEDDLRAPGKVPNCSGTRNLHDNLSDLRA

SEQ ID NO: 2214 - protein, 52 aa, Artificial Sequence
  source: /note="Description of Artificial Sequence: Synthetic polypeptide"
  source: /note="p.P283H"
STQKAEKEVTRMVVVMIFAYCVCWGHHYTFFACFAAANPGYAFHPLMAALPA

SEQ ID NO: 2215 - protein, 52 aa, Artificial Sequence
  source: /note="Description of Artificial Sequence: Synthetic polypeptide"
  source: /note="p.A285T"
QKAEKEVTRMVVVMVLAFCFCWGPYTTFFACFAAANPGYPFHPLMAALPAFF

SEQ ID NO: 2216 - protein, 52 aa, Artificial Sequence
  source: /note="Description of Artificial Sequence: Synthetic polypeptide"
  source: /note="p.C27F"
EPAPSAGAELQPPLFANASDAYPSAFFPSAGANASGPPGARSASSLALAIAI

SEQ ID NO: 2217 - protein, 52 aa, Artificial Sequence
  source: /note="Description of Artificial Sequence: Synthetic polypeptide"
  source: /note="p.R353H"
KICVFIFAFIMPVLIITVCYGLMILHHLKSVRMLSGSKEKDRNLRRITRMVL

SEQ ID NO: 2218 - protein, 52 aa, Artificial Sequence
  source: /note="Description of Artificial Sequence: Synthetic polypeptide"
  source: /note="p.R462C"
NFKRCFREFCIPTSSNIEQQNSTRICCQNTRDHPSTANTVDRTNHQLENLEA

SEQ ID NO: 2219 - protein, 43 aa, Artificial Sequence
  source: /note="Description of Artificial Sequence: Synthetic polypeptide"
  source: /note="p.P24fs"
MSHQPLSCLTEKEDSPSESTGNGPPTWPTQTWTRLPRRSCCSR

SEQ ID NO: 2220 - protein, 52 aa, Artificial Sequence
  source: /note="Description of Artificial Sequence: Synthetic polypeptide"
  source: /note="p.F73V"
IISLNQSLHVPMYLFLLNLSVVEVSVVSAVITPEMLVVLSTEKTMISFVGCF

SEQ ID NO: 2221 - protein, 52 aa, Artificial Sequence
  source: /note="Description of Artificial Sequence: Synthetic polypeptide"
  source: /note="p.S93Y"
VVEVSFSAVITPEMLVVLSTEKTMIYYFVGCFAQMYFILLFGGTECFLLGAM

SEQ ID NO: 2222 - protein, 52 aa, Artificial Sequence
  source: /note="Description of Artificial Sequence: Synthetic polypeptide"
  source: /note="p.M199I"
VIHHFFCHVLSLLKLACENKTSSVIIIGVMLVCVTALIGCLFLIILSYVFIV

SEQ ID NO: 2223 - protein, 52 aa, Artificial Sequence
  source: /note="Description of Artificial Sequence: Synthetic polypeptide"
  source: /note="p.L157Q"
DRYVAICNPLRYMVIMNKRLRIQLVQQGACSIGLIVAITQVTSVFRLPFCAR

SEQ ID NO: 2224 - protein, 52 aa, Artificial Sequence
  source: /note="Description of Artificial Sequence: Synthetic polypeptide"
  source: /note="p.R244Q"
VPMGLVFISYVLIISTILKIASVEGQQKKAFATCASHLTVVIVHYSCASIAY

SEQ ID NO: 2225 - protein, 52 aa, Artificial Sequence
  source: /note="Description of Artificial Sequence: Synthetic polypeptide"
  source: /note="p.L298I"
IVYLKPEASGDDTLIAVPYTVITPFIISPIIFSLRNKDMKNAFRRMMGNTVA

SEQ ID NO: 2226 - protein, 52 aa, Artificial Sequence
  source: /note="Description of Artificial Sequence: Synthetic polypeptide"
  source: /note="p.L205F"
DTPPVLSLACGDTGPSELRIFILSLFFVLLVSFFFITISYAYILAAILRIPS

SEQ ID NO: 2227 - protein, 52 aa, Artificial Sequence
  source: /note="Description of Artificial Sequence: Synthetic polypeptide"
  source: /note="p.H154P"
LLTVMAFDQYLAICRPLLYPNIMTGPPLCAKLVILCWVCGFLWFLIPIVLIS

SEQ ID NO: 2228 - protein, 35 aa, Artificial Sequence
  source: /note="Description of Artificial Sequence: Synthetic polypeptide"
  source: /note="p.L9V"
MEWENHTIVVVEFFLKGLSGHPRLELLFFVLIFIM

SEQ ID NO: 2229 - protein, 52 aa, Artificial Sequence
  source: /note="Description of Artificial Sequence: Synthetic polypeptide"
  source: /note="p.R258H"
KAFSTCSSHLTVVTLYYSPVIYTYIHHPASSYTFERDKVVAALYTLVTPTLN

SEQ ID NO: 2230 - protein, 52 aa, Artificial Sequence
  source: /note="Description of Artificial Sequence: Synthetic polypeptide"
  source: /note="p.G160C"
DRSTCVQRATVSWLYGGLIAVMHTACCTFSLSYCGSNMVHQFFCDIPQLLAI

SEQ ID NO: 2231 - protein, 52 aa, Artificial Sequence
  source: /note="Description of Artificial Sequence: Synthetic polypeptide"
  source: /note="p.V69I"
LIILAISIDSHLHTPMYFFLANLSLIIDFCLATNTIPKMLVSLQTGSKAISY

SEQ ID NO: 2232 - protein, 52 aa, Artificial Sequence
  source: /note="Description of Artificial Sequence: Synthetic polypeptide"
  source: /note="p.M80I"
HTPMYFFLSHLAVVDIACACSTVPQIILVNLLHPAKPISFAGCMTQMFLFLS

SEQ ID NO: 2233 - protein, 52 aa, Artificial Sequence
  source: /note="Description of Artificial Sequence: Synthetic polypeptide"
  source: /note="p.S105C"
MLVNLLHPAKPISFAGCMTQMFLFLCCFAHTECLLLVVMSYDRYVAICHPLR

SEQ ID NO: 2234 - protein, 52 aa, Artificial Sequence
  source: /note="Description of Artificial Sequence: Synthetic polypeptide"
  source: /note="p.S71L"
GLIWLDSRLHTPMYFFLSHLAIIDILLYASNNVPKMLTNLGLNKRKTISFVP

SEQ ID NO: 2235 - protein, 52 aa, Artificial Sequence
  source: /note="Description of Artificial Sequence: Synthetic polypeptide"
  source: /note="p.G249W"
TVLRMPSNEGRKKALVTCSSHLIVVWWMFYGAATFMYVLPSSFHSPKQDNII

SEQ ID NO: 2236 - protein, 52 aa, Artificial Sequence
  source: /note="Description of Artificial Sequence: Synthetic polypeptide"
  source: /note="p.W37C"
LVSAMKTGNQSFGTDFLLVGLFQYGCCINSLLFVVIATLFTVALTGNIMLIH

SEQ ID NO: 2237 - protein, 52 aa, Artificial Sequence
  source: /note="Description of Artificial Sequence: Synthetic polypeptide"
  source: /note="p.V45I"
NQSFGTDFLLVGLFQYGWINSLLFVIIIATLFTVALTGNIMLIHLIRLNTRL

SEQ ID NO: 2238 - protein, 36 aa, Artificial Sequence
  source: /note="Description of Artificial Sequence: Synthetic polypeptide"
  source: /note="p.G10V"
MKSDNHSFLVVDSPKAFILLGVSDRPWLELPLFVVL

SEQ ID NO: 2239 - protein, 52 aa, Artificial Sequence
  source: /note="Description of Artificial Sequence: Synthetic polypeptide"
  source: /note="p.V287I"
NPYAQGRGKFFGLFYAVGTPSLNPLIIYTLRNKEIKRALRRLLGKERDSRES

SEQ ID NO: 2240 - protein, 52 aa, Artificial Sequence
  source: /note="Description of Artificial Sequence: Synthetic polypeptide"
  source: /note="p.L205F"
PALIRLSCEDTSYNEIQVAVASVFIFFVVPLSLILVSYGAITWAVLRINSAK

SEQ ID NO: 2241 - protein, 52 aa, Artificial Sequence
  source: /note="Description of Artificial Sequence: Synthetic polypeptide"
  source: /note="p.G234W"
LIPLILILTTYGAIARAVLSMQSTTWWLQKVFRTCGAHLMVVSLFFIPVMCM

SEQ ID NO: 2242 - protein, 52 aa, Artificial Sequence
  source: /note="Description of Artificial Sequence: Synthetic polypeptide"
  source: /note="p.M106I"
AYNFLSGQKGISFLGCGVQSFFFLTIIACSEGLLLTSMAYDRYLAICHSLYY

SEQ ID NO: 2243 - protein, 52 aa, Artificial Sequence
  source: /note="Description of Artificial Sequence: Synthetic polypeptide"
  source: /note="p.T242A"
CGRVLFAVYHMHSKEGRKKAFTTISAAHLTVVIFYYAPFVYTYLRPRNLRSP

SEQ ID NO: 2244 - protein, 52 aa, Artificial Sequence
  source: /note="Description of Artificial Sequence: Synthetic polypeptide"
  source: /note="p.L67I"
LSMILLIFLDTHLHTPMYFLLSQLSIIIDLNYISTIVPKMASDFLSGNKSIS

SEQ ID NO: 2245 - protein, 27 aa, Artificial Sequence
  source: /note="Description of Artificial Sequence: Synthetic peptide"
  source: /note="p.M1I"
IIENYNQTSTDFILLGFFPPSRIGLFL

SEQ ID NO: 2246 - protein, 45 aa, Artificial Sequence
  source: /note="Description of Artificial Sequence: Synthetic polypeptide"
  source: /note="p.K294R"
EDKVLAVFYTTLTPMLNPIIYSLRNRREVMGALTRVSQRICSGKM

SEQ ID NO: 2247 - protein, 52 aa, Artificial Sequence
  source: /note="Description of Artificial Sequence: Synthetic polypeptide"
  source: /note="p.R121C"
CGIQSFFFLALGGAEALLLASMAYDCCYIAICFPLHYLIRMSKRVCVLMITG

SEQ ID NO: 2248 - protein, 52 aa, Artificial Sequence
  source: /note="Description of Artificial Sequence: Synthetic polypeptide"
  source: /note="p.R171S"
GSWIIGSINACAHTVYVLHIPYCRSSSAINHFFCDVPAMVTLACMDTWVYEG

SEQ ID NO: 2249 - protein, 112 aa, Artificial Sequence
  source: /note="Description of Artificial Sequence: Synthetic polypeptide"
  source: /note="p.S201fs"
FCDVPAMVTLACMDTWVYEGTVFLSHHLSRVSLHWYFMFLWPGSLCCLPHEICRREEESLFDLQHPPHCSNFLLCTFCLHLSTSKIPAISNRGQGSGCLLHHPHPNAQPHHL

SEQ ID NO: 2250 - protein, 60 aa, Artificial Sequence
  source: /note="Description of Artificial Sequence: Synthetic polypeptide"
  source: /note="p.A95fs"
DLMLICTTVPKMAFNYLSGSKSISMVVVSHKFSSIYHCLALNVFFWLLWLMTAILLFATL

SEQ ID NO: 2251 - protein, 52 aa, Artificial Sequence
  source: /note="Description of Artificial Sequence: Synthetic polypeptide"
  source: /note="p.F177L"
GSTDGIIDAVATFSFSFCGSREIAHLLFCEFPSLLILSCNDTSIFEEVIFIC

SEQ ID NO: 2252 - protein, 51 aa, Artificial Sequence
  source: /note="Description of Artificial Sequence: Synthetic polypeptide"
  source: /note="p.F323L"
TRAFMKILGKGKSESELPHKLYVLLLLAKFFFLISIFFYDVKILALIMYIA

SEQ ID NO: 2253 - protein, 52 aa, Artificial Sequence
  source: /note="Description of Artificial Sequence: Synthetic polypeptide"
  source: /note="p.R235H"
PVAIIIASYARVILAVIHMGSGEGRHHKAFTTCSSHLLVVGMYYGAALFMYI

SEQ ID NO: 2254 - protein, 52 aa, Artificial Sequence
  source: /note="Description of Artificial Sequence: Synthetic polypeptide"
  source: /note="p.M273I"
VGMYYGAALFMYIRPTSDRSPTQDKIIVSVFYTILTPMLNPLIYSLRNKEVT

SEQ ID NO: 2255 - protein, 52 aa, Artificial Sequence
  source: /note="Description of Artificial Sequence: Synthetic polypeptide"
  source: /note="p.V205L"
DFPSLLILSCNDTSIFEKVLFICCILLMIVFPVAIIIASYARVILAVIHMGS

SEQ ID NO: 2256 - protein, 52 aa, Artificial Sequence
  source: /note="Description of Artificial Sequence: Synthetic polypeptide"
  source: /note="p.R184H"
VATLSFPYCGAHEIDHFFCEAPVLVHHLACADTSVFENAMYICCVLMLLVPF

SEQ ID NO: 2257 - protein, 52 aa, Artificial Sequence
  source: /note="Description of Artificial Sequence: Synthetic polypeptide"
  source: /note="p.M258L"
KKAFATCSSHVAVVGLFYGAGIFTYLLRPKSHRSTNHDKVVSAFYTMFTPLL

SEQ ID NO: 2258 - protein, 39 aa, Artificial Sequence
  source: /note="Description of Artificial Sequence: Synthetic polypeptide"
  source: /note="p.F13V"
MGMEGLLQNSTNVVVLTGLITHPAFPGLLFAIVFSIFVV

SEQ ID NO: 2259 - protein, 37 aa, Artificial Sequence
  source: /note="Description of Artificial Sequence: Synthetic polypeptide"
  source: /note="p.D11Y"
MEQSNYSVYAYYFILLGLFSNARFPWLLFALILLVFL

SEQ ID NO: 2260 - protein, 52 aa, Artificial Sequence
  source: /note="Description of Artificial Sequence: Synthetic polypeptide"
  source: /note="p.R120S"
CGVQIFFLPTLGGGECFLLAAMAYDSSYAAVCHPLRYPTLMSWQLCLRMTMS

SEQ ID NO: 2261 - protein, 52 aa, Artificial Sequence
  source: /note="Description of Artificial Sequence: Synthetic polypeptide"
  source: /note="p.P165Q"
LRMTMSCWLLGAADGLLQAVVTLSFQQYCGAHEIDHFFCETPVLVRLACADT

SEQ ID NO: 2262 - protein, 52 aa, Artificial Sequence
  source: /note="Description of Artificial Sequence: Synthetic polypeptide"
  source: /note="p.C246F"
SSYTLILHLIHRMNSAAGRRKALATFFSSHMIIVLLLFGASFYTYMLRSSYH

SEQ ID NO: 2263 - protein, 53 aa, Artificial Sequence
  source: /note="Description of Artificial Sequence: Synthetic polypeptide"
  source: /note="p.V137L"
KMLLDQVMGVNKISAPECGMQMFFYLLTLAGSEFFLLATMAYDRYVAICHPLR

SEQ ID NO: 2264 - protein, 52 aa, Artificial Sequence
  source: /note="Description of Artificial Sequence: Synthetic polypeptide"
  source: /note="p.V213L"
ACGDKTTYETVMYVCCVAMLLIPFSLLVTASYTRILITVHQMTSAEGRKKAF

SEQ ID NO: 2265 - protein, 52 aa, Artificial Sequence
  source: /note="Description of Artificial Sequence: Synthetic polypeptide"
  source: /note="p.F248L"
LKNNSLEGRCKALSTCISHIIVVVLLLFVPCIFVYLRSVTTLPIDKAVAVFY

SEQ ID NO: 2266 - protein, 52 aa, Artificial Sequence
  source: /note="Description of Artificial Sequence: Synthetic polypeptide"
  source: /note="p.M279I"
FVYLRSVTTLPIDKAVAVFYTMVVPIILNPVVYTLRNAEVKSAIRKLWRKKV

SEQ ID NO: 2267 - protein, 27 aa, Artificial Sequence
  source: /note="Description of Artificial Sequence: Synthetic peptide"
  source: /note="p.D309Y"
VYTLRNAEVKSAIRKLWRKKVTSDNYY

SEQ ID NO: 2268 - protein, 52 aa, Artificial Sequence
  source: /note="Description of Artificial Sequence: Synthetic polypeptide"
  source: /note="p.Y63F"
LGNLLIIISVKTSQALKNPMFFFLFFFLSLSDTCLSTSITPRMIVDALLKKT

SEQ ID NO: 2269 - protein, 52 aa, Artificial Sequence
  source: /note="Description of Artificial Sequence: Synthetic polypeptide"
  source: /note="p.S135R"
IFILILTAVDRYVDICKPLHYMTIIRRQWVCGVLMAVAWVGSCVHSLVQIFL

SEQ ID NO: 2270 - protein, 52 aa, Artificial Sequence
  source: /note="Description of Artificial Sequence: Synthetic polypeptide"
  source: /note="p.L162M"
WVCGVLMAVAWVGSCVHSLVQIFLAMMSLPFCGPNVINHCFCDLQPLLKQAC

SEQ ID NO: 2271 - protein, 29 aa, Artificial Sequence
  source: /note="Description of Artificial Sequence: Synthetic peptide"
  source: /note="p.H130fs"
IADSLYEGRTISYECCMAQLFGAHFFGRC

SEQ ID NO: 2272 - protein, 52 aa, Artificial Sequence
  source: /note="Description of Artificial Sequence: Synthetic polypeptide"
  source: /note="p.R226Q"
TNSGTISLSCFLAVVTSYMVILVSLQQKHSAEGRQKALSTCSAHFMVVALFF

SEQ ID NO: 2273 - protein, 52 aa, Artificial Sequence
  source: /note="Description of Artificial Sequence: Synthetic polypeptide"
  source: /note="p.C254F"
SSRGSSKALSTCTAHFIVVFLFFGPFFIFIYMWPLSSFLTDKILSVFYTIFT

SEQ ID NO: 2274 - protein, 44 aa, Artificial Sequence
  source: /note="Description of Artificial Sequence: Synthetic polypeptide"
  source: /note="p.F177fs"
VHTLSQLSFTVNLPFCGPNVVDSFFVIFLESPNLPAWTLTSLKY

SEQ ID NO: 2275 - protein, 52 aa, Artificial Sequence
  source: /note="Description of Artificial Sequence: Synthetic polypeptide"
  source: /note="p.G41E"
GLSQTREVQLVLFVIFLSFYLFILPEENILIICTIRLDPHLTSPMYFLLANL

SEQ ID NO: 2276 - protein, 52 aa, Artificial Sequence
  source: /note="Description of Artificial Sequence: Synthetic polypeptide"
  source: /note="p.A119S"
FDGCIAQLFFLHFAGASEMFLLTVMSSFDLYTAICRPLHYATIMNQRLCCIL

SEQ ID NO: 2277 - protein, 52 aa, Artificial Sequence
  source: /note="Description of Artificial Sequence: Synthetic polypeptide"
  source: /note="p.A161S"
MNQRLCCILVALSWRGGFIHSIIQVSSLIVRLPFCGPNELDSYFCDITQVVR

SEQ ID NO: 2278 - protein, 52 aa, Artificial Sequence
  source: /note="Description of Artificial Sequence: Synthetic polypeptide"
  source: /note="p.S268F"
YSHITIVVLMFGPSIYIYARPFDSFFFLDKVVSVFNTLIFPLRNPIIYTLRN

SEQ ID NO: 2279 - protein, 52 aa, Artificial Sequence
  source: /note="Description of Artificial Sequence: Synthetic polypeptide"
  source: /note="p.G41E"
GLTQSQDIQLLVFVLVLIFYFIILPEENFLIIFTIKSDPGLTAPLYFFLGNL

SEQ ID NO: 2280 - protein, 54 aa, Artificial Sequence
  source: /note="Description of Artificial Sequence: Synthetic polypeptide"
  source: /note="p.L150fs"
ICRPLHYPTVMNPRTCYAMMLALWLWGFCPLHYPGGPHPPLAFLWPKPAGQLLL

SEQ ID NO: 2281 - protein, 54 aa, Artificial Sequence
  source: /note="Description of Artificial Sequence: Synthetic polypeptide"
  source: /note="p.L150fs"
ICRPLHCSTVMNPRACYAMMLALWLWGFCPLHYPGGPHPPLAFLWPKPAGQLLL

SEQ ID NO: 2282 - protein, 52 aa, Artificial Sequence
  source: /note="Description of Artificial Sequence: Synthetic polypeptide"
  source: /note="p.L124R"
AQEFFIHGFTVMESSVLLIMSLDRFRRAIHNPLRYSSILTSNRVAKMGLILA

SEQ ID NO: 2283 - protein, 52 aa, Artificial Sequence
  source: /note="Description of Artificial Sequence: Synthetic polypeptide"
  source: /note="p.S163L"
RVIALGVGVFLRGFVSILPVILRLFLLFSYCKSHVITRAFCLHQEIMRLACA

SEQ ID NO: 2284 - protein, 72 aa, Artificial Sequence
  source: /note="Description of Artificial Sequence: Synthetic polypeptide"
  source: /note="p.A66fs"
GTLLLLIKEDHNLHEPMYFFLAMLAGPDHNAHGAGSPLAGSQGDWKCGLLFPGLLYTLTFLSRVWHSACHGL

SEQ ID NO: 2285 - protein, 52 aa, Artificial Sequence
  source: /note="Description of Artificial Sequence: Synthetic polypeptide"
  source: /note="p.R67P"
SIPFCLLYVVAVSGNSMILFVVLCEPPSLHKPMYYFLSMLSATDLSLSLCTL

SEQ ID NO: 2286 - protein, 52 aa, Artificial Sequence
  source: /note="Description of Artificial Sequence: Synthetic polypeptide"
  source: /note="p.R159Q"
ICRPLHYPALLTNGVISKISLAISFQQCLGLHLPLPFLLAYMPYCLPQVLTH

SEQ ID NO: 2287 - protein, 50 aa, Artificial Sequence
  source: /note="Description of Artificial Sequence: Synthetic polypeptide"
  source: /note="p.P298T"
FGKHLSPVAHVLIGNIYILFPPLMNTTIIYSVKTQQIHTRMLRLFSLKRY

SEQ ID NO: 2288 - protein, 52 aa, Artificial Sequence
  source: /note="Description of Artificial Sequence: Synthetic polypeptide"
  source: /note="p.R133C"
FVHALTAMESGVLLAMACDRAAAIGCCPLHYPVLVTKACVGYAALALALKAV

SEQ ID NO: 2289 - protein, 52 aa, Artificial Sequence
  source: /note="Description of Artificial Sequence: Synthetic polypeptide"
  source: /note="p.K89N"
QHLAFVDICYTSAITPKMLQSFTEENNNLMLFQGCVIQFLVYATFATSDCYL

SEQ ID NO: 2290 - protein, 52 aa, Artificial Sequence
  source: /note="Description of Artificial Sequence: Synthetic polypeptide"
  source: /note="p.M39I"
FVGFTDYLPLRVTLFLVFLLVYTLTIIVGNILLIILVNINSSLQIPMYYFLS

SEQ ID NO: 2291 - protein, 52 aa, Artificial Sequence
  source: /note="Description of Artificial Sequence: Synthetic polypeptide"
  source: /note="p.R312H"
KAFSTCASHLTAICLFFGTTLFMYLHHPRSSYSLTQDRTVAVIYTVVIPVLN

SEQ ID NO: 2292 - protein, 52 aa, Artificial Sequence
  source: /note="Description of Artificial Sequence: Synthetic polypeptide"
  source: /note="p.S289C"
HFMGTDKMASVFYAIVIPMLNPLVYCCLRNKEVKSAFKKTVGKAKASIGFIF

SEQ ID NO: 2293 - protein, 52 aa, Artificial Sequence
  source: /note="Description of Artificial Sequence: Synthetic polypeptide"
  source: /note="p.R163H"
VCACLAIGCYVIGFLNASIQIGDTFHHLSFCMSNVIHHFFCDKPAVITLTCS

SEQ ID NO: 2294 - protein, 52 aa, Artificial Sequence
  source: /note="Description of Artificial Sequence: Synthetic polypeptide"
  source: /note="p.M266I"
SHLIAIFLFYITVIIMYIRPSSSHSIIDTDKIASVFYTMIIPMLSPIVYTLR

SEQ ID NO: 2295 - protein, 52 aa, Artificial Sequence
  source: /note="Description of Artificial Sequence: Synthetic polypeptide"
  source: /note="p.R236C"
SSLIIILTSYMLIFTTIMKMRSASGCCQKTFSTCASHLTAITIFHGTILFLY

SEQ ID NO: 2296 - protein, 52 aa, Artificial Sequence
  source: /note="Description of Artificial Sequence: Synthetic polypeptide"
  source: /note="p.H246N"
VFIFVTVLKIRSVSGRHKAFSTWASNNLTSITIFHGTILFLYCVPNSKNSRQ

SEQ ID NO: 2297 - protein, 52 aa, Artificial Sequence
  source: /note="Description of Artificial Sequence: Synthetic polypeptide"
  source: /note="p.P264T"
VFSTCASHLTAITIFHGTILFLYCVTTNSKNSRHTVKVASVFYTVVIPLLNP

SEQ ID NO: 2298 - protein, 52 aa, Artificial Sequence
  source: /note="Description of Artificial Sequence: Synthetic polypeptide"
  source: /note="p.T271K"
LTAITIFHGTILFLYCVPNSKNSRHKKVKVASVFYTVVIPMLNPLIYSLRNK

SEQ ID NO: 2299 - protein, 52 aa, Artificial Sequence
  source: /note="Description of Artificial Sequence: Synthetic polypeptide"
  source: /note="p.G44V"
DTLELQIILFLFFLVIYTLTVLGNLVVMILLIRIDSQLHTPMYFFLANLSFV

SEQ ID NO: 2300 - protein, 52 aa, Artificial Sequence
  source: /note="Description of Artificial Sequence: Synthetic polypeptide"
  source: /note="p.A36S"
EFILLGLTDHAELKAVLFVVFLVIYSSITLLRNLGMILLIQITSKLHTPMYF

SEQ ID NO: 2301 - protein, 52 aa, Artificial Sequence
  source: /note="Description of Artificial Sequence: Synthetic polypeptide"
  source: /note="p.T275N"
VFHGTVLSIYCRPSSGNSGDADKVANNVFYTVVIPMLNSVIYSLRNKDVKEA

SEQ ID NO: 2302 - protein, 32 aa, Artificial Sequence
  source: /note="Description of Artificial Sequence: Synthetic polypeptide"
  source: /note="p.T89fs"
LSFVDVWFSSNVTPKMLENLLSDKKQLLMLVV

SEQ ID NO: 2303 - protein, 52 aa, Artificial Sequence
  source: /note="Description of Artificial Sequence: Synthetic polypeptide"
  source: /note="p.A100V"
PNMLVNFLVERNTVSYLGCAIQLGSVVAFFATVECVLLAAMAYDRFVAICSP

SEQ ID NO: 2304 - protein, 37 aa, Artificial Sequence
  source: /note="Description of Artificial Sequence: Synthetic polypeptide"
  source: /note="p.I154fs"
TTIMSNKVCNWLVISSWLAGFLIIFSPRDYGPPTGFL

SEQ ID NO: 2305 - protein, 52 aa, Artificial Sequence
  source: /note="Description of Artificial Sequence: Synthetic polypeptide"
  source: /note="p.G94W"
ISFTSVCIPRFLVTVVTGNRTISYNWWCVAQLFFFIFLGVTEFYLLAAMSYD

SEQ ID NO: 2306 - protein, 52 aa, Artificial Sequence
  source: /note="Description of Artificial Sequence: Synthetic polypeptide"
  source: /note="p.P79Q"
HLHTPMYTFISALSFLEIWYTTATIQQKMLSSLLSERSISFNGCLLQMYFFH

SEQ ID NO: 2307 - protein, 52 aa, Artificial Sequence
  source: /note="Description of Artificial Sequence: Synthetic polypeptide"
  source: /note="p.F311L"
YLRFSATYSVFWDTAIAVTFVILAPLLFNPIIYSLKNKDMKEAIGRLFHYQK

SEQ ID NO: 2308 - protein, 51 aa, Artificial Sequence
  source: /note="Description of Artificial Sequence: Synthetic polypeptide"
  source: /note="p.R293C"
LTLDRTLAIVYSVLTPMVNPIIYSLCCNKEIIKAIKRTIFQKGDKASLAHL

SEQ ID NO: 2309 - protein, 52 aa, Artificial Sequence
  source: /note="Description of Artificial Sequence: Synthetic polypeptide"
  source: /note="p.I248fs"
VLRIPSASSCQKAFSTCGSHLTLVFMATVVPSFCMSGLAKLTLCKSGRSWPW

SEQ ID NO: 2310 - protein, 36 aa, Artificial Sequence
  source: /note="Description of Artificial Sequence: Synthetic polypeptide"
  source: /note="p.F104fs"
PKMLLNILTQNKFITYAGCLSQIFFSLHLDAWTIYS

SEQ ID NO: 2311 - protein, 31 aa, Artificial Sequence
  source: /note="Description of Artificial Sequence: Synthetic polypeptide"
  source: /note="p.C179fs"
MGSLLETLTVLRLSFCTEMEIPHFFVIYLKS

SEQ ID NO: 2312 - protein, 69 aa, Artificial Sequence
  source: /note="Description of Artificial Sequence: Synthetic polypeptide"
  source: /note="p.L7fs"
MSYFPILFFFFPQKVSELHRATESHRCLRIPPPGTLRGSRTAAGPRWAVPVHVPGHGAGEPAHHPGCQL

SEQ ID NO: 2313 - protein, 32 aa, Artificial Sequence
  source: /note="Description of Artificial Sequence: Synthetic polypeptide"
  source: /note="p.R306M"
IIPMLNPLIYSLRNKDVKNALKKMTMMGRQSS

SEQ ID NO: 2314 - protein, 52 aa, Artificial Sequence
  source: /note="Description of Artificial Sequence: Synthetic polypeptide"
  source: /note="p.L166F"
CLALITGPYVIGFIDSFVNVVSMSRFFHFYDSNVIHHFFCDTSPILALSCTD

SEQ ID NO: 2315 - protein, 52 aa, Artificial Sequence
  source: /note="Description of Artificial Sequence: Synthetic polypeptide"
  source: /note="p.S160L"
VVSRRLCLLLVSLTYLYGFSTAIVVLLPCIFSVSYCSSNIINHFYCDIAPLL

SEQ ID NO: 2316 - protein, 52 aa, Artificial Sequence
  source: /note="Description of Artificial Sequence: Synthetic polypeptide"
  source: /note="p.K235N"
SLLIVLLSYLLILVAILRMNSAGRQNNAFSTCGAHLTVVIVFYGTLLFMYVQ

SEQ ID NO: 2317 - protein, 52 aa, Artificial Sequence
  source: /note="Description of Artificial Sequence: Synthetic polypeptide"
  source: /note="p.A99V"
SSVIVPKMLENLLSQRKTISVEGCLVVQVFFVFVTAGTEACLLSGMAYDRHA

SEQ ID NO: 2318 - protein, 48 aa, Artificial Sequence
  source: /note="Description of Artificial Sequence: Synthetic polypeptide"
  source: /note="p.R289W"
VEYNKIVSLLVSVLTPFLNPFIFTLWWNDKVKEALRDGMKRCCQLLKD

SEQ ID NO: 2319 - protein, 52 aa, Artificial Sequence
  source: /note="Description of Artificial Sequence: Synthetic polypeptide"
  source: /note="p.R169L"
VAVSYCGGFINSSIITKKTFSFNFCLLENIIDDFFCDLLPLVELACGEKGGY

SEQ ID NO: 2320 - protein, 52 aa, Artificial Sequence
  source: /note="Description of Artificial Sequence: Synthetic polypeptide"
  source: /note="p.Q721H"
FSELALTLNAWESGTAPTDSRLRPDHHRLMENGRWDEANAEKQRLEEKQRLS

SEQ ID NO: 2321 - protein, 103 aa, Artificial Sequence
  source: /note="Description of Artificial Sequence: Synthetic polypeptide"
  source: /note="p.H627fs"
ETFELDRLDDMGLRSLCEQVSHHPPLSCALRVLQAWLEPLAGDHHLQQVPGKIHLHHAARCHPLRIPGQWESLRVEEEHLNCSQHHRGQALDRPVRGHRDCEP

SEQ ID NO: 2322 - protein, 52 aa, Artificial Sequence
  source: /note="Description of Artificial Sequence: Synthetic polypeptide"
  source: /note="p.R577Q"
SEDNTSVADNISRQILNGELTGGAFQQNGRRACLPAPCPDTSNINLWNILRN

SEQ ID NO: 2323 - protein, 45 aa, Artificial Sequence
  source: /note="Description of Artificial Sequence: Synthetic polypeptide"
  source: /note="p.R115Q"
PLDRLSAGSVDHKGKQRKVVDHPKRQQFGIPMDRIGRNRLSNSRG

SEQ ID NO: 2324 - protein, 52 aa, Artificial Sequence
  source: /note="Description of Artificial Sequence: Synthetic polypeptide"
  source: /note="p.T388M"
DDISSGLKGYVKCDVAVVGKGDNIKMMPHKANETDEDDIEGNLLLPEGVPPE

SEQ ID NO: 2325 - protein, 52 aa, Artificial Sequence
  source: /note="Description of Artificial Sequence: Synthetic polypeptide"
  source: /note="p.E1304K"
KLETMVKLDATSEAVVKVDVAEEEKKKKKKKKKGTAEEPEEEEPDESMLDWW

SEQ ID NO: 2326 - protein, 52 aa, Artificial Sequence
  source: /note="Description of Artificial Sequence: Synthetic polypeptide"
  source: /note="p.V431I"
VAQNKKQFKSRETLYGQEIDQASLLIIILKLSAGDQVWLEVSKDWNGVYVSA

SEQ ID NO: 2327 - protein, 59 aa, Artificial Sequence
  source: /note="Description of Artificial Sequence: Synthetic polypeptide"
  source: /note="p.LLW104del"
AWAVHAAGVSKSDLLCFLTALMLLQMLWYVGRSSAHRRLFRLKDTHAGAGWLRGSITLF

SEQ ID NO: 2328 - protein, 52 aa, Artificial Sequence
  source: /note="Description of Artificial Sequence: Synthetic polypeptide"
  source: /note="p.R277I"
VQNLEAENYNIESAIIAVLRMNQGKIINNAEENLEPSGRVLKQCGPLWEEGG

SEQ ID NO: 2329 - protein, 52 aa, Artificial Sequence
  source: /note="Description of Artificial Sequence: Synthetic polypeptide"
  source: /note="p.T909I"
ALASIPPVAEGKAHPPTQILNREREIIVPVELEPKRTIQSLKEKTEKVKDPK

SEQ ID NO: 2330 - protein, 53 aa, Artificial Sequence
  source: /note="Description of Artificial Sequence: Synthetic polypeptide"
  source: /note="p.A153del"
VADEDNSEISDSEDDSCKSKTAAAADVNGFKPLSGNEQLKNNGNSTSLPLSRK

SEQ ID NO: 2331 - protein, 39 aa, Artificial Sequence
  source: /note="Description of Artificial Sequence: Synthetic polypeptide"
  source: /note="p.R44fs"
TSGMDLLHPSVGYPGPWASCPAATPGNSAGRGRRSLGRS

SEQ ID NO: 2332 - protein, 52 aa, Artificial Sequence
  source: /note="Description of Artificial Sequence: Synthetic polypeptide"
  source: /note="p.E122K"
GTIEYTVESRDSLNSIALKFDTTPNKKLVQLNKLFSRAVVTGQVLYVPDPEY

SEQ ID NO: 2333 - protein, 34 aa, Artificial Sequence
  source: /note="Description of Artificial Sequence: Synthetic polypeptide"
  source: /note="p.R20fs"
MARRFQEELAAFLFEYDTPAWCWCVIRRWALSSD

SEQ ID NO: 2334 - protein, 52 aa, Artificial Sequence
  source: /note="Description of Artificial Sequence: Synthetic polypeptide"
  source: /note="p.P142Q"
RLCPEYPTRRTLCSSDRGCKKGWMDQQQSKGIQTGRCVVYEGNQKTCEVSAW

SEQ ID NO: 2335 - protein, 52 aa, Artificial Sequence
  source: /note="Description of Artificial Sequence: Synthetic polypeptide"
  source: /note="p.Y408F"
MQRMASVRAVPNPVINPYQPAPPSGFFFMAAIPQTQNRAAYYPPSQIAQLRP

SEQ ID NO: 2336 - protein, 52 aa, Artificial Sequence
  source: /note="Description of Artificial Sequence: Synthetic polypeptide"
  source: /note="p.R94C"
LDTMNFDVIKGKPVRIMWSQRDPSLCCKSGVGNIFIKNLDKSIDNKALYDTF

SEQ ID NO: 2337 - protein, 32 aa, Artificial Sequence
  source: /note="Description of Artificial Sequence: Synthetic polypeptide"
  source: /note="p.E156fs"
DENGSKGYGFVHFETQEAAERAIEKNEWNAPK

SEQ ID NO: 2338 - protein, 52 aa, Artificial Sequence
  source: /note="Description of Artificial Sequence: Synthetic polypeptide"
  source: /note="p.A181T"
EKMNGMLLNDRKVFVGRFKSRKERETTELGARAKEFTNVYIKNFGEDMDDER

SEQ ID NO: 2339 - protein, 48 aa, Artificial Sequence
  source: /note="Description of Artificial Sequence: Synthetic polypeptide"
  source: /note="p.K254fs"
KSKGFGFVSFERHEDAQKAVDEMNGNGAQWKTNLCWSSSEKGGTADGT

SEQ ID NO: 2340 - protein, 43 aa, Artificial Sequence
  source: /note="Description of Artificial Sequence: Synthetic polypeptide"
  source: /note="p.K333fs"
LRKEFSPFGTITSAKVMMEGGRSKGLVLYVSPPQKKPLKQLQK

SEQ ID NO: 2341 - protein, 45 aa, Artificial Sequence
  source: /note="Description of Artificial Sequence: Synthetic polypeptide"
  source: /note="p.V325fs"
LDDGIDDERLRKAFSPFGTITSAKVGRWSQQRVWFCMFLLPRRSH

SEQ ID NO: 2342 - protein, 43 aa, Artificial Sequence
  source: /note="Description of Artificial Sequence: Synthetic polypeptide"
  source: /note="p.K333fs"
LRKAFSPFGTITSAKVMMEGGRSKGLVLYVSPPQKKPLKQLQK

SEQ ID NO: 2343 - protein, 52 aa, Artificial Sequence
  source: /note="Description of Artificial Sequence: Synthetic polypeptide"
  source: /note="p.E359K"
AVESTSQAGDRGSVSSYDRGQPYATKKWSDDESGNPFGGSETNGGANPFEDD

SEQ ID NO: 2344 - protein, 52 aa, Artificial Sequence
  source: /note="Description of Artificial Sequence: Synthetic polypeptide"
  source: /note="p.Q331H"
ADLNRTLSRREKKKATDGVTLTGINHHTGDQSLPSKPSSTLNVPSNPAQSAQ

SEQ ID NO: 2345 - protein, 52 aa, Artificial Sequence
  source: /note="Description of Artificial Sequence: Synthetic polypeptide"
  source: /note="p.T114P"
SSDKVTVNYYDEEGSIPIDQAGLFLPPAIEISLDVDADRDGVVEKNNPKKAS

SEQ ID NO: 2346 - protein, 53 aa, Artificial Sequence
  source: /note="Description of Artificial Sequence: Synthetic polypeptide"
  source: /note="p.K302fs"
VECISWAPESSYSSISEATGSETKKVVNLGHSCCLDPETRLLRCGMSVLACAL

SEQ ID NO: 2347 - protein, 32 aa, Artificial Sequence
  source: /note="Description of Artificial Sequence: Synthetic polypeptide"
  source: /note="p.N280fs"
DSGSSQHLEHIPPKGSSELTTHDLKTLDLLHL

SEQ ID NO: 2348 - protein, 52 aa, Artificial Sequence
  source: /note="Description of Artificial Sequence: Synthetic polypeptide"
  source: /note="p.A996T"
DSAHKMLVRENGVHSLIIEPVTSRDTTGIYTCIATNRAGQNSFSLELVVAAK

SEQ ID NO: 2349 - protein, 58 aa, Artificial Sequence
  source: /note="Description of Artificial Sequence: Synthetic polypeptide"
  source: /note="p.1075_1076insEA"
KAVSKTSRDGAEQQGPEATVEEAEAEAEAAAFGSEKPQSMFEPPQVSSPVQEKRDVLP

SEQ ID NO: 2350 - protein, 37 aa, Artificial Sequence
  source: /note="Description of Artificial Sequence: Synthetic polypeptide"
  source: /note="p.G1118fs"
VQEKRDVLPKILPAEDRALRERGPPPATASCAAQWPD

SEQ ID NO: 2351 - protein, 52 aa, Artificial Sequence
  source: /note="Description of Artificial Sequence: Synthetic polypeptide"
  source: /note="p.A299T"
KLEMVHKSRKDHSSGNPGQQAQAPSTTAGPEANLDQPVTMIFMGYQNIEDEE

SEQ ID NO: 2352 - protein, 32 aa, Artificial Sequence
  source: /note="Description of Artificial Sequence: Synthetic polypeptide"
  source: /note="p.G101fs"
CDSCLIHPGCTIFENCKSCRNGSWGVPWMTSM

SEQ ID NO: 2353 - protein, 47 aa, Artificial Sequence
  source: /note="Description of Artificial Sequence: Synthetic polypeptide"
  source: /note="p.K400fs"
DSVGFNGKPECYYFENPTNPELCQKSRTALITHTLCCWLTWAQVSAF

SEQ ID NO: 2354 - protein, 55 aa, Artificial Sequence
  source: /note="Description of Artificial Sequence: Synthetic polypeptide"
  source: /note="p.T417fs"
VSILAVYSKDNYKRVTGTSLGGGTFLVSAVFLLAVPLLKKLLKWHLVEIAPKWIN

SEQ ID NO: 2355 - protein, 52 aa, Artificial Sequence
  source: /note="Description of Artificial Sequence: Synthetic polypeptide"
  source: /note="p.G126A"
AAEEARRNPTLGGLLGRQRLLLRMGAAGRLGAPMERHGRASATSVSSAGEQA

SEQ ID NO: 2356 - protein, 52 aa, Artificial Sequence
  source: /note="Description of Artificial Sequence: Synthetic polypeptide"
  source: /note="p.R260I"
LEMASKGDSTQADKLVRDIYGGDYEIIFGLPGWAVASSFGNMIYKEKRESVS

SEQ ID NO: 2357 - protein, 52 aa, Artificial Sequence
  source: /note="Description of Artificial Sequence: Synthetic polypeptide"
  source: /note="p.H107Y"
QLAAEYGLLGEKELSQENQLVETGGYYVGLPSVSYASSGASVSLQLVAEMAT

SEQ ID NO: 2358 - protein, 31 aa, Artificial Sequence
  source: /note="Description of Artificial Sequence: Synthetic polypeptide"
  source: /note="p.C225fs"
SLNGFGTRSSDGDLCLVVKEEPCFFSGKSED

SEQ ID NO: 2359 - protein, 52 aa, Artificial Sequence
  source: /note="Description of Artificial Sequence: Synthetic polypeptide"
  source: /note="p.P917T"
QYVHTASSRRVCDSSGYWTPEEAVGTTPDVDQPCEPSLQAWSPEVHLYHMNM

SEQ ID NO: 2360 - protein, 28 aa, Artificial Sequence
  source: /note="Description of Artificial Sequence: Synthetic peptide"
  source: /note="p.I1683fs"
NSVEYKCEQGYGIGAVCSPLCVIPPVTP

SEQ ID NO: 2361 - protein, 52 aa, Artificial Sequence
  source: /note="Description of Artificial Sequence: Synthetic polypeptide"
  source: /note="p.P1706H"
CVIPPSDPVMLPENITADTLEHWMEHHVKVQSIVCTGRRQWHPDPVLVHCIQ

SEQ ID NO: 2362 - protein, 37 aa, Artificial Sequence
  source: /note="Description of Artificial Sequence: Synthetic polypeptide"
  source: /note="p.G84fs"
TDAHGDLLPLTNDDSLHRALASGPPATAPTGAEAGRS

SEQ ID NO: 2363 - protein, 52 aa, Artificial Sequence
  source: /note="Description of Artificial Sequence: Synthetic polypeptide"
  source: /note="p.A584T"
KYNVAYSKKWDFTALIDFWDKVLEETTEAQHLYQSILPDMVKIALCLPNICT

SEQ ID NO: 2364 - protein, 31 aa, Artificial Sequence
  source: /note="Description of Artificial Sequence: Synthetic polypeptide"
  source: /note="p.K461fs"
PSLKTVKVVIFQPELLNIFYDSMKKETSLHH

SEQ ID NO: 2365 - protein, 49 aa, Artificial Sequence
  source: /note="Description of Artificial Sequence: Synthetic polypeptide"
  source: /note="p.K847fs"
SSLDSSGFSLHIGLSAAYLPRMWVENIQKKKARLACLSFNPISMSTSLT

SEQ ID NO: 2366 - protein, 53 aa, Artificial Sequence
  source: /note="Description of Artificial Sequence: Synthetic polypeptide"
  source: /note="p.A236del"
SSQGQRGHTSMKAVYVEPAAAAAAAISDDQIDIAEVEQYGPQENVHMFVDSDS

SEQ ID NO: 2367 - protein, 52 aa, Artificial Sequence
  source: /note="Description of Artificial Sequence: Synthetic polypeptide"
  source: /note="p.T62I"
PSRSFSSAHRHLSRRNGLSRLCQSRIIALSEDRWSSYCLSSLAAQNICTSKL

SEQ ID NO: 2368 - protein, 35 aa, Artificial Sequence
  source: /note="Description of Artificial Sequence: Synthetic polypeptide"
  source: /note="p.P395fs"
YSHPQYTAYNEAWRFSNPALLMPPPVRPCRCCRCL

SEQ ID NO: 2369 - protein, 52 aa, Artificial Sequence
  source: /note="Description of Artificial Sequence: Synthetic polypeptide"
  source: /note="p.T424M"
HGGVPHQPQTDYALSPLTGGLEPTTMMVSASCSQRLDHMKSLDSLPTSQSYC

SEQ ID NO: 2370 - protein, 52 aa, Artificial Sequence
  source: /note="Description of Artificial Sequence: Synthetic polypeptide"
  source: /note="p.S197L"
LERKEAEESEKKAKHSIDGILSERALLAPQSDEGSDIDSEPDLPLKRKQRRS

SEQ ID NO: 2371 - protein, 31 aa, Artificial Sequence
  source: /note="Description of Artificial Sequence: Synthetic polypeptide"
  source: /note="p.P375fs"
QTSSYSCMLPTSPSVNGRSYDTYTPHICRHT

SEQ ID NO: 2372 - protein, 52 aa, Artificial Sequence
  source: /note="Description of Artificial Sequence: Synthetic polypeptide"
  source: /note="p.P55Q"
LDEDMHQKIAREMNLSETAFIRKLHQQTDNFAQSSCFGLRWFTPASEVPLCG

SEQ ID NO: 2373 - protein, 52 aa, Artificial Sequence
  source: /note="Description of Artificial Sequence: Synthetic polypeptide"
  source: /note="p.E70K"
PGGRGKQDIGDILQQIMTITDQSLDKKAQAKKHALNCHRMKPALFSVLCEIK

SEQ ID NO: 2374 - protein, 52 aa, Artificial Sequence
  source: /note="Description of Artificial Sequence: Synthetic polypeptide"
  source: /note="p.Y262F"
LRSRFLDARRKRRNFSKQATEVLNEFFFYSHLSNPYPSEEAKEELAKKCGIT

SEQ ID NO: 2375 - protein, 27 aa, Artificial Sequence
  source: /note="Description of Artificial Sequence: Synthetic peptide"
  source: /note="p.H729del"
KKDKHSQSPRAAGPREGHSHSHHHHRG

SEQ ID NO: 2376 - protein, 52 aa, Artificial Sequence
  source: /note="Description of Artificial Sequence: Synthetic polypeptide"
  source: /note="p.L102Q"
DKLEEDINSSMTNSTAASRPPVTLRQQVVPATQCGSLIGKGGCKIKEIREST

SEQ ID NO: 2377 - protein, 52 aa, Artificial Sequence
  source: /note="Description of Artificial Sequence: Synthetic polypeptide"
  source: /note="p.R230H"
AVRIAREIGYPVMIKASAGGGGKGMHHIAWDDEETRDGFRLSSQEAASSFGD

SEQ ID NO: 2378 - protein, 52 aa, Artificial Sequence
  source: /note="Description of Artificial Sequence: Synthetic polypeptide"
  source: /note="p.V477M"
QVSDVNDNAPRFSQPVYDVYVTENNMMPGAYIYAVSATDRDEGANAQLAYSI

SEQ ID NO: 2379 - protein, 52 aa, Artificial Sequence
  source: /note="Description of Artificial Sequence: Synthetic polypeptide"
  source: /note="p.R587S"
ILIVDQNDNAPAIVAPLPGRNGTPASSEVLPRSAEPGYLLTRVAAVDADDGE

SEQ ID NO: 2380 - protein, 52 aa, Artificial Sequence
  source: /note="Description of Artificial Sequence: Synthetic polypeptide"
  source: /note="p.V986L"
SDGRQAADYRSNLHVPGMDSVPDTELLFETPEAQPGAERSFSTFGKEKALHS

SEQ ID NO: 2381 - protein, 37 aa, Artificial Sequence
  source: /note="Description of Artificial Sequence: Synthetic polypeptide"
  source: /note="p.N118fs"
EVFLENPLELFQVEIEVLDINDNPPLFPGARPDGGNL

SEQ ID NO: 2382 - protein, 43 aa, Artificial Sequence
  source: /note="Description of Artificial Sequence: Synthetic polypeptide"
  source: /note="p.P225fs"
TAVDGGGGGGVGEGGGGGGGAGLPPPAAAHRHGPTHHPSAGLQ

SEQ ID NO: 2383 - protein, 52 aa, Artificial Sequence
  source: /note="Description of Artificial Sequence: Synthetic polypeptide"
  source: /note="p.T486M"
DNAPVFTQSFVTVSIPENNSPGIQLMMKVSAMDADSGPNAKINYLLGPDAPP

SEQ ID NO: 2384 - protein, 52 aa, Artificial Sequence
  source: /note="Description of Artificial Sequence: Synthetic polypeptide"
  source: /note="p.R1010I"
SSDPYSVSDCGYPVTTFEVPVSVHTIIPPMKEVVRSCTPMKESTTMEIWIHP

SEQ ID NO: 2385 - protein, 52 aa, Artificial Sequence
  source: /note="Description of Artificial Sequence: Synthetic polypeptide"
  source: /note="p.R1552I"
DDLSAHNPLYKENISQVSTNSDISQIITDFVDPFSPKIQAKSKSLRGPREKI

SEQ ID NO: 2386 - protein, 52 aa, Artificial Sequence
  source: /note="Description of Artificial Sequence: Synthetic polypeptide"
  source: /note="p.C1713F"
VELKSEPNVISSPAECSLELSPSRPFFVLHSSLSRRETPICMLPIETERNIF

SEQ ID NO: 2387 - protein, 52 aa, Artificial Sequence
  source: /note="Description of Artificial Sequence: Synthetic polypeptide"
  source: /note="p.E530K"
YVSINPNSGDIYALRSFNHEQTKAFKKFKVLAKDGGLPSLQSNATVRVIILD

SEQ ID NO: 2388 - protein, 52 aa, Artificial Sequence
  source: /note="Description of Artificial Sequence: Synthetic polypeptide"
  source: /note="p.R286C"
NASDPDEGTNGQVVYSFYGYVNDRTCCELFQIDPHSGLVTVTGALDYEEGHV

SEQ ID NO: 2389 - protein, 52 aa, Artificial Sequence
  source: /note="Description of Artificial Sequence: Synthetic polypeptide"
  source: /note="p.A519T"
LVERRVGERALSNYVSVHAESGKVYTTLQPLDHEELELLQFQVSARDAGVPP

SEQ ID NO: 2390 - protein, 52 aa, Artificial Sequence
  source: /note="Description of Artificial Sequence: Synthetic polypeptide"
  source: /note="p.A736V"
ALSTVSFIFLLTIIILSIIKCYRYTVVYGTACCGGFCGVRERSPAELYKQAN

SEQ ID NO: 2391 - protein, 52 aa, Artificial Sequence
  source: /note="Description of Artificial Sequence: Synthetic polypeptide"
  source: /note="p.A742V"
TALRCSAAPTEGACGPVKPTLVCSSVVVGSWSYSQQRRQRVCSGEGLPKADL

SEQ ID NO: 2392 - protein, 52 aa, Artificial Sequence
  source: /note="Description of Artificial Sequence: Synthetic polypeptide"
  source: /note="p.K138N"
PLQVFHVDVEVKDINDNPPVFPATQNNNLFIAESRPLDSRFPLEGASDADIG

SEQ ID NO: 2393 - protein, 52 aa, Artificial Sequence
  source: /note="Description of Artificial Sequence: Synthetic polypeptide"
  source: /note="p.A156V"
RFSRQEQRLFILESRMPDSRFPLEGVVSDLDIGANAQLRYRLNPNEYFDLDV

SEQ ID NO: 2394 - protein, 52 aa, Artificial Sequence
  source: /note="Description of Artificial Sequence: Synthetic polypeptide"
  source: /note="p.E190K"
NALLSYKLSSSEFFFLDIQANDELSKKSLSLVLGKSLDREETAEVNLLLVAT

SEQ ID NO: 2395 - protein, 52 aa, Artificial Sequence
  source: /note="Description of Artificial Sequence: Synthetic polypeptide"
  source: /note="p.A266T"
AFERTIYKVRLLENAPNGTLVVTVNTTTDLDEGVNKDIAYSFNTDMSADILS

SEQ ID NO: 2396 - protein, 52 aa, Artificial Sequence
  source: /note="Description of Artificial Sequence: Synthetic polypeptide"
  source: /note="p.E271K"
SYKVVLSENVQNDTRVIQLNASDPDKKGLNGEISYGIKMILPVSEKCMFSIN

SEQ ID NO: 2397 - protein, 52 aa, Artificial Sequence
  source: /note="Description of Artificial Sequence: Synthetic polypeptide"
  source: /note="p.N568K"
SSQVTVRVVVLDDNDNRPMILYPLQKKGTLPCNDLVPRSAEAGYLVTKVVAV

SEQ ID NO: 2398 - protein, 52 aa, Artificial Sequence
  source: /note="Description of Artificial Sequence: Synthetic polypeptide"
  source: /note="p.R289C"
VSAWDLDSGTNSELSYTFSHASEDICCKTFEINQKSGDITLTAPLDFEAIES

SEQ ID NO: 2399 - protein, 52 aa, Artificial Sequence
  source: /note="Description of Artificial Sequence: Synthetic polypeptide"
  source: /note="p.P221L"
VLDKALDREEEAELRLTLTALDGGSLLPRSGTAQVYIEVLDVNDNAPEFEQP

SEQ ID NO: 2400 - protein, 53 aa, Artificial Sequence
  source: /note="Description of Artificial Sequence: Synthetic polypeptide"
  source: /note="p.P255F"
LIMDINDNAPEFVHTPYGVQVLENSFFLDSPIVRVLARDIDAGNFGSVSYGLF

SEQ ID NO: 2401 - protein, 52 aa, Artificial Sequence
  source: /note="Description of Artificial Sequence: Synthetic polypeptide"
  source: /note="p.D51Y"
AGSEAVRYSIPEETESGYSVANLAKYYLGLGVGELATRGARMHYKGNKELLQ

SEQ ID NO: 2402 - protein, 52 aa, Artificial Sequence
  source: /note="Description of Artificial Sequence: Synthetic polypeptide"
  source: /note="p.P649S"
RTARLLSERDAAKHRLVVLVKDNGESSPRSATATLHVLLVDGFSQPYLPLPE

SEQ ID NO: 2403 - protein, 52 aa, Artificial Sequence
  source: /note="Description of Artificial Sequence: Synthetic polypeptide"
  source: /note="p.D235N"
RLTLTALDGGSPPRSGTAQVYIEVVNNVNDNAPEFEQPFYRVQISEDSPISF

SEQ ID NO: 2404 - protein, 52 aa, Artificial Sequence
  source: /note="Description of Artificial Sequence: Synthetic polypeptide"
  source: /note="p.G599V"
GVELAPRSAERGYLVTKVVAVDRDSVVQNAWLSYRLLKASEPGLFSVGLHTG

SEQ ID NO: 2405 - protein, 52 aa, Artificial Sequence
  source: /note="Description of Artificial Sequence: Synthetic polypeptide"
  source: /note="p.V662M"
ALKQSLVVAVQDHGQPPLSATVTLTMMAVADSIPEVLADLGSLEPSDGPYNY

SEQ ID NO: 2406 - protein, 52 aa, Artificial Sequence
  source: /note="Description of Artificial Sequence: Synthetic polypeptide"
  source: /note="p.D664N"
RLLVAVRDGGQPPLSATATLHLVFANNSLQEVLPDITDRPDPSDLQAELQFY

SEQ ID NO: 2407 - protein, 52 aa, Artificial Sequence
  source: /note="Description of Artificial Sequence: Synthetic polypeptide"
  source: /note="p.P684H"
TVTVAVADRIPDILADLGSIKTPIDHHEDLDLTLYLVVAVAAVSCVFLAFVI

SEQ ID NO: 2408 - protein, 52 aa, Artificial Sequence
  source: /note="Description of Artificial Sequence: Synthetic polypeptide"
  source: /note="p.A70T"
SVVGNLAKDLGLSVLDVSARKLRVSTTEKLHFSVDAESGDLLVKNRIDREQI

SEQ ID NO: 2409 - protein, 38 aa, Artificial Sequence
  source: /note="Description of Artificial Sequence: Synthetic polypeptide"
  source: /note="p.K12N"
MAALQKLPHCRNNLVLLCFLLATLWEARAGQIRYSVRE

SEQ ID NO: 2410 - protein, 52 aa, Artificial Sequence
  source: /note="Description of Artificial Sequence: Synthetic polypeptide"
  source: /note="p.S289L"
LTATDPDEGINGKLTYSFRNEEEKILLETFQLDSNLGEISTLQSLDYEESRF

SEQ ID NO: 2411 - protein, 52 aa, Artificial Sequence
  source: /note="Description of Artificial Sequence: Synthetic polypeptide"
  source: /note="p.R293C"
DPDEGANGEVTYSFHNVDHRVAQIFCCLDSYTGEISNKEPLDFEEYKMYSME

SEQ ID NO: 2412 - protein, 50 aa, Artificial Sequence
  source: /note="Description of Artificial Sequence: Synthetic polypeptide"
  source: /note="p.H63fs"
SCLVKYLEENNTCPTCRIVIHQSHPCSTSVMTEPCKILFTNWYQASKKRK

SEQ ID NO: 2413 - protein, 52 aa, Artificial Sequence
  source: /note="Description of Artificial Sequence: Synthetic polypeptide"
  source: /note="p.P3946T"
PYQTQPTFQAVATMSFTPQVQPTPTTTQPSYQLPSQMMVIQQKPRQTTLYLE

SEQ ID NO: 2414 - protein, 52 aa, Artificial Sequence
  source: /note="Description of Artificial Sequence: Synthetic polypeptide"
  source: /note="p.R4133C"
VKAEEDPMEDPYELKLLKHQIKQEFCCRGTESLDHLAGLSHYYHADTSYRHF

SEQ ID NO: 2415 - protein, 52 aa, Artificial Sequence
  source: /note="Description of Artificial Sequence: Synthetic polypeptide"
  source: /note="p.R271M"
LARIYIRRTLRNFINDEMQAKGIPQMMAPPKRKRKRVKQRINTYVFVGNQLI

SEQ ID NO: 2416 - protein, 52 aa, Artificial Sequence
  source: /note="Description of Artificial Sequence: Synthetic polypeptide"
  source: /note="p.V281A"
RNFINDEMQAKGIPQRAPPKRKRKRAAKQRINTYVFVGNQLIPQPLDSEEDE

SEQ ID NO: 2417 - protein, 52 aa, Artificial Sequence
  source: /note="Description of Artificial Sequence: Synthetic polypeptide"
  source: /note="p.R135Q"
GEHITNHRNPSNNRQIHNGKKEEASQQNLSTPPLRCSSRGQSITSHHSSGPL

SEQ ID NO: 2418 - protein, 52 aa, Artificial Sequence
  source: /note="Description of Artificial Sequence: Synthetic polypeptide"
  source: /note="p.A348V"
ITTITRDGSLHATVSIINIYKEGNLVVIQQAGKNMSARLTVVCKQCPLLRRG

SEQ ID NO: 2419 - protein, 52 aa, Artificial Sequence
  source: /note="Description of Artificial Sequence: Synthetic polypeptide"
  source: /note="p.R87H"
KITVPEGKVVVLNFRFIDLESDNLCHHYDFVDVYNGHANGQRIGRFCGTFRP

SEQ ID NO: 2420 - protein, 31 aa, Artificial Sequence
  source: /note="Description of Artificial Sequence: Synthetic polypeptide"
  source: /note="p.K64R"
DLTAPETEKAALAIQGKFRRFQKRKRRDPSS

SEQ ID NO: 2421 - protein, 52 aa, Artificial Sequence
  source: /note="Description of Artificial Sequence: Synthetic polypeptide"
  source: /note="p.S417L"
MMTLEDHYHSDVAYHNSLHAADVAQLLTHVLLSTPALDAVFTDLEILAAIFA

SEQ ID NO: 2422 - protein, 52 aa, Artificial Sequence
  source: /note="Description of Artificial Sequence: Synthetic polypeptide"
  source: /note="p.E229K"
NVYALKATSELDLEMEALKTVYKSGKKTIVVTCAVFNNEVVDLQWTYPGEVK

SEQ ID NO: 2423 - protein, 52 aa, Artificial Sequence
  source: /note="Description of Artificial Sequence: Synthetic polypeptide"
  source: /note="p.S650L"
SQATMKVAVKMLKSTARSSEKQALMLLELKIMSHLGPHLNVVNLLGACTKGG

SEQ ID NO: 2424 - protein, 52 aa, Artificial Sequence
  source: /note="Description of Artificial Sequence: Synthetic polypeptide"
  source: /note="p.N56K"
PCSPTSPAHSLSRKSPIMYPSTTMAKKAPGLVSCTFFLAVNGLYSSSDDVIE

SEQ ID NO: 2425 - protein, 52 aa, Artificial Sequence
  source: /note="Description of Artificial Sequence: Synthetic polypeptide"
  source: /note="p.E500K"
LYKGEHTLKGFSDFLESHIKTKIEDKKDELLSVEQNEVIEEEVLAEEKEVPM

SEQ ID NO: 2426 - protein, 52 aa, Artificial Sequence
  source: /note="Description of Artificial Sequence: Synthetic polypeptide"
  source: /note="p.G793W"
TMFILDDHDSDLDLWPWWGEPIYRNWWQYVGKTTSSAYSYSLERHVCLGFVH

SEQ ID NO: 2427 - protein, 52 aa, Artificial Sequence
  source: /note="Description of Artificial Sequence: Synthetic polypeptide"
  source: /note="p.L1309F"
KNDDLNKPINKGRKRAAVGQESPGGFFEAGNAKAPKLQDLAKKAAPAERQID

SEQ ID NO: 2428 - protein, 52 aa, Artificial Sequence
  source: /note="Description of Artificial Sequence: Synthetic polypeptide"
  source: /note="p.G191W"
EDPKEQVKRYGGFLRKYPKRSSEVAWWEGDGDSMGHEDLYKRYGGFLRRIRP

SEQ ID NO: 2429 - protein, 52 aa, Artificial Sequence
  source: /note="Description of Artificial Sequence: Synthetic polypeptide"
  source: /note="p.R565S"
RKHSLPQLLDSSSASQEYHIVKKSTSSSLSTTQVESPWRLIRPSVISIIGLY

SEQ ID NO: 2430 - protein, 62 aa, Artificial Sequence
  source: /note="Description of Artificial Sequence: Synthetic polypeptide"
  source: /note="p.R101fs"
DTETVGLSFGNIPVFGDYGEKRRGGQEEENPPGSCAGCGLHLGDRAEEEQPSREEWEGPTAG

SEQ ID NO: 2431 - protein, 97 aa, Artificial Sequence
  source: /note="Description of Artificial Sequence: Synthetic polypeptide"
  source: /note="p.G197fs"
AKWKNPDGHMDGLTTNGVLVMHPRGASPRSPSPGSGARSLSVEMCTPCEKPGRPSNEESWWKVRPTSCRTAPSLTCVGPLSSGEQQMGFFILQLRST

SEQ ID NO: 2432 - protein, 41 aa, Artificial Sequence
  source: /note="Description of Artificial Sequence: Synthetic polypeptide"
  source: /note="p.I370fs"
QSKTKQNVLSPEKEKQMSEPLDQKKLGQIIMKKMRRPVCYK

SEQ ID NO: 2433 - protein, 52 aa, Artificial Sequence
  source: /note="Description of Artificial Sequence: Synthetic polypeptide"
  source: /note="p.R118S"
TSGGDAQGMNAAVRAVVRVGIFTGASSVFFVHEGYQGLVDGGDHIKEATWES

SEQ ID NO: 2434 - protein, 51 aa, Artificial Sequence
  source: /note="Description of Artificial Sequence: Synthetic polypeptide"
  source: /note="p.M593fs"
SGTKRRVFIIETMGGYCGYLANMGGSRPELMPHTFSKSPSTSGICSPTWST

SEQ ID NO: 2435 - protein, 41 aa, Artificial Sequence
  source: /note="Description of Artificial Sequence: Synthetic polypeptide"
  source: /note="p.R240H"
PIVYELDKNLKPIKPMQFLGDEETVHHKAMEAVAAQGKAKK

SEQ ID NO: 2436 - protein, 52 aa, Artificial Sequence
  source: /note="Description of Artificial Sequence: Synthetic polypeptide"
  source: /note="p.F565C"
QAPSSTEISLKLHIAQPENNTHVALCCKMYTSSDCRYEVTVKTSFSQILGQV

SEQ ID NO: 2437 - protein, 32 aa, Artificial Sequence
  source: /note="Description of Artificial Sequence: Synthetic polypeptide"
  source: /note="p.G426fs"
VWLSIIAARKQSVEEIVRDHWAKFGPPLLLQV

SEQ ID NO: 2438 - protein, 52 aa, Artificial Sequence
  source: /note="Description of Artificial Sequence: Synthetic polypeptide"
  source: /note="p.I98V"
RTAIEIVVQMAAANGIGRLIIGQNGVVLSTPAVSCIIRKIKAAGGIILTASH

SEQ ID NO: 2439 - protein, 65 aa, Artificial Sequence
  source: /note="Description of Artificial Sequence: Synthetic polypeptide"
  source: /note="p.R164fs"
KGCAALIHVPPLSRGLPASLLGRALKSHHPGNAGRGGKAQAQSPVRRKLNHGPSSQRELTGGLLL

SEQ ID NO: 2440 - protein, 102 aa, Artificial Sequence
  source: /note="Description of Artificial Sequence: Synthetic polypeptide"
  source: /note="p.V251fs"
LPCLPVKLSPPLPPKKVMICMPVGGARPLTGVLHSPEEWPAGCGPAPPHCPALPDPAPAAVRQPRPAPPLHHRLPPHAPLGLQNDRRAQQNAGHDHAEAGKL

SEQ ID NO: 2441 - protein, 83 aa, Artificial Sequence
  source: /note="Description of Artificial Sequence: Synthetic polypeptide"
  source: /note="p.V251fs"
LPCLPVKLSPPLPPKKVMICMPVGGQTSHWCPTQPRRVASRVWPSTTTLSCPPRSSTSCSTAATASTSPPPPAPSPCTPRAAE

SEQ ID NO: 2442 - protein, 29 aa, Artificial Sequence
  source: /note="Description of Artificial Sequence: Synthetic peptide"
  source: /note="p.S237fs"
APVPPPKPASRNTTREAAGSSHSKKNNWL

SEQ ID NO: 2443 - protein, 57 aa, Artificial Sequence
  source: /note="Description of Artificial Sequence: Synthetic polypeptide"
  source: /note="p.S354fs"
DEREKSTCSMGSELLPMISPRSPSPHCLLIYLQSLHAPLHSLLRLFKLCQKLSFHHP

SEQ ID NO: 2444 - protein, 53 aa, Artificial Sequence
  source: /note="Description of Artificial Sequence: Synthetic polypeptide"
  source: /note="p.T35del"
STAMDTEPNPGTSSVSTTTSSTTTTITTSSSRMQQPQISVYSGSDRHAVQVIQ

SEQ ID NO: 2445 - protein, 53 aa, Artificial Sequence
  source: /note="Description of Artificial Sequence: Synthetic polypeptide"
  source: /note="p.G173L"
LGILGLGRIGREVATRMQSFGMKTILLYDPIISPEVSASFGVQQLPLEEIWPL

SEQ ID NO: 2446 - protein, 52 aa, Artificial Sequence
  source: /note="Description of Artificial Sequence: Synthetic polypeptide"
  source: /note="p.I1681M"
KKRGRKPKKLQYAKPEDLEQNNVHPMMRDEVLPSSTCNFLSETNNVKEDLLQ

SEQ ID NO: 2447 - protein, 53 aa, Artificial Sequence
  source: /note="Description of Artificial Sequence: Synthetic polypeptide"
  source: /note="p.S32del"
PWPANQPLPGGLLPRPLSLAPSSSSCCSPPCSQDGRMAAQGAPRFLLTFDFDE

SEQ ID NO: 2448 - protein, 48 aa, Artificial Sequence
  source: /note="Description of Artificial Sequence: Synthetic polypeptide"
  source: /note="p.V22F"
MIAISAVSSALLFSLLCEASTFFVLLNSTDSSPPTNNFTDIEAALKAQ

SEQ ID NO: 2449 - protein, 52 aa, Artificial Sequence
  source: /note="Description of Artificial Sequence: Synthetic polypeptide"
  source: /note="p.S519L"
SETQSSPTKGVLMYQPSSVRVPSVTLLVDPAAIPPSLTDYSVPFHHTPISSM

SEQ ID NO: 2450 - protein, 52 aa, Artificial Sequence
  source: /note="Description of Artificial Sequence: Synthetic polypeptide"
  source: /note="p.D460N"
GGDPSENKKKVEVIDLTIESSSDEENNLPPTKKHCSVTSAAIPALPGSKGVL

SEQ ID NO: 2451 - protein, 36 aa, Artificial Sequence
  source: /note="Description of Artificial Sequence: Synthetic polypeptide"
  source: /note="p.H116fs"
LAPIPPTLLAPGTLLGPKREVDMHPLCPSLCTLMSP

SEQ ID NO: 2452 - protein, 52 aa, Artificial Sequence
  source: /note="Description of Artificial Sequence: Synthetic polypeptide"
  source: /note="p.R225L"
NDKSLRQFRYTFQACLYELLKRLCNLLAVLLFVAVAGLTFFALSFGFYYEYG

SEQ ID NO: 2453 - protein, 49 aa, Artificial Sequence
  source: /note="Description of Artificial Sequence: Synthetic polypeptide"
  source: /note="p.P787fs"
VTVLVKAGAGAPRTRTVLTPFSGPPLLKLTWIMWSLKSTDTCRRSSGAG

SEQ ID NO: 2454 - protein, 52 aa, Artificial Sequence
  source: /note="Description of Artificial Sequence: Synthetic polypeptide"
  source: /note="p.V183G"
NAQKRKSLYKQIGLYPVLVIDSSGYGGNPNYTGRIRLDIQGTGQLLFSVVIN

SEQ ID NO: 2455 - protein, 35 aa, Artificial Sequence
  source: /note="Description of Artificial Sequence: Synthetic polypeptide"
  source: /note="p.A346fs"
TAMINNSRNLNIQLKWKRPPENEAPQCPSCMPSGT

SEQ ID NO: 2456 - protein, 52 aa, Artificial Sequence
  source: /note="Description of Artificial Sequence: Synthetic polypeptide"
  source: /note="p.F1473L"
EELNGYIWHLIHAPPEVAECDLVYTLLFHPLPRDEKAMGTSPAPKSSDGTWA

SEQ ID NO: 2457 - protein, 116 aa, Artificial Sequence
  source: /note="Description of Artificial Sequence: Synthetic polypeptide"
  source: /note="p.R287fs"
PLDFSKDTSGKPVARSKTMPPQVPPAPMPPAMATERMRRLARTAGFLQPRWAPGPTLLPMAMSCLRSQKREMRRLLHFATCWISFDLALTSKTTSSLAMSGVLSPLAQSTSGMRST

SEQ ID NO: 2458 - protein, 52 aa, Artificial Sequence
  source: /note="Description of Artificial Sequence: Synthetic polypeptide"
  source: /note="p.N345K"
GETSTKSLWVINSALRIKILCATYVKKVNIRDIDKIYVRTGIYHGGEPLCDN

SEQ ID NO: 2459 - protein, 52 aa, Artificial Sequence
  source: /note="Description of Artificial Sequence: Synthetic polypeptide"
  source: /note="p.D350G"
KSLWVINSALRIKILCATYVNVNIRGGIDKIYVRTGIYHGGEPLCDNVNTQR

SEQ ID NO: 2460 - protein, 52 aa, Artificial Sequence
  source: /note="Description of Artificial Sequence: Synthetic polypeptide"
  source: /note="p.R38H"
IHLMPPRILVECLLPNGMIVTLECLHHEATLITIKHELFKEARKYPLHQLLQ

SEQ ID NO: 2461 - protein, 52 aa, Artificial Sequence
  source: /note="Description of Artificial Sequence: Synthetic polypeptide"
  source: /note="p.E39K"
HLMPPRILVECLLPNGMIVTLECLRKKATLITIKHELFKEARKYPLHQLLQD

SEQ ID NO: 2462 - protein, 52 aa, Artificial Sequence
  source: /note="Description of Artificial Sequence: Synthetic polypeptide"
  source: /note="p.C420R"
DLPRAARLCLSICSVKGRKGAKEEHRRPLAWGNINLFDYTDTLVSGKMALNL

SEQ ID NO: 2463 - protein, 77 aa, Artificial Sequence
  source: /note="Description of Artificial Sequence: Synthetic polypeptide"
  source: /note="p.PVPHGLEDL447del"
LAWGNINLFDYTDTLVSGKMALNLWLNPIGVTGSNPNKETPCLELEFDWFSSVVKFPDMSVIEEHANWSVSREAGFS

SEQ ID NO: 2464 - protein, 52 aa, Artificial Sequence
  source: /note="Description of Artificial Sequence: Synthetic polypeptide"
  source: /note="p.E453K"
NLFDYTDTLVSGKMALNLWPVPHGLKKDLLNPIGVTGSNPNKETPCLELEFD

SEQ ID NO: 2465 - protein, 37 aa, Artificial Sequence
  source: /note="Description of Artificial Sequence: Synthetic polypeptide"
  source: /note="p.L455fs"
DYTDTLVSGKMALNLWPVPHGLEDLAEPYWCYWIKSK

SEQ ID NO: 2466 - protein, 52 aa, Artificial Sequence
  source: /note="Description of Artificial Sequence: Synthetic polypeptide"
  source: /note="p.E542K"
LARDNELRENDKEQLKAISTRDPLSKKITEQEKDFLWSHRHYCVTIPEILPK

SEQ ID NO: 2467 - protein, 52 aa, Artificial Sequence
  source: /note="Description of Artificial Sequence: Synthetic polypeptide"
  source: /note="p.E545K"
DNELRENDKEQLKAISTRDPLSEITKKQEKDFLWSHRHYCVTIPEILPKLLL

SEQ ID NO: 2468 - protein, 52 aa, Artificial Sequence
  source: /note="Description of Artificial Sequence: Synthetic polypeptide"
  source: /note="p.E545A"
DNELRENDKEQLKAISTRDPLSEITAAQEKDFLWSHRHYCVTIPEILPKLLL

SEQ ID NO: 2469 - protein, 52 aa, Artificial Sequence
  source: /note="Description of Artificial Sequence: Synthetic polypeptide"
  source: /note="p.E545G"
DNELRENDKEQLKAISTRDPLSEITGGQEKDFLWSHRHYCVTIPEILPKLLL

SEQ ID NO: 2470 - protein, 52 aa, Artificial Sequence
  source: /note="Description of Artificial Sequence: Synthetic polypeptide"
  source: /note="p.Q546K"
NELRENDKEQLKAISTRDPLSEITEKKEKDFLWSHRHYCVTIPEILPKLLLS

SEQ ID NO: 2471 - protein, 52 aa, Artificial Sequence
  source: /note="Description of Artificial Sequence: Synthetic polypeptide"
  source: /note="p.Q546P"
NELRENDKEQLKAISTRDPLSEITEPPEKDFLWSHRHYCVTIPEILPKLLLS

SEQ ID NO: 2472 - protein, 52 aa, Artificial Sequence
  source: /note="Description of Artificial Sequence: Synthetic polypeptide"
  source: /note="p.Q546R"
NELRENDKEQLKAISTRDPLSEITERREKDFLWSHRHYCVTIPEILPKLLLS

SEQ ID NO: 2473 - protein, 27 aa, Artificial Sequence
  source: /note="Description of Artificial Sequence: Synthetic peptide"
  source: /note="p.M1V"
VVPPRPSSGELWGIHLMPPRILVECLL

SEQ ID NO: 2474 - protein, 52 aa, Artificial Sequence
  source: /note="Description of Artificial Sequence: Synthetic polypeptide"
  source: /note="p.E726K"
HLNRQVEAMEKLINLTDILKQEKKDKKTQKVQMKFLVEQMRRPDFMDALQGF

SEQ ID NO: 2475 - protein, 52 aa, Artificial Sequence
  source: /note="Description of Artificial Sequence: Synthetic polypeptide"
  source: /note="p.R88Q"
QDESSYIFVSVTQEAEREEFFDETRQQLCDLRLFQPFLKVIEPVGNREEKIL

SEQ ID NO: 2476 - protein, 52 aa, Artificial Sequence
  source: /note="Description of Artificial Sequence: Synthetic polypeptide"
  source: /note="p.R93Q"
YIFVSVTQEAEREEFFDETRRLCDLQQLFQPFLKVIEPVGNREEKILNREIG

SEQ ID NO: 2477 - protein, 52 aa, Artificial Sequence
  source: /note="Description of Artificial Sequence: Synthetic polypeptide"
  source: /note="p.M1004I"
RFQEMCYKAYLAIRQHANLFINLFSIIMLGSGMPELQSFDDIAYIRKTLALD

SEQ ID NO: 2478 - protein, 52 aa, Artificial Sequence
  source: /note="Description of Artificial Sequence: Synthetic polypeptide"
  source: /note="p.M1043V"
DIAYIRKTLALDKTEQEALEYFMKQVVNDAHHGGWTTKMDWIFHTIKQHALN

SEQ ID NO: 2479 - protein, 52 aa, Artificial Sequence
  source: /note="Description of Artificial Sequence: Synthetic polypeptide"
  source: /note="p.M1043I"
DIAYIRKTLALDKTEQEALEYFMKQIINDAHHGGWTTKMDWIFHTIKQHALN

SEQ ID NO: 2480 - protein, 51 aa, Artificial Sequence
  source: /note="Description of Artificial Sequence: Synthetic polypeptide"
  source: /note="p.N1044Y"
IAYIRKTLALDKTEQEALEYFMKQMYYDAHHGGWTTKMDWIFHTIKQHALN

SEQ ID NO: 2481 - protein, 51 aa, Artificial Sequence
  source: /note="Description of Artificial Sequence: Synthetic polypeptide"
  source: /note="p.N1044K"
IAYIRKTLALDKTEQEALEYFMKQMKKDAHHGGWTTKMDWIFHTIKQHALN

SEQ ID NO: 2482 - protein, 48 aa, Artificial Sequence
  source: /note="Description of Artificial Sequence: Synthetic polypeptide"
  source: /note="p.H1047R"
IRKTLALDKTEQEALEYFMKQMNDARRHGGWTTKMDWIFHTIKQHALN

SEQ ID NO: 2483 - protein, 48 aa, Artificial Sequence
  source: /note="Description of Artificial Sequence: Synthetic polypeptide"
  source: /note="p.H1047L"
IRKTLALDKTEQEALEYFMKQMNDALLHGGWTTKMDWIFHTIKQHALN

SEQ ID NO: 2484 - protein, 52 aa, Artificial Sequence
  source: /note="Description of Artificial Sequence: Synthetic polypeptide"
  source: /note="p.G106V"
EFFDETRRLCDLRLFQPFLKVIEPVVVNREEKILNREIGFAIGMPVCEFDMV

SEQ ID NO: 2485 - protein, 52 aa, Artificial Sequence
  source: /note="Description of Artificial Sequence: Synthetic polypeptide"
  source: /note="p.R108H"
FDETRRLCDLRLFQPFLKVIEPVGNHHEEKILNREIGFAIGMPVCEFDMVKD

SEQ ID NO: 2486 - protein, 53 aa, Artificial Sequence
  source: /note="Description of Artificial Sequence: Synthetic polypeptide"
  source: /note="p.E110del"
ETRRLCDLRLFQPFLKVIEPVGNREKILNREIGFAIGMPVCEFDMVKDPEVQD

SEQ ID NO: 2487 - protein, 52 aa, Artificial Sequence
  source: /note="Description of Artificial Sequence: Synthetic polypeptide"
  source: /note="p.K111E"
TRRLCDLRLFQPFLKVIEPVGNREEEEILNREIGFAIGMPVCEFDMVKDPEV

SEQ ID NO: 2488 - protein, 53 aa, Artificial Sequence
  source: /note="Description of Artificial Sequence: Synthetic polypeptide"
  source: /note="p.K111del"
TRRLCDLRLFQPFLKVIEPVGNREEILNREIGFAIGMPVCEFDMVKDPEVQDF

SEQ ID NO: 2489 - protein, 52 aa, Artificial Sequence
  source: /note="Description of Artificial Sequence: Synthetic polypeptide"
  source: /note="p.C381R"
CFALYAVIEKAKKARSTKKKSKKADRRPIAWANLMLFDYKDQLKTGERCLYM

SEQ ID NO: 2490 - protein, 52 aa, Artificial Sequence
  source: /note="Description of Artificial Sequence: Synthetic polypeptide"
  source: /note="p.V165I"
RHPPSEESQAFQRQLTALIGYDVTDIISNVHDDELEFTRRGLVTPRMAEVAS

SEQ ID NO: 2491 - protein, 52 aa, Artificial Sequence
  source: /note="Description of Artificial Sequence: Synthetic polypeptide"
  source: /note="p.G376R"
ADGTFLVRDASTKMHGDYTLTLRKGRRNNKLIKIFHRDGKYGFSDPLTFSSV

SEQ ID NO: 2492 - protein, 52 aa, Artificial Sequence
  source: /note="Description of Artificial Sequence: Synthetic polypeptide"
  source: /note="p.K379N"
TFLVRDASTKMHGDYTLTLRKGGNNNNLIKIFHRDGKYGFSDPLTFSSVVEL

SEQ ID NO: 2493 - protein, 62 aa, Artificial Sequence
  source: /note="Description of Artificial Sequence: Synthetic polypeptide"
  source: /note="p.KPDL567del"
RRRLEEDLKKQAAEYREIDKRMNSIIQLRKTRDQYLMWLTQKGVRQKKLNEWLGNENTEDQY

SEQ ID NO: 2494 - protein, 52 aa, Artificial Sequence
  source: /note="Description of Artificial Sequence: Synthetic polypeptide"
  source: /note="p.L371R"
LLSTSSLASHDSTLSLASSQASGPARRSRHLLTSFVSGLSDGMDSGYVEDSE

SEQ ID NO: 2495 - protein, 45 aa, Artificial Sequence
  source: /note="Description of Artificial Sequence: Synthetic polypeptide"
  source: /note="p.S291fs"
VYASLALSSSTSPRAPPSHRPLKSPPERDPVLCLKGLTNGQPSQD

SEQ ID NO: 2496 - protein, 52 aa, Artificial Sequence
  source: /note="Description of Artificial Sequence: Synthetic polypeptide"
  source: /note="p.L164F"
LQEELARSFFWQVLEAVRHCHNCGVFFHRDIKDENILIDLNRGELKLIDFGS

SEQ ID NO: 2497 - protein, 52 aa, Artificial Sequence
  source: /note="Description of Artificial Sequence: Synthetic polypeptide"
  source: /note="p.L184F"
HNCGVLHRDIKDENILIDLNRGELKFFIDFGSGALLKDTVYTDFDGTRVYSP

SEQ ID NO: 2498 - protein, 52 aa, Artificial Sequence
  source: /note="Description of Artificial Sequence: Synthetic polypeptide"
  source: /note="p.R219K"
IVTRNVFSHRLSVYRKYDLKGSTVAKKEASDKEKAKELPTLKDNDFINEGQK

SEQ ID NO: 2499 - protein, 52 aa, Artificial Sequence
  source: /note="Description of Artificial Sequence: Synthetic polypeptide"
  source: /note="p.R204H"
NTLLPQFLGMYRVSVDNEDSYMLVMHHNMFSHRLPVHRKYDLKGSLVSREAS

SEQ ID NO: 2500 - protein, 98 aa, Artificial Sequence
  source: /note="Description of Artificial Sequence: Synthetic polypeptide"
  source: /note="p.P295fs"
PPGKPSTEARSAASNTGTPDGPEAPQAQMPPPMPALGSSGPHPPVPPTHPNMEGLCLPRACLSGACRTLPETLRTAPRKSSLMPTKASRTVRRSSPRR

SEQ ID NO: 2501 - protein, 52 aa, Artificial Sequence
  source: /note="Description of Artificial Sequence: Synthetic polypeptide"
  source: /note="p.V699M"
GLKVCLQAALRAWNSCNEYMPSRIIMMYRDGVGDGQLKTLVNYEVPQFLDCL

SEQ ID NO: 2502 - protein, 52 aa, Artificial Sequence
  source: /note="Description of Artificial Sequence: Synthetic polypeptide"
  source: /note="p.T938M"
VENSASRANLSLRVTAEEPICGLRAMMPSPEARVLQGVLVRYSPVVEAGSDM

SEQ ID NO: 2503 - protein, 52 aa, Artificial Sequence
  source: /note="Description of Artificial Sequence: Synthetic polypeptide"
  source: /note="p.Y486F"
KLIRYVTTFDFFLAACEIIFCFFIFFFYVVEEILEIRIHKLHYFRSFWNCLD

SEQ ID NO: 2504 - protein, 52 aa, Artificial Sequence
  source: /note="Description of Artificial Sequence: Synthetic polypeptide"
  source: /note="p.F1856L"
PPVASLSPTSGSIGGGTTLVITGNGLLYPGNTTVTIGDEPCQIISINPNEVY

SEQ ID NO: 2505 - protein, 29 aa, Artificial Sequence
  source: /note="Description of Artificial Sequence: Synthetic peptide"
  source: /note="p.K76fs"
KREIRKELKIKEGAENLRKVTTDKKVWLM

SEQ ID NO: 2506 - protein, 47 aa, Artificial Sequence
  source: /note="Description of Artificial Sequence: Synthetic polypeptide"
  source: /note="p.W230fs"
FLQRQPQAWKDKYIRAFVSLGAPWGAWPRPCASWLQETTTGSQSSGP

SEQ ID NO: 2507 - protein, 145 aa, Artificial Sequence
  source: /note="Description of Artificial Sequence: Synthetic polypeptide"
  source: /note="p.L53fs"
KMIKCVIPGSDPFLEYNNYGCYCGLWGAQAPPWMNWTSAARHMTTAMTRPRSWTAVNFCWTTRTPTPIHTRALARQSPVAAKTKSVRPSFATATATLPSAFQKLHITRHTRTWTPRSIVRVEYHLSKASPLSASSHTVLSNKAPC

SEQ ID NO: 2508 - protein, 52 aa, Artificial Sequence
  source: /note="Description of Artificial Sequence: Synthetic polypeptide"
  source: /note="p.R201Q"
GPDLCCREHDRCPQNISPLQYNYGIQQNYRFHTISHCDCDTRFQQCLQNQHD

SEQ ID NO: 2509 - protein, 69 aa, Artificial Sequence
  source: /note="Description of Artificial Sequence: Synthetic polypeptide"
  source: /note="p.K184fs"
FESTGVLLEHLKSHAGKSSGGVKEKSTSANIVIAGSTPERMSGDTWWCTLEERTSSVSIVHRDLGERIT

SEQ ID NO: 2510 - protein, 24 aa, Artificial Sequence
  source: /note="Description of Artificial Sequence: Synthetic peptide"
  source: /note="p.P10fs"
MTTFFTSVPPGFKMQSRRRKWAGN

SEQ ID NO: 2511 - protein, 49 aa, Artificial Sequence
  source: /note="Description of Artificial Sequence: Synthetic polypeptide"
  source: /note="p.R201fs"
IIGGEFTTIENQPWFAAIYRRHRGGLCHLRVWRQPHQPLLGDQRHTLLH

SEQ ID NO: 2512 - protein, 66 aa, Artificial Sequence
  source: /note="Description of Artificial Sequence: Synthetic polypeptide"
  source: /note="p.E499fs"
KGRVLVKGKKLPAARSEDGRALSDRRRRRRMTRRKKRRWRLQRRGGWPSRSPRSCRPWLCTATPPA

SEQ ID NO: 2513 - protein, 52 aa, Artificial Sequence
  source: /note="Description of Artificial Sequence: Synthetic polypeptide"
  source: /note="p.G439C"
NTVGSLLHFLTKLPASETAHGRISVCCPCLKQCVRDTVCEYRATLQRTSISQ

SEQ ID NO: 2514 - protein, 52 aa, Artificial Sequence
  source: /note="Description of Artificial Sequence: Synthetic polypeptide"
  source: /note="p.G564C"
LMEQEQTIYRRVLPVDYLCFLTRDLCCTPECQSSLPCLKASISASILTTQNG

SEQ ID NO: 2515 - protein, 52 aa, Artificial Sequence
  source: /note="Description of Artificial Sequence: Synthetic polypeptide"
  source: /note="p.M564I"
VKGKKLPSDPDVLEGEVTDEDEEAEIISRRMSVDYNGEQKQIRLCRELSDLV

SEQ ID NO: 2516 - protein, 52 aa, Artificial Sequence
  source: /note="Description of Artificial Sequence: Synthetic polypeptide"
  source: /note="p.R1386Q"
QDARRRQEQIQAMPLADSQAVREQLQQQEQALLEEIERHGEKVEECQRFAKQ

SEQ ID NO: 2517 - protein, 52 aa, Artificial Sequence
  source: /note="Description of Artificial Sequence: Synthetic polypeptide"
  source: /note="p.R110L"
VDRCLFYYKDEKEESILGSIPLLSFLLVAAVQPSDNISRKHTFKAEHAGVRT

SEQ ID NO: 2518 - protein, 196 aa, Artificial Sequence
  source: /note="Description of Artificial Sequence: Synthetic polypeptide"
  source: /note="p.V328fs"
TNPDKIAQRKSSMNQLQQWVNLRRGYPRLKTFGVPLGSILCLAGSLSTMAPTPPSTPMIISTTRQECGRRASVPCRPMIGSARPGPWRTSAMPSAMGVALPTSCESGRSPPATGGRMPPSGSQAPPGSQSIMMSWMPPLAPCAACPCSPAPTLCPAHPARAPTAVPAFTPLSAHPVPVLSGCHLAVRTSMLTLLPM

SEQ ID NO: 2519 - protein, 52 aa, Artificial Sequence
  source: /note="Description of Artificial Sequence: Synthetic polypeptide"
  source: /note="p.S146P"
TALLEANSTPAPAGATVPPRSRRVCPPKVRCVTRSWSPCKVERRIWVRVYSP

SEQ ID NO: 2520 - protein, 52 aa, Artificial Sequence
  source: /note="Description of Artificial Sequence: Synthetic polypeptide"
  source: /note="p.E384K"
AIIFLQNSFCSLNTHRTPRTAQEVAKKLIDQHETMMKLVLEDPLLVSLRLEG

SEQ ID NO: 2521 - protein, 52 aa, Artificial Sequence
  source: /note="Description of Artificial Sequence: Synthetic polypeptide"
  source: /note="p.A895V"
RIIHNWDLTKRPICRQALKFLTQIRVVQPLINLQMVNASLYEHVERMHLIGR

SEQ ID NO: 2522 - protein, 52 aa, Artificial Sequence
  source: /note="Description of Artificial Sequence: Synthetic polypeptide"
  source: /note="p.S459L"
DQSFRTGSPGDAPERPPLCDFSEGLLLAPMDFYRFTVESPSTVTSGGGHHDP

SEQ ID NO: 2523 - protein, 30 aa, Artificial Sequence
  source: /note="Description of Artificial Sequence: Synthetic polypeptide"
  source: /note="p.T254fs"
QPSADRASSLSRPWEKTDKGATYTPRHPRS

SEQ ID NO: 2524 - protein, 52 aa, Artificial Sequence
  source: /note="Description of Artificial Sequence: Synthetic polypeptide"
  source: /note="p.E351Q"
GEMQASGPPAPGTVQVSVNGMDDSPQQPAKPSQAEGTPGTPPKDATTSTALP

SEQ ID NO: 2525 - protein, 52 aa, Artificial Sequence
  source: /note="Description of Artificial Sequence: Synthetic polypeptide"
  source: /note="p.R306W"
LETLVLSRSLTQELQGTVEALESSVWWGLPAGAQEKVAEVRRSVDALQTAFA

SEQ ID NO: 2526 - protein, 52 aa, Artificial Sequence
  source: /note="Description of Artificial Sequence: Synthetic polypeptide"
  source: /note="p.D233G"
KKTLCGTPNYIAPEVLSKKGHSFEVGGVWSIGCIMYTLLVGKPPFETSCLKE

SEQ ID NO: 2527 - protein, 68 aa, Artificial Sequence
  source: /note="Description of Artificial Sequence: Synthetic polypeptide"
  source: /note="p.P296fs"
GWTPEGGCGFCNQDRRTLPGGQPPPPGVSGRVCGTAYSVSAPLPAAAATPGLSPRQGHPFPAQQRGLP

SEQ ID NO: 2528 - protein, 85 aa, Artificial Sequence
  source: /note="Description of Artificial Sequence: Synthetic polypeptide"
  source: /note="p.R297fs"
GWTPEGGCGFCNQDRRTLPGGQPPPGCFWPCLWNSLLRFCPASCSGCYSWTIPPTGSPFSCTTTRSSMNPTSLTPGRSSRTTSQL

SEQ ID NO: 2529 - protein, 52 aa, Artificial Sequence
  source: /note="Description of Artificial Sequence: Synthetic polypeptide"
  source: /note="p.E77K"
FPSPGPVALGSAAPFLPLPGVPSGLKKFLVQIDQILIHQKAERVETFLGWET

SEQ ID NO: 2530 - protein, 26 aa, Artificial Sequence
  source: /note="Description of Artificial Sequence: Synthetic peptide"
  source: /note="p.P1016fs"
LTPPGQSPGSAPIIININRAQLTNPR

SEQ ID NO: 2531 - protein, 52 aa, Artificial Sequence
  source: /note="Description of Artificial Sequence: Synthetic polypeptide"
  source: /note="p.E1295K"
ALECKEAFAELQTDIHELTNDLDGAKSIPFLDYRTYAMRVLFPGIEDHPVLK

SEQ ID NO: 2532 - protein, 82 aa, Artificial Sequence
  source: /note="Description of Artificial Sequence: Synthetic polypeptide"
  source: /note="p.P464fs"
YNGYSVVFVGTKSGKLKKIRADGPPPMVGSSTRWSLCSRTEAPSSGTWPSPLISATCTSCLRDRSPGSPWSHVSSIRLVGSA

SEQ ID NO: 2533 - protein, 52 aa, Artificial Sequence
  source: /note="Description of Artificial Sequence: Synthetic polypeptide"
  source: /note="p.P58S"
LTHLAVHRVTGEVFVGAVNRVFKLASSNLTELRAHVTGPVEDNARCYPPPSM

SEQ ID NO: 2534 - protein, 52 aa, Artificial Sequence
  source: /note="Description of Artificial Sequence: Synthetic polypeptide"
  source: /note="p.S462L"
IYIYLTAGKEVRRIRVANCNKHKSCLLECLTATDPHCGWCHSLQRCTFQGDC

SEQ ID NO: 2535 - protein, 52 aa, Artificial Sequence
  source: /note="Description of Artificial Sequence: Synthetic polypeptide"
  source: /note="p.R819C"
NINVSEYCVATYCGFLAPSLKSSKVCCTNVTVKLRVQDTYLDCGTLQYREDP

SEQ ID NO: 2536 - protein, 52 aa, Artificial Sequence
  source: /note="Description of Artificial Sequence: Synthetic polypeptide"
  source: /note="p.R367L"
GLQCAGGAGRGDLYSRLVSVFPARELLLFAVFERPQGSPAARAAPAALCAFR

SEQ ID NO: 2537 - protein, 85 aa, Artificial Sequence
  source: /note="Description of Artificial Sequence: Synthetic polypeptide"
  source: /note="p.P208fs"
RAPPNRTIFDSDLMDSARLGGPCPPAVTRASAPRATAAAGAWRGRRPPTARSSATTRGPPSSTSRAVGRPPCWRGPGSTTHTSRP

SEQ ID NO: 2538 - protein, 52 aa, Artificial Sequence
  source: /note="Description of Artificial Sequence: Synthetic polypeptide"
  source: /note="p.K651R"
AKRIKQLHHEAQQSEGEQNYRKFRARRICPGENQAAEDELRKEISKTMFAEM

SEQ ID NO: 2539 - protein, 52 aa, Artificial Sequence
  source: /note="Description of Artificial Sequence: Synthetic polypeptide"
  source: /note="p.G174W"
NLEKLLVFTAAGVKPQGKVAGFDLDWWTLITTRSGKVFPTGPSDWRILYPEI

SEQ ID NO: 2540 - protein, 52 aa, Artificial Sequence
  source: /note="Description of Artificial Sequence: Synthetic polypeptide"
  source: /note="p.T37M"
GAVAGKEVCYERLGCFSDDSPWSGIMMERPLHILPWSPKDVNTRFLLYTNEN

SEQ ID NO: 2541 - protein, 52 aa, Artificial Sequence
  source: /note="Description of Artificial Sequence: Synthetic polypeptide"
  source: /note="p.L223P"
LDLYVNIAKQDIMLSLANLVRLNQAPPFPPSKRKMESLYQCGFDDTVKFLLK

SEQ ID NO: 2542 - protein, 172 aa, Artificial Sequence
  source: /note="Description of Artificial Sequence: Synthetic polypeptide"
  source: /note="p.P1199fs"
LAYVCCVRQLEVVKSSDYCEYLRPPSTATAPWTSASSTRSAKWATSTGARCLTSGAAAACWRRCSATSRGRARSPRVRSSPVPTPPSRTLPKLCLALSPPSPPWWMTNLTTRRSTRRSCWTSPGMHTQTSRAPQPSRAQTWRTSPHCGIDTPVWLSQNCLRAPLTRTGRGLC

SEQ ID NO: 2543 - protein, 52 aa, Artificial Sequence
  source: /note="Description of Artificial Sequence: Synthetic polypeptide"
  source: /note="p.R73C"
PRALPPTLFLPHFLGGDGPCLTPQPCCAPAALPNRSLAVAGGTPRAAPKKRR

SEQ ID NO: 2544 - protein, 31 aa, Artificial Sequence
  source: /note="Description of Artificial Sequence: Synthetic polypeptide"
  source: /note="p.I301fs"
RHVPKHLPPALYKLHLKNNKLEKIPRGPSAS

SEQ ID NO: 2545 - protein, 52 aa, Artificial Sequence
  source: /note="Description of Artificial Sequence: Synthetic polypeptide"
  source: /note="p.A150V"
QLQHLCVAHNKLSVAPQFLPRSLRVVVDLAANQVMEIFPLTFGEKPALRSVY

SEQ ID NO: 2546 - protein, 36 aa, Artificial Sequence
  source: /note="Description of Artificial Sequence: Synthetic polypeptide"
  source: /note="p.S162fs"
TATAKPNTTSSQNGAEDTTNSGGKSQPQCDHRPHIH

SEQ ID NO: 2547 - protein, 52 aa, Artificial Sequence
  source: /note="Description of Artificial Sequence: Synthetic polypeptide"
  source: /note="p.G75W"
SAPVPIAAHASVAGHLSTSTTVSSSWWAQNSDSTKKTLVTLIANNNAGNPLV

SEQ ID NO: 2548 - protein, 52 aa, Artificial Sequence
  source: /note="Description of Artificial Sequence: Synthetic polypeptide"
  source: /note="p.E603D"
PFQSHFCVVSKPKDCIFPYAFKEVIDDKKNVKVEVAATERTLLGFFLAKVHK

SEQ ID NO: 2549 - protein, 52 aa, Artificial Sequence
  source: /note="Description of Artificial Sequence: Synthetic polypeptide"
  source: /note="p.V411L"
EIGFQKDSQGEYKAPQCIHMDCLRWLLKRDSYLPVGSHNLKAAAKAKLGYDP

SEQ ID NO: 2550 - protein, 52 aa, Artificial Sequence
  source: /note="Description of Artificial Sequence: Synthetic polypeptide"
  source: /note="p.S459F"
YDPVELDPEDMCRMATEQPQTLATYFFVSDAVATYYLYMKYVHPFIFALCTI

SEQ ID NO: 2551 - protein, 52 aa, Artificial Sequence
  source: /note="Description of Artificial Sequence: Synthetic polypeptide"
  source: /note="p.R573L"
ESGVFRSDIPCRFRMNPAAFDFLLQLLVEKTLRHALEEEEKVPVEQVTNFEE

SEQ ID NO: 2552 - protein, 52 aa, Artificial Sequence
  source: /note="Description of Artificial Sequence: Synthetic polypeptide"
  source: /note="p.P286R"
DDLVERPDPVVLAFDIETTKLPLKFRRDAETDQIMMISYMIDGQGYLITNRE

SEQ ID NO: 2553 - protein, 30 aa, Artificial Sequence
  source: /note="Description of Artificial Sequence: Synthetic polypeptide"
  source: /note="p.P97fs"
EETSAEEAVSWQERRMAAAPPGCTPQLCWT

SEQ ID NO: 2554 - protein, 52 aa, Artificial Sequence
  source: /note="Description of Artificial Sequence: Synthetic polypeptide"
  source: /note="p.R860Q"
NAVPFKSARKAVDEEEEAVEERRNMQQTIWVTGRKGLTEREAAALIVEEARM

SEQ ID NO: 2555 - protein, 41 aa, Artificial Sequence
  source: /note="Description of Artificial Sequence: Synthetic polypeptide"
  source: /note="p.K332Q"
IFSVESTGVLPPDVLVSEAIKVLMGQQCRRFLDELDAVQMD

SEQ ID NO: 2556 - protein, 52 aa, Artificial Sequence
  source: /note="Description of Artificial Sequence: Synthetic polypeptide"
  source: /note="p.L372F"
GDNKVDDRDYYGNKRLELAGQLLSLFFFEDLFKKFNSEMKKIADQVIPKQRA

SEQ ID NO: 2557 - protein, 52 aa, Artificial Sequence
  source: /note="Description of Artificial Sequence: Synthetic polypeptide"
  source: /note="p.P231T"
GRRNLQPRPSAFKPLSKNGAVASFVTTRPGPLKPSLGPWSLSFCDDAWPSVL

SEQ ID NO: 2558 - protein, 52 aa, Artificial Sequence
  source: /note="Description of Artificial Sequence: Synthetic polypeptide"
  source: /note="p.P242H"
FKPLSKNGAVASFVPRPGPLKPSLGHHWSLSFCDDAWPSVLVQPAPSAIWDF

SEQ ID NO: 2559 - protein, 52 aa, Artificial Sequence
  source: /note="Description of Artificial Sequence: Synthetic polypeptide"
  source: /note="p.R306Q"
WVGCHPNGMKIFFYDSENPPASEVLQQIQNILTEEPKVTQVYAENGTVLQGS

SEQ ID NO: 2560 - protein, 36 aa, Artificial Sequence
  source: /note="Description of Artificial Sequence: Synthetic polypeptide"
  source: /note="p.K750fs"
VASSPNGKESDLRRSEVPCAPMPKKLISHLMKWAHP

SEQ ID NO: 2561 - protein, 52 aa, Artificial Sequence
  source: /note="Description of Artificial Sequence: Synthetic polypeptide"
  source: /note="p.R508C"
GAIHIFREIIKPAEKSLHEKLKQDKCCFSTFLSLLEAADLKELLTQPGDWTL

SEQ ID NO: 2562 - protein, 52 aa, Artificial Sequence
  source: /note="Description of Artificial Sequence: Synthetic polypeptide"
  source: /note="p.K507E"
EEQNTGISQDEILTNKQKQIEVAEKEEMNSELSLSHKKEEDLLRENSMLQEE

SEQ ID NO: 2563 - protein, 52 aa, Artificial Sequence
  source: /note="Description of Artificial Sequence: Synthetic polypeptide"
  source: /note="p.V166M"
DKLHRAAWWGKVPRKDLIVMLRDTDMMNKKDKQKRTALHLASANGNSEVVKL

SEQ ID NO: 2564 - protein, 52 aa, Artificial Sequence
  source: /note="Description of Artificial Sequence: Synthetic polypeptide"
  source: /note="p.V288M"
ADIESKNKHGLTPLLLGVHEQKQQVMMKFLIKKKANLNALDRYGRTALILAV

SEQ ID NO: 2565 - protein, 52 aa, Artificial Sequence
  source: /note="Description of Artificial Sequence: Synthetic polypeptide"
  source: /note="p.R303I"
LGVHEQKQQVVKFLIKKKANLNALDIIYGRTALILAVCCGSASIVSLLLEQN

SEQ ID NO: 2566 - protein, 52 aa, Artificial Sequence
  source: /note="Description of Artificial Sequence: Synthetic polypeptide"
  source: /note="p.K674N"
STLREEIAMLRLELDTMKHQSQLRENNKYLEDIESVKKRNDNLLKALQLNEL

SEQ ID NO: 2567 - protein, 52 aa, Artificial Sequence
  source: /note="Description of Artificial Sequence: Synthetic polypeptide"
  source: /note="p.S112G"
DDSAMKTLRNKMGKWCCHCFPCCRGGGSKSKVGAWGDYDDSAFMEPRYHVRG

SEQ ID NO: 2568 - protein, 52 aa, Artificial Sequence
  source: /note="Description of Artificial Sequence: Synthetic polypeptide"
  source: /note="p.D51N"
KWCRHCFPWCRGSGKSNVGTSGDHDNNSAMKTLRSKMGKWCRHCFPWCRGSS

SEQ ID NO: 2569 - protein, 52 aa, Artificial Sequence
  source: /note="Description of Artificial Sequence: Synthetic polypeptide"
  source: /note="p.R136H"
GSGKSKVGPWGDYDDSAFMEPRYHVHHREDLDKLHRAAWWGKVPRKDLIVML

SEQ ID NO: 2570 - protein, 52 aa, Artificial Sequence
  source: /note="Description of Artificial Sequence: Synthetic polypeptide"
  source: /note="p.T239A"
RIKLGFTQGDVGLAMGKLYGNDFSQAATISRFEALNLSFKNMCKLKPLLEKW

SEQ ID NO: 2571 - protein, 52 aa, Artificial Sequence
  source: /note="Description of Artificial Sequence: Synthetic polypeptide"
  source: /note="p.T239S"
RIKLGFTQGDVGLAMGKLYGNDFSQSSTISRFEALNLSFKNMCKLKPLLEKW

SEQ ID NO: 2572 - protein, 52 aa, Artificial Sequence
  source: /note="Description of Artificial Sequence: Synthetic polypeptide"
  source: /note="p.D321Y"
GGGGGAGPGLNSHDPHSDEDTPTSDYYLEQFAKQFKQRRIKLGFTQADVGLA

SEQ ID NO: 2573 - protein, 93 aa, Artificial Sequence
  source: /note="Description of Artificial Sequence: Synthetic polypeptide"
  source: /note="p.P135fs"
AFPALDGGDALSCTSASPAPSSAPPALPRRSPRPQPLRWTSSHCCRSSSWPHPTQHQALTPRRKGPPGARQASDLKVNGLVLRRTAPKTRRLP

SEQ ID NO: 2574 - protein, 52 aa, Artificial Sequence
  source: /note="Description of Artificial Sequence: Synthetic polypeptide"
  source: /note="p.S382R"
PKQDTKYDLILDEQAEDSKSSHSHTRRKKHKKKTHHCSEEKEDEDYMPIKNT

SEQ ID NO: 2575 - protein, 61 aa, Artificial Sequence
  source: /note="Description of Artificial Sequence: Synthetic polypeptide"
  source: /note="p.P454fs"
GESWELMDSAGNKLIAPAVCFVIPPQTLRPWLWLTAWAASTGACGRRQLGANARCSSGMRC

SEQ ID NO: 2576 - protein, 52 aa, Artificial Sequence
  source: /note="Description of Artificial Sequence: Synthetic polypeptide"
  source: /note="p.H326Y"
DWKEYLNLLICEESHLKYMEDYHQFYYEDVKDAQELLRKVDSDLNQKYGPDF

SEQ ID NO: 2577 - protein, 52 aa, Artificial Sequence
  source: /note="Description of Artificial Sequence: Synthetic polypeptide"
  source: /note="p.R311W"
IHLHVNLVRQEMFPHDPAEALCRAFWWVTDERFVQKAARESLRCGTTGVVTF

SEQ ID NO: 2578 - protein, 54 aa, Artificial Sequence
  source: /note="Description of Artificial Sequence: Synthetic polypeptide"
  source: /note="p.P226fs"
NSRTLTRAASLRGGVGAPGSPSTPPHASLPRRRFPMSAWSSERLKVHSRKWTYR

SEQ ID NO: 2579 - protein, 75 aa, Artificial Sequence
  source: /note="Description of Artificial Sequence: Synthetic polypeptide"
  source: /note="p.P372fs"
LSSREKISLQDLSKERRPGGAGGPPSRTRMRGKKVPPNHPLQNPEPSMASPPRRTPALRVPCSLKRPPSPGALAS

SEQ ID NO: 2580 - protein, 52 aa, Artificial Sequence
  source: /note="Description of Artificial Sequence: Synthetic polypeptide"
  source: /note="p.P179R"
CYPRVSSAVKAELRQYFRNLCSDDTRRMVRRAAASKLGEFAKVLELDNVKSE

SEQ ID NO: 2581 - protein, 52 aa, Artificial Sequence
  source: /note="Description of Artificial Sequence: Synthetic polypeptide"
  source: /note="p.R183W"
VSSAVKAELRQYFRNLCSDDTPMVRWWAAASKLGEFAKVLELDNVKSEIIPM

SEQ ID NO: 2582 - protein, 52 aa, Artificial Sequence
  source: /note="Description of Artificial Sequence: Synthetic polypeptide"
  source: /note="p.S219L"
KVLELDNVKSEIIPMFSNLASDEQDLLVRLLAVEACVNIAQLLPQEDLEALV

SEQ ID NO: 2583 - protein, 52 aa, Artificial Sequence
  source: /note="Description of Artificial Sequence: Synthetic polypeptide"
  source: /note="p.S256F"
IAQLLPQEDLEALVMPTLRQAAEDKFFWRVRYMVADKFTELQKAVGPEITKT

SEQ ID NO: 2584 - protein, 52 aa, Artificial Sequence
  source: /note="Description of Artificial Sequence: Synthetic polypeptide"
  source: /note="p.P326L"
SKGTIRLCDMRASALCDRHTKFFEELLEDPSNRSFFSEIISSISDVKFSHSG

SEQ ID NO: 2585 - protein, 94 aa, Artificial Sequence
  source: /note="Description of Artificial Sequence: Synthetic polypeptide"
  source: /note="p.T389fs"
RKVQKEGKISYADFVWFLISEEDKKHRPASSTGSAAWTWTGTAPCPCSSSSTSTRSSAEGWTAWPSRPCPSRTASARCWTWSSRGLKGRSRCRT

SEQ ID NO: 2586 - protein, 52 aa, Artificial Sequence
  source: /note="Description of Artificial Sequence: Synthetic polypeptide"
  source: /note="p.F310L"
ELRRSSFLQNVALLEEEADINQLTELLFSYEHFYVIYCKFWELDTDHDLLID

SEQ ID NO: 2587 - protein, 52 aa, Artificial Sequence
  source: /note="Description of Artificial Sequence: Synthetic polypeptide"
  source: /note="p.S259Y"
GFALPLKEEHKIFLLKVLLPLHKVKYYLSVYHPQLAYCVVQFLEKDSTLTEP

SEQ ID NO: 2588 - protein, 52 aa, Artificial Sequence
  source: /note="Description of Artificial Sequence: Synthetic polypeptide"
  source: /note="p.L597F"
DSVPLISDAVENMDSTLHYIHSDSDFFSNNSSFSPDEERRTKVQDVVPQALL

SEQ ID NO: 2589 - protein, 52 aa, Artificial Sequence
  source: /note="Description of Artificial Sequence: Synthetic polypeptide"
  source: /note="p.R301C"
LVHEGYKFMFDEKLVTVWSAPNYCYCCCGNIASIMVFKDVNTREPKLFRAVP

SEQ ID NO: 2590 - protein, 52 aa, Artificial Sequence
  source: /note="Description of Artificial Sequence: Synthetic polypeptide"
  source: /note="p.R265L"
WQSSFFGFYDANETVLEMEEQLVYLLLDSFGLKTLLARGAIVRCPMAGISHT

SEQ ID NO: 2591 - protein, 52 aa, Artificial Sequence
  source: /note="Description of Artificial Sequence: Synthetic polypeptide"
  source: /note="p.A268T"
QPEFSEAAQTPLWKPQSSEPKRDSSTTFPKKASQPPLSDFPKKPPQPELGDL

SEQ ID NO: 2592 - protein, 52 aa, Artificial Sequence
  source: /note="Description of Artificial Sequence: Synthetic polypeptide"
  source: /note="p.C84S"
KLQVLDLQDVCENFWMVWSEAMAHGSSFLNAKRNKTPVQDCPRMRERQPLTV

SEQ ID NO: 2593 - protein, 52 aa, Artificial Sequence
  source: /note="Description of Artificial Sequence: Synthetic polypeptide"
  source: /note="p.R104Q"
AMAHGCFLNAKRNKTPVQDCPRMREQQQPLTVFVELWLKNRTLDEYLTCLLL

SEQ ID NO: 2594 - protein, 52 aa, Artificial Sequence
  source: /note="Description of Artificial Sequence: Synthetic polypeptide"
  source: /note="p.R248H"
LTQFTPYLGHMRNLQKLILSHMDVSHHYVSPEQKKEIVTQFTTQFLKLRCLQ

SEQ ID NO: 2595 - protein, 52 aa, Artificial Sequence
  source: /note="Description of Artificial Sequence: Synthetic polypeptide"
  source: /note="p.I448V"
ALCWGRFAELGAELMKTPRDLRQPKVVIVFCTVPCPRCGIRASYDLEPSHCL

SEQ ID NO: 2596 - protein, 52 aa, Artificial Sequence
  source: /note="Description of Artificial Sequence: Synthetic polypeptide"
  source: /note="p.R319H"
LEMVVMTDCLLSESDLKHLSWCPSIHHQLKELDLRGVTLTHFSPEPLTGLLE

SEQ ID NO: 2597 - protein, 95 aa, Artificial Sequence
  source: /note="Description of Artificial Sequence: Synthetic polypeptide"
  source: /note="p.R274fs"
KPQGPPPPGKPQGPPAQGGSKSQSADLLQESHKDHPNKKATILKVPHLQQEAIPSSLRHLLLDSPRDHHALLKGADLPDLPSDSLPSHLGFNDRK

SEQ ID NO: 2598 - protein, 52 aa, Artificial Sequence
  source: /note="Description of Artificial Sequence: Synthetic polypeptide"
  source: /note="p.S588C"
PYPLKKQNGKIKYECNVCAKTFGQLCCNLKVHLRVHSGERPFKCQTCNKGFT

SEQ ID NO: 2599 - protein, 52 aa, Artificial Sequence
  source: /note="Description of Artificial Sequence: Synthetic polypeptide"
  source: /note="p.P1036L"
HLCNRCFGQQTNLDRHLKKHEHENALLVSQHPGVLTNHLGTSASSPTSESDN

SEQ ID NO: 2600 - protein, 52 aa, Artificial Sequence
  source: /note="Description of Artificial Sequence: Synthetic polypeptide"
  source: /note="p.E271Q"
RRHKKYTCGSVGAALYEGLAEELKPQQGLGGGSGQAHECKDCERMFPNKYSL

SEQ ID NO: 2601 - protein, 50 aa, Artificial Sequence
  source: /note="Description of Artificial Sequence: Synthetic polypeptide"
  source: /note="p.*802K"
DSVGTEDCRINSAVYSADESLSAHKKKKEKKQAILDENANGKIHITSYLL

SEQ ID NO: 2602 - protein, 52 aa, Artificial Sequence
  source: /note="Description of Artificial Sequence: Synthetic polypeptide"
  source: /note="p.M387L"
GQELGIRSSIEPAESLGQAVNCWSGLLGMSMARNWASSGAASGRKSSWQGEN

SEQ ID NO: 2603 - protein, 52 aa, Artificial Sequence
  source: /note="Description of Artificial Sequence: Synthetic polypeptide"
  source: /note="p.D201Y"
LRLSQNHISRIPPGVFSKLENLLLLYYLQHNRLSDGVFKPDTFHGLKNLMQL

SEQ ID NO: 2604 - protein, 52 aa, Artificial Sequence
  source: /note="Description of Artificial Sequence: Synthetic polypeptide"
  source: /note="p.F469L"
SKDGTKIPMFIVHKKGIKLDGSHPALLLYGYGGFNISITPNYSVSRLIFVRH

SEQ ID NO: 2605 - protein, 52 aa, Artificial Sequence
  source: /note="Description of Artificial Sequence: Synthetic polypeptide"
  source: /note="p.V731I"
AKEIIKIPDQPDTLCFQIRGAAPPYIIYAVGRGSEAMAAGLCAGQCILKVNG

SEQ ID NO: 2606 - protein, 52 aa, Artificial Sequence
  source: /note="Description of Artificial Sequence: Synthetic polypeptide"
  source: /note="p.E1246K"
CLEHLFNQVDSINALLKGPVMSRAFKKETKHFPMNHSLQEFKQKEECTIRGR

SEQ ID NO: 2607 - protein, 52 aa, Artificial Sequence
  source: /note="Description of Artificial Sequence: Synthetic polypeptide"
  source: /note="p.R363Q"
WFVCMAKTPEEKHEWFEAILKERERQQKGLKLGMEQDTWVMISEQGEKLYKM

SEQ ID NO: 2608 - protein, 27 aa, Artificial Sequence
  source: /note="Description of Artificial Sequence: Synthetic peptide"
  source: /note="p.R562fs"
CDNGFMHHVLEKSEFKDEPLLFRFFFG

SEQ ID NO: 2609 - protein, 52 aa, Artificial Sequence
  source: /note="Description of Artificial Sequence: Synthetic polypeptide"
  source: /note="p.N675H"
PTTPEEPTPTTPEEPAPTTPKAAAPHHTPKEPAPTTPKEPAPTTPKEPAPTT

SEQ ID NO: 2610 - protein, 52 aa, Artificial Sequence
  source: /note="Description of Artificial Sequence: Synthetic polypeptide"
  source: /note="p.E1289Q"
LFWVQIVLWRQGFYYPLGIVREVLPQQASTWEQGLRILGLEYSLRVPPSDQA

SEQ ID NO: 2611 - protein, 52 aa, Artificial Sequence
  source: /note="Description of Artificial Sequence: Synthetic polypeptide"
  source: /note="p.R407Q"
CPLDALNTTKPKSLAVKKAKWHLGIQQSQSKPYDIMAEVYRAMKQLDFEWKV

SEQ ID NO: 2612 - protein, 52 aa, Artificial Sequence
  source: /note="Description of Artificial Sequence: Synthetic polypeptide"
  source: /note="p.P104H"
PTVFRWTGGGKEVYLSGSFNNWSKLHHLTRSHNNFVAILDLPEGEHQYKFFV

SEQ ID NO: 2613 - protein, 52 aa, Artificial Sequence
  source: /note="Description of Artificial Sequence: Synthetic polypeptide"
  source: /note="p.S309L"
ERLKVVDVIGTKVYNDGEQIIAQGDLLADSFFIVESGEVKITMKRKGKSEVE

SEQ ID NO: 2614 - protein, 26 aa, Artificial Sequence
  source: /note="Description of Artificial Sequence: Synthetic peptide"
  source: /note="p.G432fs"
FLTHLICTFQTKDHLFFVMEFLNGGT

SEQ ID NO: 2615 - protein, 140 aa, Artificial Sequence
  source: /note="Description of Artificial Sequence: Synthetic polypeptide"
  source: /note="p.Q157fs"
SSGEAPKDNEERVFRERMRPRKRQGGRQAQGPSGQRPQVHGHLSSAAHLLLPLQRLHLGCHRKAGIPVSSLHLRGPQAVPRAHNHKVCWVKEAGDPRPGGLPAVQRQHAPQVRYPQLQGPYLLRSLWVPALGTLAAGFAV

SEQ ID NO: 2616 - protein, 52 aa, Artificial Sequence
  source: /note="Description of Artificial Sequence: Synthetic polypeptide"
  source: /note="p.R345C"
SSSPIPSPSPSPTDPKRCFFGASPGCCLHISDFSFLMVLGKGSFGKVMLAER

SEQ ID NO: 2617 - protein, 52 aa, Artificial Sequence
  source: /note="Description of Artificial Sequence: Synthetic polypeptide"
  source: /note="p.R480C"
IVGSSDNPDQNTEDYLFQVILEKQICCIPRSLSVKAASVLKSFLNKDPKERL

SEQ ID NO: 2618 - protein, 52 aa, Artificial Sequence
  source: /note="Description of Artificial Sequence: Synthetic polypeptide"
  source: /note="p.A324V"
GMNVHHRCQTKVANLCGINQKLMAEVVLAMIESTQQARCLRDTEQIFREGPV

SEQ ID NO: 2619 - protein, 52 aa, Artificial Sequence
  source: /note="Description of Artificial Sequence: Synthetic polypeptide"
  source: /note="p.Q3568E"
DTSTGHKNKEFVARIKSKLDQGGVIEEDFINALDQLSNPELLFKDWSNDVRA

SEQ ID NO: 2620 - protein, 52 aa, Artificial Sequence
  source: /note="Description of Artificial Sequence: Synthetic polypeptide"
  source: /note="p.K122N"
NILKANASICFAVPDPLMPDPSKQPNNNQLNPIGSLQELAIHHGWRLPEYTL

SEQ ID NO: 2621 - protein, 59 aa, Artificial Sequence
  source: /note="Description of Artificial Sequence: Synthetic polypeptide"
  source: /note="p.S28fs"
SSRCLLLRRKMAENAAESTEVNSPPPSPPSPSSLLSPCNASIMCPLNPAAQDGARCPSC

SEQ ID NO: 2622 - protein, 52 aa, Artificial Sequence
  source: /note="Description of Artificial Sequence: Synthetic polypeptide"
  source: /note="p.S31P"
SSRCLLLRRKMAENAAESTEVNSPPPPQPPQPVVPAKPVQCVHHVSTQPSCP

SEQ ID NO: 2623 - protein, 52 aa, Artificial Sequence
  source: /note="Description of Artificial Sequence: Synthetic polypeptide"
  source: /note="p.L527V"
TVRFALRRMEELGLHPADHRVYFGQVVLGMCDQISFPLGQAGYPVYKYVPYG

SEQ ID NO: 2624 - protein, 52 aa, Artificial Sequence
  source: /note="Description of Artificial Sequence: Synthetic polypeptide"
  source: /note="p.V297I"
KTVLVLMCILTAYVLCWAPFYGFTIIIRDFFPTVFVKEKHYLTAFYVVECIA

SEQ ID NO: 2625 - protein, 34 aa, Artificial Sequence
  source: /note="Description of Artificial Sequence: Synthetic polypeptide"
  source: /note="p.F592fs"
SPYSGSAMQEGLSPNHLKKAKLMFFIPVIPAPIC

SEQ ID NO: 2626 - protein, 52 aa, Artificial Sequence
  source: /note="Description of Artificial Sequence: Synthetic polypeptide"
  source: /note="p.V225D"
PRESYRENKRKQKLPQQQQQSFQQLDDSARKEQKREERRQLKQQLEDMQKQL

SEQ ID NO: 2627 - protein, 52 aa, Artificial Sequence
  source: /note="Description of Artificial Sequence: Synthetic polypeptide"
  source: /note="p.R289W"
STSVLPHTGYIYHSDIVQSLPPDLRWWKAARLVAAKCTLAARVDSFHESTEG

SEQ ID NO: 2628 - protein, 52 aa, Artificial Sequence
  source: /note="Description of Artificial Sequence: Synthetic polypeptide"
  source: /note="p.R763L"
KCPHSTPLWLLLSRLEEKIGQLTRALLAILEKSRLKNPKNPGLWLESVRLEY

SEQ ID NO: 2629 - protein, 52 aa, Artificial Sequence
  source: /note="Description of Artificial Sequence: Synthetic polypeptide"
  source: /note="p.P1883T"
SASIPILASALASTSAPTPAPAASSTTAAPVITAPTIPASAPTASVPLAPAS

SEQ ID NO: 2630 - protein, 52 aa, Artificial Sequence
  source: /note="Description of Artificial Sequence: Synthetic polypeptide"
  source: /note="p.A196V"
DVTAVEQPIVPRPAPRPTDYLSWGTVVSPYSAMATYSATCANNSPAQGINMA

SEQ ID NO: 2631 - protein, 52 aa, Artificial Sequence
  source: /note="Description of Artificial Sequence: Synthetic polypeptide"
  source: /note="p.D107N"
EGNEQFINAAKIIRHPQYDRKTLNNNNIMLIKLSSRAVINARVSTISLPTAP

SEQ ID NO: 2632 - protein, 30 aa, Artificial Sequence
  source: /note="Description of Artificial Sequence: Synthetic polypeptide"
  source: /note="p.L680fs"
LPQGHQVSRLVISIRLPQHLGLRPPWPSWS

SEQ ID NO: 2633 - protein, 52 aa, Artificial Sequence
  source: /note="Description of Artificial Sequence: Synthetic polypeptide"
  source: /note="p.E39Q"
TVATALMLPVKPPAGSWGAQIIGGHQQVTPHSRPYMASVRFGGQHHCGGFLL

SEQ ID NO: 2634 - protein, 37 aa, Artificial Sequence
  source: /note="Description of Artificial Sequence: Synthetic polypeptide"
  source: /note="p.G256fs"
NVLSRLSLMAMPNGFHEDGPQGPGGMRMMMRRTRTSC

SEQ ID NO: 2635 - protein, 52 aa, Artificial Sequence
  source: /note="Description of Artificial Sequence: Synthetic polypeptide"
  source: /note="p.T563P"
PEIAFWGSNAGVKTTRLEAHSEMGSPPEILEKETPENLSNGTSSNVEAAKRL

SEQ ID NO: 2636 - protein, 52 aa, Artificial Sequence
  source: /note="Description of Artificial Sequence: Synthetic polypeptide"
  source: /note="p.R397C"
FQLSGQKLFIPQITTKHSGLYACSVCCNSATGKESSKSMTVKVSGKRIPVSL

SEQ ID NO: 2637 - protein, 52 aa, Artificial Sequence
  source: /note="Description of Artificial Sequence: Synthetic polypeptide"
  source: /note="p.R320C"
LILPSVTRNETGPYQCEIRDQYGGICCSYPVTLNVLYGPDLPRIYPSFTYYR

SEQ ID NO: 2638 - protein, 49 aa, Artificial Sequence
  source: /note="Description of Artificial Sequence: Synthetic polypeptide"
  source: /note="p.E404K"
LFIPQITRNHSGLYACSVHNSATGKKKISKSMTVKVSGPCHGDLTESQS

SEQ ID NO: 2639 - protein, 31 aa, Artificial Sequence
  source: /note="Description of Artificial Sequence: Synthetic polypeptide"
  source: /note="p.A5V"
MAAAVVVVEFQRAQSLLSTDREASIDILHSI

SEQ ID NO: 2640 - protein, 52 aa, Artificial Sequence
  source: /note="Description of Artificial Sequence: Synthetic polypeptide"
  source: /note="p.R201Q"
SMEKKERVEFILEQMRLCLAVKDYIQQTQIISKKINTKFFQEENTEKLKLKY

SEQ ID NO: 2641 - protein, 52 aa, Artificial Sequence
  source: /note="Description of Artificial Sequence: Synthetic polypeptide"
  source: /note="p.R231W"
IAKYPHVEDYRRTVTEIDEKEYISLWWLIISELRNQYVTLHDMILKNIEKIK

SEQ ID NO: 2642 - protein, 52 aa, Artificial Sequence
  source: /note="Description of Artificial Sequence: Synthetic polypeptide"
  source: /note="p.N495D"
GGRWFPEGPTHMLPLLMRALPGVDPDDDFSKCMITFQFIATFSTLVPLVDCS

SEQ ID NO: 2643 - protein, 52 aa, Artificial Sequence
  source: /note="Description of Artificial Sequence: Synthetic polypeptide"
  source: /note="p.V145I"
IRELVSRLQERNVQVFLISGGFRSIIIEHVASKLNIPATNVFANRLKFYFNG

SEQ ID NO: 2644 - protein, 52 aa, Artificial Sequence
  source: /note="Description of Artificial Sequence: Synthetic polypeptide"
  source: /note="p.P689H"
LRTEYDPHTHVYYTTAEPRSEISVQHHVTVTQDTLSCQSPESTSSTRDLLSQ

SEQ ID NO: 2645 - protein, 88 aa, Artificial Sequence
  source: /note="Description of Artificial Sequence: Synthetic polypeptide"
  source: /note="p.P1307fs"
RQQPHLDSGSLPPGRQGQQPRRDPPEKACGHPPTDRAETLLKFLLKGILALAIGPAGALAGPVLTTLGTQRPLPWAAPCPATASPSPL

SEQ ID NO: 2646 - protein, 42 aa, Artificial Sequence
  source: /note="Description of Artificial Sequence: Synthetic polypeptide"
  source: /note="p.F588fs"
KKFCCFPFGSVPDEHGTDIHPISLFLETILAPFSQGVSPSIL

SEQ ID NO: 2647 - protein, 52 aa, Artificial Sequence
  source: /note="Description of Artificial Sequence: Synthetic polypeptide"
  source: /note="p.R130G"
CEDLDQWLSEDDNHVAAIHCKAGKGGGTGVMICAYLLHRGKFLKAQEALDFY

SEQ ID NO: 2648 - protein, 52 aa, Artificial Sequence
  source: /note="Description of Artificial Sequence: Synthetic polypeptide"
  source: /note="p.R130Q"
CEDLDQWLSEDDNHVAAIHCKAGKGQQTGVMICAYLLHRGKFLKAQEALDFY

SEQ ID NO: 2649 - protein, 52 aa, Artificial Sequence
  source: /note="Description of Artificial Sequence: Synthetic polypeptide"
  source: /note="p.R130P"
CEDLDQWLSEDDNHVAAIHCKAGKGPPTGVMICAYLLHRGKFLKAQEALDFY

SEQ ID NO: 2650 - protein, 52 aa, Artificial Sequence
  source: /note="Description of Artificial Sequence: Synthetic polypeptide"
  source: /note="p.R130L"
CEDLDQWLSEDDNHVAAIHCKAGKGLLTGVMICAYLLHRGKFLKAQEALDFY

SEQ ID NO: 2651 - protein, 52 aa, Artificial Sequence
  source: /note="Description of Artificial Sequence: Synthetic polypeptide"
  source: /note="p.C136Y"
WLSEDDNHVAAIHCKAGKGRTGVMIYYAYLLHRGKFLKAQEALDFYGEVRTR

SEQ ID NO: 2652 - protein, 52 aa, Artificial Sequence
  source: /note="Description of Artificial Sequence: Synthetic polypeptide"
  source: /note="p.S170N"
FLKAQEALDFYGEVRTRDKKGVTIPNNQRRYVYYYSYLLKNHLDYRPVALLF

SEQ ID NO: 2653 - protein, 52 aa, Artificial Sequence
  source: /note="Description of Artificial Sequence: Synthetic polypeptide"
  source: /note="p.R173H"
AQEALDFYGEVRTRDKKGVTIPSQRHHYVYYYSYLLKNHLDYRPVALLFHKM

SEQ ID NO: 2654 - protein, 52 aa, Artificial Sequence
  source: /note="Description of Artificial Sequence: Synthetic polypeptide"
  source: /note="p.R234L"
GTCNPQFVVCQLKVKIYSSNSGPTRLLEDKFMYFEFPQPLPVCGDIKVEFFH

SEQ ID NO: 2655 - protein, 33 aa, Artificial Sequence
  source: /note="Description of Artificial Sequence: Synthetic polypeptide"
  source: /note="p.L265fs"
EFPQPLPVCGDIKVEFFHKQNKMLKRTKCFTFG

SEQ ID NO: 2656 - protein, 52 aa, Artificial Sequence
  source: /note="Description of Artificial Sequence: Synthetic polypeptide"
  source: /note="p.T277I"
DIKVEFFHKQNKMLKKDKMFHFWVNIIFFIPGPEETSEKVENGSLCDQEIDS

SEQ ID NO: 2657 - protein, 52 aa, Artificial Sequence
  source: /note="Description of Artificial Sequence: Synthetic polypeptide"
  source: /note="p.E40A"
GYPTNSDFELKTAELPPLKNGEVLLAAALFLTVDPYMRVAAKRLKEGDTMMG

SEQ ID NO: 2658 - protein, 48 aa, Artificial Sequence
  source: /note="Description of Artificial Sequence: Synthetic polypeptide"
  source: /note="p.L22V"
METRQVSRSPRVRLLLLLLLLVVVVPWGVRTASGVALPPVGVLSLRPP

SEQ ID NO: 2659 - protein, 52 aa, Artificial Sequence
  source: /note="Description of Artificial Sequence: Synthetic polypeptide"
  source: /note="p.R430W"
AVAADFDNRGMIFSNEQQFDPLWKRWWNVECLQPLTHLKRRLSYSDSDLKRA

SEQ ID NO: 2660 - protein, 52 aa, Artificial Sequence
  source: /note="Description of Artificial Sequence: Synthetic polypeptide"
  source: /note="p.G503V"
IIREKGVDCDIDVPKTIQMVRSQRSVVMVQTEAQYRFIYMAVQHYIETLQRR

SEQ ID NO: 2661 - protein, 52 aa, Artificial Sequence
  source: /note="Description of Artificial Sequence: Synthetic polypeptide"
  source: /note="p.E76K"
VTHIKIQNTGDYYDLYGGEKFATLAKKLVQYYMEHHGQLKEKNGDVIELKYP

SEQ ID NO: 2662 - protein, 42 aa, Artificial Sequence
  source: /note="Description of Artificial Sequence: Synthetic polypeptide"
  source: /note="p.R765Q"
PPTFSDKREQISENPTEATDIGFGNQQCGKPKGPRDPPSEWT

SEQ ID NO: 2663 - protein, 52 aa, Artificial Sequence
  source: /note="Description of Artificial Sequence: Synthetic polypeptide"
  source: /note="p.S887L"
SYQHKFQLQMRARQSNQDAQDIERALLFRSLNLQAESVRGFNMGRAISTGSL

SEQ ID NO: 2664 - protein, 52 aa, Artificial Sequence
  source: /note="Description of Artificial Sequence: Synthetic polypeptide"
  source: /note="p.E2067K"
YIQEDDIYDDSQEAEVIQSLLDVVDKKEAQNLLNENNAAGYSCGPGTLKMNG

SEQ ID NO: 2665 - protein, 53 aa, Artificial Sequence
  source: /note="Description of Artificial Sequence: Synthetic polypeptide"
  source: /note="p.E716del"
QYHHKKTFSDATMLIHSSESEEEEEAPESVPQIPMLREKMEYSAQLQAALARI

SEQ ID NO: 2666 - protein, 52 aa, Artificial Sequence
  source: /note="Description of Artificial Sequence: Synthetic polypeptide"
  source: /note="p.E286K"
THNKSTILVELINKEETALFHTDDIKKNAKYISRLFATRHKFYKQNKICTEQ

SEQ ID NO: 2667 - protein, 56 aa, Artificial Sequence
  source: /note="Description of Artificial Sequence: Synthetic polypeptide"
  source: /note="p.TG378del"
TYAVVQKRGAPAGAGSGTQTGTGTGARSAEEAPLYSKVTPRAQRPGAHAEDARGTL

SEQ ID NO: 2668 - protein, 31 aa, Artificial Sequence
  source: /note="Description of Artificial Sequence: Synthetic polypeptide"
  source: /note="p.N319fs"
NLWKACVEHHTFFRLDRPLPPQKNFLHIILH

SEQ ID NO: 2669 - protein, 52 aa, Artificial Sequence
  source: /note="Description of Artificial Sequence: Synthetic polypeptide"
  source: /note="p.Q726H"
SLTPGRLYTVTITTRSGKYENHSFSHHERTVPDKVQGVSVSNSARSDYLRVS

SEQ ID NO: 2670 - protein, 52 aa, Artificial Sequence
  source: /note="Description of Artificial Sequence: Synthetic polypeptide"
  source: /note="p.D1560N"
ENPNSNSKSFNIKLGAEMESLGGKCNNPTQQKFCDGPLKPHTAYRISIRAFT

SEQ ID NO: 2671 - protein, 52 aa, Artificial Sequence
  source: /note="Description of Artificial Sequence: Synthetic polypeptide"
  source: /note="p.Q895H"
GLEAENKVDVYGYVVKLRRQRCLMVHHVEAQYILIHQALVEYNQFGETEVNL

SEQ ID NO: 2672 - protein, 52 aa, Artificial Sequence
  source: /note="Description of Artificial Sequence: Synthetic polypeptide"
  source: /note="p.R1174Q"
PRWSTPEELELDELLEAIEQGGEEQQQRRRRQAERLKPYVAAQLDVLPETFT

SEQ ID NO: 2673 - protein, 52 aa, Artificial Sequence
  source: /note="Description of Artificial Sequence: Synthetic polypeptide"
  source: /note="p.G334W"
HDESLVGPVDPSSGQQSRDTEVLLVWWLEPGTRYNATVYSQAANGTEGQPQA

SEQ ID NO: 2674 - protein, 52 aa, Artificial Sequence
  source: /note="Description of Artificial Sequence: Synthetic polypeptide"
  source: /note="p.R928L"
SWDTAKEDENRNKNRYGNIISYDHSLLVRLLVLDGDPHSDYINANYIDGYHR

SEQ ID NO: 2675 - protein, 30 aa, Artificial Sequence
  source: /note="Description of Artificial Sequence: Synthetic polypeptide"
  source: /note="p.P1075fs"
WPDHGVPCYATGLLGFVRQVKFLNPRKLGP

SEQ ID NO: 2676 - protein, 52 aa, Artificial Sequence
  source: /note="Description of Artificial Sequence: Synthetic polypeptide"
  source: /note="p.P559S"
VNVPGPRRTISKLRNETYHVFSNLHSSGTTYLFSVRARTGKGFGQAALTEIT

SEQ ID NO: 2677 - protein, 39 aa, Artificial Sequence
  source: /note="Description of Artificial Sequence: Synthetic polypeptide"
  source: /note="p.D1434N"
FFAAKTLRNYKPNMVETMDQYHFCYNNVALEYLEGLESR

SEQ ID NO: 2678 - protein, 52 aa, Artificial Sequence
  source: /note="Description of Artificial Sequence: Synthetic polypeptide"
  source: /note="p.S396L"
VMAAQAPGVITGVTPARPPIPVTIPLLVGVVNPILASPPTLGLLEPKKEKEE

SEQ ID NO: 2679 - protein, 52 aa, Artificial Sequence
  source: /note="Description of Artificial Sequence: Synthetic polypeptide"
  source: /note="p.A358T"
LDPQEDSGKQVDLVSASVVVVGVIATTLLFCLLVVVVVLMSRYHRRKAQQMT

SEQ ID NO: 2680 - protein, 124 aa, Artificial Sequence
  source: /note="Description of Artificial Sequence: Synthetic polypeptide"
  source: /note="p.S84fs"
PVNDSHGRAPEEGDAEVMQLGSSSPLLPAGFSPPRPPAPSHPRPSCRRCPPEACPRTLPTSKAPPSLTRCGSGTRTSCGCPSRRPGPSSARGGVCPATATRGASSSAPSACGRARCSVRSARAR

SEQ ID NO: 2681 - protein, 52 aa, Artificial Sequence
  source: /note="Description of Artificial Sequence: Synthetic polypeptide"
  source: /note="p.T1312M"
IPKVDLRVWQDCCADCRSRGQFRAVMMQESQKKRSAQYSYPVDKDMELSHLR

SEQ ID NO: 2682 - protein, 34 aa, Artificial Sequence
  source: /note="Description of Artificial Sequence: Synthetic polypeptide"
  source: /note="p.P1456T"
CPPAPCPSPELVKGTCCPVCRDRGMTTSDSPEKR

SEQ ID NO: 2683 - protein, 35 aa, Artificial Sequence
  source: /note="Description of Artificial Sequence: Synthetic polypeptide"
  source: /note="p.Q150fs"
GPQPLRRQPPPFPPNPMGPAFNMPPRVLATHPQAT

SEQ ID NO: 2684 - protein, 52 aa, Artificial Sequence
  source: /note="Description of Artificial Sequence: Synthetic polypeptide"
  source: /note="p.G148A"
NRLTAKGAEETLGPQKRKKPSEEETAATKRSKMSKEQTRPSCSAGASTSTAM

SEQ ID NO: 2685 - protein, 52 aa, Artificial Sequence
  source: /note="Description of Artificial Sequence: Synthetic polypeptide"
  source: /note="p.S226L"
AHCGLVGFKPSYGLVSRHGLIPLVNLLMDVPGILTRCVDDAAIVLGALAGPD

SEQ ID NO: 2686 - protein, 52 aa, Artificial Sequence
  source: /note="Description of Artificial Sequence: Synthetic polypeptide"
  source: /note="p.R401L"
DDRKEGAVLAKKVNWIGCQGSEPHFLLGFPCSLWVLFHFLTVQAARQNVDHS

SEQ ID NO: 2687 - protein, 42 aa, Artificial Sequence
  source: /note="Description of Artificial Sequence: Synthetic polypeptide"
  source: /note="p.R683L"
SLDMSLCVVLYVASSLFLMVMYFFFLLVRSRRWKVKHHHPAV

SEQ ID NO: 2688 - protein, 52 aa, Artificial Sequence
  source: /note="Description of Artificial Sequence: Synthetic polypeptide"
  source: /note="p.S588N"
MPNQQQAAYQGMIGVQQPQNQGLLSNNQRSSMGGQMQGLVVQYTPLPSYQVP

SEQ ID NO: 2689 - protein, 52 aa, Artificial Sequence
  source: /note="Description of Artificial Sequence: Synthetic polypeptide"
  source: /note="p.S592G"
QQAAYQGMIGVQQPQNQGLLSSQRSGGMGGQMQGLVVQYTPLPSYQVPVGSD

SEQ ID NO: 2690 - protein, 52 aa, Artificial Sequence
  source: /note="Description of Artificial Sequence: Synthetic polypeptide"
  source: /note="p.R206W"
EFINDNNNQFKKFPQMTSYHRMLLHWWVAAYFGMDHNVDQTGKAVIINKTSN

SEQ ID NO: 2691 - protein, 52 aa, Artificial Sequence
  source: /note="Description of Artificial Sequence: Synthetic polypeptide"
  source: /note="p.S596L"
SLYEAKNLFAAQTKAQSLAAEIDTALLRDELMEALKEQEEINFRLRQYMDKI

SEQ ID NO: 2692 - protein, 52 aa, Artificial Sequence
  source: /note="Description of Artificial Sequence: Synthetic polypeptide"
  source: /note="p.R170H"
WYKLHSKPGKKEKERGEIEVTIQFTHHNNLSASMFDLSMKDKPRSPFSKIRD

SEQ ID NO: 2693 - protein, 52 aa, Artificial Sequence
  source: /note="Description of Artificial Sequence: Synthetic polypeptide"
  source: /note="p.R167L"
EHGIRFFETSAKSSMNVDEAFSSLALLDILLKSGGRRSGNGNKPPSTDLKTC

SEQ ID NO: 2694 - protein, 52 aa, Artificial Sequence
  source: /note="Description of Artificial Sequence: Synthetic polypeptide"
  source: /note="p.R79W"
YEIVRLQLWDIAGQERFTSMTRLYYWWDASACVIMFDVTNATTFSNSQRWKQ

SEQ ID NO: 2695 - protein, 46 aa, Artificial Sequence
  source: /note="Description of Artificial Sequence: Synthetic polypeptide"
  source: /note="p.G20W"
MAKTYDYLFKLLLIGDSGVWWKTCVLFRFSEDAFNSTFISTIGIDF

SEQ ID NO: 2696 - protein, 31 aa, Artificial Sequence
  source: /note="Description of Artificial Sequence: Synthetic polypeptide"
  source: /note="p.K928fs"
LEEESAQLKEMCRRELDKAESEIKKKQFYHW

SEQ ID NO: 2697 - protein, 39 aa, Artificial Sequence
  source: /note="Description of Artificial Sequence: Synthetic polypeptide"
  source: /note="p.K928fs"
LEEESAQLKEMCRRELDKAESEIKKTVLSLVTISRFVLS

SEQ ID NO: 2698 - protein, 52 aa, Artificial Sequence
  source: /note="Description of Artificial Sequence: Synthetic polypeptide"
  source: /note="p.N207D"
PASADDFLPTLIYIVLKGNPPRLQSDDIQYITRFCNPSRLMTGEDGYYFTNL

SEQ ID NO: 2699 - protein, 52 aa, Artificial Sequence
  source: /note="Description of Artificial Sequence: Synthetic polypeptide"
  source: /note="p.P34R"
VGDGAVGKTCLLISYTTNAFPGEYIRRTVFDNYSANVMVDGKPVNLGLWDTA

SEQ ID NO: 2700 - protein, 52 aa, Artificial Sequence
  source: /note="Description of Artificial Sequence: Synthetic polypeptide"
  source: /note="p.A159V"
LTPITYPQGLAMAKEIGAVKYLECSVVLTQRGLKTVFDEAIRAVLCPPPVKK

SEQ ID NO: 2701 - protein, 52 aa, Artificial Sequence
  source: /note="Description of Artificial Sequence: Synthetic polypeptide"
  source: /note="p.P29S"
IKCVVVGDGAVGKTCLLISYTTNAFSSGEYIPTVFDNYSANVMVDGKPVNLG

SEQ ID NO: 2702 - protein, 52 aa, Artificial Sequence
  source: /note="Description of Artificial Sequence: Synthetic polypeptide"
  source: /note="p.D69Y"
TIIECLKYICTGDFPPGTKGNTFVHYYPKVAQETDVRAQIRLQFRDVNGELI

SEQ ID NO: 2703 - protein, 26 aa, Artificial Sequence
  source: /note="Description of Artificial Sequence: Synthetic peptide"
  source: /note="p.T316fs"
RDFTNIYWSQNRPDVKKQKLQNDKKL

SEQ ID NO: 2704 - protein, 52 aa, Artificial Sequence
  source: /note="Description of Artificial Sequence: Synthetic polypeptide"
  source: /note="p.D167N"
VQIPECFGGVAGEAVFIDTEGSFMVNNRVVDLATACIQHLQLIAEKHKGEEH

SEQ ID NO: 2705 - protein, 52 aa, Artificial Sequence
  source: /note="Description of Artificial Sequence: Synthetic polypeptide"
  source: /note="p.Y224H"
FTLDNILSHIYYFRCRDYTELLAQVHHLLPDFLSEHSKVRLVIVDGIAFPFR

SEQ ID NO: 2706 - protein, 52 aa, Artificial Sequence
  source: /note="Description of Artificial Sequence: Synthetic polypeptide"
  source: /note="p.S257L"
YSTPHAFTFNTSSPSSEGSLSQRQRLLTSTPNVHMVSTTLPVDSRMIEDAIR

SEQ ID NO: 2707 - protein, 52 aa, Artificial Sequence
  source: /note="Description of Artificial Sequence: Synthetic polypeptide"
  source: /note="p.R398C"
LTEREPSSSSLCSIDEEHLTDIEIVCCRVFSSKRSNVNFVTEIFRQAFLLPI

SEQ ID NO: 2708 - protein, 35 aa, Artificial Sequence
  source: /note="Description of Artificial Sequence: Synthetic polypeptide"
  source: /note="p.T379fs"
RSDSAPPTPVNRLSMPQSAAVSTTPHITGGTGLLL

SEQ ID NO: 2709 - protein, 52 aa, Artificial Sequence
  source: /note="Description of Artificial Sequence: Synthetic polypeptide"
  source: /note="p.R381Q"
SKSATFPSEKARHLLDDSVLESRSPQQRGLALTSSSAVTNGLSLGSSESSEF

SEQ ID NO: 2710 - protein, 52 aa, Artificial Sequence
  source: /note="Description of Artificial Sequence: Synthetic polypeptide"
  source: /note="p.M900I"
HSDLLQYRKLSQSYYPLLECLTQDHIISFIINLEPPVLMYVLTSISEGLTTL

SEQ ID NO: 2711 - protein, 52 aa, Artificial Sequence
  source: /note="Description of Artificial Sequence: Synthetic polypeptide"
  source: /note="p.R1231C"
VESKEWKERGIGNVKILRHKTSGKICCLLMRREQVLKICANHYISPDMKLTP

SEQ ID NO: 2712 - protein, 52 aa, Artificial Sequence
  source: /note="Description of Artificial Sequence: Synthetic polypeptide"
  source: /note="p.L386W"
EATPEKESLAESAAAYTKATARKCLWWEKVEVITGEEAESNVLQMQCKLFVF

SEQ ID NO: 2713 - protein, 52 aa, Artificial Sequence
  source: /note="Description of Artificial Sequence: Synthetic polypeptide"
  source: /note="p.R915W"
QWGLCIFDDIIEHCSPTSFKYVEYFWWWPMLLNMRDNNPEVRQAAAYGLGVM

SEQ ID NO: 2714 - protein, 52 aa, Artificial Sequence
  source: /note="Description of Artificial Sequence: Synthetic polypeptide"
  source: /note="p.I984L"
LVKVIKCANSKTKKNVIATENCISALLGKILKFKPNCVNVDEVLPHWLSWLP

SEQ ID NO: 2715 - protein, 52 aa, Artificial Sequence
  source: /note="Description of Artificial Sequence: Synthetic polypeptide"
  source: /note="p.R356L"
LPGKFKNLFRKFENLTDPCRNHKSYLLEVISKMKPPVIPFVPLILKDLTFLH

SEQ ID NO: 2716 - protein, 32 aa, Artificial Sequence
  source: /note="Description of Artificial Sequence: Synthetic polypeptide"
  source: /note="p.R6C"
MACGFCCRAIACQLSRVLNLPPENLITSISAV

SEQ ID NO: 2717 - protein, 52 aa, Artificial Sequence
  source: /note="Description of Artificial Sequence: Synthetic polypeptide"
  source: /note="p.R82H"
VSTQPAPRSIFRRVLSAPPKESRTSHHLRLSKALWGRHKNPPPEPDPEPEQE

SEQ ID NO: 2718 - protein, 52 aa, Artificial Sequence
  source: /note="Description of Artificial Sequence: Synthetic polypeptide"
  source: /note="p.A188T"
LAALRQGPEGLVGADKPISYRTKPPTTSIHRELLGVCSDPYTLAQQLTHVEL

SEQ ID NO: 2719 - protein, 52 aa, Artificial Sequence
  source: /note="Description of Artificial Sequence: Synthetic polypeptide"
  source: /note="p.R601C"
ATLLALCVQHSARELELGHLPRLLGCCLARLIKEAVWEKIKEIGDRQPENHP

SEQ ID NO: 2720 - protein, 37 aa, Artificial Sequence
  source: /note="Description of Artificial Sequence: Synthetic polypeptide"
  source: /note="p.N316fs"
FKNFIPFMNSLGLVTSNGLPEVENLNDTKKFILKIKI

SEQ ID NO: 2721 - protein, 52 aa, Artificial Sequence
  source: /note="Description of Artificial Sequence: Synthetic polypeptide"
  source: /note="p.E330K"
NLKLKLHSFESHKDEIFQVQWSPHNKKTILASSGTDRRLNVWDLSKIGEEQS

SEQ ID NO: 2722 - protein, 52 aa, Artificial Sequence
  source: /note="Description of Artificial Sequence: Synthetic polypeptide"
  source: /note="p.E274K"
QKLMIWDTRSNTTSKPSHLVDAHTAKKVNCLSFNPYSEFILATGSADKTVAL

SEQ ID NO: 2723 - protein, 52 aa, Artificial Sequence
  source: /note="Description of Artificial Sequence: Synthetic polypeptide"
  source: /note="p.E313K"
LATGSADKTVALWDLRNLKLKLHTFKKSHKDEIFQVHWSPHNETILASSGTD

SEQ ID NO: 2724 - protein, 52 aa, Artificial Sequence
  source: /note="Description of Artificial Sequence: Synthetic polypeptide"
  source: /note="p.A340T"
NTYIPLISLPLVPGFPYPTAATTAATTFRGAHLRGRGRTVYGAVRAVPPTAI

SEQ ID NO: 2725 - protein, 52 aa, Artificial Sequence
  source: /note="Description of Artificial Sequence: Synthetic polypeptide"
  source: /note="p.E127K"
VSKGTVEGNYVSLTRILKCSEQSLIKKFFNKMKKWEDMANLPPHFRERTERL

SEQ ID NO: 2726 - protein, 71 aa, Artificial Sequence
  source: /note="Description of Artificial Sequence: Synthetic polypeptide"
  source: /note="p.AAAAAAA286del"
LTSTSLDPYDRHLLPTSGAAATAAAVTAASTSYYGRDRSPLRRATAPVPTVGEGYGYGHESELSQASAAAR

SEQ ID NO: 2727 - protein, 52 aa, Artificial Sequence
  source: /note="Description of Artificial Sequence: Synthetic polypeptide"
  source: /note="p.G390W"
FREKNVPTTKGAPKNTTKSWQGRILWWENEEEEDLAESGRLFVRNLPYTSTE

SEQ ID NO: 2728 - protein, 52 aa, Artificial Sequence
  source: /note="Description of Artificial Sequence: Synthetic polypeptide"
  source: /note="p.P644A"
TTSPKPLVQQPILPVVKQSVKERLGAAVPSSTIEPAEAQSASSDLPQNVTKL

SEQ ID NO: 2729 - protein, 52 aa, Artificial Sequence
  source: /note="Description of Artificial Sequence: Synthetic polypeptide"
  source: /note="p.T353I"
ERTDASSASSFLDSDELERTGIDLGIITGRLQLMARLAEGTGLQIPPAAQQA

SEQ ID NO: 2730 - protein, 72 aa, Artificial Sequence
  source: /note="Description of Artificial Sequence: Synthetic polypeptide"
  source: /note="p.495_502AAAAAAAA>A"
HTVEHMISPIAVQPDPASAAAAAAAAVIPTVSTPPPFQGRPITPVYTVAPNVQRIPTAGIYGASYVPFAAPA

SEQ ID NO: 2731 - protein, 52 aa, Artificial Sequence
  source: /note="Description of Artificial Sequence: Synthetic polypeptide"
  source: /note="p.V675G"
RQDGESKTIMLKRIYRSTPPEVIVEGGLEPYVRLTTANVRIIKNRTGPMGHT

SEQ ID NO: 2732 - protein, 30 aa, Artificial Sequence
  source: /note="Description of Artificial Sequence: Synthetic polypeptide"
  source: /note="p.R96fs"
SYGARDGPHGDYRGGEGPGHDFRGGRFFVF

SEQ ID NO: 2733 - protein, 52 aa, Artificial Sequence
  source: /note="Description of Artificial Sequence: Synthetic polypeptide"
  source: /note="p.P112Q"
HDCSVLRGIGYYLESLLCLAPFMKHQQLKIVLRGVTNDQVDPSVDVLKATAL

SEQ ID NO: 2734 - protein, 52 aa, Artificial Sequence
  source: /note="Description of Artificial Sequence: Synthetic polypeptide"
  source: /note="p.A198V"
LLQFNIFISLVEPGPVVTEFEGKLLVVQVSMAEFPGTDPETLHYFRDLYLPA

SEQ ID NO: 2735 - protein, 52 aa, Artificial Sequence
  source: /note="Description of Artificial Sequence: Synthetic polypeptide"
  source: /note="p.W57L"
PRISCPEGTNAYRSYCYYFNEDPETLLVDADLYCQNMNSGNLVSVLTQAEGA

SEQ ID NO: 2736 - protein, 52 aa, Artificial Sequence
  source: /note="Description of Artificial Sequence: Synthetic polypeptide"
  source: /note="p.M67I"
AYRSYCYYFNEDPETWVDADLYCQNIINSGNLVSVLTQAEGAFVASLIKESS

SEQ ID NO: 2737 - protein, 52 aa, Artificial Sequence
  source: /note="Description of Artificial Sequence: Synthetic polypeptide"
  source: /note="p.S150L"
SDVMNYFAWERNPSTISSPGHCASLLLRSTAFLRWKDYNCNVRLPYVCKFTD

SEQ ID NO: 2738 - protein, 52 aa, Artificial Sequence
  source: /note="Description of Artificial Sequence: Synthetic polypeptide"
  source: /note="p.G110V"
GYQRSQPIWIGLHDPQKRQQWQWIDVVAMYLYRSWSGKSMGGNKHCAEMSSN

SEQ ID NO: 2739 - protein, 44 aa, Artificial Sequence
  source: /note="Description of Artificial Sequence: Synthetic polypeptide"
  source: /note="p.15_16LL>L"
MDGWRRMPRWGLLLLLWGSCTFGLPTDTTTFKRIFLKRMPSIRE

SEQ ID NO: 2740 - protein, 52 aa, Artificial Sequence
  source: /note="Description of Artificial Sequence: Synthetic polypeptide"
  source: /note="p.K176N"
PACSLPVASQPPQHLSEAGRGPVGSNNRDHLLMNVKWYYRQSEVPDSVYQHL

SEQ ID NO: 2741 - protein, 52 aa, Artificial Sequence
  source: /note="Description of Artificial Sequence: Synthetic polypeptide"
  source: /note="p.A30S"
RIVTADYYMASPLQGLDTCQSPLTQSSPVKKVPVVRVFGATPAGQKTCLHLH

SEQ ID NO: 2742 - protein, 52 aa, Artificial Sequence
  source: /note="Description of Artificial Sequence: Synthetic polypeptide"
  source: /note="p.I82N"
RELYGVGVEKLRIEHQTITTPSKKKNNEISTIASNYHLEVNPSDAGNSDRVV

SEQ ID NO: 2743 - protein, 36 aa, Artificial Sequence
  source: /note="Description of Artificial Sequence: Synthetic polypeptide"
  source: /note="p.K296N"
LLEVRGRLYELLTHCIPPEIIMKACNNEESRSCDIF

SEQ ID NO: 2744 - protein, 52 aa, Artificial Sequence
  source: /note="Description of Artificial Sequence: Synthetic polypeptide"
  source: /note="p.S63R"
AWTGMGLRAAPSSAAAAAAEVEQRRRRPGLCPPPLELLLLLLFSLGLLHAGD

SEQ ID NO: 2745 - protein, 52 aa, Artificial Sequence
  source: /note="Description of Artificial Sequence: Synthetic polypeptide"
  source: /note="p.W366L"
LKDQVGRDQFLRFLESEFSSENLRFLLLAVQDLKKQPLQDVAKRVEEIWQEF

SEQ ID NO: 2746 - protein, 52 aa, Artificial Sequence
  source: /note="Description of Artificial Sequence: Synthetic polypeptide"
  source: /note="p.R44C"
PNMLVYRKMEDVIARMQDEKNGIPICCTVKSFLSKIPSVFSGSDIVQWLIKN

SEQ ID NO: 2747 - protein, 52 aa, Artificial Sequence
  source: /note="Description of Artificial Sequence: Synthetic polypeptide"
  source: /note="p.A96S"
ERAEFERLWVAFSGCLDLLEADMRRSSLELGAAFPLHAPRRPLVRTGVAGAS

SEQ ID NO: 2748 - protein, 52 aa, Artificial Sequence
  source: /note="Description of Artificial Sequence: Synthetic polypeptide"
  source: /note="p.V222I"
HTKMTMAKEEACHGLMQEYETRLYSIICYTHIGGLPLNMSIKKCHHFQKRYS

SEQ ID NO: 2749 - protein, 126 aa, Artificial Sequence
  source: /note="Description of Artificial Sequence: Synthetic polypeptide"
  source: /note="p.G34fs"
SPALPLASSVLMLLMSTLWLVGAGPRPGPGPGAVAGPLAGAPAADPCPGPHGPARPAPEPAAPAHCGLAAGVPPGHAEIPACLSPARPGFWAAGSAAGRPWAVQCSRQLWIHACPPGHAGWGGTPP

SEQ ID NO: 2750 - protein, 52 aa, Artificial Sequence
  source: /note="Description of Artificial Sequence: Synthetic polypeptide"
  source: /note="p.Y35N"
AILGYRSVGKSSLTIQFVEGQFVDSNNDPTIENTFTKLITVNGQEYHLQLVD

SEQ ID NO: 2751 - protein, 52 aa, Artificial Sequence
  source: /note="Description of Artificial Sequence: Synthetic polypeptide"
  source: /note="p.E40Q"
ACGKTCLLIVFSKDQFPEVYVPTVFQQNYVADIEVDGKQVELALWDTAGQED

SEQ ID NO: 2752 - protein, 52 aa, Artificial Sequence
  source: /note="Description of Artificial Sequence: Synthetic polypeptide"
  source: /note="p.Y42C"
GKTCLLIVFSKDQFPEVYVPTVFENCCVADIEVDGKQVELALWDTAGQEDYD

SEQ ID NO: 2753 - protein, 52 aa, Artificial Sequence
  source: /note="Description of Artificial Sequence: Synthetic polypeptide"
  source: /note="p.T464M"
VLEMFDLRMMVENIMNKEAFMNQEIMMKAFHVRKANRIKECLSKGTFSDVTF

SEQ ID NO: 2754 - protein, 52 aa, Artificial Sequence
  source: /note="Description of Artificial Sequence: Synthetic polypeptide"
  source: /note="p.V73M"
LKAVRMRTGAENLLKVATNSKVREQMMRLELSFVNSDLQMLKEELEGLNISV

SEQ ID NO: 2755 - protein, 52 aa, Artificial Sequence
  source: /note="Description of Artificial Sequence: Synthetic polypeptide"
  source: /note="p.S358R"
RIPQPPPIAHPRTSPQPESGIKRLFRRFFSRDKKRLANTQRNVHIQESFGQW

SEQ ID NO: 2756 - protein, 52 aa, Artificial Sequence
  source: /note="Description of Artificial Sequence: Synthetic polypeptide"
  source: /note="p.R830H"
FPRGSAGPQRSRPVTVPSIDDYGRDHHLSPDFYEESETDPGAEELPARIFVA

SEQ ID NO: 2757 - protein, 53 aa, Artificial Sequence
  source: /note="Description of Artificial Sequence: Synthetic polypeptide"
  source: /note="p.A396del"
HELIKLNWLLAKALWVLARRCYTLQENKQLRRAGCPYQADEKVKRLKVKRAEL

SEQ ID NO: 2758 - protein, 52 aa, Artificial Sequence
  source: /note="Description of Artificial Sequence: Synthetic polypeptide"
  source: /note="p.Q1154R"
YADGLKVCEVADATAGSTLLEFSQLRRVPLTWQKVSVRTMSLCGESLDSVPA

SEQ ID NO: 2759 - protein, 27 aa, Artificial Sequence
  source: /note="Description of Artificial Sequence: Synthetic peptide"
  source: /note="p.V401fs"
LGLKVVGGKMTESGRLCAFITKVKKEV

SEQ ID NO: 2760 - protein, 52 aa, Artificial Sequence
  source: /note="Description of Artificial Sequence: Synthetic polypeptide"
  source: /note="p.R55L"
EREEYSQYATSDTAMPRSPSDYADRLLSQHEPQFYEDSDHLSYRDSNRRSHR

SEQ ID NO: 2761 - protein, 52 aa, Artificial Sequence
  source: /note="Description of Artificial Sequence: Synthetic polypeptide"
  source: /note="p.R599Q"
KRRTKTVKKTLEPKWNQTFIYSPVHQQREFRERMLEITLWDQARVREEESEF

SEQ ID NO: 2762 - protein, 52 aa, Artificial Sequence
  source: /note="Description of Artificial Sequence: Synthetic polypeptide"
  source: /note="p.L449V"
DTPRESTEQGQDTEVKASDPHSMPEVVPRTAKQPPVPPPRKKRISRQLASTL

SEQ ID NO: 2763 - protein, 52 aa, Artificial Sequence
  source: /note="Description of Artificial Sequence: Synthetic polypeptide"
  source: /note="p.S708L"
LYKCVLKPLKEAINSCLHQIHSKDGLLLQQLKENQLVILATTTTDLGVTTSV

SEQ ID NO: 2764 - protein, 38 aa, Artificial Sequence
  source: /note="Description of Artificial Sequence: Synthetic polypeptide"
  source: /note="p.G171fs"
QAMHRAQRVRRPIPGSDQTTTMSGGKESPGREKGMEKM

SEQ ID NO: 2765 - protein, 52 aa, Artificial Sequence
  source: /note="Description of Artificial Sequence: Synthetic polypeptide"
  source: /note="p.P402L"
RRRQTALRAGAGPPGAQGPGPEGQSLLAPALRSRIHERLAHLHAACAPRRKV

SEQ ID NO: 2766 - protein, 52 aa, Artificial Sequence
  source: /note="Description of Artificial Sequence: Synthetic polypeptide"
  source: /note="p.L107fs"
SKMQLEEQVLTISSEIPKRIRSALKMQKNQSNFLISFWSRKLISSAPLTAIC

SEQ ID NO: 2767 - protein, 52 aa, Artificial Sequence
  source: /note="Description of Artificial Sequence: Synthetic polypeptide"
  source: /note="p.M90I"
DDEPANLDILDTAGQAEFTAMRDQYIIRAGEGFIICYSITDRRSFHEVREFK

SEQ ID NO: 2768 - protein, 52 aa, Artificial Sequence
  source: /note="Description of Artificial Sequence: Synthetic polypeptide"
  source: /note="p.R85L"
QVRIDNEPAYLDILDTAGQAEFTAMLLEQYMRGGEGFIICYSVTDRQSFQEA

SEQ ID NO: 2769 - protein, 52 aa, Artificial Sequence
  source: /note="Description of Artificial Sequence: Synthetic polypeptide"
  source: /note="p.A72V"
KAKDELNEREETREEAVRELQEMVQVVQAASGEELAVAVAERVQEKDSGFFL

SEQ ID NO: 2770 - protein, 52 aa, Artificial Sequence
  source: /note="Description of Artificial Sequence: Synthetic polypeptide"
  source: /note="p.D281N"
PFLKSKLLERVFVHGDDLSGFYQEINNENILPSDFGGTLPKYDGKAVAEQLF

SEQ ID NO: 2771 - protein, 52 aa, Artificial Sequence
  source: /note="Description of Artificial Sequence: Synthetic polypeptide"
  source: /note="p.S501L"
SPSSSSGGESSETSSDLFEGSNEGSLLSSGSSGARREGRHRAPVTFDESGSL

SEQ ID NO: 2772 - protein, 52 aa, Artificial Sequence
  source: /note="Description of Artificial Sequence: Synthetic polypeptide"
  source: /note="p.S138C"
QQHVPVLKDSSLLFEEFKKLIRNRQCCEAADSSPSELKYLGLDTHSRKKRQL

SEQ ID NO: 2773 - protein, 52 aa, Artificial Sequence
  source: /note="Description of Artificial Sequence: Synthetic polypeptide"
  source: /note="p.A127V"
HSFPNRSRFWKHEWEKHGTCAAQVDVVLNSQKKYFGRSLELYRELDLNSVLL

SEQ ID NO: 2774 - protein, 68 aa, Artificial Sequence
  source: /note="Description of Artificial Sequence: Synthetic polypeptide"
  source: /note="p.R771fs"
HEVMQRMEVQRRRMMQHPTRAHERPHPIHIGCTQTMVMGIIFMCLRLCPHILDRLQRGLPGNWELKLE

SEQ ID NO: 2775 - protein, 52 aa, Artificial Sequence
  source: /note="Description of Artificial Sequence: Synthetic polypeptide"
  source: /note="p.A172V"
YRGIHSYLRYLKPKDTSMGNSSSGMVVRKGPIRAPGHLRATVRWDYQPDICK

SEQ ID NO: 2776 - protein, 35 aa, Artificial Sequence
  source: /note="Description of Artificial Sequence: Synthetic polypeptide"
  source: /note="p.S9G"
MAWRRREAGGVGARGVLALALLALALCVPGARGRA

SEQ ID NO: 2777 - protein, 52 aa, Artificial Sequence
  source: /note="Description of Artificial Sequence: Synthetic polypeptide"
  source: /note="p.S208L"
LERNITVTMYITIGTRNLQKYVSRTLLVVFVSISFIVLMIISLAWLVFYYIQ

SEQ ID NO: 2778 - protein, 52 aa, Artificial Sequence
  source: /note="Description of Artificial Sequence: Synthetic polypeptide"
  source: /note="p.R236Q"
FVSISFIVLMIISLAWLVFYYIQRFQQYANARDRNQRRLGDAAKKAISKLQI

SEQ ID NO: 2779 - protein, 52 aa, Artificial Sequence
  source: /note="Description of Artificial Sequence: Synthetic polypeptide"
  source: /note="p.P95S"
PDDPEVLAVIAIPHTSEHTPVFIKLSSSNGCYMLPLPISKERALLPGDMGCR

SEQ ID NO: 2780 - protein, 52 aa, Artificial Sequence
  source: /note="Description of Artificial Sequence: Synthetic polypeptide"
  source: /note="p.S351C"
KKYNNKKELSCYDTYPPLEKKKVDMCCVLTSEAPPPPLQPETNDVHLEAKNF

SEQ ID NO: 2781 - protein, 52 aa, Artificial Sequence
  source: /note="Description of Artificial Sequence: Synthetic polypeptide"
  source: /note="p.A133T"
PLAASSPAWRPPPGQARPPGSPGQSTTQLPLDLLPSLPRESQIFVISRHGMP

SEQ ID NO: 2782 - protein, 52 aa, Artificial Sequence
  source: /note="Description of Artificial Sequence: Synthetic polypeptide"
  source: /note="p.G263C"
HRRLLISADRRSVQLAPPGTPAPPDCCPKRFDQLPAVLGAQGFGAGRHCWEV

SEQ ID NO: 2783 - protein, 65 aa, Artificial Sequence
  source: /note="Description of Artificial Sequence: Synthetic polypeptide"
  source: /note="p.G659fs"
PSTSSLFNLQKSSLSARHPQRKRRGVPPSPPLALGPRMQLCTQLARFFPITPPVWHILGPQRHTP

SEQ ID NO: 2784 - protein, 32 aa, Artificial Sequence
  source: /note="Description of Artificial Sequence: Synthetic polypeptide"
  source: /note="p.P116fs"
NASDDDNLEPGFISIVKLESPRRAPPPLPVTG

SEQ ID NO: 2785 - protein, 52 aa, Artificial Sequence
  source: /note="Description of Artificial Sequence: Synthetic polypeptide"
  source: /note="p.S216L"
PPAWPDYDVWILMTVVGTIFVIILALLVLRIRCRPRHSRPDPLQQRTAWAIS

SEQ ID NO: 2786 - protein, 43 aa, Artificial Sequence
  source: /note="Description of Artificial Sequence: Synthetic polypeptide"
  source: /note="p.K392fs"
PEFLVYFPLLNEMAKKYNMKLVYKKHFWNSTKKRLRTMKIKCS

SEQ ID NO: 2787 - protein, 42 aa, Artificial Sequence
  source: /note="Description of Artificial Sequence: Synthetic polypeptide"
  source: /note="p.E116fs"
LVVEFAKEQDRVHSPCPTSGSEKKKGLMTLSKMIKKKKNLVI

SEQ ID NO: 2788 - protein, 52 aa, Artificial Sequence
  source: /note="Description of Artificial Sequence: Synthetic polypeptide"
  source: /note="p.D1018N"
SQITQATPYATTQILHSNSIHELAVNNLPDPQWKSSIQQKTDLMGFGYSLPD

SEQ ID NO: 2789 - protein, 46 aa, Artificial Sequence
  source: /note="Description of Artificial Sequence: Synthetic polypeptide"
  source: /note="p.P1080fs"
KNKNSSKPQKNNGSTWANVPLPPPPSPAPSWHGAGTLCSGTTRKWL

SEQ ID NO: 2790 - protein, 44 aa, Artificial Sequence
  source: /note="Description of Artificial Sequence: Synthetic polypeptide"
  source: /note="p.K1293fs"
PTSPFSTDSNTSAALSQSQRPRPTKNTREGGWTNNQHCLIEGKE

SEQ ID NO: 2791 - protein, 52 aa, Artificial Sequence
  source: /note="Description of Artificial Sequence: Synthetic polypeptide"
  source: /note="p.T518S"
HRINEYQRKAEQENEKRRNVENEVSSSLKDQLEDLKKVSQNSQLANEKLSQL

SEQ ID NO: 2792 - protein, 52 aa, Artificial Sequence
  source: /note="Description of Artificial Sequence: Synthetic polypeptide"
  source: /note="p.D672N"
KLLGNSLLPIRWMAPEAIMYGKFSINNSDIWSYGVVLWEVFSYGLQPYCGYS

SEQ ID NO: 2793 - protein, 52 aa, Artificial Sequence
  source: /note="Description of Artificial Sequence: Synthetic polypeptide"
  source: /note="p.G94W"
NRNRCQHCRLQKCLALGMSRDAVKFWWRMSKKQRDSLYAEVQKHQQRLQEQR

SEQ ID NO: 2794 - protein, 52 aa, Artificial Sequence
  source: /note="Description of Artificial Sequence: Synthetic polypeptide"
  source: /note="p.R245I"
FPGGPILGYNLRLISKNQKLDAGTQIITSFQFYSTLPNTIYRFSIAAVNEVG

SEQ ID NO: 2795 - protein, 52 aa, Artificial Sequence
  source: /note="Description of Artificial Sequence: Synthetic polypeptide"
  source: /note="p.S1771L"
WLLKENHLLRMSSENPGMCGNADTTLLVDTLLDNNSSEVPYSHFGNLAPGPT

SEQ ID NO: 2796 - protein, 52 aa, Artificial Sequence
  source: /note="Description of Artificial Sequence: Synthetic polypeptide"
  source: /note="p.R31H"
SEGAIAAIMQKGDTNIKPILQVINIHHPITTGNSPPRYRLLMSDGLNTLSSF

SEQ ID NO: 2797 - protein, 52 aa, Artificial Sequence
  source: /note="Description of Artificial Sequence: Synthetic polypeptide"
  source: /note="p.K187T"
RQKIHISKKWGFTKFNADEFEDMVATTKCLIPDGCGVKYVPSHGPLDKWRVL

SEQ ID NO: 2798 - protein, 52 aa, Artificial Sequence
  source: /note="Description of Artificial Sequence: Synthetic polypeptide"
  source: /note="p.G107R"
QTMRGMPPHKTKPGQAALDCLKVFDRRIPPPYDKKKRMVVPAALKVVRLKPA

SEQ ID NO: 2799 - protein, 52 aa, Artificial Sequence
  source: /note="Description of Artificial Sequence: Synthetic polypeptide"
  source: /note="p.R151C"
KVKGNVFKNKRILMEHIHKLKADKACCKKLLADQAEARRSKTKEARKRREER

SEQ ID NO: 2800 - protein, 18 aa, Artificial Sequence
  source: /note="Description of Artificial Sequence: Synthetic peptide"
  source: /note="p.K15fs"
MAPVKKLVVKGGKKRSKF

SEQ ID NO: 2801 - protein, 77 aa, Artificial Sequence
  source: /note="Description of Artificial Sequence: Synthetic polypeptide"
  source: /note="p.R58fs"
KRLVIQDKNKYNTPKYRMIVRVTNRYHLSDCLCPYRGGYDSLRSVCTRTAKIWCEGWPDKLCCSILYWPAAGPQASQ

SEQ ID NO: 2802 - protein, 52 aa, Artificial Sequence
  source: /note="Description of Artificial Sequence: Synthetic polypeptide"
  source: /note="p.F193C"
LASGLLLVTGPLVLNRVPLRRTHQKCCVIATSTKIDISNVKIPKHLTDAYFK

SEQ ID NO: 2803 - protein, 52 aa, Artificial Sequence
  source: /note="Description of Artificial Sequence: Synthetic polypeptide"
  source: /note="p.R97S"
PHRLNLFYLANDVIQNCKRKNAIIFSSESFADVLPEAAALVKDPSVSKSVER

SEQ ID NO: 2804 - protein, 52 aa, Artificial Sequence
  source: /note="Description of Artificial Sequence: Synthetic polypeptide"
  source: /note="p.R200G"
GKPHTVPCKVTGRCGSVLVRLIPAPGGGTGIVSAPVPKKLLMMAGIDDCYTS

SEQ ID NO: 2805 - protein, 52 aa, Artificial Sequence
  source: /note="Description of Artificial Sequence: Synthetic polypeptide"
  source: /note="p.E166K"
THLSQRERFTEHEVQIYVGEIVLALKKHLHKLGIIYRDIKLENILLDSNGHV

SEQ ID NO: 2806 - protein, 52 aa, Artificial Sequence
  source: /note="Description of Artificial Sequence: Synthetic polypeptide"
  source: /note="p.S394Y"
ATSIAEEYKITPITSANVLPIVQINYENAAQFGEVYELKEDIGVGSYSVCKR

SEQ ID NO: 2807 - protein, 42 aa, Artificial Sequence
  source: /note="Description of Artificial Sequence: Synthetic polypeptide"
  source: /note="p.K109fs"
KKASLKVRDRVRTKMERDILVEVNHHLLSNCTMPFRLKGNCT

SEQ ID NO: 2808 - protein, 52 aa, Artificial Sequence
  source: /note="Description of Artificial Sequence: Synthetic polypeptide"
  source: /note="p.Q111E"
AVLKFAAATGATPIAGRFTPGTFTNEEIQAAFWEPRLLVVTDPRADHQPLTE

SEQ ID NO: 2809 - protein, 52 aa, Artificial Sequence
  source: /note="Description of Artificial Sequence: Synthetic polypeptide"
  source: /note="p.G364S"
QSSHYGQMDRKGQCYHYDQTNRQGQSSSHYSQPNRQGQSSHYGQPDTQDQSS

SEQ ID NO: 2810 - protein, 52 aa, Artificial Sequence
  source: /note="Description of Artificial Sequence: Synthetic polypeptide"
  source: /note="p.M538I"
QTDRQGQSFHYGQPDRQGQSSHYSQIIDRQGQSSHYGQTDRQGQSSHYGQTD

SEQ ID NO: 2811 - protein, 52 aa, Artificial Sequence
  source: /note="Description of Artificial Sequence: Synthetic polypeptide"
  source: /note="p.G296S"
CGQSERLGQELGCGQTDRQGQSSHYSSQTDRQDQSYHYGQTDRQGQSSHYSQ

SEQ ID NO: 2812 - protein, 52 aa, Artificial Sequence
  source: /note="Description of Artificial Sequence: Synthetic polypeptide"
  source: /note="p.A278E"
LRRDSKEANARRQAGTRRRESLGKKEEKRFLGRIVARNSRKMAFRAKSKSCH

SEQ ID NO: 2813 - protein, 52 aa, Artificial Sequence
  source: /note="Description of Artificial Sequence: Synthetic polypeptide"
  source: /note="p.G783V"
CGEDLKHYRALRIHMRTHCGRGLGGVVHKGRKPFECKECSAAFAAKRNCIHH

SEQ ID NO: 2814 - protein, 35 aa, Artificial Sequence
  source: /note="Description of Artificial Sequence: Synthetic polypeptide"
  source: /note="p.R9C"
MAAPLLHTCCLPGDAAASSSAVKKLGASRTGISNM

SEQ ID NO: 2815 - protein, 37 aa, Artificial Sequence
  source: /note="Description of Artificial Sequence: Synthetic polypeptide"
  source: /note="p.P11S"
MAAPLLHTRLSSGDAAASSSAVKKLGASRTGISNMRA

SEQ ID NO: 2816 - protein, 52 aa, Artificial Sequence
  source: /note="Description of Artificial Sequence: Synthetic polypeptide"
  source: /note="p.L214F"
KEAGSSMRKRAKLISTVSKKDFISVFFRGMDGSTNETASSRKKPKAKQTEVK

SEQ ID NO: 2817 - protein, 66 aa, Artificial Sequence
  source: /note="Description of Artificial Sequence: Synthetic polypeptide"
  source: /note="p.N45fs"
QRITVHKELELQFDLGNLLASDRNPRPGCGAPDPRRRPSYRPWRGTTRNCSSTSCGSCPRSAWKRR

SEQ ID NO: 2818 - protein, 52 aa, Artificial Sequence
  source: /note="Description of Artificial Sequence: Synthetic polypeptide"
  source: /note="p.E572K"
SPFKRRRSMNEIKNLQYLPRTSEPRKKVLFEDRTRAHADHVGQGFDWQSTAA

SEQ ID NO: 2819 - protein, 30 aa, Artificial Sequence
  source: /note="Description of Artificial Sequence: Synthetic polypeptide"
  source: /note="p.K386fs"
HEITEKSTEETEKLKNDQQAKIPLKNEKLN

SEQ ID NO: 2820 - protein, 52 aa, Artificial Sequence
  source: /note="Description of Artificial Sequence: Synthetic polypeptide"
  source: /note="p.R28C"
FRLFSFALIILNCMDYSHCQGNRWRCCSKRASYVSNPICKGCLSCSKDNGCS

SEQ ID NO: 2821 - protein, 52 aa, Artificial Sequence
  source: /note="Description of Artificial Sequence: Synthetic polypeptide"
  source: /note="p.S103W"
ASTGVAGVSSAMDHTFSTTSKDGEGWWCYTSLISDICYPPQEDSTYFTGILQ

SEQ ID NO: 2822 - protein, 33 aa, Artificial Sequence
  source: /note="Description of Artificial Sequence: Synthetic polypeptide"
  source: /note="p.P313fs"
KTVPILELSPPLWTAIGWVQRGPTPLLLSSGFY

SEQ ID NO: 2823 - protein, 39 aa, Artificial Sequence
  source: /note="Description of Artificial Sequence: Synthetic polypeptide"
  source: /note="p.D96fs"
LCSVLPTHWRCNKTLPIAFKVVALGGCSRWHSGHCDGWQ

SEQ ID NO: 2824 - protein, 52 aa, Artificial Sequence
  source: /note="Description of Artificial Sequence: Synthetic polypeptide"
  source: /note="p.R135G"
DENYSAELRNATAAMKNQVARFNDLGGFVGRSGRGKSFTLTITVFTNPPQVA

SEQ ID NO: 2825 - protein, 68 aa, Artificial Sequence
  source: /note="Description of Artificial Sequence: Synthetic polypeptide"
  source: /note="p.R142fs"
LRNATAAMKNQVARFNDLRFVGRSGKREKLHSDHHCLHKPTASRHLPQSHQNHSGWAPRTSKTSAETR

SEQ ID NO: 2826 - protein, 52 aa, Artificial Sequence
  source: /note="Description of Artificial Sequence: Synthetic polypeptide"
  source: /note="p.R337M"
SPSIHSTTPLSSTRGTGLPAITDVPMMRISDDDTATSDFCLWPSTLSKKSQA

SEQ ID NO: 2827 - protein, 52 aa, Artificial Sequence
  source: /note="Description of Artificial Sequence: Synthetic polypeptide"
  source: /note="p.P466H"
STPYLYYGTSSGSYQFPMVPGGDRSHHSRMLPPCTTTSNGSTLLNPNLPNQN

SEQ ID NO: 2828 - protein, 52 aa, Artificial Sequence
  source: /note="Description of Artificial Sequence: Synthetic polypeptide"
  source: /note="p.Q71E"
VAAQQQQQQQQQQQQQQQQQQQQQQEEEAAAAAAAAAAAAAAAAAVPRLRPP

SEQ ID NO: 2829 - protein, 55 aa, Artificial Sequence
  source: /note="Description of Artificial Sequence: Synthetic polypeptide"
  source: /note="p.P486fs"
SSTQAAAAVGPTVLEGQVYTNTSPPTSALDVSAPAAMIAACSAALLSAWARWNVC

SEQ ID NO: 2830 - protein, 52 aa, Artificial Sequence
  source: /note="Description of Artificial Sequence: Synthetic polypeptide"
  source: /note="p.E431K"
SVQLLTPANLLAKINGKDSIEKEHVKKEISELFYDAKSSAKILADQQDKYMK

SEQ ID NO: 2831 - protein, 52 aa, Artificial Sequence
  source: /note="Description of Artificial Sequence: Synthetic polypeptide"
  source: /note="p.R117C"
PFCPMVGSEVYSTEIKKTEVLMENFCCRAIGLRIKETKEVYEGEVTELTPCE

SEQ ID NO: 2832 - protein, 52 aa, Artificial Sequence
  source: /note="Description of Artificial Sequence: Synthetic polypeptide"
  source: /note="p.R254H"
VEGPQSACEEFWSRLRKLNWKRILIHHHREDIPFDGTNDETERQRKFSIFEE

SEQ ID NO: 2833 - protein, 52 aa, Artificial Sequence
  source: /note="Description of Artificial Sequence: Synthetic polypeptide"
  source: /note="p.S223Y"
HRLEWLIIEDNHLSRISPPTFYGLNYYLILLVLMNNVLTRLPDKPLCQHMPR

SEQ ID NO: 2834 - protein, 52 aa, Artificial Sequence
  source: /note="Description of Artificial Sequence: Synthetic polypeptide"
  source: /note="p.S427Y"
AYCKHKYPEQPGRFAKLLLRLPALRYYIGLKCLEHLFFFKLIGDTPIDTFLM

SEQ ID NO: 2835 - protein, 52 aa, Artificial Sequence
  source: /note="Description of Artificial Sequence: Synthetic polypeptide"
  source: /note="p.S427F"
AYCKHKYPEQPGRFAKLLLRLPALRFFIGLKCLEHLFFFKLIGDTPIDTFLM

SEQ ID NO: 2836 - protein, 52 aa, Artificial Sequence
  source: /note="Description of Artificial Sequence: Synthetic polypeptide"
  source: /note="p.D668Y"
IRPNIFVGRAEGTTQYSKWYFEVMVYYEVTPFLTAQATHLRVGWALTEGYTP

SEQ ID NO: 2837 - protein, 52 aa, Artificial Sequence
  source: /note="Description of Artificial Sequence: Synthetic polypeptide"
  source: /note="p.A2576T"
NRYLCLAVLPLITKCAPLFAGTEHRTTIMVDSMLHTVYRLSRGRSLTKAQRD

SEQ ID NO: 2838 - protein, 52 aa, Artificial Sequence
  source: /note="Description of Artificial Sequence: Synthetic polypeptide"
  source: /note="p.M4334I"
ICSLLLGGSLVEGAKKIKVAELLANIIPDPTQDEVRGDGEEGERKPLEAALP

SEQ ID NO: 2839 - protein, 52 aa, Artificial Sequence
  source: /note="Description of Artificial Sequence: Synthetic polypeptide"
  source: /note="p.E711K"
VTAEATHLRVGWASTEGYSPYPGGGKKEWGGNGVGDDLFSYGFDGLHLWSGC

SEQ ID NO: 2840 - protein, 52 aa, Artificial Sequence
  source: /note="Description of Artificial Sequence: Synthetic polypeptide"
  source: /note="p.L2023F"
DFHEDLMTHCGIELDEDGSLDGNSDFFTIRGRLLSLVEKVTYLKKKQAEKPV

SEQ ID NO: 2841 - protein, 52 aa, Artificial Sequence
  source: /note="Description of Artificial Sequence: Synthetic polypeptide"
  source: /note="p.K2413N"
IMTFYSALIDLLGRCAPEMHLIHAGNNGEAIRIRSILRSLIPLGDLVGVISI

SEQ ID NO: 2842 - protein, 52 aa, Artificial Sequence
  source: /note="Description of Artificial Sequence: Synthetic polypeptide"
  source: /note="p.P1670T"
DESKRHGLPGVGLRTCLKPGFRFSTTTCFVVTGEDHQKQSPEIPLESLRTKA

SEQ ID NO: 2843 - protein, 52 aa, Artificial Sequence
  source: /note="Description of Artificial Sequence: Synthetic polypeptide"
  source: /note="p.R2705Q"
LAVGWTVERTKEGEALVQQRENEKLQQSVSQANQGNSYSPAPLDLSNVVLSR

SEQ ID NO: 2844 - protein, 52 aa, Artificial Sequence
  source: /note="Description of Artificial Sequence: Synthetic polypeptide"
  source: /note="p.R2906Q"
FHVNGHFALDSARRNLWRDDNGVGVQQSDWNNSLMTALIAPAYVELLIQLKK

SEQ ID NO: 2845 - protein, 32 aa, Artificial Sequence
  source: /note="Description of Artificial Sequence: Synthetic polypeptide"
  source: /note="p.W798fs"
REGQHYPERHGGPERHGRDSRDGWGAMALTRG

SEQ ID NO: 2846 - protein, 52 aa, Artificial Sequence
  source: /note="Description of Artificial Sequence: Synthetic polypeptide"
  source: /note="p.G799V"
EREGQHYPERHGGPERHGRDSRDGWVVGYGSDKRMSEGRGLPPPPRGRRDWG

SEQ ID NO: 2847 - protein, 52 aa, Artificial Sequence
  source: /note="Description of Artificial Sequence: Synthetic polypeptide"
  source: /note="p.R229C"
HNVCEQKMENVQPAPDNVLLTLRPRCCINMTDTGISPMSTRDPYATITYNVP

SEQ ID NO: 2848 - protein, 52 aa, Artificial Sequence
  source: /note="Description of Artificial Sequence: Synthetic polypeptide"
  source: /note="p.H298Q"
STGLINVAGAGTPAISTNGLYSTVPQQNVCEEKMENDQPQPNNVLSTVQPVI

SEQ ID NO: 2849 - protein, 52 aa, Artificial Sequence
  source: /note="Description of Artificial Sequence: Synthetic polypeptide"
  source: /note="p.L593V"
PGLNHVESGVSATAESPQSLLGGPPVVTKAEPVSLPCTNARAGDAPVGAQAS

SEQ ID NO: 2850 - protein, 38 aa, Artificial Sequence
  source: /note="Description of Artificial Sequence: Synthetic polypeptide"
  source: /note="p.V995fs"
NQYTSMLNGGLAVKTNEISVIQSGGFLPSRFPWGPPPL

SEQ ID NO: 2851 - protein, 52 aa, Artificial Sequence
  source: /note="Description of Artificial Sequence: Synthetic polypeptide"
  source: /note="p.R187L"
PPTPQDISYLAKGKVANTNVTLQALLLGTKVAVNQRSADALPAPVPGANSIP

SEQ ID NO: 2852 - protein, 52 aa, Artificial Sequence
  source: /note="Description of Artificial Sequence: Synthetic polypeptide"
  source: /note="p.Q206H"
DMTKYLEGSLYPSTQQYNDVVNALLHHAHPFLDEDGCGFFLWKRALKDRFKY

SEQ ID NO: 2853 - protein, 52 aa, Artificial Sequence
  source: /note="Description of Artificial Sequence: Synthetic polypeptide"
  source: /note="p.R477W"
APAPTDGSEPAPAPVADGDIPSQFTWWVMGKVCTQLLVSRPDEENITSYLQL

SEQ ID NO: 2854 - protein, 52 aa, Artificial Sequence
  source: /note="Description of Artificial Sequence: Synthetic polypeptide"
  source: /note="p.P1076fs"
SRNLVKNAKKTIGRQHVTRKKYNPPAGSTGASRPLRTRRTRSQCRRSWSPAR

SEQ ID NO: 2855 - protein, 29 aa, Artificial Sequence
  source: /note="Description of Artificial Sequence: Synthetic peptide"
  source: /note="p.N1139fs"
EVHQQNALFQYFADTLTAVVQNAKKKWKI

SEQ ID NO: 2856 - protein, 52 aa, Artificial Sequence
  source: /note="Description of Artificial Sequence: Synthetic polypeptide"
  source: /note="p.G133W"
GGAPCPPLEERAGCLEYSTPQGQDCWWHTYVPAFITTSAFNKERTRQATSPH

SEQ ID NO: 2857 - protein, 43 aa, Artificial Sequence
  source: /note="Description of Artificial Sequence: Synthetic polypeptide"
  source: /note="p.P208fs"
PPPAPSSASSSPSPSPSSSSPSPPPTPTAPCTPSPTCPPIRYL

SEQ ID NO: 2858 - protein, 32 aa, Artificial Sequence
  source: /note="Description of Artificial Sequence: Synthetic polypeptide"
  source: /note="p.E926fs"
SSPGEKSRSQSRERESDRDGQRRERKENQKVV

SEQ ID NO: 2859 - protein, 52 aa, Artificial Sequence
  source: /note="Description of Artificial Sequence: Synthetic polypeptide"
  source: /note="p.G740C"
LVQPSLSMTPETVKDVGFGSLVIPGCCSVASNLATSALPAGNVFNAPTKQAE

SEQ ID NO: 2860 - protein, 52 aa, Artificial Sequence
  source: /note="Description of Artificial Sequence: Synthetic polypeptide"
  source: /note="p.R366Q"
AEKTQFTVSTLDDVKNSGSIRDNYVQQTSEISAVHIDTECVSVMLQAGTPPL

SEQ ID NO: 2861 - protein, 52 aa, Artificial Sequence
  source: /note="Description of Artificial Sequence: Synthetic polypeptide"
  source: /note="p.R614Q"
SVSFAEGTKFAPQSRRSSGELSSPLQQKPKRLSRGAQSGPEGREAEESTGPE

SEQ ID NO: 2862 - protein, 52 aa, Artificial Sequence
  source: /note="Description of Artificial Sequence: Synthetic polypeptide"
  source: /note="p.R545W"
TDWDSSINLTFHKSKIAVDELFTSLWWDIAGARSLLKQFKSVYVPGNHTHQA

SEQ ID NO: 2863 - protein, 35 aa, Artificial Sequence
  source: /note="Description of Artificial Sequence: Synthetic polypeptide"
  source: /note="p.K109fs"
MKLQLENVIKENERLHSELKDAVEKNWRPFPWAQR

SEQ ID NO: 2864 - protein, 52 aa, Artificial Sequence
  source: /note="Description of Artificial Sequence: Synthetic polypeptide"
  source: /note="p.R194Q"
GKQHLRSLPVVNSIGYVLRFLAKLCQQSLLCDDLFSHQPFPRGCSASEKVQE

SEQ ID NO: 2865 - protein, 52 aa, Artificial Sequence
  source: /note="Description of Artificial Sequence: Synthetic polypeptide"
  source: /note="p.L261F"
YLVNPVGMNRYSVDTSASTFNHRGSFFHPSSSLYCKRQNSGDSHLGGGPAAT

SEQ ID NO: 2866 - protein, 52 aa, Artificial Sequence
  source: /note="Description of Artificial Sequence: Synthetic polypeptide"
  source: /note="p.R1142H"
EGCIRHCPCCKLDTTKSPWDVGWQVHHKTCYRIVEHSWFESFIIFMILLSSG

SEQ ID NO: 2867 - protein, 52 aa, Artificial Sequence
  source: /note="Description of Artificial Sequence: Synthetic polypeptide"
  source: /note="p.T1570M"
IVVVLSIASLIFSAILKSLQSYFSPMMLFRVIRLARIGRILRLIRAAKGIRT

SEQ ID NO: 2868 - protein, 52 aa, Artificial Sequence
  source: /note="Description of Artificial Sequence: Synthetic polypeptide"
  source: /note="p.R36K"
PDSFRFFTRESLAAIEQRIAEEKAKKKPKQERKDEDDENGPKPNSDLEAGKS

SEQ ID NO: 2869 - protein, 52 aa, Artificial Sequence
  source: /note="Description of Artificial Sequence: Synthetic polypeptide"
  source: /note="p.T155K"
LFNMLIMCTILTNCVFMTMSNPPDWKKKNVEYTFTGIYTFESLIKILARGFC

SEQ ID NO: 2870 - protein, 52 aa, Artificial Sequence
  source: /note="Description of Artificial Sequence: Synthetic polypeptide"
  source: /note="p.R1358H"
MTVGSYLVPPSLVQLILLSRIIHMLHHLGKGPKVFHNLMLPLMLSLPALLNI

SEQ ID NO: 2871 - protein, 52 aa, Artificial Sequence
  source: /note="Description of Artificial Sequence: Synthetic polypeptide"
  source: /note="p.R564H"
MSCSVVCVIEIIEVFFIDFFSIIARHHQWQKAKEWWAWKQAPPCPEAPRSPQ

SEQ ID NO: 2872 - protein, 52 aa, Artificial Sequence
  source: /note="Description of Artificial Sequence: Synthetic polypeptide"
  source: /note="p.G332V"
SLGKLTKLTNLNVDRNHLEALPPEIVVGCVALSVLSLRDNRLAVLPPELAHT

SEQ ID NO: 2873 - protein, 52 aa, Artificial Sequence
  source: /note="Description of Artificial Sequence: Synthetic polypeptide"
  source: /note="p.S133A"
VSEGYAADAFFITDGRSRRKASNAGAAAAAPSTASAAAPDGDAGGGGGAGGR

SEQ ID NO: 2874 - protein, 52 aa, Artificial Sequence
  source: /note="Description of Artificial Sequence: Synthetic polypeptide"
  source: /note="p.V342M"
DGKTCKDIDECQTRNGGCDHFCKNIMMGSFDCGCKKGFKLLTDEKSCQDVDE

SEQ ID NO: 2875 - protein, 39 aa, Artificial Sequence
  source: /note="Description of Artificial Sequence: Synthetic polypeptide"
  source: /note="p.K275fs"
YATGKKSSKNKKKLEKAMKVLKKQKRRKNQRCLTFQPFT

SEQ ID NO: 2876 - protein, 52 aa, Artificial Sequence
  source: /note="Description of Artificial Sequence: Synthetic polypeptide"
  source: /note="p.H66Y"
DYKVRIDEYDHSKPIQGQQKKPFEEYYWRKHTLSYVDVSTGKVTVEYRPIID

SEQ ID NO: 2877 - protein, 31 aa, Artificial Sequence
  source: /note="Description of Artificial Sequence: Synthetic polypeptide"
  source: /note="p.S37fs"
VGRPPVPLHMVSTASGQTRCWTWLSLVRHVP

SEQ ID NO: 2878 - protein, 52 aa, Artificial Sequence
  source: /note="Description of Artificial Sequence: Synthetic polypeptide"
  source: /note="p.R31C"
LCPACTPVGRPPVPLHMVSTASGQTCCCWTWLSGQACALSIAESCRPGDKVP

SEQ ID NO: 2879 - protein, 52 aa, Artificial Sequence
  source: /note="Description of Artificial Sequence: Synthetic polypeptide"
  source: /note="p.A66T"
AACASVHGANRLGANSLLDLVVFGQTTCALSIEESCRPGDKVPPIKPNAGEE

SEQ ID NO: 2880 - protein, 44 aa, Artificial Sequence
  source: /note="Description of Artificial Sequence: Synthetic polypeptide"
  source: /note="p.K508fs"
RPVDTTVTDGMTAILRCEVSGAPKPRHHLEKRKPHSGQWLCPDS

SEQ ID NO: 2881 - protein, 52 aa, Artificial Sequence
  source: /note="Description of Artificial Sequence: Synthetic polypeptide"
  source: /note="p.T1181M"
PSPYSPSSRVIQTLQAPPDVAPTSVMMVRTASETSLRLRWVPLPDSQYNGNP

SEQ ID NO: 2882 - protein, 52 aa, Artificial Sequence
  source: /note="Description of Artificial Sequence: Synthetic polypeptide"
  source: /note="p.Y2146C"
ADASESEATDSDYEDALPKHSFVNHCCMSDPTYYNSWKRRAQGRAPAPHRYE

SEQ ID NO: 2883 - protein, 28 aa, Artificial Sequence
  source: /note="Description of Artificial Sequence: Synthetic peptide"
  source: /note="p.A50fs"
YGHYGDPSHTASPTGMMKPAGPLGAHRH

SEQ ID NO: 2884 - protein, 52 aa, Artificial Sequence
  source: /note="Description of Artificial Sequence: Synthetic polypeptide"
  source: /note="p.P905S"
GVRPASSQPQLLGGQRVQVPNPVGFSSGTWPLPGSPLPMACPGIMRPGSTSL

SEQ ID NO: 2885 - protein, 52 aa, Artificial Sequence
  source: /note="Description of Artificial Sequence: Synthetic polypeptide"
  source: /note="p.G126V"
EVGDTPKDRALFNGAQKLFGMIITIVVQAIVYVMTGMYGDPAEMGAGICLLI

SEQ ID NO: 2886 - protein, 52 aa, Artificial Sequence
  source: /note="Description of Artificial Sequence: Synthetic polypeptide"
  source: /note="p.D608E"
GMDELISTPSVEDKSEEPPGTELQREETEASHLAPNHTTFPKIHSRRFRDYC

SEQ ID NO: 2887 - protein, 52 aa, Artificial Sequence
  source: /note="Description of Artificial Sequence: Synthetic polypeptide"
  source: /note="p.R429W"
RAFQYDTNCSFRCAEGFMLRGADIVWWCDNLGQWTAPAPVCQALQCQDLPVP

SEQ ID NO: 2888 - protein, 52 aa, Artificial Sequence
  source: /note="Description of Artificial Sequence: Synthetic polypeptide"
  source: /note="p.A297T"
NMTCLHSAKAFQHQSSCSFSCEEGFTTLVGPEVVQCTASGVWTAPAPVCKAV

SEQ ID NO: 2889 - protein, 52 aa, Artificial Sequence
  source: /note="Description of Artificial Sequence: Synthetic polypeptide"
  source: /note="p.D81N"
SYHTFLLDEERSRLYVGAKDHIFSFNNLVNIKDFQKIVWPVSYTRRDECKWA

SEQ ID NO: 2890 - protein, 52 aa, Artificial Sequence
  source: /note="Description of Artificial Sequence: Synthetic polypeptide"
  source: /note="p.R252Q"
EDDRVYFFFTEVSVEYEFVFRVLIPQQIARVCKGDQGGLRTLQKKWTSFLKA

SEQ ID NO: 2891 - protein, 52 aa, Artificial Sequence
  source: /note="Description of Artificial Sequence: Synthetic polypeptide"
  source: /note="p.R292C"
QHQTKNLSQDQEHGRKAHKISYPSSCCTEERQLHHGEKSVQKDVSKGSISIQ

SEQ ID NO: 2892 - protein, 52 aa, Artificial Sequence
  source: /note="Description of Artificial Sequence: Synthetic polypeptide"
  source: /note="p.S673Y"
ELELSYPLSWVQAFPLFQNLSSKESYYFIHYYCVSTCSFPAGVAVAEEMKLK

SEQ ID NO: 2893 - protein, 48 aa, Artificial Sequence
  source: /note="Description of Artificial Sequence: Synthetic polypeptide"
  source: /note="p.R371Q"
GEGHQAWIIGIVEKGNRTARIIDKPQQIIEVAPQVATQNVNPTPGATS

SEQ ID NO: 2894 - protein, 39 aa, Artificial Sequence
  source: /note="Description of Artificial Sequence: Synthetic polypeptide"
  source: /note="p.E13K"
MSTRESFNPESYKKLDKSFRLTRFTELKGTGCKVPQDVL

SEQ ID NO: 2895 - protein, 52 aa, Artificial Sequence
  source: /note="Description of Artificial Sequence: Synthetic polypeptide"
  source: /note="p.R211G"
HGKINNLIENIDPGTVMLLANYIFFGGARWKHEFDPNVTKEEDFFLEKNSSV

SEQ ID NO: 2896 - protein, 52 aa, Artificial Sequence
  source: /note="Description of Artificial Sequence: Synthetic polypeptide"
  source: /note="p.D253Y"
FFLEKNSSVKVPMMFRSGIYQVGYDYYKLSCTILEIPYQKNITAIFILPDEG

SEQ ID NO: 2897 - protein, 52 aa, Artificial Sequence
  source: /note="Description of Artificial Sequence: Synthetic polypeptide"
  source: /note="p.K158N"
LQLSMGNAMFVKEQLSLLDRFTEDANNRLYGSEAFATDFQDSAAAKKLINDY

SEQ ID NO: 2898 - protein, 52 aa, Artificial Sequence
  source: /note="Description of Artificial Sequence: Synthetic polypeptide"
  source: /note="p.R98C"
HQQILETGEGSPSLKIAPANADFAFCCFYYLIASETPGKNIFFSPLSISAAY

SEQ ID NO: 2899 - protein, 48 aa, Artificial Sequence
  source: /note="Description of Artificial Sequence: Synthetic polypeptide"
  source: /note="p.M414I"
TTKFIVRSKDGPSYFTVSFNRTFLMIIITNKATDGILFLGKVENPTKS

SEQ ID NO: 2900 - protein, 63 aa, Artificial Sequence
  source: /note="Description of Artificial Sequence: Synthetic polypeptide"
  source: /note="p.Q168fs"
PICQEYLDGVIQFYHTTIESVDFQKTLKNPDKRLTSGLNVNPKVKSRNSSARTLLMLRLCWYW

SEQ ID NO: 2901 - protein, 52 aa, Artificial Sequence
  source: /note="Description of Artificial Sequence: Synthetic polypeptide"
  source: /note="p.S209C"
GQWENKFKKENTKEEKFWPNKNTYKCCVQMMRQYNSFNFALLEDVQAKVLEI

SEQ ID NO: 2902 - protein, 52 aa, Artificial Sequence
  source: /note="Description of Artificial Sequence: Synthetic polypeptide"
  source: /note="p.R45L"
SLLLIGFWDCVTCHGSPVDICTAKPLLDIPMNPMCIYRSPEKKATEDEGSEQ

SEQ ID NO: 2903 - protein, 32 aa, Artificial Sequence
  source: /note="Description of Artificial Sequence: Synthetic polypeptide"
  source: /note="p.L81fs"
GMMELGAQGSTQKEIRHSMGYDSLKMVKNFLS

SEQ ID NO: 2904 - protein, 52 aa, Artificial Sequence
  source: /note="Description of Artificial Sequence: Synthetic polypeptide"
  source: /note="p.I306M"
VMQVVNWLEGPGSEQLRAQWGIGDSMMRASQALQQKHEEIESQHSEWFAVYV

SEQ ID NO: 2905 - protein, 35 aa, Artificial Sequence
  source: /note="Description of Artificial Sequence: Synthetic polypeptide"
  source: /note="p.R715fs"
YGYEAGTVPEKEIFCQCGVNKCRKKYYKYVTNACL

SEQ ID NO: 2906 - protein, 52 aa, Artificial Sequence
  source: /note="Description of Artificial Sequence: Synthetic polypeptide"
  source: /note="p.S207L"
VPLWLDRKESAVPTTPAPLQISPFTLLQPYVAHTLPQRPEPGEPGPDMAQEA

SEQ ID NO: 2907 - protein, 52 aa, Artificial Sequence
  source: /note="Description of Artificial Sequence: Synthetic polypeptide"
  source: /note="p.R74P"
EALAELLHGALLRRGPEMGYLPGSDPPDPTLATPPAGQTLAVPSLPRATEPG

SEQ ID NO: 2908 - protein, 52 aa, Artificial Sequence
  source: /note="Description of Artificial Sequence: Synthetic polypeptide"
  source: /note="p.R255W"
IETPEDQNDLRKMQLRELARLNGTLWWEDDNRILRPWQSSETRSITNTTVCT

SEQ ID NO: 2909 - protein, 52 aa, Artificial Sequence
  source: /note="Description of Artificial Sequence: Synthetic polypeptide"
  source: /note="p.Y623C"
SNLAKAAGLATMISTMRPDIDNMDECCVRNTTARAFAVVASALGIPSLLPFL

SEQ ID NO: 2910 - protein, 52 aa, Artificial Sequence
  source: /note="Description of Artificial Sequence: Synthetic polypeptide"
  source: /note="p.N626Y"
AKAAGLATMISTMRPDIDNMDEYVRYYTTARAFAVVASALGIPSLLPFLKAV

SEQ ID NO: 2911 - protein, 52 aa, Artificial Sequence
  source: /note="Description of Artificial Sequence: Synthetic polypeptide"
  source: /note="p.K666E"
IPSLLPFLKAVCKSKKSWQARHTGIEEIVQQIAILMGCAILPHLRSLVEIIE

SEQ ID NO: 2912 - protein, 52 aa, Artificial Sequence
  source: /note="Description of Artificial Sequence: Synthetic polypeptide"
  source: /note="p.K700E"
MGCAILPHLRSLVEIIEHGLVDEQQEEVRTISALAIAALAEAATPYGIESFD

SEQ ID NO: 2913 - protein, 52 aa, Artificial Sequence
  source: /note="Description of Artificial Sequence: Synthetic polypeptide"
  source: /note="p.E902K"
GNLGAADIDHKLEEQLIDGILYAFQKKQTTEDSVMLNGFGTVVNALGKRVKP

SEQ ID NO: 2914 - protein, 52 aa, Artificial Sequence
  source: /note="Description of Artificial Sequence: Synthetic polypeptide"
  source: /note="p.R957Q"
ICGTVLWRLNNKSAKVRQQAADLISQQTAVVMKTCQEEKLMGHLGVVLYEYL

SEQ ID NO: 2915 - protein, 52 aa, Artificial Sequence
  source: /note="Description of Artificial Sequence: Synthetic polypeptide"
  source: /note="p.R821Q"
THHLQCVRKRLLHRQSTQLLAQRLSQQTCFRQWRQQLAARRQEQRATVRALW

SEQ ID NO: 2916 - protein, 52 aa, Artificial Sequence
  source: /note="Description of Artificial Sequence: Synthetic polypeptide"
  source: /note="p.R611Q"
EEQMRRQREESYSRMGYMDPRERDMQQMGGGGAMNMGDPYGSGGQKFPPLGG

SEQ ID NO: 2917 - protein, 52 aa, Artificial Sequence
  source: /note="Description of Artificial Sequence: Synthetic polypeptide"
  source: /note="p.R232Q"
QRSGCNEVTTVVDVKEIFKSSSPIPQQTQVPLITNSSCQCPHILPHQDVLIM

SEQ ID NO: 2918 - protein, 52 aa, Artificial Sequence
  source: /note="Description of Artificial Sequence: Synthetic polypeptide"
  source: /note="p.S617Y"
PLEKNRVKLDDDSDDDEESKEGQESYYSSAANTNPAVAPPCVVVEEKKPQLT

SEQ ID NO: 2919 - protein, 52 aa, Artificial Sequence
  source: /note="Description of Artificial Sequence: Synthetic polypeptide"
  source: /note="p.A220V"
ESPTRSLSMDAPRGVHIQAHAGKIEVVLSQMDILFHSSDGMLVLDAETVCLP

SEQ ID NO: 2920 - protein, 52 aa, Artificial Sequence
  source: /note="Description of Artificial Sequence: Synthetic polypeptide"
  source: /note="p.I41M"
REQYILATQQNNLPRTENAQLYPVGMMYGWRKRCLYFFVLLLLVTMIVNLAM

SEQ ID NO: 2921 - protein, 52 aa, Artificial Sequence
  source: /note="Description of Artificial Sequence: Synthetic polypeptide"
  source: /note="p.R502L"
GVGDVSRPFSPPIHSSSPPPIAPLALLAESTSSISSTNSLSAATTPTVENEQ

SEQ ID NO: 2922 - protein, 53 aa, Artificial Sequence
  source: /note="Description of Artificial Sequence: Synthetic polypeptide"
  source: /note="p.K367del"
AKDDFMEIKSHVFFSLINWDDLINKITPPFNPNVSGPNDLRHFDPEFTEEPVP

SEQ ID NO: 2923 - protein, 27 aa, Artificial Sequence
  source: /note="Description of Artificial Sequence: Synthetic peptide"
  source: /note="p.L61fs"
SEWFVFRRYAEFDKLYNTLKKQFPAWP

SEQ ID NO: 2924 - protein, 76 aa, Artificial Sequence
  source: /note="Description of Artificial Sequence: Synthetic polypeptide"
  source: /note="p.E407fs"
KKSNKKTNEHGMKTFRKVKDSSSEKREKDQRDSLKIVQMSILGKRLKTGQKDLMSWMAKGVQKIPVLFSIMNSWLR

SEQ ID NO: 2925 - protein, 52 aa, Artificial Sequence
  source: /note="Description of Artificial Sequence: Synthetic polypeptide"
  source: /note="p.E818K"
VLDAQRNTPTVLRPRDGSVDDRQSSKKATTSQDEAPREELAVQDSLESDLLA

SEQ ID NO: 2926 - protein, 52 aa, Artificial Sequence
  source: /note="Description of Artificial Sequence: Synthetic polypeptide"
  source: /note="p.F1117L"
IALALVEVYRDIILENNMDFTDIIKLLFNEMAERHNTKQVLKLARDLVYKVQ

SEQ ID NO: 2927 - protein, 96 aa, Artificial Sequence
  source: /note="Description of Artificial Sequence: Synthetic polypeptide"
  source: /note="p.P563fs"
ISQVSDNKASLPPKPGTMAAGGGGPSPSVLSGALPPVILFGNSWTQSQLPVSVRHGRKTKDGACGQQPGGRGGAKDTGPRAEEHHRDHEGPAETRD

SEQ ID NO: 2928 - protein, 63 aa, Artificial Sequence
  source: /note="Description of Artificial Sequence: Synthetic polypeptide"
  source: /note="p.L574fs"
LPPKPGTMAAGGGGPAPLSSAAPSPCHPLWEQLDTEPTPRLCSARKENQRWSLRPAARRPWRS

SEQ ID NO: 2929 - protein, 52 aa, Artificial Sequence
  source: /note="Description of Artificial Sequence: Synthetic polypeptide"
  source: /note="p.S759L"
SSDLITLPATTPPCPTKKEWEGPATLLYMTCSAYQKVQDSEISFPAGVEVQV

SEQ ID NO: 2930 - protein, 52 aa, Artificial Sequence
  source: /note="Description of Artificial Sequence: Synthetic polypeptide"
  source: /note="p.R318C"
RKVPGQFSITTALNTLNRMVHSPSGCCHMVEISTPVLISSSNPSVITQPMEK

SEQ ID NO: 2931 - protein, 52 aa, Artificial Sequence
  source: /note="Description of Artificial Sequence: Synthetic polypeptide"
  source: /note="p.R89C"
RCVNGPLQEAARRRLWALENEDQEVCCMLFKDLSARLVSIQSQRAQFLITFK

SEQ ID NO: 2932 - protein, 52 aa, Artificial Sequence
  source: /note="Description of Artificial Sequence: Synthetic polypeptide"
  source: /note="p.A460T"
RNSQTSKHDYSLSLRSNQGFMHMKLTTKTKEKYVLGQNSPPFDSVPEVIHYY

SEQ ID NO: 2933 - protein, 54 aa, Artificial Sequence
  source: /note="Description of Artificial Sequence: Synthetic polypeptide"
  source: /note="p.1156_1157EE>E"
EEEEEEEEEEEEEEEEEEEAEEEEEELPPQYFSSETSGSCALNPEEVLEQPQPL

SEQ ID NO: 2934 - protein, 52 aa, Artificial Sequence
  source: /note="Description of Artificial Sequence: Synthetic polypeptide"
  source: /note="p.V1217F"
LDFYMFLGPTPEVATKQYHEVIGHPFFMPAYWALGFQLCRYGYANTSEVREL

SEQ ID NO: 2935 - protein, 52 aa, Artificial Sequence
  source: /note="Description of Artificial Sequence: Synthetic polypeptide"
  source: /note="p.I1681K"
WFDYHTGKDIGVRGQFQTFNASYDTKKNLHVRGGHILPCQEPAQNTFYSRQK

SEQ ID NO: 2936 - protein, 36 aa, Artificial Sequence
  source: /note="Description of Artificial Sequence: Synthetic polypeptide"
  source: /note="p.P318fs"
QAAWSDAGVYTCQAENGVGSLVSPPSASTSSWLRSR

SEQ ID NO: 2937 - protein, 52 aa, Artificial Sequence
  source: /note="Description of Artificial Sequence: Synthetic polypeptide"
  source: /note="p.T250M"
SAQRTVRLRVAYAPRDLVISISRDNMMPALEPQPQGNVPYLEAQKGQFLRLL

SEQ ID NO: 2938 - protein, 52 aa, Artificial Sequence
  source: /note="Description of Artificial Sequence: Synthetic polypeptide"
  source: /note="p.S363F"
NRLGSQQQALDLSVQYPPENLRVMVFFQANRTVLENLGNGTSLPVLEGQSLR

SEQ ID NO: 2939 - protein, 32 aa, Artificial Sequence
  source: /note="Description of Artificial Sequence: Synthetic polypeptide"
  source: /note="p.Q678fs"
EVLEQQRLLQLQHHPAAAPGCSQAPSRPLPRL

SEQ ID NO: 2940 - protein, 52 aa, Artificial Sequence
  source: /note="Description of Artificial Sequence: Synthetic polypeptide"
  source: /note="p.V213M"
YLKIRQYSLDMSPFDGCYQNVGLVAMMGHSLPPSAVTEIKLHSNMFMFRASL

SEQ ID NO: 2941 - protein, 52 aa, Artificial Sequence
  source: /note="Description of Artificial Sequence: Synthetic polypeptide"
  source: /note="p.R1063Q"
SETYRMPVMEYKMNEGVSYEFKFPFQQNNNKWQRNASKGPHSPQVPSQVQSP

SEQ ID NO: 2942 - protein, 52 aa, Artificial Sequence
  source: /note="Description of Artificial Sequence: Synthetic polypeptide"
  source: /note="p.S1227Y"
PSWQRSEDSIADQMAYSYRGPQDFNYYFVLEQHEYTEPTCHLPAVSKVLPAF

SEQ ID NO: 2943 - protein, 52 aa, Artificial Sequence
  source: /note="Description of Artificial Sequence: Synthetic polypeptide"
  source: /note="p.G777A"
RVHNPCTDNVCYSMAVTRSKDAPPFAAPPIPSGTTFRKSDVFRDFLLAKVIN

SEQ ID NO: 2944 - protein, 53 aa, Artificial Sequence
  source: /note="Description of Artificial Sequence: Synthetic polypeptide"
  source: /note="p.D131del"
IRIGNITPADAGTYYCVKFRKGSPDVEFKSGAGTELSVRAKPSAPVVSGPAAR

SEQ ID NO: 2945 - protein, 52 aa, Artificial Sequence
  source: /note="Description of Artificial Sequence: Synthetic polypeptide"
  source: /note="p.V233I"
SIHSTAKVVLTREDVHSQVICEVAHIITLQGDPLRGTANLSETIRVPPTLEV

SEQ ID NO: 2946 - protein, 52 aa, Artificial Sequence
  source: /note="Description of Artificial Sequence: Synthetic polypeptide"
  source: /note="p.E191K"
TQVSNWFKNRRQRDRAAEAKERENTKKNNNSSSNKQNQLSPLEGGKPLMSSS

SEQ ID NO: 2947 - protein, 52 aa, Artificial Sequence
  source: /note="Description of Artificial Sequence: Synthetic polypeptide"
  source: /note="p.I27L"
VFRSPLDLYSSHFLLPNFADSHHRSLLLLASSGGGNGAGGGGGAGGGSGGGN

SEQ ID NO: 2948 - protein, 52 aa, Artificial Sequence
  source: /note="Description of Artificial Sequence: Synthetic polypeptide"
  source: /note="p.A62G"
AFSARWAQEAYKKESAKEAGAAAVPGGPVPAATEPPPVLHLPAIQPPPPVLP

SEQ ID NO: 2949 - protein, 52 aa, Artificial Sequence
  source: /note="Description of Artificial Sequence: Synthetic polypeptide"
  source: /note="p.Y883C"
EEMVQQLQIVRDTLCNELDQERKARCCAIQQKLKEAHDALHHFSCKMLTPRH

SEQ ID NO: 2950 - protein, 78 aa, Artificial Sequence
  source: /note="Description of Artificial Sequence: Synthetic polypeptide"
  source: /note="p.S277fs"
LIMVVILQLRRRGKTNHYQTTVEKKALRSMPKSRNQVLFRRNLTPSQLRTLAPPYMLLPQSLSQSLSRKQIPSQSMLV

SEQ ID NO: 2951 - protein, 52 aa, Artificial Sequence
  source: /note="Description of Artificial Sequence: Synthetic polypeptide"
  source: /note="p.F281L"
YKYSRVADYIVKVSLWSLLVTLVVLLLIMTGTMLGPELLASIPAAVYVIAIF

SEQ ID NO: 2952 - protein, 45 aa, Artificial Sequence
  source: /note="Description of Artificial Sequence: Synthetic polypeptide"
  source: /note="p.G109fs"
YLLAISFSLKPVQAIAVLIMGCCPGAPSLTFSPSGLMEIWISASV

SEQ ID NO: 2953 - protein, 52 aa, Artificial Sequence
  source: /note="Description of Artificial Sequence: Synthetic polypeptide"
  source: /note="p.S261L"
LILFIIFSIQLSFMLLTFIFSTRNNLLGFTPADTVAIIFCSTHKSLTLGIPM

SEQ ID NO: 2954 - protein, 52 aa, Artificial Sequence
  source: /note="Description of Artificial Sequence: Synthetic polypeptide"
  source: /note="p.S292L"
ANAVAVAMYVVGFAETVVDLLKESDLLMMVDPTNDIRIIGSITVVILLGISV

SEQ ID NO: 2955 - protein, 52 aa, Artificial Sequence
  source: /note="Description of Artificial Sequence: Synthetic polypeptide"
  source: /note="p.R828Q"
ALLHLVHDFTKNVGLMICGHVHMGPQQRQAMKEMSIDQAKYQRWLIKNKMKA

SEQ ID NO: 2956 - protein, 35 aa, Artificial Sequence
  source: /note="Description of Artificial Sequence: Synthetic polypeptide"
  source: /note="p.H686fs"
WGDGIRGLSLNAARYALLRVEHGPPTPRTGGPRCW

SEQ ID NO: 2957 - protein, 54 aa, Artificial Sequence
  source: /note="Description of Artificial Sequence: Synthetic polypeptide"
  source: /note="p.L493fs"
IVLLLGGGYALAKGSERSGLSEWLGKQADPTAECASSSHCHHPLPPGGHLHRVH

SEQ ID NO: 2958 - protein, 52 aa, Artificial Sequence
  source: /note="Description of Artificial Sequence: Synthetic polypeptide"
  source: /note="p.Q273P"
VNFASWFAFAFPNMLVMLLFAWLWLPPFVYMRFNFKKSWGCGLESKKNEKAA

SEQ ID NO: 2959 - protein, 42 aa, Artificial Sequence
  source: /note="Description of Artificial Sequence: Synthetic polypeptide"
  source: /note="p.R495Q"
YDFSFYICGLLYMIGILFLLIQPCIQQIIEQSRRKYMDGAHV

SEQ ID NO: 2960 - protein, 58 aa, Artificial Sequence
  source: /note="Description of Artificial Sequence: Synthetic polypeptide"
  source: /note="p.G98fs"
LTFSAPLATVLSNRFGHRLVVMLGGATCQHRDGGRLLLTRGFSYVRRHRHHLWSGILL

SEQ ID NO: 2961 - protein, 59 aa, Artificial Sequence
  source: /note="Description of Artificial Sequence: Synthetic polypeptide"
  source: /note="p.CVLLGG470del"
LGPPIVGWFYDWTQTYDIAFYFSGFFILLLAALPSWDTCNKQLPKPAPTTFLYKVASNV

SEQ ID NO: 2962 - protein, 52 aa, Artificial Sequence
  source: /note="Description of Artificial Sequence: Synthetic polypeptide"
  source: /note="p.V324I"
HLINQGYRAITVRKLMQGMGLGLSSIIFALCLGHTSSFCESVVFASASIGLQ

SEQ ID NO: 2963 - protein, 58 aa, Artificial Sequence
  source: /note="Description of Artificial Sequence: Synthetic polypeptide"
  source: /note="p.F348fs"
LIIHGGIFLPLIYFVVTRKNPFSFFCWHFPSLDHCPGHRFQCWNFACHLSLPGRKSGD

SEQ ID NO: 2964 - protein, 38 aa, Artificial Sequence
  source: /note="Description of Artificial Sequence: Synthetic polypeptide"
  source: /note="p.P328fs"
PLQAVVEERTVSFKLGDLEEAPEREASQRGLERGNQHR

SEQ ID NO: 2965 - protein, 52 aa, Artificial Sequence
  source: /note="Description of Artificial Sequence: Synthetic polypeptide"
  source: /note="p.S201L"
NGGMSLVAFVLLNECVGTAYWALAGLLIGGLFFAVGIAQYALLGYFIRSWRT

SEQ ID NO: 2966 - protein, 52 aa, Artificial Sequence
  source: /note="Description of Artificial Sequence: Synthetic polypeptide"
  source: /note="p.R407Q"
LQTLFGAVILLANCVAPWALKYMNRQQASQMLLMFLLAICLLAIIFVPQEMQ

SEQ ID NO: 2967 - protein, 52 aa, Artificial Sequence
  source: /note="Description of Artificial Sequence: Synthetic polypeptide"
  source: /note="p.A134V"
SENSTDHAQGDYPKDIFSLEERRKGVVIILHVIGMIYMFIALAIVCDEFFVP

SEQ ID NO: 2968 - protein, 52 aa, Artificial Sequence
  source: /note="Description of Artificial Sequence: Synthetic polypeptide"
  source: /note="p.R35S"
ARRALLLGILWATAHLPLSGTSLPQSSLPRATGNSTQCVISPSSEFPEGFFT

SEQ ID NO: 2969 - protein, 66 aa, Artificial Sequence
  source: /note="Description of Artificial Sequence: Synthetic polypeptide"
  source: /note="p.F28fs"
LSYESLVHAVAGAVGSVTAMTVFFPWIQLDFDFRLMRKENPKLHTWCSWRSLKKKDSWHHIEGGFQ

SEQ ID NO: 2970 - protein, 52 aa, Artificial Sequence
  source: /note="Description of Artificial Sequence: Synthetic polypeptide"
  source: /note="p.Q83E"
LRPKYNGILHCLTTIWKLDGLRGLYEEGVTPNIWGAGLSWGLYFFFYNAIKS

SEQ ID NO: 2971 - protein, 52 aa, Artificial Sequence
  source: /note="Description of Artificial Sequence: Synthetic polypeptide"
  source: /note="p.R96Q"
EGGNKLWYKKPGNFQGTLDAFFKIIQQNEGIKSLWSGLPPTLVMAVPATVIY

SEQ ID NO: 2972 - protein, 52 aa, Artificial Sequence
  source: /note="Description of Artificial Sequence: Synthetic polypeptide"
  source: /note="p.G106C"
LLVLTATSHQERRAQPPSYMHIFLACCCTGGFLQAYCLAPFDLIKVRLQNQT

SEQ ID NO: 2973 - protein, 52 aa, Artificial Sequence
  source: /note="Description of Artificial Sequence: Synthetic polypeptide"
  source: /note="p.A67T"
TLSCIRVVYRRESMFGFFKGMSFPLTTSIAVYNSVVFGVFSNTQRFLSQHRC

SEQ ID NO: 2974 - protein, 52 aa, Artificial Sequence
  source: /note="Description of Artificial Sequence: Synthetic polypeptide"
  source: /note="p.R101S"
VFGVFSNTQRFLSQHRCGEPEASPPSSTLSDLLLASMVAGVVSVGLGGPVDL

SEQ ID NO: 2975 - protein, 52 aa, Artificial Sequence
  source: /note="Description of Artificial Sequence: Synthetic polypeptide"
  source: /note="p.I79F"
IIDCVVRIPKEQGVLSFWRGNLANVFFRYFPTQALNFAFKDKYKQIFLGGVD

SEQ ID NO: 2976 - protein, 52 aa, Artificial Sequence
  source: /note="Description of Artificial Sequence: Synthetic polypeptide"
  source: /note="p.A118T"
DKYKQIFLGGVDKRTQFWLYFAGNLTTSGGAAGATSLCFVYPLDFARTRLAA

SEQ ID NO: 2977 - protein, 52 aa, Artificial Sequence
  source: /note="Description of Artificial Sequence: Synthetic polypeptide"
  source: /note="p.V88I"
WLPAYRLKEWLLSDIVSGISTGIVAIILQGLAFALLVDIPPVYGLYASFFPA

SEQ ID NO: 2978 - protein, 32 aa, Artificial Sequence
  source: /note="Description of Artificial Sequence: Synthetic polypeptide"
  source: /note="p.I629fs"
LAHCTASLIKAMTYYGNLDSEKPIFLNRYLLQ

SEQ ID NO: 2979 - protein, 89 aa, Artificial Sequence
  source: /note="Description of Artificial Sequence: Synthetic polypeptide"
  source: /note="p.P643fs"
VNVYGVTVPGHEGRAGMAALVLRPPTLWTLCSSTPTCLRTCHLMPGPDSSGSRSLWPPQRPSNSRKFGWQMRASTPAPCLTHCTFWTRL

SEQ ID NO: 2980 - protein, 52 aa, Artificial Sequence
  source: /note="Description of Artificial Sequence: Synthetic polypeptide"
  source: /note="p.A230D"
LIMILLLSFMPNSPRFLLSRGRDEEDDLRALAWLRGTDVDVHWEFEQIQDNV

SEQ ID NO: 2981 - protein, 52 aa, Artificial Sequence
  source: /note="Description of Artificial Sequence: Synthetic polypeptide"
  source: /note="p.A65T"
YNLSVVNTPHKVFKSFYNETYFERHTTTFMDGKLMLLLWSCTVSMFPLGGLL

SEQ ID NO: 2982 - protein, 52 aa, Artificial Sequence
  source: /note="Description of Artificial Sequence: Synthetic polypeptide"
  source: /note="p.H268Q"
LRGHTDMEAELEDMRAEARAERAEGQQLSVLHLCALRSLRWQLLSIIVLMAG

SEQ ID NO: 2983 - protein, 52 aa, Artificial Sequence
  source: /note="Description of Artificial Sequence: Synthetic polypeptide"
  source: /note="p.R194H"
LRSDVEAKSLEVWGSPEALAREKKLHHKEAEIEYRERLFRNQKILREYRDFL

SEQ ID NO: 2984 - protein, 52 aa, Artificial Sequence
  source: /note="Description of Artificial Sequence: Synthetic polypeptide"
  source: /note="p.V494I"
CFLLPSLFHLRLLWRKLLWHQVFFDIIAIFVIGGICSVSGFVHSLEGLIEAY

SEQ ID NO: 2985 - protein, 34 aa, Artificial Sequence
  source: /note="Description of Artificial Sequence: Synthetic polypeptide"
  source: /note="p.S542L"
CVFIGFGWWFFLGPKFKKLQDEGSSLLWKCKRNN

SEQ ID NO: 2986 - protein, 43 aa, Artificial Sequence
  source: /note="Description of Artificial Sequence: Synthetic polypeptide"
  source: /note="p.*417S"
VWRLVRGTRYMKKDYLIENEELPSPSSEGGACTYLCAYTYFIC

SEQ ID NO: 2987 - protein, 52 aa, Artificial Sequence
  source: /note="Description of Artificial Sequence: Synthetic polypeptide"
  source: /note="p.A280T"
CNKAFVFLLSWIVLRDRFMGVRIVATTILAIAGIVMMTYADGFHSHSVIGIA

SEQ ID NO: 2988 - protein, 42 aa, Artificial Sequence
  source: /note="Description of Artificial Sequence: Synthetic polypeptide"
  source: /note="p.K62fs"
INEGYGNFMEENPKKGLLSEMKKKGELSLEPWIPYLHQQKTQ

SEQ ID NO: 2989 - protein, 32 aa, Artificial Sequence
  source: /note="Description of Artificial Sequence: Synthetic polypeptide"
  source: /note="p.V528I"
ACALLFLIRLIHKELSCPGSATGDQIIPFKEQ

SEQ ID NO: 2990 - protein, 52 aa, Artificial Sequence
  source: /note="Description of Artificial Sequence: Synthetic polypeptide"
  source: /note="p.G100R"
MSVFNLSNAIMGSGILGLAFALANTRRILLFLVLLTSVTLLSIYSINLLLIC

SEQ ID NO: 2991 - protein, 54 aa, Artificial Sequence
  source: /note="Description of Artificial Sequence: Synthetic polypeptide"
  source: /note="p.1071_1072II>I"
SDLRRRRRDLGPHAEGQLAPRDGVIIGLNPLPDVQVNDLRGALDAQLRQAAGGA

SEQ ID NO: 2992 - protein, 52 aa, Artificial Sequence
  source: /note="Description of Artificial Sequence: Synthetic polypeptide"
  source: /note="p.C628S"
ILMNFISSLTAFMGLYIGLSVSADPSSVQDWIFTVTAGMFLYLSLVEMLPEM

SEQ ID NO: 2993 - protein, 52 aa, Artificial Sequence
  source: /note="Description of Artificial Sequence: Synthetic polypeptide"
  source: /note="p.R53L"
AFPQTTEKISPNWESGINVDLAISTLLQYHLQQLFYRYGENNSLSVEGFRKL

SEQ ID NO: 2994 - protein, 52 aa, Artificial Sequence
  source: /note="Description of Artificial Sequence: Synthetic polypeptide"
  source: /note="p.R382C"
LHEVPHEVGDFAILVQSGCSKKQAMCCLQLLTAVGALAGTACALLTEGGAVG

SEQ ID NO: 2995 - protein, 35 aa, Artificial Sequence
  source: /note="Description of Artificial Sequence: Synthetic polypeptide"
  source: /note="p.L456fs"
SVLPELLREASPLQSLLEVLGLLGGSYHDGADCPP

SEQ ID NO: 2996 - protein, 52 aa, Artificial Sequence
  source: /note="Description of Artificial Sequence: Synthetic polypeptide"
  source: /note="p.P133L"
LVGSACFTASCTLMALASRDVEALSLLLIFLALSLNGFGGICLTFTSLTLPN

SEQ ID NO: 2997 - protein, 52 aa, Artificial Sequence
  source: /note="Description of Artificial Sequence: Synthetic polypeptide"
  source: /note="p.R216H"
LLYEKGISLRASFIFISVCSTWHVAHHTFLLMPRGHIPYPLPPNYSYGLCPG

SEQ ID NO: 2998 - protein, 52 aa, Artificial Sequence
  source: /note="Description of Artificial Sequence: Synthetic polypeptide"
  source: /note="p.V70F"
KPADTPSEEEDFGDPRTYDPDFKGPFFANRSCTDVLCCMIFLLCIIGYIVLG

SEQ ID NO: 2999 - protein, 52 aa, Artificial Sequence
  source: /note="Description of Artificial Sequence: Synthetic polypeptide"
  source: /note="p.R185H"
CPEKFLTYVEMQLLYTKDKSYWEDYHHQFCKTTAKPVKSLTQLLLDDDCPTA

SEQ ID NO: 3000 - protein, 48 aa, Artificial Sequence
  source: /note="Description of Artificial Sequence: Synthetic polypeptide"
  source: /note="p.L1061fs"
SQKARRLLKGSGFHLDLLLIGSLGGSVGCLGCPGSRLPRSAPSPMSMR

SEQ ID NO: 3001 - protein, 52 aa, Artificial Sequence
  source: /note="Description of Artificial Sequence: Synthetic polypeptide"
  source: /note="p.I533V"
WFPSDFYDGFHIQSISAILFIYLGCVVTNAITFGGLLGDATDNYQGVMESFL

SEQ ID NO: 3002 - protein, 52 aa, Artificial Sequence
  source: /note="Description of Artificial Sequence: Synthetic polypeptide"
  source: /note="p.N229K"
LNDSMRVKVREALLKKHHHQNEKKRKKNLIPIVRSFAEVGKKQSDPHLMDKH

SEQ ID NO: 3003 - protein, 53 aa, Artificial Sequence
  source: /note="Description of Artificial Sequence: Synthetic polypeptide"
  source: /note="p.G370del"
LSLLGMLFGAYLMALAILSPCPPLVTTAGVVLVVLSWVLCLCVFSYVKVAASS

SEQ ID NO: 3004 - protein, 67 aa, Artificial Sequence
  source: /note="Description of Artificial Sequence: Synthetic polypeptide"
  source: /note="p.G399fs"
LSWVLCLGVFSYVKVAASSLLHGGGPAGIAGSRRGHPGGLSARRCCYVPPDQHLSRVPQQKGLCRPL

SEQ ID NO: 3005 - protein, 52 aa, Artificial Sequence
  source: /note="Description of Artificial Sequence: Synthetic polypeptide"
  source: /note="p.G53W"
DISIIVIYFVVVMAVGLWAMFSTNRWWTVGGFFLAGRSMVWWPIGASLFASN

SEQ ID NO: 3006 - protein, 52 aa, Artificial Sequence
  source: /note="Description of Artificial Sequence: Synthetic polypeptide"
  source: /note="p.G336C"
KTTEEADMILPIVLQYLCPVYISFFCCLGAVSAAVMSSADSSILSASSMFAR

SEQ ID NO: 3007 - protein, 52 aa, Artificial Sequence
  source: /note="Description of Artificial Sequence: Synthetic polypeptide"
  source: /note="p.G442V"
IFPQLLCVLFVKGTNTYGAVAGYVSVVLFLRITGGEPYLYLQPLIFYPGYYP

SEQ ID NO: 3008 - protein, 52 aa, Artificial Sequence
  source: /note="Description of Artificial Sequence: Synthetic polypeptide"
  source: /note="p.K88N"
WSFFTPLVCMGIFIFNVVYYKPLVYNNNTNVYPWWGEAMGWAFVLSSMLCMP

SEQ ID NO: 3009 - protein, 52 aa, Artificial Sequence
  source: /note="Description of Artificial Sequence: Synthetic polypeptide"
  source: /note="p.W299L"
TLPGASEGIKFYLYPDLSRLSDPQVLLVDAGTQIFFSYAICLGCLTALGSYN

SEQ ID NO: 3010 - protein, 39 aa, Artificial Sequence
  source: /note="Description of Artificial Sequence: Synthetic polypeptide"
  source: /note="p.A85fs"
FPYLTYSNGGGAFLIPYAIMLALAGFTFVLSGVFTGTIC

SEQ ID NO: 3011 - protein, 52 aa, Artificial Sequence
  source: /note="Description of Artificial Sequence: Synthetic polypeptide"
  source: /note="p.R94K"
LLPQLMAQHSLAMAQNGAVPSEATKKKDQNLKRGNWGNQIEFVLTSVGYAVG

SEQ ID NO: 3012 - protein, 52 aa, Artificial Sequence
  source: /note="Description of Artificial Sequence: Synthetic polypeptide"
  source: /note="p.R243W"
AYCNNPWNTHDCAGVLDASNLTNGSWWPAALPSNLSHLLNHSLQRTSPSEEY

SEQ ID NO: 3013 - protein, 36 aa, Artificial Sequence
  source: /note="Description of Artificial Sequence: Synthetic polypeptide"
  source: /note="p.P157fs"
TSLAVISMTFSNYVLQPVFPNCIPPPQPPGCCPWPA

SEQ ID NO: 3014 - protein, 52 aa, Artificial Sequence
  source: /note="Description of Artificial Sequence: Synthetic polypeptide"
  source: /note="p.R322W"
TLAGAATCFYAFVGFDCIATTGEEVWWNPQKAIPIGIVTSLLVCFMAYFGVS

SEQ ID NO: 3015 - protein, 52 aa, Artificial Sequence
  source: /note="Description of Artificial Sequence: Synthetic polypeptide"
  source: /note="p.R431H"
VSKIFFEQGTYQCLENCGTVALTIIHHRGGDLTNTVFVDFRTEDGTANAGSD

SEQ ID NO: 3016 - protein, 52 aa, Artificial Sequence
  source: /note="Description of Artificial Sequence: Synthetic polypeptide"
  source: /note="p.G433C"
KIFFEQGTYQCLENCGTVALTIIRRCCGDLTNTVFVDFRTEDGTANAGSDYE

SEQ ID NO: 3017 - protein, 58 aa, Artificial Sequence
  source: /note="Description of Artificial Sequence: Synthetic polypeptide"
  source: /note="p.T746fs"
SPQSYKMEWKNEVDVDSGRDMPSTPQHPTAEKRAPRRQAYYSSPFSLKTSLAQRGKTV

SEQ ID NO: 3018 - protein, 52 aa, Artificial Sequence
  source: /note="Description of Artificial Sequence: Synthetic polypeptide"
  source: /note="p.R631H"
RTLSYNKYNLKPQTSEKQAKEILIRHHQNTLRESMRKGHSLPWGKPAGTKNI

SEQ ID NO: 3019 - protein, 52 aa, Artificial Sequence
  source: /note="Description of Artificial Sequence: Synthetic polypeptide"
  source: /note="p.L447F"
TKVPAKDYFVATTIVVVFFTVIVQGFFTIKPLVKWLKVKRSEHHKPTLNQEL

SEQ ID NO: 3020 - protein, 71 aa, Artificial Sequence
  source: /note="Description of Artificial Sequence: Synthetic polypeptide"
  source: /note="p.V446fs"
FAGFSFKEKIFIALAWMPKATVQAVRSSGSRNSKSLRTPLGTICEGCDDSSIFSHLDHSSKWSSTYGHSGA

SEQ ID NO: 3021 - protein, 52 aa, Artificial Sequence
  source: /note="Description of Artificial Sequence: Synthetic polypeptide"
  source: /note="p.M479I"
IFHPVCGDNGIEYLSPCHAGCSNINIISSATSKQLIYLNCSCVTGGSASAKT

SEQ ID NO: 3022 - protein, 52 aa, Artificial Sequence
  source: /note="Description of Artificial Sequence: Synthetic polypeptide"
  source: /note="p.R1460L"
SGTKGAHCVCDPGFSGELCEQESECLLGDPVRDFHQVQRGYAICQTTRPLSW

SEQ ID NO: 3023 - protein, 88 aa, Artificial Sequence
  source: /note="Description of Artificial Sequence: Synthetic polypeptide"
  source: /note="p.K45fs"
TGDVCKEKICSCNEIEGDLHVDCEKRASQVCSVSLPRLPSFTIYFCMAIPSLDFSLMSSLTFIMRLVCTWKTMACMKSFRGLFWGCSW

SEQ ID NO: 3024 - protein, 52 aa, Artificial Sequence
  source: /note="Description of Artificial Sequence: Synthetic polypeptide"
  source: /note="p.R52H"
KICSCNEIEGDLHVDCEKKGFTSLQHHFTAPTSQFYHLFLHGNSLTRLFPNE

SEQ ID NO: 3025 - protein, 52 aa, Artificial Sequence
  source: /note="Description of Artificial Sequence: Synthetic polypeptide"
  source: /note="p.R214L"
PTNLFKAVSLTHLDLRGNRLKVLFYLLGMLDHIGRSLMELQLEENPWNCTCE

SEQ ID NO: 3026 - protein, 52 aa, Artificial Sequence
  source: /note="Description of Artificial Sequence: Synthetic polypeptide"
  source: /note="p.S298L"
REIRKTELCPLLSDSEVEASLGIPHLLSSSKENAWPTKPSSMLSSVHFTASS

SEQ ID NO: 3027 - protein, 52 aa, Artificial Sequence
  source: /note="Description of Artificial Sequence: Synthetic polypeptide"
  source: /note="p.R468M"
NRISMIQDRAFGDLTNLRRLYLNGNMMIERLSPELFYGLQSLQYLFLQYNLI

SEQ ID NO: 3028 - protein, 52 aa, Artificial Sequence
  source: /note="Description of Artificial Sequence: Synthetic polypeptide"
  source: /note="p.R68L"
YYGEICDNACPCEEKDGILTVSCENLLGIISLSEISPPRFPIYHLLLSGNLL

SEQ ID NO: 3029 - protein, 52 aa, Artificial Sequence
  source: /note="Description of Artificial Sequence: Synthetic polypeptide"
  source: /note="p.N741K"
HLQRSLLEQENHSPLTGSNMKYKTTKKQSTEFLSFQDASSLYRNILEKEREL

SEQ ID NO: 3030 - protein, 52 aa, Artificial Sequence
  source: /note="Description of Artificial Sequence: Synthetic polypeptide"
  source: /note="p.R321Q"
SLTVDGFTDPSNSERFCLGLLSNVNQQNATVEMTRRHIGRGVRLYYIGGEVF

SEQ ID NO: 3031 - protein, 52 aa, Artificial Sequence
  source: /note="Description of Artificial Sequence: Synthetic polypeptide"
  source: /note="p.R361H"
GETFKVPSSCPIVTVDGYVDPSGGDHHFCLGQLSNVHRTEAIERARLHIGKG

SEQ ID NO: 3032 - protein, 72 aa, Artificial Sequence
  source: /note="Description of Artificial Sequence: Synthetic polypeptide"
  source: /note="p.E169fs"
QPLVSSPSLQAAVDKNKLEKEKEKKRKRKREKRSQKSRQNHLQLKSCRRKISNWSLKKVPALKKLRSPLWIF

SEQ ID NO: 3033 - protein, 52 aa, Artificial Sequence
  source: /note="Description of Artificial Sequence: Synthetic polypeptide"
  source: /note="p.R381Q"
QKPRGLDPVEILQEREYRLQARIAHQQIQELENLPGSLAGDLRTKATIELKA

SEQ ID NO: 3034 - protein, 52 aa, Artificial Sequence
  source: /note="Description of Artificial Sequence: Synthetic polypeptide"
  source: /note="p.P913L"
NHHCKLTQVLNTHYVAPRRLLLTGTLLLQNKLPELWALLNFLLPTIFKSCST

SEQ ID NO: 3035 - protein, 42 aa, Artificial Sequence
  source: /note="Description of Artificial Sequence: Synthetic polypeptide"
  source: /note="p.T156fs"
KQNLLSVGDYRHRRTEQEEDEELLTAPKQPMFALDLKTLHRM

SEQ ID NO: 3036 - protein, 52 aa, Artificial Sequence
  source: /note="Description of Artificial Sequence: Synthetic polypeptide"
  source: /note="p.E970Q"
ELGSLPQEAFEKYQTLSLKQLFRKLQQQCNTELKKYSHVNKKALDQFVNFSE

SEQ ID NO: 3037 - protein, 52 aa, Artificial Sequence
  source: /note="Description of Artificial Sequence: Synthetic polypeptide"
  source: /note="p.E175K"
VRPFCMAYISADQHKIMQQFQELSAKKFSRASECLKTGNRKAFAGELEKKLK

SEQ ID NO: 3038 - protein, 52 aa, Artificial Sequence
  source: /note="Description of Artificial Sequence: Synthetic polypeptide"
  source: /note="p.P2696H"
LICNTTVERCQELYRKYEMQYAPQPHHPTVCQFITATEMTLQRYAADINSRL

SEQ ID NO: 3039 - protein, 34 aa, Artificial Sequence
  source: /note="Description of Artificial Sequence: Synthetic polypeptide"
  source: /note="p.E846fs"
TQDPIKLFEPSLQPPVMQQQPLEKKNEAFSHGAI

SEQ ID NO: 3040 - protein, 31 aa, Artificial Sequence
  source: /note="Description of Artificial Sequence: Synthetic polypeptide"
  source: /note="p.D211fs"
QNMKHVISVDKSKPDKALSLIKDDFLTILRT

SEQ ID NO: 3041 - protein, 35 aa, Artificial Sequence
  source: /note="Description of Artificial Sequence: Synthetic polypeptide"
  source: /note="p.T292fs"
IPAGGSLGPAAEGDGAGSKAPEETPQPPRRPSTAN

SEQ ID NO: 3042 - protein, 52 aa, Artificial Sequence
  source: /note="Description of Artificial Sequence: Synthetic polypeptide"
  source: /note="p.Q38E"
GPAVPTVQRGIIKMVLSGCAIIVRGEEPRGGPPPERQINLSNIRAGNLARRA

SEQ ID NO: 3043 - protein, 26 aa, Artificial Sequence
  source: /note="Description of Artificial Sequence: Synthetic peptide"
  source: /note="p.H721fs"
VQDVETGTQLEKLMENMRNDIASHPL

SEQ ID NO: 3044 - protein, 26 aa, Artificial Sequence
  source: /note="Description of Artificial Sequence: Synthetic peptide"
  source: /note="p.F64fs"
GRIDIKQLIAKKIKLTAEAEELKPFL

SEQ ID NO: 3045 - protein, 52 aa, Artificial Sequence
  source: /note="Description of Artificial Sequence: Synthetic polypeptide"
  source: /note="p.R714H"
GFLMGASCGGGNMKVDDSAYESLGLHHPRHAYSILDVRDVQGTRLLRLRNPW

SEQ ID NO: 3046 - protein, 52 aa, Artificial Sequence
  source: /note="Description of Artificial Sequence: Synthetic polypeptide"
  source: /note="p.S908L"
AQMLASGTMDAQMLASSTQDSAMLGLLKSPDPYRLAQDPYRLAQDPYRLGHD

SEQ ID NO: 3047 - protein, 74 aa, Artificial Sequence
  source: /note="Description of Artificial Sequence: Synthetic polypeptide"
  source: /note="p.VLESSAVT1359del"
LAESILEPPAMAAPESSAMAVLESSTVTVLESSTVTVLEPSVVTVPEPPVVAEPDYVTIPVPVVSALEPSVPVL

SEQ ID NO: 3048 - protein, 52 aa, Artificial Sequence
  source: /note="Description of Artificial Sequence: Synthetic polypeptide"
  source: /note="p.F570L"
VLTNEKMSRDISPEEIDLKNEPWYKLLFSELEFGKPPPKKIWDYTPGDCSIL

SEQ ID NO: 3049 - protein, 52 aa, Artificial Sequence
  source: /note="Description of Artificial Sequence: Synthetic polypeptide"
  source: /note="p.V1156M"
AERGAGERGPGGPKISKKSCLKPSDMMVRCLSTEQRLSDLNTPEESRPGKPL

SEQ ID NO: 3050 - protein, 52 aa, Artificial Sequence
  source: /note="Description of Artificial Sequence: Synthetic polypeptide"
  source: /note="p.P866S"
VFEALDSALKDICDQIKAEKKRGSLSSDNSILHRLISELLPDVPERNSSLRA

SEQ ID NO: 3051 - protein, 89 aa, Artificial Sequence
  source: /note="Description of Artificial Sequence: Synthetic polypeptide"
  source: /note="p.E1158fs"
DRIHSLSSNKPQRPVFTHENIQGGGNRFRLCITILPGMKMSWSSEKVMSLMSWKSVMTAGLWGPQEEPNSLVLSPETTSRGCELRSLLL

SEQ ID NO: 3052 - protein, 52 aa, Artificial Sequence
  source: /note="Description of Artificial Sequence: Synthetic polypeptide"
  source: /note="p.R320W"
FWSVSGVDADPDLVHVEAQDLGGDFWWYVTCAIHNCSEKMLTAPFAGPIDHG

SEQ ID NO: 3053 - protein, 52 aa, Artificial Sequence
  source: /note="Description of Artificial Sequence: Synthetic polypeptide"
  source: /note="p.R205L"
ADAYAQYLWITFDFCNTLQGFSIPFLLAADLLLHSKASNLLLGFDRSHPNKQ

SEQ ID NO: 3054 - protein, 52 aa, Artificial Sequence
  source: /note="Description of Artificial Sequence: Synthetic polypeptide"
  source: /note="p.N233Y"
FMAEIRQYIRELNLIIKVFREPFVSYYSKLFSANDVENIFSRIVDIHELSVK

SEQ ID NO: 3055 - protein, 52 aa, Artificial Sequence
  source: /note="Description of Artificial Sequence: Synthetic polypeptide"
  source: /note="p.R124P"
AAQPSKPTSTVLPRSASAPGAPPLVPPVPRPVEPPGDLGLPTEPQDTPGGPA

SEQ ID NO: 3056 - protein, 38 aa, Artificial Sequence
  source: /note="Description of Artificial Sequence: Synthetic polypeptide"
  source: /note="p.S403I"
PYQGHDSGVNLPDSHGAISSVVSDAIISAVYYCNYPDV

SEQ ID NO: 3057 - protein, 52 aa, Artificial Sequence
  source: /note="Description of Artificial Sequence: Synthetic polypeptide"
  source: /note="p.R719W"
HLEKYPNYKYKPRPKRTCIVDGKKLWWIGEYKQLMRSRRQEMRQFFTVGQQP

SEQ ID NO: 3058 - protein, 38 aa, Artificial Sequence
  source: /note="Description of Artificial Sequence: Synthetic polypeptide"
  source: /note="p.L309fs"
RRIPHLPGHPYSPEYAPSPLHCSHPWAPWPLASPPASP

SEQ ID NO: 3059 - protein, 52 aa, Artificial Sequence
  source: /note="Description of Artificial Sequence: Synthetic polypeptide"
  source: /note="p.E75K"
ENTFPKGEPDLKKESEEDKFPVCIRKKAVSQVLKGYDWTLVPMPVRVNGSSK

SEQ ID NO: 3060 - protein, 38 aa, Artificial Sequence
  source: /note="Description of Artificial Sequence: Synthetic polypeptide"
  source: /note="p.E11del"
MSDQKKEEEEAAAAAAMATEGGKTSEPENNNKKPKTSG

SEQ ID NO: 3061 - protein, 33 aa, Artificial Sequence
  source: /note="Description of Artificial Sequence: Synthetic polypeptide"
  source: /note="p.E7K"
MSDQKKKKEEEEAAAAAAMATEGGKTSEPENNN

SEQ ID NO: 3062 - protein, 52 aa, Artificial Sequence
  source: /note="Description of Artificial Sequence: Synthetic polypeptide"
  source: /note="p.V439L"
GDTTVKLWDLCKGDCILTFEGHSRALLWSCTWHSCGNFVASSSLDKTSKIWD

SEQ ID NO: 3063 - protein, 52 aa, Artificial Sequence
  source: /note="Description of Artificial Sequence: Synthetic polypeptide"
  source: /note="p.P488S"
WDVNSERCRCTLYGHTDSVNSIEFFSSFSNTLLTSSADKTLSIWDARTGICE

SEQ ID NO: 3064 - protein, 27 aa, Artificial Sequence
  source: /note="Description of Artificial Sequence: Synthetic peptide"
  source: /note="p.Q1264fs"
GQESTGQYVIDEEPTWDIMVRQSYPRG

SEQ ID NO: 3065 - protein, 52 aa, Artificial Sequence
  source: /note="Description of Artificial Sequence: Synthetic polypeptide"
  source: /note="p.R346Q"
LVYTFGETVALGASGIVIWGTLSIMQQSMKSCLLLDNYMETILNPYIINVTL

SEQ ID NO: 3066 - protein, 52 aa, Artificial Sequence
  source: /note="Description of Artificial Sequence: Synthetic polypeptide"
  source: /note="p.R72K"
QVRAYIRHLNRIVTIIQKWWRSFLGKKKQYQLTVQVAYYTMMMNLYNAMAVR

SEQ ID NO: 3067 - protein, 52 aa, Artificial Sequence
  source: /note="Description of Artificial Sequence: Synthetic polypeptide"
  source: /note="p.S150L"
NDFKPQCKRTNLVANDGKNSCPVSSLVAQQQKQLRIPEPPNLSRNKETELLR

SEQ ID NO: 3068 - protein, 46 aa, Artificial Sequence
  source: /note="Description of Artificial Sequence: Synthetic polypeptide"
  source: /note="p.C685fs"
KVCTKTMPIGPDVSLENLAAETCFFLELILETSAQKLLCWLCKKMD

SEQ ID NO: 3069 - protein, 52 aa, Artificial Sequence
  source: /note="Description of Artificial Sequence: Synthetic polypeptide"
  source: /note="p.C189F"
AVLKKVKNIFQEEESIRQNREESENFFRKAFSEPVLSEPMFAEGEIKAKPYR

SEQ ID NO: 3070 - protein, 52 aa, Artificial Sequence
  source: /note="Description of Artificial Sequence: Synthetic polypeptide"
  source: /note="p.A944V"
EAEGGLCRLRILAAERGDAGFYTCKVVVNEYGARQCEARLEVRAHPESRSLA

SEQ ID NO: 3071 - protein, 27 aa, Artificial Sequence
  source: /note="Description of Artificial Sequence: Synthetic peptide"
  source: /note="p.A992fs"
AVLAPLQDVDVGAGEMALFECLVAGAH

SEQ ID NO: 3072 - protein, 38 aa, Artificial Sequence
  source: /note="Description of Artificial Sequence: Synthetic polypeptide"
  source: /note="p.E803fs"
RLERYTKNEKTDKERTFDPERVERETLNTEGKSGKGQN

SEQ ID NO: 3073 - protein, 52 aa, Artificial Sequence
  source: /note="Description of Artificial Sequence: Synthetic polypeptide"
  source: /note="p.F121L"
EETTTFPTGGFTPEIGKKKHTESTPLLWSIKPNNVSIVLHAEEPYIENEEPE

SEQ ID NO: 3074 - protein, 26 aa, Artificial Sequence
  source: /note="Description of Artificial Sequence: Synthetic peptide"
  source: /note="p.F232fs"
QPPPLETLGLDADELILIPNGVQIFL

SEQ ID NO: 3075 - protein, 52 aa, Artificial Sequence
  source: /note="Description of Artificial Sequence: Synthetic polypeptide"
  source: /note="p.M150V"
ANTIIGKAVEHMFEGEHGSKDEWRGVVVLAQAPIMKAWFYITYEKDPVLYMY

SEQ ID NO: 3076 - protein, 52 aa, Artificial Sequence
  source: /note="Description of Artificial Sequence: Synthetic polypeptide"
  source: /note="p.Y171C"
PVMDTWFYITYEKDPVLYMYTLLDDCCKDGDLRIIPDSNYYFPTAEQEPGEV

SEQ ID NO: 3077 - protein, 52 aa, Artificial Sequence
  source: /note="Description of Artificial Sequence: Synthetic polypeptide"
  source: /note="p.A316V"
LREEECILACRGVQGGPLRGSSGAQVVTFPQGPSMERRHPVCSGTCQPTQFR

SEQ ID NO: 3078 - protein, 52 aa, Artificial Sequence
  source: /note="Description of Artificial Sequence: Synthetic polypeptide"
  source: /note="p.E50K"
TQIKVVKFSYMWTINNFSFCREEMGKKVIKSSTFSSGANDKLKWCLRVNPKG

SEQ ID NO: 3079 - protein, 52 aa, Artificial Sequence
  source: /note="Description of Artificial Sequence: Synthetic polypeptide"
  source: /note="p.F102V"
DEESKDYLSLYLLLVSCPKSEVRAKVVKFSILNAKGEETKAMESQRAYRFVQ

SEQ ID NO: 3080 - protein, 52 aa, Artificial Sequence
  source: /note="Description of Artificial Sequence: Synthetic polypeptide"
  source: /note="p.F102C"
DEESKDYLSLYLLLVSCPKSEVRAKCCKFSILNAKGEETKAMESQRAYRFVQ

SEQ ID NO: 3081 - protein, 52 aa, Artificial Sequence
  source: /note="Description of Artificial Sequence: Synthetic polypeptide"
  source: /note="p.W131G"
ILNAKGEETKAMESQRAYRFVQGKDGGGFKKFIRRDFLLDEANGLLPDDKLT

SEQ ID NO: 3082 - protein, 52 aa, Artificial Sequence
  source: /note="Description of Artificial Sequence: Synthetic polypeptide"
  source: /note="p.F133I"
NAKGEETKAMESQRAYRFVQGKDWGIIKKFIRRDFLLDEANGLLPDDKLTLF

SEQ ID NO: 3083 - protein, 52 aa, Artificial Sequence
  source: /note="Description of Artificial Sequence: Synthetic polypeptide"
  source: /note="p.F133V"
NAKGEETKAMESQRAYRFVQGKDWGVVKKFIRRDFLLDEANGLLPDDKLTLF

SEQ ID NO: 3084 - protein, 52 aa, Artificial Sequence
  source: /note="Description of Artificial Sequence: Synthetic polypeptide"
  source: /note="p.F133C"
NAKGEETKAMESQRAYRFVQGKDWGCCKKFIRRDFLLDEANGLLPDDKLTLF

SEQ ID NO: 3085 - protein, 52 aa, Artificial Sequence
  source: /note="Description of Artificial Sequence: Synthetic polypeptide"
  source: /note="p.F133L"
NAKGEETKAMESQRAYRFVQGKDWGLLKKFIRRDFLLDEANGLLPDDKLTLF

SEQ ID NO: 3086 - protein, 52 aa, Artificial Sequence
  source: /note="Description of Artificial Sequence: Synthetic polypeptide"
  source: /note="p.K1732T"
EKLKEAYALFQFFQDLDDEESWIEETTLIRVSSQDYGRDLQGVQNLLKKHKR

SEQ ID NO: 3087 - protein, 52 aa, Artificial Sequence
  source: /note="Description of Artificial Sequence: Synthetic polypeptide"
  source: /note="p.A2011V"
PEITDLKDKLISAQHNQSKAIEERYVVALLKRWEQLLEASAVHRQKLLEKQL

SEQ ID NO: 3088 - protein, 52 aa, Artificial Sequence
  source: /note="Description of Artificial Sequence: Synthetic polypeptide"
  source: /note="p.D2243Y"
DLGDNLEDALILDIKYSTIGLAQQWYYQLYQLGLRMQHNLEQQIQAKDIKGV

SEQ ID NO: 3089 - protein, 52 aa, Artificial Sequence
  source: /note="Description of Artificial Sequence: Synthetic polypeptide"
  source: /note="p.G2367C"
FLIDKESENIKSSDEIENAFQALAECCKSYITKEDMKQALTPEQVSFCATHM

SEQ ID NO: 3090 - protein, 52 aa, Artificial Sequence
  source: /note="Description of Artificial Sequence: Synthetic polypeptide"
  source: /note="p.R86C"
KWVNSHLARVSCRITDLYKDLRDGRCLLIKLLEVLSGEMLPKPTKGKMRIHC

SEQ ID NO: 3091 - protein, 52 aa, Artificial Sequence
  source: /note="Description of Artificial Sequence: Synthetic polypeptide"
  source: /note="p.T1864I"
AFERELHLLGVQVQQFQDVATRLQTIVYAGEKAEAIQNKEQEVSAAWQALLD

SEQ ID NO: 3092 - protein, 52 aa, Artificial Sequence
  source: /note="Description of Artificial Sequence: Synthetic polypeptide"
  source: /note="p.A1993V"
ADKPRDVSSVEVLMNYHQGLKTELEVVRVPELTTCQELGRSLLLNKSAMADE

SEQ ID NO: 3093 - protein, 52 aa, Artificial Sequence
  source: /note="Description of Artificial Sequence: Synthetic polypeptide"
  source: /note="p.R97K"
IGTLFGYLRDFLRNWGIEKCNAAVEKKKEQKDFVPLYQDFENFYTRNLYMRI

SEQ ID NO: 3094 - protein, 36 aa, Artificial Sequence
  source: /note="Description of Artificial Sequence: Synthetic polypeptide"
  source: /note="p.P485fs"
GSSRGPGRPVSSPHELRRPVSGLGPRGGLSVALGDP

SEQ ID NO: 3095 - protein, 45 aa, Artificial Sequence
  source: /note="Description of Artificial Sequence: Synthetic polypeptide"
  source: /note="p.Q1875fs"
RSGPPSPPSTATSFGGPRPRRQPPPTTSFPFLSGLPGGKAEAAAV

SEQ ID NO: 3096 - protein, 45 aa, Artificial Sequence; identical to SEQ ID NO: 3095
  source: /note="Description of Artificial Sequence: Synthetic polypeptide"
  source: /note="p.P1876fs"

SEQ ID NO: 3097 - protein, 28 aa, Artificial Sequence
  source: /note="Description of Artificial Sequence: Synthetic peptide"
  source: /note="p.P865fs"
LSQSPKKVTAETDFNKSVDFEMPPPAPR

SEQ ID NO: 3098 - protein, 37 aa, Artificial Sequence
  source: /note="Description of Artificial Sequence: Synthetic polypeptide"
  source: /note="p.H763fs"
LSRAQSLCGPEHSAVPDSLRWLCHPWARSFSWSGAGL

SEQ ID NO: 3099 - protein, 52 aa, Artificial Sequence
  source: /note="Description of Artificial Sequence: Synthetic polypeptide"
  source: /note="p.T61M"
EQQTEMRVQLLQDLQDFFRKKAEIEMMEYSRNLEKLAERFMAKTRSTKDHQQ

SEQ ID NO: 3100 - protein, 40 aa, Artificial Sequence
  source: /note="Description of Artificial Sequence: Synthetic polypeptide"
  source: /note="p.G14S"
MASADSRRVADGGSSAGGTFQPYLDTLRQELQQTDPTLLS

SEQ ID NO: 3101 - protein, 52 aa, Artificial Sequence
  source: /note="Description of Artificial Sequence: Synthetic polypeptide"
  source: /note="p.A2257S"
IPAASAAAMNLASARTPAIPTAVNLSSDSRTPAAAAAMNLASPRTAVAPSAV

SEQ ID NO: 3102 - protein, 38 aa, Artificial Sequence
  source: /note="Description of Artificial Sequence: Synthetic polypeptide"
  source: /note="p.G17fs"
MSNTTVVPSTAGPGPSGGARWRRWWWRRRRRHRGNPGD

SEQ ID NO: 3103 - protein, 66 aa, Artificial Sequence
  source: /note="Description of Artificial Sequence: Synthetic polypeptide"
  source: /note="p.S4198fs"
PRGQQSRFRSSTSGSWAPECREEQSRASPALSPRAHPCACRALAPAPWGTAGCRGSASGAPAPRRV

SEQ ID NO: 3104 - protein, 52 aa, Artificial Sequence
  source: /note="Description of Artificial Sequence: Synthetic polypeptide"
  source: /note="p.H778Q"
KTLKSLMAANSQELKCPTPGCDGSGQQVTGNYASHRSLSGCPRARKGGVKMT

SEQ ID NO: 3105 - protein, 52 aa, Artificial Sequence
  source: /note="Description of Artificial Sequence: Synthetic polypeptide"
  source: /note="p.S354N"
ELNYSLVQKVVTRFPPVPQQQLLLANNLPAGSLRCITCAVVGNGGILNNSHM

SEQ ID NO: 3106 - protein, 61 aa, Artificial Sequence
  source: /note="Description of Artificial Sequence: Synthetic polypeptide"
  source: /note="p.P1120fs"
ASVDVADLLATNGVLHILSQVLLPPPRGCARWAGVAAAAGLGACLQPLPGIAAAPWVGAPD

SEQ ID NO: 3107 - protein, 52 aa, Artificial Sequence
  source: /note="Description of Artificial Sequence: Synthetic polypeptide"
  source: /note="p.G117W"
FKDHFFKKPKFCDVCARMIVLNNKFWWLRCKNCKTNIHEHCQSYVEMQRCFG

SEQ ID NO: 3108 - protein, 52 aa, Artificial Sequence
  source: /note="Description of Artificial Sequence: Synthetic polypeptide"
  source: /note="p.Y143H"
TDELKNDLLKKYNVEYQEYLQSKNKHHKAEILKKLEHQRLIEAERKRIAQMR

SEQ ID NO: 3109 - protein, 52 aa, Artificial Sequence
  source: /note="Description of Artificial Sequence: Synthetic polypeptide"
  source: /note="p.G662A"
RRNKTPDYRGQHVFGVPPLIHVQRTAAQPLPQSIQQAMRYLRSQCLDQVGIF

SEQ ID NO: 3110 - protein, 65 aa, Artificial Sequence
  source: /note="Description of Artificial Sequence: Synthetic polypeptide"
  source: /note="p.P489fs"
AWASVLWFNLLSPNLQNQQFFSNPPNGPLELAGPCSQLAVLLLCWPRPQLRPAEHAEKQAVRAEL

SEQ ID NO: 3111 - protein, 52 aa, Artificial Sequence
  source: /note="Description of Artificial Sequence: Synthetic polypeptide"
  source: /note="p.D661V"
SVEPYTKQQLNNMSFAEIIMGYKIMVVATNILVSPLVYLYPDIPKEEAFGKY

SEQ ID NO: 3112 - protein, 33 aa, Artificial Sequence
  source: /note="Description of Artificial Sequence: Synthetic polypeptide"
  source: /note="p.P367fs"
KTQTKFAATVRLLVGGKLNVHMNPPPGEGHHHQ

SEQ ID NO: 3113 - protein, 91 aa, Artificial Sequence
  source: /note="Description of Artificial Sequence: Synthetic polypeptide"
  source: /note="p.P354fs"
QVLKTQTKFQAGVRFLLGLRFLGAPSQASAGQGRHGDREAGAGAECASGSWGWSRKHWRNHQQHCALGEQHSWELLLCPVQEPASQEDQAV

SEQ ID NO: 3114 - protein, 52 aa, Artificial Sequence
  source: /note="Description of Artificial Sequence: Synthetic polypeptide"
  source: /note="p.D468H"
LGPGKLPIQLQALSLPLVVIVHGNQHHNNAKATILWDNAFSEMDRVPFVVAE

SEQ ID NO: 3115 - protein, 30 aa, Artificial Sequence
  source: /note="Description of Artificial Sequence: Synthetic polypeptide"
  source: /note="p.G279fs"
EGDNIYKLFENIGKGSYAIPGDCGPRSLTC

SEQ ID NO: 3116 - protein, 52 aa, Artificial Sequence
  source: /note="Description of Artificial Sequence: Synthetic polypeptide"
  source: /note="p.A155E"
PLHCLHGLRGIYSQLETLICSRSLQEELEELLSACGGDFCSALPWLALLSAN

SEQ ID NO: 3117 - protein, 52 aa, Artificial Sequence
  source: /note="Description of Artificial Sequence: Synthetic polypeptide"
  source: /note="p.D89N"
RGARPGGGDAGGTPGETVRHCSAPENNPIFRFSSLHSYPFPGTIKSRDMSWK

SEQ ID NO: 3118 - protein, 34 aa, Artificial Sequence
  source: /note="Description of Artificial Sequence: Synthetic polypeptide"
  source: /note="p.R18fs"
MQKWFSAFDDAIIQRQWRGKPLPGRGRCELHEGG

SEQ ID NO: 3119 - protein, 52 aa, Artificial Sequence
  source: /note="Description of Artificial Sequence: Synthetic polypeptide"
  source: /note="p.D86Y"
VVFRLGRIQADKAKGPGLILVLPCIYYVFVKVDLRTVTCNIPPQEILTRDSV

SEQ ID NO: 3120 - protein, 52 aa, Artificial Sequence
  source: /note="Description of Artificial Sequence: Synthetic polypeptide"
  source: /note="p.N451S"
KVTKEGKFVESAVITQIYCLCFVNGSSLECFLTLNDLELPKRDESYYEKDSE

SEQ ID NO: 3121 - protein, 52 aa, Artificial Sequence
  source: /note="Description of Artificial Sequence: Synthetic polypeptide"
  source: /note="p.Q68R"
QPAGNQTSPGATEDYSYGSWYIDEPRRGGEELQPEGEVPSCHTSIPPGLYHA

SEQ ID NO: 3122 - protein, 66 aa, Artificial Sequence
  source: /note="Description of Artificial Sequence: Synthetic polypeptide"
  source: /note="p.R333fs"
EELTMSPSRSVANSGLSDSLTTSTPGPPTVTRPPTPTTEPSPPTSTTLWSSAFSATRMPGPVPAPS

SEQ ID NO: 3123 - protein, 52 aa, Artificial Sequence
  source: /note="Description of Artificial Sequence: Synthetic polypeptide"
  source: /note="p.K218N"
LDVRSQRVRSLLGLSNSEPNGSVETNNNLEQILNGGESPKQKGQEIKRSSGD

SEQ ID NO: 3124 - protein, 52 aa, Artificial Sequence
  source: /note="Description of Artificial Sequence: Synthetic polypeptide"
  source: /note="p.D583Y"
TSNAYSSPSVVLASYNHDGTRNILDYYFREAYFWLRQNTDEHARVMSWWDYG

SEQ ID NO: 3125 - protein, 52 aa, Artificial Sequence
  source: /note="Description of Artificial Sequence: Synthetic polypeptide"
  source: /note="p.R107L"
KKTANKIRAKLKAIEQSFDQDESGNLLTSVDLRIRRTQHSVLSRKFVEAMAE

SEQ ID NO: 3126 - protein, 38 aa, Artificial Sequence
  source: /note="Description of Artificial Sequence: Synthetic polypeptide"
  source: /note="p.K252fs"
MINNIERNVMNATDYVEHAKEETKKLSNIRARQEGKSG

SEQ ID NO: 3127 - protein, 52 aa, Artificial Sequence
  source: /note="Description of Artificial Sequence: Synthetic polypeptide"
  source: /note="p.D92N"
QFEGSTSFVRRSQWMLEQLRQVNGINNPNGDSAEFDLLFENAFDQWVASTAS

SEQ ID NO: 3128 - protein, 52 aa, Artificial Sequence
  source: /note="Description of Artificial Sequence: Synthetic polypeptide"
  source: /note="p.R85Q"
WTQEIVELIQNEGDVEKSKRAPTHQQQFPFLEMKIPSLGSGLEQAHAMPSPR

SEQ ID NO: 3129 - protein, 52 aa, Artificial Sequence
  source: /note="Description of Artificial Sequence: Synthetic polypeptide"
  source: /note="p.R77Q"
WVSEIVYMIYKEGDVEKCKEDVIFNQQIPFLECRKENLMNGVKQLDEMNSPR

SEQ ID NO: 3130 - protein, 52 aa, Artificial Sequence
  source: /note="Description of Artificial Sequence: Synthetic polypeptide"
  source: /note="p.G110E"
IFPVTNKDFRDFVREKKYRTEAEMFEEWSFVFEDFVSDELRNKATQPMKSVL

SEQ ID NO: 3131 - protein, 45 aa, Artificial Sequence
  source: /note="Description of Artificial Sequence: Synthetic polypeptide"
  source: /note="p.P339Q"
TFELQHAVSEYLLCVKLNIFSNWGHQQKYTCLYRFRVHGTPGKHI

SEQ ID NO: 3132 - protein, 52 aa, Artificial Sequence
  source: /note="Description of Artificial Sequence: Synthetic polypeptide"
  source: /note="p.L124I"
LRMPKEQLELLKKESQNLENNFRQIIIFLIEQIDVLKALLRDMKDGMDNNHN

SEQ ID NO: 3133 - protein, 52 aa, Artificial Sequence
  source: /note="Description of Artificial Sequence: Synthetic polypeptide"
  source: /note="p.E128K"
KEQLELLKKESQNLENNFRQILFLIKKQIDVLKALLRDMKDGMDNNHNWNTH

SEQ ID NO: 3134 - protein, 52 aa, Artificial Sequence
  source: /note="Description of Artificial Sequence: Synthetic polypeptide"
  source: /note="p.A957T"
SSDEDILCLKFHPLQEHVVKEELLNTTLYCEFINRVNEVGVDVNRAIAHPYS

SEQ ID NO: 3135 - protein, 52 aa, Artificial Sequence
  source: /note="Description of Artificial Sequence: Synthetic polypeptide"
  source: /note="p.R343C"
SRRINPKISYVISIKGQRLDPMESVCCEETVNLTTDSRTPEVCLALYPGTNY

SEQ ID NO: 3136 - protein, 52 aa, Artificial Sequence
  source: /note="Description of Artificial Sequence: Synthetic polypeptide"
  source: /note="p.T513M"
YELTSSTLEILTVNTVKQTPNHIPSMMIMATTQPPVETTVPEIQDSFPYLLS

SEQ ID NO: 3137 - protein, 63 aa, Artificial Sequence
  source: /note="Description of Artificial Sequence: Synthetic polypeptide"
  source: /note="p.E138fs"
MADGAPLAGVRGGLSDGEGPPGGRGRHNDGKNEKNWPNSMKPSYGSVATAASSGHCILCLVWR

SEQ ID NO: 3138 - protein, 52 aa, Artificial Sequence
  source: /note="Description of Artificial Sequence: Synthetic polypeptide"
  source: /note="p.P60Q"
DRAQDEYTQRSYSRFQDEEDDDDYYQQAGETYNGEANDDEGSSEATEGHDED

SEQ ID NO: 3139 - protein, 52 aa, Artificial Sequence
  source: /note="Description of Artificial Sequence: Synthetic polypeptide"
  source: /note="p.M93T"
EKQTRSKYCTETSGVHGDSPYGSGTTTDTHSLESKAERIARYKAERRRQLAE

SEQ ID NO: 3140 - protein, 68 aa, Artificial Sequence
  source: /note="Description of Artificial Sequence: Synthetic polypeptide"
  source: /note="p.G1862fs"
EERGAQVQVLQGKEPPCFLQCFQGGWWCTRGGGKRKKKMCKVSGGCTACVERCPWKGICWKWPVTVAA

SEQ ID NO: 3141 - protein, 52 aa, Artificial Sequence
  source: /note="Description of Artificial Sequence: Synthetic polypeptide"
  source: /note="p.K474N"
KPSKYIKNSDKGNRNNSQLEKTTPSNNRKMSEASMIVSGADRYTMRSPVLFS

SEQ ID NO: 3142 - protein, 52 aa, Artificial Sequence
  source: /note="Description of Artificial Sequence: Synthetic polypeptide"
  source: /note="p.A336G"
HPASLEFQAQITTLLVDLGTPQAEIGGRNMPSSKDTRKRPRDDSDSTLKKMK

SEQ ID NO: 3143 - protein, 53 aa, Artificial Sequence
  source: /note="Description of Artificial Sequence: Synthetic polypeptide"
  source: /note="p.A34del"
LSDSSFIANLPNGYMTDLQRPEPQQPTPPPPGPGAASAAAPPTASPGPERTPP

SEQ ID NO: 3144 - protein, 52 aa, Artificial Sequence
  source: /note="Description of Artificial Sequence: Synthetic polypeptide"
  source: /note="p.D135Y"
CCETTFIEDRSPTKDSLEYPDGKFIYYLSADDIKIHTLSYDVEEEEEFQELE

SEQ ID NO: 3145 - protein, 52 aa, Artificial Sequence
  source: /note="Description of Artificial Sequence: Synthetic polypeptide"
  source: /note="p.K3103N"
ESRRLNAQILSQRIEKAKCLCDEIINNKLNENKTFDDSFKEKEILQIKLNAE

SEQ ID NO: 3146 - protein, 52 aa, Artificial Sequence
  source: /note="Description of Artificial Sequence: Synthetic polypeptide"
  source: /note="p.R169Q"
QAAIAFTFFSILVWIFQAYLAFQDLQQNDAPVPYKRFLDEGGMVLTTLPLPS

SEQ ID NO: 3147 - protein, 52 aa, Artificial Sequence
  source: /note="Description of Artificial Sequence: Synthetic polypeptide"
  source: /note="p.I681F"
KTISRDNKYVLLASEQLVGVCLFVFFFRPQHAPFIRDVAVDTVKTGMGGATG

SEQ ID NO: 3148 - protein, 52 aa, Artificial Sequence
  source: /note="Description of Artificial Sequence: Synthetic polypeptide"
  source: /note="p.K832T"
WRKKHPFDKTAGELNLLDSDLDVDTTTVRHTWSPGALQYYGRAELQASDHRP

SEQ ID NO: 3149 - protein, 72 aa, Artificial Sequence
  source: /note="Description of Artificial Sequence: Synthetic polypeptide"
  source: /note="p.P1111fs"
HRSPSRSLSVPNRPRPPQPPQRPPPSNRFNGEKVGFRCVHLLRHPWTVFNFADGKTSTRSTSATSQGSDWNK

SEQ ID NO: 3150 - protein, 52 aa, Artificial Sequence
  source: /note="Description of Artificial Sequence: Synthetic polypeptide"
  source: /note="p.R516Q"
RTVILGKKTEVKATREQERNRPETIQQTKPEEKMFDSKEKASEERNLRWEEL

SEQ ID NO: 3151 - protein, 53 aa, Artificial Sequence
  source: /note="Description of Artificial Sequence: Synthetic polypeptide"
  source: /note="p.G619fs"
SSHLKGQAVPASKTGILEESMARRGQPQIHVYFRGEAQGDPESRLAGSGTDSG

SEQ ID NO: 3152 - protein, 66 aa, Artificial Sequence
  source: /note="Description of Artificial Sequence: Synthetic polypeptide"
  source: /note="p.M1fs"
WLRSPPAGKNLMKSPQWWGSSVHLAWSSQSLSLHGSAVRENHPSLTRLLHTSLCMCLRELIFTLKT

SEQ ID NO: 3153 - protein, 52 aa, Artificial Sequence
  source: /note="Description of Artificial Sequence: Synthetic polypeptide"
  source: /note="p.T349M"
TMKRNLNPIFNESFAFDIPTEKLREMMTIIITVMDKDKLSRNDVIGKIYLSW

SEQ ID NO: 3154 - protein, 52 aa, Artificial Sequence
  source: /note="Description of Artificial Sequence: Synthetic polypeptide"
  source: /note="p.R373W"
GARASGQPLQHWADMLAHARRPIAQWWHPLRPAREVDRMLALQPRLRLRLPL

SEQ ID NO: 3155 - protein, 52 aa, Artificial Sequence
  source: /note="Description of Artificial Sequence: Synthetic polypeptide"
  source: /note="p.I440M"
FPINGLHSHSEVLTARPQSMENSPTMMNEPKDKSSELTRLESVLPRSPADEL

SEQ ID NO: 3156 - protein, 52 aa, Artificial Sequence
  source: /note="Description of Artificial Sequence: Synthetic polypeptide"
  source: /note="p.R211T"
HIPRYSTNPITVTVSQNLPSGQTVPTTALQILPQIPSNLYGSPGSIYIRQTS

SEQ ID NO: 3157 - protein, 52 aa, Artificial Sequence
  source: /note="Description of Artificial Sequence: Synthetic polypeptide"
  source: /note="p.E67K"
IGHHRRYHGYQLVDGGRFTLWGPEAKKGGWTSREEQLLLDAIEQFGFGNWED

SEQ ID NO: 3158 - protein, 52 aa, Artificial Sequence
  source: /note="Description of Artificial Sequence: Synthetic polypeptide"
  source: /note="p.R843W"
SKDRPRRIRMEDIKKAFPSHSESSIWWKRLKLCADFKRTGMDSNWWVLKSDF

SEQ ID NO: 3159 - protein, 53 aa, Artificial Sequence
  source: /note="Description of Artificial Sequence: Synthetic polypeptide"
  source: /note="p.R172M"
HGMLKDAKRNLSEAETWRHGENTSSMMEILINLIQAYKGLLQYYTWSEKKMEL

SEQ ID NO: 3160 - protein, 52 aa, Artificial Sequence
  source: /note="Description of Artificial Sequence: Synthetic polypeptide"
  source: /note="p.R292C"
GIESWPDYEDIYKKTVEVGTFLDLPCCFPDITEDCYLHPNILCMKYLMEVNL

SEQ ID NO: 3161 - protein, 38 aa, Artificial Sequence
  source: /note="Description of Artificial Sequence: Synthetic polypeptide"
  source: /note="p.K851fs"
QVFIYRLFWKSKDRPRRIRMEDIKKPFLPIQKAASGRG

SEQ ID NO: 3162 - protein, 52 aa, Artificial Sequence
  source: /note="Description of Artificial Sequence: Synthetic polypeptide"
  source: /note="p.S130A"
RQSKLREAEEALRREAGLLEEAVAGAAGAPGEVDSAGAEVTSALLSRVTASA

SEQ ID NO: 3163 - protein, 52 aa, Artificial Sequence
  source: /note="Description of Artificial Sequence: Synthetic polypeptide"
  source: /note="p.S380L"
LDSPGKAIRGPQQPIWKPFPNQDSDLLVVLSGTDSELHIPRVCEFCQAVFPP

SEQ ID NO: 3164 - protein, 27 aa, Artificial Sequence
  source: /note="Description of Artificial Sequence: Synthetic peptide"
  source: /note="p.Q899fs"
QRVEEELLALQTGRSERIRSLLERQGP

SEQ ID NO: 3165 - protein, 52 aa, Artificial Sequence
  source: /note="Description of Artificial Sequence: Synthetic polypeptide"
  source: /note="p.L782V"
VLTELINLHLKVGWKRGNPIWRVISVVLKNASIQHLQEMDSGQEPTVGSQIQ

SEQ ID NO: 3166 - protein, 52 aa, Artificial Sequence
  source: /note="Description of Artificial Sequence: Synthetic polypeptide"
  source: /note="p.E199K"
RGSELPVLERICQELTAAARPFRRLKKASRDQLRQLFKDNPFKLHLIEEKVT

SEQ ID NO: 3167 - protein, 52 aa, Artificial Sequence
  source: /note="Description of Artificial Sequence: Synthetic polypeptide"
  source: /note="p.G366D"
KGPHVRHTGKIKTIKIFKNSSTYWEDDNPEMETLQRIYGISFPDNKMMRDWE

SEQ ID NO: 3168 - protein, 52 aa, Artificial Sequence
  source: /note="Description of Artificial Sequence: Synthetic polypeptide"
  source: /note="p.R270C"
PNQNMTSEERQRLVTIVDKLQQSTACCVVVVFSPDLTLYHFFNEVLRQNFTG

SEQ ID NO: 3169 - protein, 52 aa, Artificial Sequence
  source: /note="Description of Artificial Sequence: Synthetic polypeptide"
  source: /note="p.E525K"
SRQCQEGQVRRVKGFHSCCYDCVDCKKAGSYRQNPDDIACTFCGQDEWSPER

SEQ ID NO: 3170 - protein, 52 aa, Artificial Sequence
  source: /note="Description of Artificial Sequence: Synthetic polypeptide"
  source: /note="p.F183L"
KFFSQNATIQKEDTLAIQIFSFVAELLSVPLLIFLFAVLLLIFSLGRHTRQM

SEQ ID NO: 3171 - protein, 52 aa, Artificial Sequence
  source: /note="Description of Artificial Sequence: Synthetic polypeptide"
  source: /note="p.Q177H"
IQLLTMEHLPRNSTVTDKLENFHQYHHFQAHTVALVIPFILFLASTIFLMAS

SEQ ID NO: 3172 - protein, 52 aa, Artificial Sequence
  source: /note="Description of Artificial Sequence: Synthetic polypeptide"
  source: /note="p.V231I"
QIQHHSTGHCNPSMKARFTALRSLAIILFIVFTSYFLTILITIIGTLFDKRC

SEQ ID NO: 3173 - protein, 39 aa, Artificial Sequence
  source: /note="Description of Artificial Sequence: Synthetic polypeptide"
  source: /note="p.L236fs"
HGKGSQDPSTKVHIKALQTVTSFLLVMCHLLSVHDHISL

SEQ ID NO: 3174 - protein, 49 aa, Artificial Sequence
  source: /note="Description of Artificial Sequence: Synthetic polypeptide"
  source: /note="p.I311T"
MAACPSGHAAILISGNAKLRRAVMTTTLLWAQSSLKVRADHKADSRTLC

SEQ ID NO: 3175 - protein, 52 aa, Artificial Sequence
  source: /note="Description of Artificial Sequence: Synthetic polypeptide"
  source: /note="p.A255T"
TRALKSLISFLILYALSFLSLIIDATTKFISMQNDFYWPWQIAVYLCISVHP

SEQ ID NO: 3176 - protein, 52 aa, Artificial Sequence
  source: /note="Description of Artificial Sequence: Synthetic polypeptide"
  source: /note="p.W98C"
PDVYTKNKQQIVIFTFWTFANYLNMCCITTCLNVFYFLKIASSSHPLFLWLK

SEQ ID NO: 3177 - protein, 52 aa, Artificial Sequence
  source: /note="Description of Artificial Sequence: Synthetic polypeptide"
  source: /note="p.E163Q"
FLISLIISVPKNDDMWYHLFKVSHEQQNITWKFKVSKIPGTFKQLTLNLGVM

SEQ ID NO: 3178 - protein, 52 aa, Artificial Sequence
  source: /note="Description of Artificial Sequence: Synthetic polypeptide"
  source: /note="p.R367H"
TLSFLKSNADLCYGALAAIPGLRPVHHPSGAMYLMVGIEMEHFPEFENDVEF

SEQ ID NO: 3179 - protein, 52 aa, Artificial Sequence
  source: /note="Description of Artificial Sequence: Synthetic polypeptide"
  source: /note="p.S71F"
EVRRLSRQSTRKEPVTKQVRLCVSPFFGLRCEPEPGRSQQWDPLIYSSIFEC

SEQ ID NO: 3180 - protein, 52 aa, Artificial Sequence
  source: /note="Description of Artificial Sequence: Synthetic polypeptide"
  source: /note="p.H277R"
DGGLRSSGFFSSFEESDIENHLISGRRNIVQPTDIEENRTMLFTIGQSEVYL

SEQ ID NO: 3181 - protein, 52 aa, Artificial Sequence
  source: /note="Description of Artificial Sequence: Synthetic polypeptide"
  source: /note="p.F608Y"
PDVGYVQGMSFIAAVLILNLEEADAYYIAFANLLNKPCQLAFFRVDHSMMLK

SEQ ID NO: 3182 - protein, 52 aa, Artificial Sequence
  source: /note="Description of Artificial Sequence: Synthetic polypeptide"
  source: /note="p.R920Q"
ILDARKLISISFGDLNPFPLRQIRNQQRAYHLEKVRLELTELEAIREDFLRE

SEQ ID NO: 3183 - protein, 52 aa, Artificial Sequence
  source: /note="Description of Artificial Sequence: Synthetic polypeptide"
  source: /note="p.P1233T"
DWAITFEQFLASLLTEPALVKYFDKTTVCMMARITSAKNIRMMGKPLTSASD

SEQ ID NO: 3184 - protein, 52 aa, Artificial Sequence
  source: /note="Description of Artificial Sequence: Synthetic polypeptide"
  source: /note="p.R476C"
DEKRGACSVGTNVRDAACYVCWAFACCAYEPQELKPFVTAISSALVIAAVFD

SEQ ID NO: 3185 - protein, 40 aa, Artificial Sequence
  source: /note="Description of Artificial Sequence: Synthetic polypeptide"
  source: /note="p.N126fs"
DKLAQQQAAAAAAAAAAASQQGSAKMEKTQQMGRRMEHIL

SEQ ID NO: 3186 - protein, 52 aa, Artificial Sequence
  source: /note="Description of Artificial Sequence: Synthetic polypeptide"
  source: /note="p.H187Y"
RYKFHNSRWMVAGKADPEMPKRMYIYYPDSPATGEQWMSKVVTFHKLKLTNN

SEQ ID NO: 3187 - protein, 32 aa, Artificial Sequence
  source: /note="Description of Artificial Sequence: Synthetic polypeptide"
  source: /note="p.S370fs"
LDLPCKRSYLEAPSSVGEDHYFRSPLPTTSKC

SEQ ID NO: 3188 - protein, 52 aa, Artificial Sequence
  source: /note="Description of Artificial Sequence: Synthetic polypeptide"
  source: /note="p.E308K"
DLLSAFEAMTSQANPEALSAPALQEKKAAFPGRRVNAKMPVYSGSRPACQLQ

SEQ ID NO: 3189 - protein, 52 aa, Artificial Sequence
  source: /note="Description of Artificial Sequence: Synthetic polypeptide"
  source: /note="p.H140P"
GMYKETVYSAFNLLMHYPPPSGAGQPPPQPQPPLHKANQPPHGVPQLSLYEH

SEQ ID NO: 3190 - protein, 50 aa, Artificial Sequence
  source: /note="Description of Artificial Sequence: Synthetic polypeptide"
  source: /note="p.E172fs"
KLREMELDLHQKHVVNSWEMQKEEKNSKKPPQSKRTNGMKMNMKGPEGRR

SEQ ID NO: 3191 - protein, 53 aa, Artificial Sequence
  source: /note="Description of Artificial Sequence: Synthetic polypeptide"
  source: /note="p.K1366del"
GWESRKRKLSGDQPAARTPRSKKKKLGAGEGGEASVSPEKTSTTSKGKAKRDK

SEQ ID NO: 3192 - protein, 52 aa, Artificial Sequence
  source: /note="Description of Artificial Sequence: Synthetic polypeptide"
  source: /note="p.K264R"
APAPGKVGDVTPQVKGGALPPAKRARRKPEEESESSEEGSESEEEAPAGTRS

SEQ ID NO: 3193 - protein, 52 aa, Artificial Sequence
  source: /note="Description of Artificial Sequence: Synthetic polypeptide"
  source: /note="p.S127I"
PEHQQKVLNHLSPDLPLAVTANLIDIIENYWLRCCMHRWPVCHVAHHGGSWK

SEQ ID NO: 3194 - protein, 52 aa, Artificial Sequence
  source: /note="Description of Artificial Sequence: Synthetic polypeptide"
  source: /note="p.S74L"
HAVLKEELANAEYSPEEMPQLTKHLLLENIKDKLKEMGFDRYKMVVQVVIGE

SEQ ID NO: 3195 - protein, 52 aa, Artificial Sequence
  source: /note="Description of Artificial Sequence: Synthetic polypeptide"
  source: /note="p.Q197H"
RVPYNRRHYRDNFKGEENELLLKSEHHEKTLLELVEAWLERTPGLEPHGFNF

SEQ ID NO: 3196 - protein, 52 aa, Artificial Sequence
  source: /note="Description of Artificial Sequence: Synthetic polypeptide"
  source: /note="p.W276C"
CLAEYHLGDYGHAWNRCWVLDRVDTCCAVVMFIDFGQLATIPVQSLRSLDSD

SEQ ID NO: 3197 - protein, 52 aa, Artificial Sequence
  source: /note="Description of Artificial Sequence: Synthetic polypeptide"
  source: /note="p.S322L"
SLDSDDFWTIPPLTQPFMLEKDILSLLYEVVHRILKGKITGALNSAVTAPAS

SEQ ID NO: 3198 - protein, 43 aa, Artificial Sequence
  source: /note="Description of Artificial Sequence: Synthetic polypeptide"
  source: /note="p.P298fs"
DVRQIYDKFPEKKGGLRELYDRGPPPCLLPGQVLGGPELGPKW

SEQ ID NO: 3199 - protein, 52 aa, Artificial Sequence
  source: /note="Description of Artificial Sequence: Synthetic polypeptide"
  source: /note="p.L29I"
KAFVLLAIFAEASAKSCAPNKADVIIIVFCYPKTIITKIPECPYGWEVHQLA

SEQ ID NO: 3200 - protein, 52 aa, Artificial Sequence
  source: /note="Description of Artificial Sequence: Synthetic polypeptide"
  source: /note="p.M166I"
LLVLTAELWAPNMCHLQLMETFLILIIMGSWLMQAGFILYRPVSGYPWQDDD

SEQ ID NO: 3201 - protein, 52 aa, Artificial Sequence
  source: /note="Description of Artificial Sequence: Synthetic polypeptide"
  source: /note="p.R401H"
LLERSIMAKEGPLKVAQTRLECRTRHHPNMELCRDIPQLKLVNEVFTIDDTL

SEQ ID NO: 3202 - protein, 52 aa, Artificial Sequence
  source: /note="Description of Artificial Sequence: Synthetic polypeptide"
  source: /note="p.T1472S"
AAVREIMENRYGQKGNAIRIEIVVYSSGKEGKSSHGCPIAKWVLRRSSDEEK

SEQ ID NO: 3203 - protein, 52 aa, Artificial Sequence
  source: /note="Description of Artificial Sequence: Synthetic polypeptide"
  source: /note="p.E1652Q"
ASSLQILQEETKVCLNILPLFVEAFQQRKQECSVEQILISRELLVDQNLWNN

SEQ ID NO: 3204 - protein, 162 aa, Artificial Sequence
  source: /note="Description of Artificial Sequence: Synthetic polypeptide"
  source: /note="p.G482fs"
SLKPEQLDIEEEGRPGAATFHVGGGTCPECSPSAAPCTALRCPSGPALSQRPPGGPGRPLPPGAGGHSDGGGGGGGGRTVGGCPVPTAGCLRSPALFSVPCCLQGQQPPQQLQHGRGVLIRPHPSPGTFPPRKGGPVRMRPRLFPHPPMRLPCPGILGEEEM

SEQ ID NO: 3205 - protein, 45 aa, Artificial Sequence
  source: /note="Description of Artificial Sequence: Synthetic polypeptide"
  source: /note="p.A382V"
YQPRPGFTSLPGSTMTPPPSGPNPYVVRNRPPFGQGYTQPGPGYR

SEQ ID NO: 3206 - protein, 52 aa, Artificial Sequence
  source: /note="Description of Artificial Sequence: Synthetic polypeptide"
  source: /note="p.R206C"
RTCDAFTYTGCGGNDNNFVSREDCKCCACAKALKKKKKMPKLRFASRIRKIR

SEQ ID NO: 3207 - protein, 40 aa, Artificial Sequence
  source: /note="Description of Artificial Sequence: Synthetic polypeptide"
  source: /note="p.R222C"
NFVSREDCKRACAKALKKKKKMPKLCCFASRIRKIRKKQF

SEQ ID NO: 3208 - protein, 28 aa, Artificial Sequence
  source: /note="Description of Artificial Sequence: Synthetic peptide"
  source: /note="p.S252C"
EALDSSWVSRGPDKLLPYPTLASPACCD

SEQ ID NO: 3209 - protein, 52 aa, Artificial Sequence
  source: /note="Description of Artificial Sequence: Synthetic polypeptide"
  source: /note="p.S241L"
FGEVWRGKWRGEEVAVKIFSSREERLLWFREAEIYQTVMLRHENILGFIAAD

SEQ ID NO: 3210 - protein, 123 aa, Artificial Sequence
  source: /note="Description of Artificial Sequence: Synthetic polypeptide"
  source: /note="p.T358fs"
WNESWFARQDLGPSYNGWQVLDATPRRRVKVCSGAAQPQSPPSARVMCTWLTMAPSCLRRSTPTTSPGCGTRMRAGSVYTQTRRRLGDASAPRRWAVTPAWTSLTSTSIRKGPGKRGRCTARR

SEQ ID NO: 3211 - protein, 39 aa, Artificial Sequence
  source: /note="Description of Artificial Sequence: Synthetic polypeptide"
  source: /note="p.S1941L"
RLLAFLEGKEGEDTLVLSVWDSYAELLRQLTLPRTEAAC

SEQ ID NO: 3212 - protein, 52 aa, Artificial Sequence
  source: /note="Description of Artificial Sequence: Synthetic polypeptide"
  source: /note="p.S287Y"
EELNTNKESVIAIFVPAENSKPSVNYYFISAQKETTEMEDTDIEDSLYKDVD

SEQ ID NO: 3213 - protein, 43 aa, Artificial Sequence
  source: /note="Description of Artificial Sequence: Synthetic polypeptide"
  source: /note="p.L17R"
MLRSCAARLRTLGALCRRPPVGRRLPGSEPRPELRSFSSEEVI

SEQ ID NO: 3214 - protein, 52 aa, Artificial Sequence
  source: /note="Description of Artificial Sequence: Synthetic polypeptide"
  source: /note="p.K551R"
YKAVQEKSSSPPPRKTSESRDKLGARRGDFPTGKSSFSITREAQVNVRMDSF

SEQ ID NO: 3215 - protein, 52 aa, Artificial Sequence
  source: /note="Description of Artificial Sequence: Synthetic polypeptide"
  source: /note="p.R90C"
VCDWHSDLFQWEVSDWHHCVLVPYACCGEVKPRTAECVTAQHGLQHRMVRCI

SEQ ID NO: 3216 - protein, 52 aa, Artificial Sequence
  source: /note="Description of Artificial Sequence: Synthetic polypeptide"
  source: /note="p.R90H"
VCDWHSDLFQWEVSDWHHCVLVPYAHHGEVKPRTAECVTAQHGLQHRMVRCI

SEQ ID NO: 3217 - protein, 52 aa, Artificial Sequence
  source: /note="Description of Artificial Sequence: Synthetic polypeptide"
  source: /note="p.E126K"
VTAQHGLQHRMVRCIQKLNRTVVANKKICEHFALQPPTEQACLIPCPRDCVV

SEQ ID NO: 3218 - protein, 53 aa, Artificial Sequence
  source: /note="Description of Artificial Sequence: Synthetic polypeptide"
  source: /note="p.G247M"
QLSTCQRANSLGDLYAQKNSGVTANMMGPGSKFAGYCRNLVSDIPNLANHKMP

SEQ ID NO: 3219 - protein, 52 aa, Artificial Sequence
  source: /note="Description of Artificial Sequence: Synthetic polypeptide"
  source: /note="p.D43E"
GPSAFANVPPRLQHDTSPLLLGRGQEEAHLQLQLPRLSRRHLSLEPYLEKGS

SEQ ID NO: 3220 - protein, 52 aa, Artificial Sequence
  source: /note="Description of Artificial Sequence: Synthetic polypeptide"
  source: /note="p.S312F"
VESFPAHPEVKNLKSIELAFFPSCLFFSKCIAMKQGVIKSLKIKYRHCLIKK

SEQ ID NO: 3221 - protein, 53 aa, Artificial Sequence
  source: /note="Description of Artificial Sequence: Synthetic polypeptide"
  source: /note="p.T152del"
VRLNLQRASTTTHRTATTTTRRTTTSPTTTRQMTTTPAALPTTVVTTPDLTTG

SEQ ID NO: 3222 - protein, 33 aa, Artificial Sequence
  source: /note="Description of Artificial Sequence: Synthetic polypeptide"
  source: /note="p.K83fs"
GFLSGLLDNVKQELAKNKEMKESIKNSVTRPEG

SEQ ID NO: 3223 - protein, 26 aa, Artificial Sequence
  source: /note="Description of Artificial Sequence: Synthetic peptide"
  source: /note="p.A199fs"
YQSKHYACIRQKGGYCSWYRGWAPPG

SEQ ID NO: 3224 - protein, 52 aa, Artificial Sequence
  source: /note="Description of Artificial Sequence: Synthetic polypeptide"
  source: /note="p.E403K"
MQVREDFFHYKTGIYRHVTSTNKESKKKYRKLQTHAVKLTGWGTLRGAQGQK

SEQ ID NO: 3225 - protein, 52 aa, Artificial Sequence
  source: /note="Description of Artificial Sequence: Synthetic polypeptide"
  source: /note="p.P53Q"
CAGLDYDYTFDGNEEDKTETIDYKDQQCKAAVFWGDIALDDEDLNIFQIDRT

SEQ ID NO: 3226 - protein, 52 aa, Artificial Sequence
  source: /note="Description of Artificial Sequence: Synthetic polypeptide"
  source: /note="p.T153M"
VKGKVPLQFSGQNEKNRVPRAATSRMMERIWPGGVIPYVIGGNFTGSQRAMF

SEQ ID NO: 3227 - protein, 52 aa, Artificial Sequence
  source: /note="Description of Artificial Sequence: Synthetic polypeptide"
  source: /note="p.S872L"
LGRFCGSKKPDPTVASGSSMFLRFYLLDASVQRKGFQAVHSTECGGRLKAEV

SEQ ID NO: 3228 - protein, 52 aa, Artificial Sequence
  source: /note="Description of Artificial Sequence: Synthetic polypeptide"
  source: /note="p.S208L"
REQGVDENETLLLRRKFFYSDQNVDLLRDPVQLNLLYVQARDDILNGSHPVS

SEQ ID NO: 3229 - protein, 52 aa, Artificial Sequence
  source: /note="Description of Artificial Sequence: Synthetic polypeptide"
  source: /note="p.D327V"
RVIDPGKVETLTIRRLHIPRFYLFYVVLSTLYSLTERVKRITVENSKVFLVP

SEQ ID NO: 3230 - protein, 52 aa, Artificial Sequence
  source: /note="Description of Artificial Sequence: Synthetic polypeptide"
  source: /note="p.L498V"
LEVLKMAGNSFQENFLPDIFTELRNVVTFLDLSQCQLEQLSPTAFNSLSSLQ

SEQ ID NO: 3231 - protein, 41 aa, Artificial Sequence
  source: /note="Description of Artificial Sequence: Synthetic polypeptide"
  source: /note="p.S15W"
MSASAATGVFVLSLWWAIPVTYVFNHLAAQHDSWTIVGVAA

SEQ ID NO: 3232 - protein, 52 aa, Artificial Sequence
  source: /note="Description of Artificial Sequence: Synthetic polypeptide"
  source: /note="p.R91H"
RLDSVESVLPYEYTAFDFCQASEGKHHPSENLGQVLFGERIEPSPYKFTFNK

SEQ ID NO: 3233 - protein, 52 aa, Artificial Sequence
  source: /note="Description of Artificial Sequence: Synthetic polypeptide"
  source: /note="p.R276C"
DYGSSETPKMTRGVLSRTSSIQPSFCCHRSDDPVGSLWGENDYPEGIEMASM

SEQ ID NO: 3234 - protein, 52 aa, Artificial Sequence
  source: /note="Description of Artificial Sequence: Synthetic polypeptide"
  source: /note="p.R110H"
EQTSRDGNVAEYLKLVNNADKQQAGHHIKQVFEKKNQKSAHSIAQLQKKLEQ

SEQ ID NO: 3235 - protein, 32 aa, Artificial Sequence
  source: /note="Description of Artificial Sequence: Synthetic polypeptide"
  source: /note="p.S15fs"
MSTSSSSSWDNLLESLSQHSMELDTSKFFGRD

SEQ ID NO: 3236 - protein, 52 aa, Artificial Sequence
  source: /note="Description of Artificial Sequence: Synthetic polypeptide"
  source: /note="p.A110P"
AELLLLRGGIREGSLDLGHAPLGPYPPRGPHYDAGFTLLVPMFSLDGTELQL

SEQ ID NO: 3237 - protein, 45 aa, Artificial Sequence
  source: /note="Description of Artificial Sequence: Synthetic polypeptide"
  source: /note="p.P299del"
FPPPALSLELQPPPPQRNSVPPPPPLHGPPGRPHMSSPTRDPLDT

SEQ ID NO: 3238 - protein, 52 aa, Artificial Sequence
  source: /note="Description of Artificial Sequence: Synthetic polypeptide"
  source: /note="p.E1319Q"
AHSPLEQHPQPPLPPPVPQPQEPQPQQRLSPAPLAHPSHPERASSARHSSED

SEQ ID NO: 3239 - protein, 52 aa, Artificial Sequence
  source: /note="Description of Artificial Sequence: Synthetic polypeptide"
  source: /note="p.R481C"
EACDAVFVAGKESRGARGVRVDFWWCCRLRASLRLTVWAPLLPLRIELTDTT

SEQ ID NO: 3240 - protein, 52 aa, Artificial Sequence
  source: /note="Description of Artificial Sequence: Synthetic polypeptide"
  source: /note="p.R578W"
GDSEEEEDDERRGRGCTLQYQHAMVWWVLTQFVAEAAGPGGHLAHLLGSDWQ

SEQ ID NO: 3241 - protein, 99 aa, Artificial Sequence
  source: /note="Description of Artificial Sequence: Synthetic polypeptide"
  source: /note="p.P206fs"
SCRLQGDLGLCVAELELLSSWFSPPRWLPGGGSPWTSRRGPPWSSTTPCTQGVREGTASGKTRGEAMGSGQATVTSMSPGPPCRGSGASSFIRHTGNPP

SEQ ID NO: 3242 - protein, 52 aa, Artificial Sequence
  source: /note="Description of Artificial Sequence: Synthetic polypeptide"
  source: /note="p.A92V"
FIGEFMKASVDVADLIGLNLVMSRNVVGKGEYKIMVAALGWATAELIMSRCI

SEQ ID NO: 3243 - protein, 52 aa, Artificial Sequence
  source: /note="Description of Artificial Sequence: Synthetic polypeptide"
  source: /note="p.R81C"
SFVTFLQPVRETQIIMRIFLNPSNFCCNFTRTCQDITGEFKMCSSCLVCESK

SEQ ID NO: 3244 - protein, 52 aa, Artificial Sequence
  source: /note="Description of Artificial Sequence: Synthetic polypeptide"
  source: /note="p.L142P"
VYLVTEVYYNFMKPTQEMNISLVWCPPLVLSFAIKVLFSLTTHYFKVEDGGE

SEQ ID NO: 3245 - protein, 52 aa, Artificial Sequence
  source: /note="Description of Artificial Sequence: Synthetic polypeptide"
  source: /note="p.R315Q"
KDYIMNPPLGKESIPLMTEATFDTLQQLWLIILLCALRLAMMRSHLQAYLNL

SEQ ID NO: 3246 - protein, 37 aa, Artificial Sequence
  source: /note="Description of Artificial Sequence: Synthetic polypeptide"
  source: /note="p.G331fs"
LDNNAVNLFSSVLIALLLPTAAWGFGPGGELYFISTG

SEQ ID NO: 3247 - protein, 52 aa, Artificial Sequence
  source: /note="Description of Artificial Sequence: Synthetic polypeptide"
  source: /note="p.D140G"
LFLIGAFLIIIGSLLLSGYISKGGAGGRAVPVLIIGILVFLPGFYHLRIAYY

SEQ ID NO: 3248 - protein, 52 aa, Artificial Sequence
  source: /note="Description of Artificial Sequence: Synthetic polypeptide"
  source: /note="p.Q128E"
EMELEKVRMEFELTRLKYLHEKNQREERQHEVVMEQLQRERQHEVVMEQLQQ

SEQ ID NO: 3249 - protein, 29 aa, Artificial Sequence
  source: /note="Description of Artificial Sequence: Synthetic peptide"
  source: /note="p.F156fs"
VVSYFPDKVALLQRKVEENRNSLFFSYCF

SEQ ID NO: 3250 - protein, 30 aa, Artificial Sequence
  source: /note="Description of Artificial Sequence: Synthetic polypeptide"
  source: /note="p.F230fs"
RITPFLPNWFINITSPVINVPLKVFLLVLF

SEQ ID NO: 3251 - protein, 52 aa, Artificial Sequence
  source: /note="Description of Artificial Sequence: Synthetic polypeptide"
  source: /note="p.G87S"
ASLDIWHCESTLSSDWQIATLALLLSSGAAIILIAFLVGLISICVGSRRRFY

SEQ ID NO: 3252 - protein, 52 aa, Artificial Sequence
  source: /note="Description of Artificial Sequence: Synthetic polypeptide"
  source: /note="p.R189Q"
MELRFNTLAKCPHCKKISSVGSALPQQRRCCAYITIGMICIFIGVGLTVGTP

SEQ ID NO: 3253 - protein, 35 aa, Artificial Sequence
  source: /note="Description of Artificial Sequence: Synthetic polypeptide"
  source: /note="p.K77fs"
LIVKMAGRCKSGFDPRHGSHNIKKKPGTSLQCYLN

SEQ ID NO: 3254 - protein, 52 aa, Artificial Sequence
  source: /note="Description of Artificial Sequence: Synthetic polypeptide"
  source: /note="p.R63Q"
DSLDGYHSFECGSIDPLTGSHYTCRQQSPRLLTNGYYIWTEDSFLCDKDGNI

SEQ ID NO: 3255 - protein, 52 aa, Artificial Sequence
  source: /note="Description of Artificial Sequence: Synthetic polypeptide"
  source: /note="p.R125Q"
CNCCSQELETSFTYVDKNINLEQRNQQSSPSAKGHNHPGELGWENPNEWSQE

SEQ ID NO: 3256 - protein, 33 aa, Artificial Sequence
  source: /note="Description of Artificial Sequence: Synthetic polypeptide"
  source: /note="p.P161fs"
ERQPQEDLIVRCEAGEGECRTFMPPPGHPPRPH

SEQ ID NO: 3257 - protein, 52 aa, Artificial Sequence
  source: /note="Description of Artificial Sequence: Synthetic polypeptide"
  source: /note="p.S288L"
IHEKYRSAAREYDIAVVQVSSRVTFLLDDIRQICLPEASASFQPNLTVHITG

SEQ ID NO: 3258 - protein, 52 aa, Artificial Sequence
  source: /note="Description of Artificial Sequence: Synthetic polypeptide"
  source: /note="p.G259C"
FTTYKNPARWTASFGVTIKPSKMKRCCLRRIIVHEKYKHPSHDYDISLAELS

SEQ ID NO: 3259 - protein, 52 aa, Artificial Sequence
  source: /note="Description of Artificial Sequence: Synthetic polypeptide"
  source: /note="p.R274Q"
CFWKNKDPTQWIATFGATITPPAVKQQNVRKIILHENYHRETNENDIALVQL

SEQ ID NO: 3260 - protein, 42 aa, Artificial Sequence
  source: /note="Description of Artificial Sequence: Synthetic polypeptide"
  source: /note="p.R16Q"
MGENDPPAVEAPFSFQQSLFGLDDLKISPVAPDADAVAAQIL

SEQ ID NO: 3261 - protein, 52 aa, Artificial Sequence
  source: /note="Description of Artificial Sequence: Synthetic polypeptide"
  source: /note="p.V302I"
ITSVYGCSRQEPVVEVLASGAIMAVIIWKKGLHSYYDPFVLSVQPVVFQACE

SEQ ID NO: 3262 - protein, 52 aa, Artificial Sequence
  source: /note="Description of Artificial Sequence: Synthetic polypeptide"
  source: /note="p.T409R"
RTQLPSTENIVVLSLSLLIIPFVPARRNLFFYVGFVIAERVLYIPSMGFCLL

SEQ ID NO: 3263 - protein, 52 aa, Artificial Sequence
  source: /note="Description of Artificial Sequence: Synthetic polypeptide"
  source: /note="p.R611C"
EAAEQSYRTAIKHRRKYPDCYYNLGCCLYADLNRHVDALNAWRNATVLKPEH

SEQ ID NO: 3264 - protein, 52 aa, Artificial Sequence
  source: /note="Description of Artificial Sequence: Synthetic polypeptide"
  source: /note="p.R151C"
AHRVSGALIRPLPSQQMFEHMQKRHCCVFFVYVGGESPLKEKYIDAASELIV

SEQ ID NO: 3265 - protein, 52 aa, Artificial Sequence
  source: /note="Description of Artificial Sequence: Synthetic polypeptide"
  source: /note="p.L47F"
GGPQGSRRCLFLSLFSFLIVAGATTFFFCLLHFGVIGPQREEFPRDLSLISP

SEQ ID NO: 3266 - protein, 49 aa, Artificial Sequence
  source: /note="Description of Artificial Sequence: Synthetic polypeptide"
  source: /note="p.A232T"
SAGQRLGVHLHTEARARHAWQLTQGTTTVLGLFRVTPEIPAGLPSPRSE

SEQ ID NO: 3267 - protein, 52 aa, Artificial Sequence
  source: /note="Description of Artificial Sequence: Synthetic polypeptide"
  source: /note="p.R73G"
LRARLAALEGDAAPSLVDALLEQVAGGFREQLRRQEGGAAEAQMRQEIERLT

SEQ ID NO: 3268 - protein, 52 aa, Artificial Sequence
  source: /note="Description of Artificial Sequence: Synthetic polypeptide"
  source: /note="p.A139T"
QPQHEREKEVVLLRRSMAEGERARATTSDVLCRSLANETHQLRRTLTATAHM

SEQ ID NO: 3269 - protein, 28 aa, Artificial Sequence
  source: /note="Description of Artificial Sequence: Synthetic peptide"
  source: /note="p.P632fs"
PTRALPRPLHPTPVVDWDARPLPPPARL

SEQ ID NO: 3270 - protein, 36 aa, Artificial Sequence
  source: /note="Description of Artificial Sequence: Synthetic polypeptide"
  source: /note="p.T619fs"
HEAAAKGKYEICKLLLQHGADPTKKKQGWKYSFGSC

SEQ ID NO: 3271 - protein, 52 aa, Artificial Sequence
  source: /note="Description of Artificial Sequence: Synthetic polypeptide"
  source: /note="p.L692I"
SAVMNSQQSVPATMNARTELDSPRDIIMVTASSETSISLIWTKASGPIDHYR

SEQ ID NO: 3272 - protein, 52 aa, Artificial Sequence
  source: /note="Description of Artificial Sequence: Synthetic polypeptide"
  source: /note="p.P183S"
GQPSQRRYVHYFSGLLSGSIKMNNKSSLFLHHVIMHGIPNFESKGGCRPFLR

SEQ ID NO: 3273 - protein, 31 aa, Artificial Sequence
  source: /note="Description of Artificial Sequence: Synthetic polypeptide"
  source: /note="p.V706fs"
EEPPASACPGGCGPRELCRAGQCVCRGLPRP

SEQ ID NO: 3274 - protein, 52 aa, Artificial Sequence
  source: /note="Description of Artificial Sequence: Synthetic polypeptide"
  source: /note="p.R736L"
NERSIPSMVDGLKPGQRKVLFTCFKLLNDKREVKVAQLAGSVAEMSSYHHGE

SEQ ID NO: 3275 - protein, 52 aa, Artificial Sequence
  source: /note="Description of Artificial Sequence: Synthetic polypeptide"
  source: /note="p.K1199E"
FIEELEAVEAKEKQDEQVGLPGKGGEEAKGKKTQMAEVLPSPRGQRVIPRIT

SEQ ID NO: 3276 - protein, 52 aa, Artificial Sequence
  source: /note="Description of Artificial Sequence: Synthetic polypeptide"
  source: /note="p.R656H"
IKYYKGLGTSTAKEAKEYFADMERHHHILFRYAGPEDDAAITLAFSKKKIDD

SEQ ID NO: 3277 - protein, 85 aa, Artificial Sequence
  source: /note="Description of Artificial Sequence: Synthetic polypeptide"
  source: /note="p.I1381fs"
ILDVLTGINVQQRRLALAAMRWRKKSSKDKNLALLREHLVGGRLFYMWISLEKQASNAFFSQEEQRCYLVILYLYLKRPHIFFLT

SEQ ID NO: 3278 - protein, 52 aa, Artificial Sequence
  source: /note="Description of Artificial Sequence: Synthetic polypeptide"
  source: /note="p.G146R"
PSDKVGRADAHLGSSSVALPKEASDRRTGASQEPPTTDSQEAQSPGHSSAGQ

SEQ ID NO: 3279 - protein, 39 aa, Artificial Sequence
  source: /note="Description of Artificial Sequence: Synthetic polypeptide"
  source: /note="p.F13L"
MLRGPWRQLWLFLLLLLLPGAPEPRGASRPWEGTDEPGS

SEQ ID NO: 3280 - protein, 52 aa, Artificial Sequence
  source: /note="Description of Artificial Sequence: Synthetic polypeptide"
  source: /note="p.S354L"
RASLVSKSYSEPVDVKTSQPPQLINLLKPSVFHGPSQAHSALYLSSHYHQQP

SEQ ID NO: 3281 - protein, 52 aa, Artificial Sequence
  source: /note="Description of Artificial Sequence: Synthetic polypeptide"
  source: /note="p.R337L"
TSSSPQPKKKPLDGEYFTLQIRGRELLFEMFRELNEALELKDAQAGKEPGGS

SEQ ID NO: 3282 - protein, 89 aa, Artificial Sequence
  source: /note="Description of Artificial Sequence: Synthetic polypeptide"
  source: /note="p.P58fs"
SPLPSQAMDDLMLSPDDIEQWFTEDQVQMKLPECQRLLPPWPLHQQLLHRRPLHQPPPGPCHLLSLPRKPTRAATVSVWASCILGQPSL

SEQ ID NO: 3283 - protein, 74 aa, Artificial Sequence
  source: /note="Description of Artificial Sequence: Synthetic polypeptide"
  source: /note="p.P72fs"
DDIEQWFTEDPGPDEAPRMPEAAPPWPLHQQLLHRRPLHQPPPGPCHLLSLPRKPTRAATVSVWASCILGQPSL

SEQ ID NO: 3284 - protein, 52 aa, Artificial Sequence
  source: /note="Description of Artificial Sequence: Synthetic polypeptide"
  source: /note="p.G105C"
PTPAAPAPAPSWPLSSSVPSQKTYQCCSYGFRLGFLHSGTAKSVTCTYSPAL

SEQ ID NO: 3285 - protein, 39 aa, Artificial Sequence
  source: /note="Description of Artificial Sequence: Synthetic polypeptide"
  source: /note="p.G108fs"
AAPAPAPSWPLSSSVPSQKTYQGSYVSVWASCILGQPSL

SEQ ID NO: 3286 - protein, 37 aa, Artificial Sequence
  source: /note="Description of Artificial Sequence: Synthetic polypeptide"
  source: /note="p.R110fs"
PAPAPSWPLSSSVPSQKTYQGSYGFVWASCILGQPSL

SEQ ID NO: 3287 - protein, 52 aa, Artificial Sequence
  source: /note="Description of Artificial Sequence: Synthetic polypeptide"
  source: /note="p.R110L"
PAPAPSWPLSSSVPSQKTYQGSYGFLLLGFLHSGTAKSVTCTYSPALNKMFC

SEQ ID NO: 3288 - protein, 52 aa, Artificial Sequence
  source: /note="Description of Artificial Sequence: Synthetic polypeptide"
  source: /note="p.K132N"
YGFRLGFLHSGTAKSVTCTYSPALNNNMFCQLAKTCPVQLWVDSTPPPGTRV

SEQ ID NO: 3289 - protein, 52 aa, Artificial Sequence; identical to SEQ ID NO: 3288
  source: /note="Description of Artificial Sequence: Synthetic polypeptide"
  source: /note="p.K132N"

SEQ ID NO: 3290 - protein, 52 aa, Artificial Sequence
  source: /note="Description of Artificial Sequence: Synthetic polypeptide"
  source: /note="p.C141G"
SGTAKSVTCTYSPALNKMFCQLAKTGGPVQLWVDSTPPPGTRVRAMAIYKQS

SEQ ID NO: 3291 - protein, 52 aa, Artificial Sequence
  source: /note="Description of Artificial Sequence: Synthetic polypeptide"
  source: /note="p.C141Y"
SGTAKSVTCTYSPALNKMFCQLAKTYYPVQLWVDSTPPPGTRVRAMAIYKQS

SEQ ID NO: 3292 - protein, 52 aa, Artificial Sequence
  source: /note="Description of Artificial Sequence: Synthetic polypeptide"
  source: /note="p.V143M"
TAKSVTCTYSPALNKMFCQLAKTCPMMQLWVDSTPPPGTRVRAMAIYKQSQH

SEQ ID NO: 3293 - protein, 52 aa, Artificial Sequence
  source: /note="Description of Artificial Sequence: Synthetic polypeptide"
  source: /note="p.P151T"
YSPALNKMFCQLAKTCPVQLWVDSTTTPPGTRVRAMAIYKQSQHMTEVVRRC

SEQ ID NO: 3294 - protein, 42 aa, Artificial Sequence
  source: /note="Description of Artificial Sequence: Synthetic polypeptide"
  source: /note="p.P152fs"
SPALNKMFCQLAKTCPVQLWVDSTPRPAPASAPWPSTSSHST

SEQ ID NO: 3295 - protein, 52 aa, Artificial Sequence
  source: /note="Description of Artificial Sequence: Synthetic polypeptide"
  source: /note="p.G154V"
ALNKMFCQLAKTCPVQLWVDSTPPPVVTRVRAMAIYKQSQHMTEVVRRCPHH

SEQ ID NO: 3296 - protein, 52 aa, Artificial Sequence
  source: /note="Description of Artificial Sequence: Synthetic polypeptide"
  source: /note="p.T155N"
LNKMFCQLAKTCPVQLWVDSTPPPGNNRVRAMAIYKQSQHMTEVVRRCPHHE

SEQ ID NO: 3297 - protein, 52 aa, Artificial Sequence
  source: /note="Description of Artificial Sequence: Synthetic polypeptide"
  source: /note="p.V157F"
KMFCQLAKTCPVQLWVDSTPPPGTRFFRAMAIYKQSQHMTEVVRRCPHHERC

SEQ ID NO: 3298 - protein, 52 aa, Artificial Sequence
  source: /note="Description of Artificial Sequence: Synthetic polypeptide"
  source: /note="p.R158H"
MFCQLAKTCPVQLWVDSTPPPGTRVHHAMAIYKQSQHMTEVVRRCPHHERCS

SEQ ID NO: 3299 - protein, 52 aa, Artificial Sequence
  source: /note="Description of Artificial Sequence: Synthetic polypeptide"
  source: /note="p.R158L"
MFCQLAKTCPVQLWVDSTPPPGTRVLLAMAIYKQSQHMTEVVRRCPHHERCS

SEQ ID NO: 3300 - protein, 52 aa, Artificial Sequence
  source: /note="Description of Artificial Sequence: Synthetic polypeptide"
  source: /note="p.A159P"
FCQLAKTCPVQLWVDSTPPPGTRVRPPMAIYKQSQHMTEVVRRCPHHERCSD

SEQ ID NO: 3301 - protein, 52 aa, Artificial Sequence
  source: /note="Description of Artificial Sequence: Synthetic polypeptide"
  source: /note="p.A159V"
FCQLAKTCPVQLWVDSTPPPGTRVRVVMAIYKQSQHMTEVVRRCPHHERCSD

SEQ ID NO: 3302 - protein, 52 aa, Artificial Sequence
  source: /note="Description of Artificial Sequence: Synthetic polypeptide"
  source: /note="p.Y163C"
AKTCPVQLWVDSTPPPGTRVRAMAICCKQSQHMTEVVRRCPHHERCSDSDGL

SEQ ID NO: 3303 - protein, 52 aa, Artificial Sequence
  source: /note="Description of Artificial Sequence: Synthetic polypeptide"
  source: /note="p.V173M"
DSTPPPGTRVRAMAIYKQSQHMTEVMMRRCPHHERCSDSDGLAPPQHLIRVE

SEQ ID NO: 3304 - protein, 52 aa, Artificial Sequence
  source: /note="Description of Artificial Sequence: Synthetic polypeptide"
  source: /note="p.V173L"
DSTPPPGTRVRAMAIYKQSQHMTEVLLRRCPHHERCSDSDGLAPPQHLIRVE

SEQ ID NO: 3305 - protein, 52 aa, Artificial Sequence
  source: /note="Description of Artificial Sequence: Synthetic polypeptide"
  source: /note="p.R175G"
TPPPGTRVRAMAIYKQSQHMTEVVRGGCPHHERCSDSDGLAPPQHLIRVEGN

SEQ ID NO: 3306 - protein, 52 aa, Artificial Sequence
  source: /note="Description of Artificial Sequence: Synthetic polypeptide"
  source: /note="p.R175C"
TPPPGTRVRAMAIYKQSQHMTEVVRCCCPHHERCSDSDGLAPPQHLIRVEGN

SEQ ID NO: 3307 - protein, 52 aa, Artificial Sequence
  source: /note="Description of Artificial Sequence: Synthetic polypeptide"
  source: /note="p.R175H"
TPPPGTRVRAMAIYKQSQHMTEVVRHHCPHHERCSDSDGLAPPQHLIRVEGN

SEQ ID NO: 3308 - protein, 52 aa, Artificial Sequence
  source: /note="Description of Artificial Sequence: Synthetic polypeptide"
  source: /note="p.C176Y"
PPPGTRVRAMAIYKQSQHMTEVVRRYYPHHERCSDSDGLAPPQHLIRVEGNL

SEQ ID NO: 3309 - protein, 52 aa, Artificial Sequence
  source: /note="Description of Artificial Sequence: Synthetic polypeptide"
  source: /note="p.C176F"
PPPGTRVRAMAIYKQSQHMTEVVRRFFPHHERCSDSDGLAPPQHLIRVEGNL

SEQ ID NO: 3310 - protein, 52 aa, Artificial Sequence
  source: /note="Description of Artificial Sequence: Synthetic polypeptide"
  source: /note="p.H179Y"
GTRVRAMAIYKQSQHMTEVVRRCPHYYERCSDSDGLAPPQHLIRVEGNLRVE

SEQ ID NO: 3311 - protein, 52 aa, Artificial Sequence
  source: /note="Description of Artificial Sequence: Synthetic polypeptide"
  source: /note="p.H179R"
GTRVRAMAIYKQSQHMTEVVRRCPHRRERCSDSDGLAPPQHLIRVEGNLRVE

SEQ ID NO: 3312 - protein, 52 aa, Artificial Sequence
  source: /note="Description of Artificial Sequence: Synthetic polypeptide"
  source: /note="p.H179L"
GTRVRAMAIYKQSQHMTEVVRRCPHLLERCSDSDGLAPPQHLIRVEGNLRVE

SEQ ID NO: 3313 - protein, 53 aa, Artificial Sequence
  source: /note="Description of Artificial Sequence: Synthetic polypeptide"
  source: /note="p.P191del"
SQHMTEVVRRCPHHERCSDSDGLAPQHLIRVEGNLRVEYLDDRNTFRHSVVVP

SEQ ID NO: 3314 - protein, 52 aa, Artificial Sequence
  source: /note="Description of Artificial Sequence: Synthetic polypeptide"
  source: /note="p.H193Y"
HMTEVVRRCPHHERCSDSDGLAPPQYYLIRVEGNLRVEYLDDRNTFRHSVVV

SEQ ID NO: 3315 - protein, 52 aa, Artificial Sequence
  source: /note="Description of Artificial Sequence: Synthetic polypeptide"
  source: /note="p.H193R"
HMTEVVRRCPHHERCSDSDGLAPPQRRLIRVEGNLRVEYLDDRNTFRHSVVV

SEQ ID NO: 3316 - protein, 52 aa, Artificial Sequence
  source: /note="Description of Artificial Sequence: Synthetic polypeptide"
  source: /note="p.H193L"
HMTEVVRRCPHHERCSDSDGLAPPQLLLIRVEGNLRVEYLDDRNTFRHSVVV

SEQ ID NO: 3317 - protein, 52 aa, Artificial Sequence
  source: /note="Description of Artificial Sequence: Synthetic polypeptide"
  source: /note="p.L194R"
MTEVVRRCPHHERCSDSDGLAPPQHRRIRVEGNLRVEYLDDRNTFRHSVVVP

SEQ ID NO: 3318 - protein, 52 aa, Artificial Sequence
  source: /note="Description of Artificial Sequence: Synthetic polypeptide"
  source: /note="p.I195T"
TEVVRRCPHHERCSDSDGLAPPQHLTTRVEGNLRVEYLDDRNTFRHSVVVPY

SEQ ID NO: 3319 - protein, 52 aa, Artificial Sequence
  source: /note="Description of Artificial Sequence: Synthetic polypeptide"
  source: /note="p.R196P"
EVVRRCPHHERCSDSDGLAPPQHLIPPVEGNLRVEYLDDRNTFRHSVVVPYE

SEQ ID NO: 3320 - protein, 52 aa, Artificial Sequence
  source: /note="Description of Artificial Sequence: Synthetic polypeptide"
  source: /note="p.G199V"
RRCPHHERCSDSDGLAPPQHLIRVEVVNLRVEYLDDRNTFRHSVVVPYEPPE

SEQ ID NO: 3321 - protein, 52 aa, Artificial Sequence
  source: /note="Description of Artificial Sequence: Synthetic polypeptide"
  source: /note="p.Y205C"
ERCSDSDGLAPPQHLIRVEGNLRVECCLDDRNTFRHSVVVPYEPPEVGSDCT

SEQ ID NO: 3322 - protein, 30 aa, Artificial Sequence
  source: /note="Description of Artificial Sequence: Synthetic polypeptide"
  source: /note="p.R209fs"
DSDGLAPPQHLIRVEGNLRVEYLDDKHFST

SEQ ID NO: 3323 - protein, 52 aa, Artificial Sequence
  source: /note="Description of Artificial Sequence: Synthetic polypeptide"
  source: /note="p.H214R"
APPQHLIRVEGNLRVEYLDDRNTFRRRSVVVPYEPPEVGSDCTTIHYNYMCN

SEQ ID NO: 3324 - protein, 52 aa, Artificial Sequence
  source: /note="Description of Artificial Sequence: Synthetic polypeptide"
  source: /note="p.S215I"
PPQHLIRVEGNLRVEYLDDRNTFRHIIVVVPYEPPEVGSDCTTIHYNYMCNS

SEQ ID NO: 3325 - protein, 52 aa, Artificial Sequence
  source: /note="Description of Artificial Sequence: Synthetic polypeptide"
  source: /note="p.S215R"
PPQHLIRVEGNLRVEYLDDRNTFRHRRVVVPYEPPEVGSDCTTIHYNYMCNS

SEQ ID NO: 3326 - protein, 52 aa, Artificial Sequence
  source: /note="Description of Artificial Sequence: Synthetic polypeptide"
  source: /note="p.V216M"
PQHLIRVEGNLRVEYLDDRNTFRHSMMVVPYEPPEVGSDCTTIHYNYMCNSS

SEQ ID NO: 3327 - protein, 52 aa, Artificial Sequence
  source: /note="Description of Artificial Sequence: Synthetic polypeptide"
  source: /note="p.Y220S"
IRVEGNLRVEYLDDRNTFRHSVVVPSSEPPEVGSDCTTIHYNYMCNSSCMGG

SEQ ID NO: 3328 - protein, 52 aa, Artificial Sequence
  source: /note="Description of Artificial Sequence: Synthetic polypeptide"
  source: /note="p.Y220C"
IRVEGNLRVEYLDDRNTFRHSVVVPCCEPPEVGSDCTTIHYNYMCNSSCMGG

SEQ ID NO: 3329 - protein, 52 aa, Artificial Sequence
  source: /note="Description of Artificial Sequence: Synthetic polypeptide"
  source: /note="p.Y234C"
RNTFRHSVVVPYEPPEVGSDCTTIHCCNYMCNSSCMGGMNRRPILTIITLED

SEQ ID NO: 3330 - protein, 52 aa, Artificial Sequence
  source: /note="Description of Artificial Sequence: Synthetic polypeptide"
  source: /note="p.Y236D"
TFRHSVVVPYEPPEVGSDCTTIHYNDDMCNSSCMGGMNRRPILTIITLEDSS

SEQ ID NO: 3331 - protein, 52 aa, Artificial Sequence
  source: /note="Description of Artificial Sequence: Synthetic polypeptide"
  source: /note="p.Y236C"
TFRHSVVVPYEPPEVGSDCTTIHYNCCMCNSSCMGGMNRRPILTIITLEDSS

SEQ ID NO: 3332 - protein, 52 aa, Artificial Sequence
  source: /note="Description of Artificial Sequence: Synthetic polypeptide"
  source: /note="p.M237I"
FRHSVVVPYEPPEVGSDCTTIHYNYIICNSSCMGGMNRRPILTIITLEDSSG

SEQ ID NO: 3333 - protein, 52 aa, Artificial Sequence; identical to SEQ ID NO: 3332
  source: /note="Description of Artificial Sequence: Synthetic polypeptide"
  source: /note="p.M237I"

SEQ ID NO: 3334 - protein, 52 aa, Artificial Sequence
  source: /note="Description of Artificial Sequence: Synthetic polypeptide"
  source: /note="p.C238Y"
RHSVVVPYEPPEVGSDCTTIHYNYMYYNSSCMGGMNRRPILTIITLEDSSGN

SEQ ID NO: 3335 - protein, 52 aa, Artificial Sequence
  source: /note="Description of Artificial Sequence: Synthetic polypeptide"
  source: /note="p.C238F"
RHSVVVPYEPPEVGSDCTTIHYNYMFFNSSCMGGMNRRPILTIITLEDSSGN

SEQ ID NO: 3336 - protein, 52 aa, Artificial Sequence
  source: /note="Description of Artificial Sequence: Synthetic polypeptide"
  source: /note="p.S241Y"
VVVPYEPPEVGSDCTTIHYNYMCNSYYCMGGMNRRPILTIITLEDSSGNLLG

SEQ ID NO: 3337 - protein, 52 aa, Artificial Sequence
  source: /note="Description of Artificial Sequence: Synthetic polypeptide"
  source: /note="p.S241F"
VVVPYEPPEVGSDCTTIHYNYMCNSFFCMGGMNRRPILTIITLEDSSGNLLG

SEQ ID NO: 3338 - protein, 29 aa, Artificial Sequence
  source: /note="Description of Artificial Sequence: Synthetic peptide"
  source: /note="p.S241fs"
VVPYEPPEVGSDCTTIHYNYMCNSSAWAA

SEQ ID NO: 3339 - protein, 52 aa, Artificial Sequence
  source: /note="Description of Artificial Sequence: Synthetic polypeptide"
  source: /note="p.C242F"
VVPYEPPEVGSDCTTIHYNYMCNSSFFMGGMNRRPILTIITLEDSSGNLLGR

SEQ ID NO: 3340 - protein, 52 aa, Artificial Sequence
  source: /note="Description of Artificial Sequence: Synthetic polypeptide"
  source: /note="p.G244C"
PYEPPEVGSDCTTIHYNYMCNSSCMCCGMNRRPILTIITLEDSSGNLLGRNS

SEQ ID NO: 3341 - protein, 52 aa, Artificial Sequence
  source: /note="Description of Artificial Sequence: Synthetic polypeptide"
  source: /note="p.G244D"
PYEPPEVGSDCTTIHYNYMCNSSCMDDGMNRRPILTIITLEDSSGNLLGRNS

SEQ ID NO: 3342 - protein, 52 aa, Artificial Sequence
  source: /note="Description of Artificial Sequence: Synthetic polypeptide"
  source: /note="p.G245S"
YEPPEVGSDCTTIHYNYMCNSSCMGSSMNRRPILTIITLEDSSGNLLGRNSF

SEQ ID NO: 3343 - protein, 52 aa, Artificial Sequence
  source: /note="Description of Artificial Sequence: Synthetic polypeptide"
  source: /note="p.G245D"
YEPPEVGSDCTTIHYNYMCNSSCMGDDMNRRPILTIITLEDSSGNLLGRNSF

SEQ ID NO: 3344 - protein, 52 aa, Artificial Sequence
  source: /note="Description of Artificial Sequence: Synthetic polypeptide"
  source: /note="p.G245V"
YEPPEVGSDCTTIHYNYMCNSSCMGVVMNRRPILTIITLEDSSGNLLGRNSF

SEQ ID NO: 3345 - protein, 52 aa, Artificial Sequence
  source: /note="Description of Artificial Sequence: Synthetic polypeptide"
  source: /note="p.R248W"
PEVGSDCTTIHYNYMCNSSCMGGMNWWRPILTIITLEDSSGNLLGRNSFEVR

SEQ ID NO: 3346 - protein, 52 aa, Artificial Sequence
  source: /note="Description of Artificial Sequence: Synthetic polypeptide"
  source: /note="p.R248Q"
PEVGSDCTTIHYNYMCNSSCMGGMNQQRPILTIITLEDSSGNLLGRNSFEVR

SEQ ID NO: 3347 - protein, 52 aa, Artificial Sequence
  source: /note="Description of Artificial Sequence: Synthetic polypeptide"
  source: /note="p.R248P"
PEVGSDCTTIHYNYMCNSSCMGGMNPPRPILTIITLEDSSGNLLGRNSFEVR

SEQ ID NO: 3348 - protein, 52 aa, Artificial Sequence
  source: /note="Description of Artificial Sequence: Synthetic polypeptide"
  source: /note="p.R249G"
EVGSDCTTIHYNYMCNSSCMGGMNRGGPILTIITLEDSSGNLLGRNSFEVRV

SEQ ID NO: 3349 - protein, 52 aa, Artificial Sequence
  source: /note="Description of Artificial Sequence: Synthetic polypeptide"
  source: /note="p.R249M"
EVGSDCTTIHYNYMCNSSCMGGMNRMMPILTIITLEDSSGNLLGRNSFEVRV

SEQ ID NO: 3350 - protein, 52 aa, Artificial Sequence
  source: /note="Description of Artificial Sequence: Synthetic polypeptide"
  source: /note="p.R249S"
EVGSDCTTIHYNYMCNSSCMGGMNRSSPILTIITLEDSSGNLLGRNSFEVRV

SEQ ID NO: 3351 - protein, 52 aa, Artificial Sequence
  source: /note="Description of Artificial Sequence: Synthetic polypeptide"
  source: /note="p.P250L"
VGSDCTTIHYNYMCNSSCMGGMNRRLLILTIITLEDSSGNLLGRNSFEVRVC

SEQ ID NO: 3352 - protein, 52 aa, Artificial Sequence
  source: /note="Description of Artificial Sequence: Synthetic polypeptide"
  source: /note="p.I255F"
TTIHYNYMCNSSCMGGMNRRPILTIFFTLEDSSGNLLGRNSFEVRVCACPGR

SEQ ID NO: 3353 - protein, 52 aa, Artificial Sequence
  source: /note="Description of Artificial Sequence: Synthetic polypeptide"
  source: /note="p.D259Y"
YNYMCNSSCMGGMNRRPILTIITLEYYSSGNLLGRNSFEVRVCACPGRDRRT

SEQ ID NO: 3354 - protein, 52 aa, Artificial Sequence
  source: /note="Description of Artificial Sequence: Synthetic polypeptide"
  source: /note="p.G262V"
MCNSSCMGGMNRRPILTIITLEDSSVVNLLGRNSFEVRVCACPGRDRRTEEE

SEQ ID NO: 3355 - protein, 52 aa, Artificial Sequence
  source: /note="Description of Artificial Sequence: Synthetic polypeptide"
  source: /note="p.G266R"
SCMGGMNRRPILTIITLEDSSGNLLRRRNSFEVRVCACPGRDRRTEEENLRK

SEQ ID NO: 3356 - protein, 52 aa, Artificial Sequence
  source: /note="Description of Artificial Sequence: Synthetic polypeptide"
  source: /note="p.G266E"
SCMGGMNRRPILTIITLEDSSGNLLEERNSFEVRVCACPGRDRRTEEENLRK

SEQ ID NO: 3357 - protein, 52 aa, Artificial Sequence
  source: /note="Description of Artificial Sequence: Synthetic polypeptide"
  source: /note="p.G266V"
SCMGGMNRRPILTIITLEDSSGNLLVVRNSFEVRVCACPGRDRRTEEENLRK

SEQ ID NO: 3358 - protein, 52 aa, Artificial Sequence
  source: /note="Description of Artificial Sequence: Synthetic polypeptide"
  source: /note="p.R267P"
CMGGMNRRPILTIITLEDSSGNLLGPPNSFEVRVCACPGRDRRTEEENLRKK

SEQ ID NO: 3359 - protein, 52 aa, Artificial Sequence
  source: /note="Description of Artificial Sequence: Synthetic polypeptide"
  source: /note="p.E271K"
MNRRPILTIITLEDSSGNLLGRNSFKKVRVCACPGRDRRTEEENLRKKGEPH

SEQ ID NO: 3360 - protein, 52 aa, Artificial Sequence
  source: /note="Description of Artificial Sequence: Synthetic polypeptide"
  source: /note="p.V272M"
NRRPILTIITLEDSSGNLLGRNSFEMMRVCACPGRDRRTEEENLRKKGEPHH

SEQ ID NO: 3361 - protein, 52 aa, Artificial Sequence
  source: /note="Description of Artificial Sequence: Synthetic polypeptide"
  source: /note="p.R273C"
RRPILTIITLEDSSGNLLGRNSFEVCCVCACPGRDRRTEEENLRKKGEPHHE

SEQ ID NO: 3362 - protein, 52 aa, Artificial Sequence
  source: /note="Description of Artificial Sequence: Synthetic polypeptide"
  source: /note="p.R273H"
RRPILTIITLEDSSGNLLGRNSFEVHHVCACPGRDRRTEEENLRKKGEPHHE

SEQ ID NO: 3363 - protein, 52 aa, Artificial Sequence
  source: /note="Description of Artificial Sequence: Synthetic polypeptide"
  source: /note="p.R273L"
RRPILTIITLEDSSGNLLGRNSFEVLLVCACPGRDRRTEEENLRKKGEPHHE

SEQ ID NO: 3364 - protein, 52 aa, Artificial Sequence
  source: /note="Description of Artificial Sequence: Synthetic polypeptide"
  source: /note="p.V274F"
RPILTIITLEDSSGNLLGRNSFEVRFFCACPGRDRRTEEENLRKKGEPHHEL

SEQ ID NO: 3365 - protein, 52 aa, Artificial Sequence
  source: /note="Description of Artificial Sequence: Synthetic polypeptide"
  source: /note="p.C275Y"
PILTIITLEDSSGNLLGRNSFEVRVYYACPGRDRRTEEENLRKKGEPHHELP

SEQ ID NO: 3366 - protein, 52 aa, Artificial Sequence
  source: /note="Description of Artificial Sequence: Synthetic polypeptide"
  source: /note="p.C275F"
PILTIITLEDSSGNLLGRNSFEVRVFFACPGRDRRTEEENLRKKGEPHHELP

SEQ ID NO: 3367 - protein, 52 aa, Artificial Sequence
  source: /note="Description of Artificial Sequence: Synthetic polypeptide"
  source: /note="p.C277F"
LTIITLEDSSGNLLGRNSFEVRVCAFFPGRDRRTEEENLRKKGEPHHELPPG

SEQ ID NO: 3368 - protein, 52 aa, Artificial Sequence
  source: /note="Description of Artificial Sequence: Synthetic polypeptide"
  source: /note="p.P278S"
TIITLEDSSGNLLGRNSFEVRVCACSSGRDRRTEEENLRKKGEPHHELPPGS

SEQ ID NO: 3369 - protein, 52 aa, Artificial Sequence
  source: /note="Description of Artificial Sequence: Synthetic polypeptide"
  source: /note="p.D281N"
TLEDSSGNLLGRNSFEVRVCACPGRNNRRTEEENLRKKGEPHHELPPGSTKR

SEQ ID NO: 3370 - protein, 52 aa, Artificial Sequence
  source: /note="Description of Artificial Sequence: Synthetic polypeptide"
  source: /note="p.R282W"
LEDSSGNLLGRNSFEVRVCACPGRDWWRTEEENLRKKGEPHHELPPGSTKRA

SEQ ID NO: 3371 - protein, 52 aa, Artificial Sequence
  source: /note="Description of Artificial Sequence: Synthetic polypeptide"
  source: /note="p.E285K"
SSGNLLGRNSFEVRVCACPGRDRRTKKEENLRKKGEPHHELPPGSTKRALPN

SEQ ID NO: 3372 - protein, 52 aa, Artificial Sequence
  source: /note="Description of Artificial Sequence: Synthetic polypeptide"
  source: /note="p.E286K"
SGNLLGRNSFEVRVCACPGRDRRTEKKENLRKKGEPHHELPPGSTKRALPNN

SEQ ID NO: 3373 - protein, 43 aa, Artificial Sequence
  source: /note="Description of Artificial Sequence: Synthetic polypeptide"
  source: /note="p.S315fs"
KGEPHHELPPGSTKRALPNNTSSSPAKEETTGWRIFHPSDPWA

SEQ ID NO: 3374 - protein, 28 aa, Artificial Sequence
  source: /note="Description of Artificial Sequence: Synthetic peptide"
  source: /note="p.L174fs"
VLARMHDEDLIHGDLTTSNMLLKPPWNS

SEQ ID NO: 3375 - protein, 52 aa, Artificial Sequence
  source: /note="Description of Artificial Sequence: Synthetic polypeptide"
  source: /note="p.S398T"
AACAPEPGIPGETRGPCFLAGDGRATTEVPSLTALHTLWLREHNRLAAALKA

SEQ ID NO: 3376 - protein, 52 aa, Artificial Sequence
  source: /note="Description of Artificial Sequence: Synthetic polypeptide"
  source: /note="p.E558K"
GGLDPLIRGLLARPAKLQVQDQLMNKKELTERLFVLSNSSTLDLASINLQRG

SEQ ID NO: 3377 - protein, 52 aa, Artificial Sequence
  source: /note="Description of Artificial Sequence: Synthetic polypeptide"
  source: /note="p.A826T"
ADGAHPPCHASARCRNTKGGFQCLCTTDPYELGDDGRTCVDSGRLPRVTWIS

SEQ ID NO: 3378 - protein, 52 aa, Artificial Sequence
  source: /note="Description of Artificial Sequence: Synthetic polypeptide"
  source: /note="p.R30K"
AKPAKAANRTPPKSPGDPSKDRAAKKKLSLESEGAGEGAAASPELSALEEAF

SEQ ID NO: 3379 - protein, 52 aa, Artificial Sequence
  source: /note="Description of Artificial Sequence: Synthetic polypeptide"
  source: /note="p.S2155L"
EDRTVPSTPTLVVPHRTDGFAEAIHLLPQVAGVPRFRFGPPEDMPQTSSSHS

SEQ ID NO: 3380 - protein, 52 aa, Artificial Sequence
  source: /note="Description of Artificial Sequence: Synthetic polypeptide"
  source: /note="p.S200P"
NPGPIPGPNPGPIPGPISGPIPGPIPPVPIPGPIPGPISGPISGPNPGPIPG

SEQ ID NO: 3381 - protein, 52 aa, Artificial Sequence
  source: /note="Description of Artificial Sequence: Synthetic polypeptide"
  source: /note="p.S423L"
AQVKHLYNWNLPPRRILFIKHFIIYLLIPRYVRDLKIQIEMEKKVVFSTISL

SEQ ID NO: 3382 - protein, 37 aa, Artificial Sequence
  source: /note="Description of Artificial Sequence: Synthetic polypeptide"
  source: /note="p.M541I"
DNLHKQKARRIYPSDFAVEILFGEKIITSSDVVAGSD

SEQ ID NO: 3383 - protein, 52 aa, Artificial Sequence
  source: /note="Description of Artificial Sequence: Synthetic polypeptide"
  source: /note="p.R258Q"
FPSSGRQSFYRNPIEEVVRFLDKKHQQNHYRVYNLCSERAYDPKHFHNRVSR

SEQ ID NO: 3384 - protein, 35 aa, Artificial Sequence
  source: /note="Description of Artificial Sequence: Synthetic polypeptide"
  source: /note="p.S9F"
MESSKKMDFFPGALQTNPPLKLHTDRSAGTPVFVP

SEQ ID NO: 3385 - protein, 37 aa, Artificial Sequence
  source: /note="Description of Artificial Sequence: Synthetic polypeptide"
  source: /note="p.R11H"
MSSGKSARYNHHFSGGPSNLPTPDVTTGTRMETTFGP

SEQ ID NO: 3386 - protein, 52 aa, Artificial Sequence
  source: /note="Description of Artificial Sequence: Synthetic polypeptide"
  source: /note="p.D627N"
DPRPGVVTKGFRTLDVDLDEVYCLNNNFEEDDTGDHISLPRLATSTPVQHPE

SEQ ID NO: 3387 - protein, 52 aa, Artificial Sequence
  source: /note="Description of Artificial Sequence: Synthetic polypeptide"
  source: /note="p.E41Q"
HEFVLQNHADIVSCVAMVFLLGLMFQQITAKASIIFVTLQYNVTLPATEEQA

SEQ ID NO: 3388 - protein, 38 aa, Artificial Sequence
  source: /note="Description of Artificial Sequence: Synthetic polypeptide"
  source: /note="p.R345fs"
LQRWVEDSNIQASCMKKKRSRSSKKEQKTEWEWKLQIE

SEQ ID NO: 3389 - protein, 52 aa, Artificial Sequence
  source: /note="Description of Artificial Sequence: Synthetic polypeptide"
  source: /note="p.E846K"
YNISRRLSKLRVLPWSIHELYGDEIKKDFTQAELALLMKCINDPNSMFLTGD

SEQ ID NO: 3390 - protein, 42 aa, Artificial Sequence
  source: /note="Description of Artificial Sequence: Synthetic polypeptide"
  source: /note="p.K133fs"
WQNVLKAHSSVDWLIVIVENDAKKKKQNQHPSPNLYCGQNKK

SEQ ID NO: 3391 - protein, 52 aa, Artificial Sequence
  source: /note="Description of Artificial Sequence: Synthetic polypeptide"
  source: /note="p.R568Q"
MNESPDPEPDCDILAVKTAQKLWADQQISLAGSNIFTIGVQDFVPFVQCKAK

SEQ ID NO: 3392 - protein, 42 aa, Artificial Sequence
  source: /note="Description of Artificial Sequence: Synthetic polypeptide"
  source: /note="p.*730Y"
PFTPADRPGESSGQANSPGQKQQGQYYTHMYDPYKCFKILKM

SEQ ID NO: 3393 - protein, 52 aa, Artificial Sequence
  source: /note="Description of Artificial Sequence: Synthetic polypeptide"
  source: /note="p.R396Q"
QQQFTEVADHIQLDASIPVTFTKDNQQVHIGPKMEIRVVTLGLDGAGKTTIL

SEQ ID NO: 3394 - protein, 52 aa, Artificial Sequence
  source: /note="Description of Artificial Sequence: Synthetic polypeptide"
  source: /note="p.R289Q"
IVEDGIGMAHTEHVPGTAENARSCIQQAYFYDLHETLCRQEEMALSVVDAHV

SEQ ID NO: 3395 - protein, 52 aa, Artificial Sequence
  source: /note="Description of Artificial Sequence: Synthetic polypeptide"
  source: /note="p.R398L"
NVFTSGKHYWEVESRDSLEVAVGVCLLEDVMGITDRSKMSPDVGIWAIYWSA

SEQ ID NO: 3396 - protein, 52 aa, Artificial Sequence
  source: /note="Description of Artificial Sequence: Synthetic polypeptide"
  source: /note="p.Q127K"
TFHKGRLRSIHTSSKTALRTGSSDTKKVDEVKSIPANSHLVNHLNCPMCSRL

SEQ ID NO: 3397 - protein, 52 aa, Artificial Sequence
  source: /note="Description of Artificial Sequence: Synthetic polypeptide"
  source: /note="p.A93D"
CFECIKTIQQRNLKTNIRLKKMASLDDRKASLWLFLSSEEQMCGIHRETKKM

SEQ ID NO: 3398 - protein, 52 aa, Artificial Sequence
  source: /note="Description of Artificial Sequence: Synthetic polypeptide"
  source: /note="p.K98N"
SLTEIAKQLQIRSKKRKRQEEKHVCNNKHNQVLTFFCQKDLELLCPRCSLST

SEQ ID NO: 3399 - protein, 52 aa, Artificial Sequence
  source: /note="Description of Artificial Sequence: Synthetic polypeptide"
  source: /note="p.L332I"
MKNKVWNVSLKTFVLKGMLKKFKEDIIRGELEKEEKVELTLDPDTANPRLIL

SEQ ID NO: 3400 - protein, 52 aa, Artificial Sequence
  source: /note="Description of Artificial Sequence: Synthetic polypeptide"
  source: /note="p.R337S"
FEACLVAQCDALIDALNRRKAQLLASSVNKEHEHKLKVVRDQISHCTVKLRQ

SEQ ID NO: 3401 - protein, 52 aa, Artificial Sequence
  source: /note="Description of Artificial Sequence: Synthetic polypeptide"
  source: /note="p.H399Q"
DLFSLIGLKIGDDYSLWVSSPLKGQQQVREPVCKVGVFLDYESGHIAFYNGT

SEQ ID NO: 3402 - protein, 52 aa, Artificial Sequence
  source: /note="Description of Artificial Sequence: Synthetic polypeptide"
  source: /note="p.R661W"
QTGECDPEEIYQAAHQLEDRIQDFVWWRVEQRKILLDMSVSFHTHVKELWTW

SEQ ID NO: 3403 - protein, 52 aa, Artificial Sequence
  source: /note="Description of Artificial Sequence: Synthetic polypeptide"
  source: /note="p.H1300R"
DLPPPRRLAQRQPGPQAQCSSGGRTRRSPGRAEVERLFGQERRKSEAAGAFQ

SEQ ID NO: 3404 - protein, 41 aa, Artificial Sequence
  source: /note="Description of Artificial Sequence: Synthetic polypeptide"
  source: /note="p.K541fs"
DQLSKQQNEGDSIISKLKQDLNDEKREFINLKMIKWTLLKS

SEQ ID NO: 3405 - protein, 52 aa, Artificial Sequence
  source: /note="Description of Artificial Sequence: Synthetic polypeptide"
  source: /note="p.L1775P"
KLMAKAIMDFRLVDLPLGLPFYKWMPPRQETSLTSHDLFDIDPVVARSVYHL

SEQ ID NO: 3406 - protein, 52 aa, Artificial Sequence
  source: /note="Description of Artificial Sequence: Synthetic polypeptide"
  source: /note="p.S244I"
ALAARGFSELSTLEVLPQVYNVRTVIILPPPDLGTGTDGPAGSDTSPFRSGT

SEQ ID NO: 3407 - protein, 52 aa, Artificial Sequence
  source: /note="Description of Artificial Sequence: Synthetic polypeptide"
  source: /note="p.K54N"
TEDFKESLKVVFEGSAYGLQNFNKQNNKLKRCDDMDTFFLHYAAAEGQIELM

SEQ ID NO: 3408 - protein, 47 aa, Artificial Sequence
  source: /note="Description of Artificial Sequence: Synthetic polypeptide"
  source: /note="p.T673fs"
DKSCRDYYIEYNFKYLQCPLEFTKKHLHRMLYMNRLQPSTQWYKITA

SEQ ID NO: 3409 - protein, 52 aa, Artificial Sequence
  source: /note="Description of Artificial Sequence: Synthetic polypeptide"
  source: /note="p.S490L"
PREEWEMWHPTLIAEALFAISNILSLLLRLISLFTANSHLGPLQISLGRMLL

SEQ ID NO: 3410 - protein, 52 aa, Artificial Sequence
  source: /note="Description of Artificial Sequence: Synthetic polypeptide"
  source: /note="p.R429W"
TRTQAQHLFIILMECMKKKELITVFWWMGSEGHQDIDLAILTALLKGANASA

SEQ ID NO: 3411 - protein, 52 aa, Artificial Sequence
  source: /note="Description of Artificial Sequence: Synthetic polypeptide"
  source: /note="p.G298W"
QTMSNPMSKLTVLNSMHSHFILADNWWTTGKYGAEVKLRRQLEKHISLQKIN

SEQ ID NO: 3412 - protein, 52 aa, Artificial Sequence
  source: /note="Description of Artificial Sequence: Synthetic polypeptide"
  source: /note="p.R995H"
IAKMTANMFYIVIIMAIVLLSFGVAHHKAILSPKEPPSWSLARDIVFEPYWM

SEQ ID NO: 3413 - protein, 52 aa, Artificial Sequence
  source: /note="Description of Artificial Sequence: Synthetic polypeptide"
  source: /note="p.R843Q"
VRILDSNEGKNEMEIQMKSKKLPITQQKFYAFYHAPIVKFWFNTLAYLGFLM

SEQ ID NO: 3414 - protein, 30 aa, Artificial Sequence
  source: /note="Description of Artificial Sequence: Synthetic polypeptide"
  source: /note="p.R1862C"
PQDEPSDLNLQPGNSTKESESTNSVCCLML

SEQ ID NO: 3415 - protein, 38 aa, Artificial Sequence
  source: /note="Description of Artificial Sequence: Synthetic polypeptide"
  source: /note="p.H765fs"
VFYIAFLLLFAYVLLMDFHSVPHPPRAGPVLAGLCPLL

SEQ ID NO: 3416 - protein, 52 aa, Artificial Sequence
  source: /note="Description of Artificial Sequence: Synthetic polypeptide"
  source: /note="p.R1125W"
IEKYQYPLFGLPFVHNDFQSEADWLWWFWSKYKLSVPGNPHYLSHVPGLPNP

SEQ ID NO: 3417 - protein, 53 aa, Artificial Sequence
  source: /note="Description of Artificial Sequence: Synthetic polypeptide"
  source: /note="p.L627del"
KFTIGMGELAFQEQLHFRGMVLLLLAYVLLTYILLLNMLIALMSETVNSVATD

SEQ ID NO: 3418 - protein, 52 aa, Artificial Sequence
  source: /note="Description of Artificial Sequence: Synthetic polypeptide"
  source: /note="p.A218E"
FAEENDILGRFINAEYTEEAYEGQTEELNIAIERRQGDIAALLIAAGADVNA

SEQ ID NO: 3419 - protein, 52 aa, Artificial Sequence
  source: /note="Description of Artificial Sequence: Synthetic polypeptide"
  source: /note="p.R492H"
YFTRGFQMLGPFTIMIQKMIFGDLMHHFCWLMAVVILGFASAFYIIFQTEDP

SEQ ID NO: 3420 - protein, 52 aa, Artificial Sequence
  source: /note="Description of Artificial Sequence: Synthetic polypeptide"
  source: /note="p.R3515W"
THYYIKIARFMPRVEIVQKHNTAARWWLYIRGHNGKIYPYLVMNDACLTESR

SEQ ID NO: 3421 - protein, 52 aa, Artificial Sequence
  source: /note="Description of Artificial Sequence: Synthetic polypeptide"
  source: /note="p.A973S"
DCLKSANTEPYYRRQAWEVIKCFLVSSMMSLEDNKHALYQLLAHPNFTEKTI

SEQ ID NO: 3422 - protein, 52 aa, Artificial Sequence
  source: /note="Description of Artificial Sequence: Synthetic polypeptide"
  source: /note="p.G378C"
CGMTTPPTSPGNVPPDLSHPYSKVFCCTTAGGKGTPLGTPATSPPPAPLCHS

SEQ ID NO: 3423 - protein, 52 aa, Artificial Sequence
  source: /note="Description of Artificial Sequence: Synthetic polypeptide"
  source: /note="p.A419T"
AQPSSTGAAASPATAATLPVGTGQNTTSSVGAQLMGASSQPSEAMAPRTGPA

SEQ ID NO: 3424 - protein, 52 aa, Artificial Sequence
  source: /note="Description of Artificial Sequence: Synthetic polypeptide"
  source: /note="p.K265R"
WRMKEEMDRAQAELNALKRTEEDLKRRGHQKLEEMVTRLDQEVAEVDKNIEL

SEQ ID NO: 3425 - protein, 52 aa, Artificial Sequence
  source: /note="Description of Artificial Sequence: Synthetic polypeptide"
  source: /note="p.R276S"
AELNALKRTEEDLKKGHQKLEEMVTSSLDQEVAEVDKNIELLKKKDEELSSA

SEQ ID NO: 3426 - protein, 52 aa, Artificial Sequence
  source: /note="Description of Artificial Sequence: Synthetic polypeptide"
  source: /note="p.K501N"
EDSLEKFEPSTLYPYLREEDLDDSPNNGGLDILKSLENTVSTAISKAQNGAP

SEQ ID NO: 3427 - protein, 52 aa, Artificial Sequence
  source: /note="Description of Artificial Sequence: Synthetic polypeptide"
  source: /note="p.R881M"
QAQFASSLRETTEGKYIMSDLGPQEMMVHISKFTGLSMTTISHWLANVKYQL

SEQ ID NO: 3428 - protein, 52 aa, Artificial Sequence
  source: /note="Description of Artificial Sequence: Synthetic polypeptide"
  source: /note="p.A222T"
LYRQSSKMCGTVFTGASRFRCRQCSTTAYDTLVELTVHMNETGHYQDDNRKK

SEQ ID NO: 3429 - protein, 52 aa, Artificial Sequence
  source: /note="Description of Artificial Sequence: Synthetic polypeptide"
  source: /note="p.G677V"
EPIKMEASSDGGFRSQENSPSPPRDVVCKDGSPLAEPVENGKELVKPLASSL

SEQ ID NO: 3430 - protein, 52 aa, Artificial Sequence
  source: /note="Description of Artificial Sequence: Synthetic polypeptide"
  source: /note="p.E513K"
CPSCQRLHKKILELERQALAKHVRAKKALSSTLRLAQDEALRAKNLLLTDKM

SEQ ID NO: 3431 - protein, 52 aa, Artificial Sequence
  source: /note="Description of Artificial Sequence: Synthetic polypeptide"
  source: /note="p.L92V"
IGFVGCLGAIKENKCLLLTFFLLLLVVVFLLEATIAILFFAYTDKIDRYAQQ

SEQ ID NO: 3432 - protein, 52 aa, Artificial Sequence
  source: /note="Description of Artificial Sequence: Synthetic polypeptide"
  source: /note="p.E301K"
ARGSPSVAINKEGESSRGTEPLWTPKKPGSDKKSATKLEPEGEAQPQAQPET

SEQ ID NO: 3433 - protein, 52 aa, Artificial Sequence
  source: /note="Description of Artificial Sequence: Synthetic polypeptide"
  source: /note="p.C83W"
KQVLKMEVAVLKKLQGKDHVCRFIGWWGRNDRFNYVVMQLQGRNLADLRRSQ

SEQ ID NO: 3434 - protein, 52 aa, Artificial Sequence
  source: /note="Description of Artificial Sequence: Synthetic polypeptide"
  source: /note="p.S270Y"
ESNIDACQILTVHELAREGNMTTVSYYLKTQKATNHVRNLIKALETREPENP

SEQ ID NO: 3435 - protein, 111 aa, Artificial Sequence
  source: /note="Description of Artificial Sequence: Synthetic polypeptide"
  source: /note="p.K336fs"
RPAVGLHGETAGIPAPAYKNKSKKKRKSPITRNLRQWPCLRASRVHTLKDHRWAVRLGLWKAVQLLKGSRNPTVQRRSLRKGSLRLSKGHECLVMIFQCPVRTLRAHSLIQ

SEQ ID NO: 3436 - protein, 52 aa, Artificial Sequence
  source: /note="Description of Artificial Sequence: Synthetic polypeptide"
  source: /note="p.Q530R"
IKDRATSTIKRMYRDDLERFKEFKARRGVAIKFGKFSVKENKQLEKNVEDFL

SEQ ID NO: 3437 - protein, 52 aa, Artificial Sequence
  source: /note="Description of Artificial Sequence: Synthetic polypeptide"
  source: /note="p.R761S"
LDEAHNVKNPRVQTSIAVCKLQACASSWAVTGTPIQNNLLDMYSLLKFLRCS

SEQ ID NO: 3438 - protein, 52 aa, Artificial Sequence
  source: /note="Description of Artificial Sequence: Synthetic polypeptide"
  source: /note="p.R707H"
CGYDSLQHLINQNSDYLVNGISLNLHHHLALHPHTPKVLEVMLRNSDANLLP

SEQ ID NO: 3439 - protein, 58 aa, Artificial Sequence
  source: /note="Description of Artificial Sequence: Synthetic polypeptide"
  source: /note="p.122_123insKA"
SELAARWEAEAVAAAKAAAKAEAEAKAKATAETVAEQVRVDAGAAGEPECKAGEEQPK

SEQ ID NO: 3440 - protein, 52 aa, Artificial Sequence
  source: /note="Description of Artificial Sequence: Synthetic polypeptide"
  source: /note="p.R751H"
LIKLDSVKQRKVLDIVKTSIRTVLPHHIWKVPDVEEVNLYRIFNRVFNRLLW

SEQ ID NO: 3441 - protein, 32 aa, Artificial Sequence
  source: /note="Description of Artificial Sequence: Synthetic polypeptide"
  source: /note="p.L146F"
EDGVVGLNYSCGNLGRRVNGELQLGFFLAIIN

SEQ ID NO: 3442 - protein, 48 aa, Artificial Sequence
  source: /note="Description of Artificial Sequence: Synthetic polypeptide"
  source: /note="p.Q176fs"
SLLMERLSVDYGKKSKLEFAIYPAPPGLHGRGGALQLHPDHPHDPGTF

SEQ ID NO: 3443 - protein, 52 aa, Artificial Sequence
  source: /note="Description of Artificial Sequence: Synthetic polypeptide"
  source: /note="p.R243Q"
DIERPTYTNLNRLIGQIVSSITASLQQFDGALNVDLTEFQTNLVPYPRIHFP

SEQ ID NO: 3444 - protein, 52 aa, Artificial Sequence
  source: /note="Description of Artificial Sequence: Synthetic polypeptide"
  source: /note="p.V102M"
TYHGDSHLQLERINVHHHEASGGRYMMPRAVLVDLEPGTMDSVRSGPFGQVL

SEQ ID NO: 3445 - protein, 52 aa, Artificial Sequence
  source: /note="Description of Artificial Sequence: Synthetic polypeptide"
  source: /note="p.R119H"
HEASGGRYVPRAVLVDLEPGTMDSVHHSGPFGQVLRPDNFIFGELRARTGVR

SEQ ID NO: 3446 - protein, 52 aa, Artificial Sequence
  source: /note="Description of Artificial Sequence: Synthetic polypeptide"
  source: /note="p.A200V"
YGTGEVIVQNYNSILTLSHLYRSSDVVLLLHENDAIHKICAKLMNIKQISFS

SEQ ID NO: 3447 - protein, 52 aa, Artificial Sequence
  source: /note="Description of Artificial Sequence: Synthetic polypeptide"
  source: /note="p.A340T"
KSQQRKVRQMIEQLQNSKAVIQSKDTTTIQELKEKIAYLEAENLEMHDRMEH

SEQ ID NO: 3448 - protein, 52 aa, Artificial Sequence
  source: /note="Description of Artificial Sequence: Synthetic polypeptide"
  source: /note="p.L101F"
HSAGHSLASELVESHDGHEEIIKVYFFKGRSGDKMIHEKNINQLKSEVQYIQ

SEQ ID NO: 3449 - protein, 52 aa, Artificial Sequence
  source: /note="Description of Artificial Sequence: Synthetic polypeptide"
  source: /note="p.H306Q"
KKKHQEVQDQDPVFQGSDSSGYQSDQQKKKKKKRKHSEEAEFTPPLKCSPKR

SEQ ID NO: 3450 - protein, 44 aa, Artificial Sequence
  source: /note="Description of Artificial Sequence: Synthetic polypeptide"
  source: /note="p.R343Q"
LIKSVDWLLVFSLFFLISFIMYATIQQTESIRWLIPGQEQEHVE

SEQ ID NO: 3451 - protein, 52 aa, Artificial Sequence
  source: /note="Description of Artificial Sequence: Synthetic polypeptide"
  source: /note="p.R234C"
AERSEPTQALELTEDDIKEDGIVPLCCYVKFQNVNSVTIFVQSNQGEEETTR

SEQ ID NO: 3452 - protein, 55 aa, Artificial Sequence
  source: /note="Description of Artificial Sequence: Synthetic polypeptide"
  source: /note="p.T352fs"
PEPQDVAQCLEVGLFDTPPFYSNSTVSETQWKVTVTPRESMTLLFEVFTIWLIYS

SEQ ID NO: 3453 - protein, 52 aa, Artificial Sequence
  source: /note="Description of Artificial Sequence: Synthetic polypeptide"
  source: /note="p.S34Y"
FGTEKDKVNCSFYFKIGACRHGDRCYYRLHNKPTFSQTIALLNIYRNPQNSS

SEQ ID NO: 3454 - protein, 52 aa, Artificial Sequence
  source: /note="Description of Artificial Sequence: Synthetic polypeptide"
  source: /note="p.S34F"
FGTEKDKVNCSFYFKIGACRHGDRCFFRLHNKPTFSQTIALLNIYRNPQNSS

SEQ ID NO: 3455 - protein, 49 aa, Artificial Sequence
  source: /note="Description of Artificial Sequence: Synthetic polypeptide"
  source: /note="p.G684fs"
EDGRTLSDYNIQKESTLHLVLRLRGVSKFPLLRFQQISLHFPFNKVVAF

SEQ ID NO: 3456 - protein, 52 aa, Artificial Sequence
  source: /note="Description of Artificial Sequence: Synthetic polypeptide"
  source: /note="p.I191T"
TLEVEPSDTIENVKAKIQDKEGIPPTTSRGSSLQASSWKMAVLFLTTTSRRS

SEQ ID NO: 3457 - protein, 52 aa, Artificial Sequence
  source: /note="Description of Artificial Sequence: Synthetic polypeptide"
  source: /note="p.G193W"
KQKQKAQDELSSRPQTLPLPDVVPDWWETHLVQNGIQLLNGHAPGAVPNLAG

SEQ ID NO: 3458 - protein, 52 aa, Artificial Sequence
  source: /note="Description of Artificial Sequence: Synthetic polypeptide"
  source: /note="p.G131D"
LEGNVCLNILREDWKPVLTINSIIYDDLQYLFLEPNPEDPLNKEAAEVLQNN

SEQ ID NO: 3459 - protein, 52 aa, Artificial Sequence
  source: /note="Description of Artificial Sequence: Synthetic polypeptide"
  source: /note="p.R86I"
EEYPMAAPKVRFMTKIYHPNVDKLEIIISLDILKDKWSPALQIRTVLLSIQA

SEQ ID NO: 3460 - protein, 30 aa, Artificial Sequence
  source: /note="Description of Artificial Sequence: Synthetic polypeptide"
  source: /note="p.R1118fs"
YENSRCYNEMALIRVVQSMTQLVRRAPRGL

SEQ ID NO: 3461 - protein, 52 aa, Artificial Sequence
  source: /note="Description of Artificial Sequence: Synthetic polypeptide"
  source: /note="p.A97T"
AYRSHGVLDPRLLVGCAVAVLAVHGTTGNLVNTYYDFSKGIDHKKSDDRTLV

SEQ ID NO: 3462 - protein, 52 aa, Artificial Sequence
  source: /note="Description of Artificial Sequence: Synthetic polypeptide"
  source: /note="p.S417L"
LPTTSEHTAKKMKATNEPSLTHMDCLLTGPLSHEQKLSQSLEIALASTLGSM

SEQ ID NO: 3463 - protein, 95 aa, Artificial Sequence
  source: /note="Description of Artificial Sequence: Synthetic polypeptide"
  source: /note="p.A523fs"
PIGPIVPFTPIGPIGPIGPTGPAAPLAPPALVAPRGLLCPALHLVKPRVLHQNLDPTSSSFSKWCRPWLEQMLHSCRIQKSDFSNNWNSSTQWGS

SEQ ID NO: 3464 - protein, 52 aa, Artificial Sequence
  source: /note="Description of Artificial Sequence: Synthetic polypeptide"
  source: /note="p.G1647W"
KHPVLCLFCGAILCSQNICCQEIVNWWEEVGACIFHALHCGAGVCIFLKIRE

SEQ ID NO: 3465 - protein, 40 aa, Artificial Sequence
  source: /note="Description of Artificial Sequence: Synthetic polypeptide"
  source: /note="p.P2802fs"
TAENVNNGNPSPLEALLAGAEGFPPCWTSHLMQMTRPWLN

SEQ ID NO: 3466 - protein, 52 aa, Artificial Sequence
  source: /note="Description of Artificial Sequence: Synthetic polypeptide"
  source: /note="p.K2120fs"
EVLPTKMSYAANLKNVMNMQNRQKKKGKNSPCCQKKLRVQNQGHLLMILLHN

SEQ ID NO: 3467 - protein, 52 aa, Artificial Sequence
  source: /note="Description of Artificial Sequence: Synthetic polypeptide"
  source: /note="p.R2517S"
LDDTDDGDDNAPLFYQPGKRGFYTPSSPGKNTEARLNCFRNIGRILGLCLLQ

SEQ ID NO: 3468 - protein, 52 aa, Artificial Sequence
  source: /note="Description of Artificial Sequence: Synthetic polypeptide"
  source: /note="p.A276V"
LDQVTGFLGEHGQLDGLSSSPPKKCVVRSESLIDASEDSQLEAAIRASLQET

SEQ ID NO: 3469 - protein, 52 aa, Artificial Sequence
  source: /note="Description of Artificial Sequence: Synthetic polypeptide"
  source: /note="p.D262H"
ASFYNSGLLDTFIGEGKEYIFVSNIHHNLGATVDLYILNHLMNPPNGKRCEF

SEQ ID NO: 3470 - protein, 30 aa, Artificial Sequence
  source: /note="Description of Artificial Sequence: Synthetic polypeptide"
  source: /note="p.T4A"
MARAAGWTSPIPLCVSLLLTCGFAEAGKLL

SEQ ID NO: 3471 - protein, 42 aa, Artificial Sequence
  source: /note="Description of Artificial Sequence: Synthetic polypeptide"
  source: /note="p.N97fs"
EIYRVPFGKERIEGVIKDFVLTWLEIDHLLQPFGDSIRRWPK

SEQ ID NO: 3472 - protein, 52 aa, Artificial Sequence
  source: /note="Description of Artificial Sequence: Synthetic polypeptide"
  source: /note="p.R447I"
STDLLNALKTVINDPLYKENIMKLSIIIQHDQPVKPLDRAVFWIEFVMPHKG

SEQ ID NO: 3473 - protein, 52 aa, Artificial Sequence
  source: /note="Description of Artificial Sequence: Synthetic polypeptide"
  source: /note="p.P289H"
FQFPHPFLPNIDFVGGLHCKPAKPLHHKEMEEFVQSSGENGVVVFSLGSVIS

SEQ ID NO: 3474 - protein, 52 aa, Artificial Sequence
  source: /note="Description of Artificial Sequence: Synthetic polypeptide"
  source: /note="p.M214I"
FPPSYVPVVMSELTDQMTFMERVKNIIIYVLYFDFWFEIFDMKKWDQFYSEV

SEQ ID NO: 3475 - protein, 52 aa, Artificial Sequence
  source: /note="Description of Artificial Sequence: Synthetic polypeptide"
  source: /note="p.E102K"
FNSTTSDAFLQSKMRNIFSGRLTAIKKLFDILDHYTKNCDLMVGNHALIQGL

SEQ ID NO: 3476 - protein, 44 aa, Artificial Sequence
  source: /note="Description of Artificial Sequence: Synthetic polypeptide"
  source: /note="p.I1330fs"
EIPVVVPMQIELLNSSITLKDDIPPSIQHLQAPSPSLWPWNMLC

SEQ ID NO: 3477 - protein, 52 aa, Artificial Sequence
  source: /note="Description of Artificial Sequence: Synthetic polypeptide"
  source: /note="p.M559I"
CQCRTTRDATPSRAGRACEGDLVSPIIGGGLSAATGVTVPGLGTGTAALGLE

SEQ ID NO: 3478 - protein, 39 aa, Artificial Sequence
  source: /note="Description of Artificial Sequence: Synthetic polypeptide"
  source: /note="p.V445A"
LTMVAYGLVECVESKNPIRPHAPGQAANQAEDEEIQTKM

SEQ ID NO: 3479 - protein, 52 aa, Artificial Sequence
  source: /note="Description of Artificial Sequence: Synthetic polypeptide"
  source: /note="p.V498M"
YHWWQAVAIFTVYLGSSLHMKAKLAMMLLVTLVAAAVSYLRMEQKLRRGVAP

SEQ ID NO: 3480 - protein, 34 aa, Artificial Sequence
  source: /note="Description of Artificial Sequence: Synthetic polypeptide"
  source: /note="p.P49fs"
DFNISSLSGLLSPALTESLLVALPPVTSQEAMPH

SEQ ID NO: 3481 - protein, 30 aa, Artificial Sequence
  source: /note="Description of Artificial Sequence: Synthetic polypeptide"
  source: /note="p.G272fs"
QITQEAVPKSLGASESSYTSVNRGPATGQG

SEQ ID NO: 3482 - protein, 32 aa, Artificial Sequence
  source: /note="Description of Artificial Sequence: Synthetic polypeptide"
  source: /note="p.S6A"
MLSVAAARSGPFAPVLSATSRGVAGALRPLVQ

SEQ ID NO: 3483 - protein, 52 aa, Artificial Sequence
  source: /note="Description of Artificial Sequence: Synthetic polypeptide"
  source: /note="p.I83V"
QAVRRPLVASVGLNVPASVCYSHTDVVKVPDFSEYRRLEVLDSTKSSRESSE

SEQ ID NO: 3484 - protein, 122 aa, Artificial Sequence
  source: /note="Description of Artificial Sequence: Synthetic polypeptide"
  source: /note="p.G639fs"
HFLREMGQFYEAESCLVEAGRLPAGPEAFCPLPRLGLGAAADRAASGANRWEHAEHARPLGHRAPEGAARPTGETVKAGGSVNRRGARHGQVHTPQHHVWAAVCHREELRSSRGLHAAHHSG

SEQ ID NO: 3485 - protein, 42 aa, Artificial Sequence
  source: /note="Description of Artificial Sequence: Synthetic polypeptide"
  source: /note="p.S13fs"
MEAPTVETPPDPSPPFGPGPCPGSVARPGCGAAARGAGKGGH

SEQ ID NO: 3486 - protein, 52 aa, Artificial Sequence
  source: /note="Description of Artificial Sequence: Synthetic polypeptide"
  source: /note="p.R52Q"
DPTSVAIASIQSAATFPDPNVKYVFQQTENGGQVMYRVIQVSEGQLDGQTEG

SEQ ID NO: 3487 - protein, 52 aa, Artificial Sequence
  source: /note="Description of Artificial Sequence: Synthetic polypeptide"
  source: /note="p.R3719H"
NSTTVELYWSLPEKPNGLVSQYQLSHHNGNLLFLGGSEEQNFTDKNLEPNSR

SEQ ID NO: 3488 - protein, 52 aa, Artificial Sequence
  source: /note="Description of Artificial Sequence: Synthetic polypeptide"
  source: /note="p.F2369L"
KAHVRWEAPFRPNGLLTHSVLFTGILLYVDPVGNNYTLLNVTKVMYSGEETN

SEQ ID NO: 3489 - protein, 52 aa, Artificial Sequence
  source: /note="Description of Artificial Sequence: Synthetic polypeptide"
  source: /note="p.A286T"
VLDAALETGQLIIMETRKKDGTWPSTTQLHVMNNNMSEEDEDFKGQPGICGL

SEQ ID NO: 3490 - protein, 28 aa, Artificial Sequence
  source: /note="Description of Artificial Sequence: Synthetic peptide"
  source: /note="p.K782fs"
KKRYFDENAAEDFEKHESVEYKPPKNPL

SEQ ID NO: 3491 - protein, 52 aa, Artificial Sequence
  source: /note="Description of Artificial Sequence: Synthetic polypeptide"
  source: /note="p.R455Q"
DIPSGTSKHLQKKAKKQAKKQAKNQQQRQQKIQGKVLHLNDICTIDHPEDSE

SEQ ID NO: 3492 - protein, 52 aa, Artificial Sequence
  source: /note="Description of Artificial Sequence: Synthetic polypeptide"
  source: /note="p.R873H"
FKAIKLEYARLVKLAQEDTPPETDYHHLHHVVVYFIQNQAPKKIIEKTLLEQ

SEQ ID NO: 3493 - protein, 33 aa, Artificial Sequence
  source: /note="Description of Artificial Sequence: Synthetic polypeptide"
  source: /note="p.R1119Q"
EPPKLPSYSTHELCERFARIMLSLSQQTPADGR

SEQ ID NO: 3494 - protein, 52 aa, Artificial Sequence
  source: /note="Description of Artificial Sequence: Synthetic polypeptide"
  source: /note="p.R861Q"
TLKSGHYICDAYDFEKQIWFTYDDMQQVLGIQEAQMQEDRRCTGYIFFYMHN

SEQ ID NO: 3495 - protein, 52 aa, Artificial Sequence
  source: /note="Description of Artificial Sequence: Synthetic polypeptide"
  source: /note="p.F81L"
NIRSVVLRHCKKRQSHLRLTLKNNVLLLFIDKLSYRDAKQLNMFLDIIHQNK

SEQ ID NO: 3496 - protein, 52 aa, Artificial Sequence
  source: /note="Description of Artificial Sequence: Synthetic polypeptide"
  source: /note="p.D391N"
LTEMYYDGFHRSFCDTDDLETVHESNNCIFAFETPEIFRPEGILSQRGIHLN

SEQ ID NO: 3497 - protein, 52 aa, Artificial Sequence
  source: /note="Description of Artificial Sequence: Synthetic polypeptide"
  source: /note="p.R36Q"
LTLKVLPHFESLGKQEKIPNKMSAFQQNHCPHLDSVGEITKEDLIQKSLGTC

SEQ ID NO: 3498 - protein, 52 aa, Artificial Sequence
  source: /note="Description of Artificial Sequence: Synthetic polypeptide"
  source: /note="p.L259V"
STAPSRNFTTSPKSSASPYSSVSASVVIANGDSTSTCGMHSSGVSRGGSGFS

SEQ ID NO: 3499 - protein, 52 aa, Artificial Sequence
  source: /note="Description of Artificial Sequence: Synthetic polypeptide"
  source: /note="p.S851L"
DSYTLKEAELKMGSSLGLCLGKAPSLLSQLFLFFAMGSDVQPGTEMEIVVEE

SEQ ID NO: 3500 - protein, 52 aa, Artificial Sequence
  source: /note="Description of Artificial Sequence: Synthetic polypeptide"
  source: /note="p.R779P"
SPAAESLEEPDAAAGLSSTKKAPPPPPDPGTPATKEGAWEAMAVAPEEPPPS

SEQ ID NO: 3501 - protein, 52 aa, Artificial Sequence
  source: /note="Description of Artificial Sequence: Synthetic polypeptide"
  source: /note="p.Q137R"
LFDNYMQQDAHEFLNYLLNTIADILRREEKKQEKQNGKLKNGNMNEPAENNK

SEQ ID NO: 3502 - protein, 52 aa, Artificial Sequence
  source: /note="Description of Artificial Sequence: Synthetic polypeptide"
  source: /note="p.V148I"
EEIERIHREVAFNKTAQVLSKWDPVIILKNRQAEQLVFPLEKEEPAIAPIEH

SEQ ID NO: 3503 - protein, 53 aa, Artificial Sequence
  source: /note="Description of Artificial Sequence: Synthetic polypeptide"
  source: /note="p.E81del"
SRAALAKGWNEVQSGDEEDGEEEEEVLALDMDDEDDEDGGNAGEEEEEENADD

SEQ ID NO: 3504 - protein, 52 aa, Artificial Sequence
  source: /note="Description of Artificial Sequence: Synthetic polypeptide"
  source: /note="p.A289E"
VLLFWACFLPFWLWQLLAQYHQAPLEEPRTARIVNYLTTCLTYGNSCANPFL

SEQ ID NO: 3505 - protein, 52 aa, Artificial Sequence
  source: /note="Description of Artificial Sequence: Synthetic polypeptide"
  source: /note="p.V100L"
QKYPPVKFLSEKDRKRILITGGAGFLLGSHLTDKLMMDGHEVTVVDNFFTGR

SEQ ID NO: 3506 - protein, 53 aa, Artificial Sequence
  source: /note="Description of Artificial Sequence: Synthetic polypeptide"
  source: /note="p.P51S"
EAGEGPGWGGAHPRICLQPPPTSRTSSFPPPRLPALEQGPGGLWVWGATAVAQ

SEQ ID NO: 3507 - protein, 149 aa, Artificial Sequence
  source: /note="Description of Artificial Sequence: Synthetic polypeptide"
  source: /note="p.G3fs"
MPGGRRWLGVAAAVPLQRPLRPPPPLGSGVWRPAKEPQPREMRSQKRKGKRTCETEASPSLSTGVGYLWMRPPGKGCGNTWPRSTPMERRWRNGSVGPQTCPRSPYRVCLRSSRLHLSLSAWKLCSATSESCSTITQGHSSLKLRRADL

SEQ ID NO: 3508 - protein, 52 aa, Artificial Sequence
  source: /note="Description of Artificial Sequence: Synthetic polypeptide"
  source: /note="p.E685K"
CVPKPVDYSCQPWYAGAMERLQAETKKLINRVNSTYLVRHRTKESGEYAISI

SEQ ID NO: 3509 - protein, 52 aa, Artificial Sequence
  source: /note="Description of Artificial Sequence: Synthetic polypeptide"
  source: /note="p.R1125H"
HSVSYPPGAVTEHKVKTDEVVTLTPHHIGPKVSLSPGPEQKYETEGSSTTGF

SEQ ID NO: 3510 - protein, 52 aa, Artificial Sequence
  source: /note="Description of Artificial Sequence: Synthetic polypeptide"
  source: /note="p.S1308C"
SSPPATQPTRPPTVEDKEAFGPQALCCTPQPPASTKFHPDINVYIIEVRENK

SEQ ID NO: 3511 - protein, 54 aa, Artificial Sequence
  source: /note="Description of Artificial Sequence: Synthetic polypeptide"
  source: /note="p.355_356insN"
ETSNQKQQQQQQQQQQQQQQQQQQHNNVTSWPGKQVETLRLWEEAVKARKKEAA

SEQ ID NO: 3512 - protein, 52 aa, Artificial Sequence
  source: /note="Description of Artificial Sequence: Synthetic polypeptide"
  source: /note="p.G39S"
GAEEAGVEEYGPEEDGGEESGAEESSSPEESGPEELGAEEEMEAGRPRPVLR

SEQ ID NO: 3513 - protein, 52 aa, Artificial Sequence
  source: /note="Description of Artificial Sequence: Synthetic polypeptide"
  source: /note="p.P45L"
VEEYGPEEDGGEESGAEESGPEESGLLEELGAEEEMEAGRPRPVLRSVNSRE

SEQ ID NO: 3514 - protein, 52 aa, Artificial Sequence
  source: /note="Description of Artificial Sequence: Synthetic polypeptide"
  source: /note="p.S65L"
PEESGPEELGAEEEMEAGRPRPVLRLLVNSREPSQVIFCNRSPRVVLPVWLN

SEQ ID NO: 3515 - protein, 52 aa, Artificial Sequence
  source: /note="Description of Artificial Sequence: Synthetic polypeptide"
  source: /note="p.V74D"
GAEEEMEAGRPRPVLRSVNSREPSQDDIFCNRSPRVVLPVWLNFDGEPQPYP

SEQ ID NO: 3516 - protein, 52 aa, Artificial Sequence
  source: /note="Description of Artificial Sequence: Synthetic polypeptide"
  source: /note="p.N78D"
EMEAGRPRPVLRSVNSREPSQVIFCDDRSPRVVLPVWLNFDGEPQPYPTLPP

SEQ ID NO: 3517 - protein, 52 aa, Artificial Sequence
  source: /note="Description of Artificial Sequence: Synthetic polypeptide"
  source: /note="p.R79P"
MEAGRPRPVLRSVNSREPSQVIFCNPPSPRVVLPVWLNFDGEPQPYPTLPPG

SEQ ID NO: 3518 - protein, 52 aa, Artificial Sequence
  source: /note="Description of Artificial Sequence: Synthetic polypeptide"
  source: /note="p.R82P"
GRPRPVLRSVNSREPSQVIFCNRSPPPVVLPVWLNFDGEPQPYPTLPPGTGR

SEQ ID NO: 3519 - protein, 52 aa, Artificial Sequence
  source: /note="Description of Artificial Sequence: Synthetic polypeptide"
  source: /note="p.W88L"
LRSVNSREPSQVIFCNRSPRVVLPVLLLNFDGEPQPYPTLPPGTGRRIHSYR

SEQ ID NO: 3520 - protein, 52 aa, Artificial Sequence
  source: /note="Description of Artificial Sequence: Synthetic polypeptide"
  source: /note="p.L89H"
RSVNSREPSQVIFCNRSPRVVLPVWHHNFDGEPQPYPTLPPGTGRRIHSYRG

SEQ ID NO: 3521 - protein, 52 aa, Artificial Sequence
  source: /note="Description of Artificial Sequence: Synthetic polypeptide"
  source: /note="p.L89P"
RSVNSREPSQVIFCNRSPRVVLPVWPPNFDGEPQPYPTLPPGTGRRIHSYRG

SEQ ID NO: 3522 - protein, 52 aa, Artificial Sequence
  source: /note="Description of Artificial Sequence: Synthetic polypeptide"
  source: /note="p.R107P"
RVVLPVWLNFDGEPQPYPTLPPGTGPPRIHSYRGHLWLFRDAGTHDGLLVNQ

SEQ ID NO: 3523 - protein, 52 aa, Artificial Sequence
  source: /note="Description of Artificial Sequence: Synthetic polypeptide"
  source: /note="p.S111N"
PVWLNFDGEPQPYPTLPPGTGRRIHNNYRGHLWLFRDAGTHDGLLVNQTELF

SEQ ID NO: 3524 - protein, 52 aa, Artificial Sequence
  source: /note="Description of Artificial Sequence: Synthetic polypeptide"
  source: /note="p.S111R"
PVWLNFDGEPQPYPTLPPGTGRRIHRRYRGHLWLFRDAGTHDGLLVNQTELF

SEQ ID NO: 3525 - protein, 52 aa, Artificial Sequence
  source: /note="Description of Artificial Sequence: Synthetic polypeptide"
  source: /note="p.H115N"
NFDGEPQPYPTLPPGTGRRIHSYRGNNLWLFRDAGTHDGLLVNQTELFVPSL

SEQ ID NO: 3526 - protein, 66 aa, Artificial Sequence
  source: /note="Description of Artificial Sequence: Synthetic polypeptide"
  source: /note="p.L116fs"
DGEPQPYPTLPPGTGRRIHSYRGHLGSSEMQGHTMGFWLTKLNYLCHLSMLTDSLFLPISHCQCIL

SEQ ID NO: 3527 - protein, 52 aa, Artificial Sequence
  source: /note="Description of Artificial Sequence: Synthetic polypeptide"
  source: /note="p.D121Y"
QPYPTLPPGTGRRIHSYRGHLWLFRYYAGTHDGLLVNQTELFVPSLNVDGQP

SEQ ID NO: 3528 - protein, 59 aa, Artificial Sequence
  source: /note="Description of Artificial Sequence: Synthetic polypeptide"
  source: /note="p.G123fs"
PTLPPGTGRRIHSYRGHLWLFRDAGHTMGFWLTKLNYLCHLSMLTDSLFLPISHCQCIL

SEQ ID NO: 3529 - protein, 52 aa, Artificial Sequence
  source: /note="Description of Artificial Sequence: Synthetic polypeptide"
  source: /note="p.L128H"
PGTGRRIHSYRGHLWLFRDAGTHDGHHLVNQTELFVPSLNVDGQPIFANITL

SEQ ID NO: 3530 - protein, 52 aa, Artificial Sequence
  source: /note="Description of Artificial Sequence: Synthetic polypeptide"
  source: /note="p.L135F"
HSYRGHLWLFRDAGTHDGLLVNQTEFFFVPSLNVDGQPIFANITLPVYTLKE

SEQ ID NO: 3531 - protein, 52 aa, Artificial Sequence
  source: /note="Description of Artificial Sequence: Synthetic polypeptide"
  source: /note="p.I151T"
DGLLVNQTELFVPSLNVDGQPIFANTTTLPVYTLKERCLQVVRSLVKPENYR

SEQ ID NO: 3532 - protein, 52 aa, Artificial Sequence
  source: /note="Description of Artificial Sequence: Synthetic polypeptide"
  source: /note="p.L153P"
LLVNQTELFVPSLNVDGQPIFANITPPPVYTLKERCLQVVRSLVKPENYRRL

SEQ ID NO: 3533 - protein, 52 aa, Artificial Sequence
  source: /note="Description of Artificial Sequence: Synthetic polypeptide"
  source: /note="p.L158V"
TELFVPSLNVDGQPIFANITLPVYTVVKERCLQVVRSLVKPENYRRLDIVRS

SEQ ID NO: 3534 - protein, 52 aa, Artificial Sequence
  source: /note="Description of Artificial Sequence: Synthetic polypeptide"
  source: /note="p.L158P"
TELFVPSLNVDGQPIFANITLPVYTPPKERCLQVVRSLVKPENYRRLDIVRS

SEQ ID NO: 3535 - protein, 29 aa, Artificial Sequence
  source: /note="Description of Artificial Sequence: Synthetic peptide"
  source: /note="p.Q164fs"
LNVDGQPIFANITLPVYTLKERCLQLSGA

SEQ ID NO: 3536 - protein, 52 aa, Artificial Sequence
  source: /note="Description of Artificial Sequence: Synthetic polypeptide"
  source: /note="p.L169P"
GQPIFANITLPVYTLKERCLQVVRSPPVKPENYRRLDIVRSLYEDLEDHPNV

SEQ ID NO: 3537 - protein, 52 aa, Artificial Sequence
  source: /note="Description of Artificial Sequence: Synthetic polypeptide"
  source: /note="p.L184P"
KERCLQVVRSLVKPENYRRLDIVRSPPYEDLEDHPNVQKDLERLTQERIAHQ

SEQ ID NO: 3538 - protein, 52 aa, Artificial Sequence
  source: /note="Description of Artificial Sequence: Synthetic polypeptide"
  source: /note="p.L188P"
LQVVRSLVKPENYRRLDIVRSLYEDPPEDHPNVQKDLERLTQERIAHQRMGD

SEQ ID NO: 3539 - protein, 52 aa, Artificial Sequence
  source: /note="Description of Artificial Sequence: Synthetic polypeptide"
  source: /note="p.R231H"
IPISWVCDDDADCSDQSDESLEQCGHHQPVIHTKCPASEIQCGSGECIHKKW

SEQ ID NO: 3540 - protein, 52 aa, Artificial Sequence
  source: /note="Description of Artificial Sequence: Synthetic polypeptide"
  source: /note="p.E369Q"
AQRQKLHHKSEMGTPQGENWLSWMFQQKLVVVMVCYFILSIINSMAQSYAKR

SEQ ID NO: 3541 - protein, 52 aa, Artificial Sequence
  source: /note="Description of Artificial Sequence: Synthetic polypeptide"
  source: /note="p.R802Q"
ARLQKADVVAQSRISFPEKELLLLIQQNHLISKGLGETATVLTKEADLPMTA

SEQ ID NO: 3542 - protein, 40 aa, Artificial Sequence
  source: /note="Description of Artificial Sequence: Synthetic polypeptide"
  source: /note="p.K939fs"
CNGRKIRVLRQKSDHGAYSQSPAIKNSWTDIFLPHLRWTV

SEQ ID NO: 3543 - protein, 44 aa, Artificial Sequence
  source: /note="Description of Artificial Sequence: Synthetic polypeptide"
  source: /note="p.F2883fs"
ILGLDVLGNPFGLIREFSEGVEAFFMNLTREPSRVLKSLWKEWH

SEQ ID NO: 3544 - protein, 52 aa, Artificial Sequence
  source: /note="Description of Artificial Sequence: Synthetic polypeptide"
  source: /note="p.R692Q"
IMGEKNSSNFMNTTNFQSLRPLPSIQQILVDKINLEHSVPMYAEQLVHVVSS

SEQ ID NO: 3545 - protein, 52 aa, Artificial Sequence
  source: /note="Description of Artificial Sequence: Synthetic polypeptide"
  source: /note="p.G2575W"
AQADCKLLECRNVTMQSVVKPFSIFWWQMAVSSDVVEKLLDCTVIVDSVFVN

SEQ ID NO: 3546 - protein, 52 aa, Artificial Sequence
  source: /note="Description of Artificial Sequence: Synthetic polypeptide"
  source: /note="p.D1359Y"
SWYHKVPVVEIKGHLDSMNVSLNQEYYLNLLFRILTENLCEGTEDLDKVKPR

SEQ ID NO: 3547 - protein, 52 aa, Artificial Sequence
  source: /note="Description of Artificial Sequence: Synthetic polypeptide"
  source: /note="p.G317D"
RTTCPGPCDSQPCQNGGTCVPEGLDDDYQCLCPLAFGGEANCALKLSLECRV

SEQ ID NO: 3548 - protein, 52 aa, Artificial Sequence
  source: /note="Description of Artificial Sequence: Synthetic polypeptide"
  source: /note="p.V955I"
LEKVLRRYVQRLQWLLSGSRRLFGTIILESKVCILLDTSGSMGPYLQQVKTE

SEQ ID NO: 3549 - protein, 52 aa, Artificial Sequence
  source: /note="Description of Artificial Sequence: Synthetic polypeptide"
  source: /note="p.R557L"
QFIQEQLKYKSKFNFVKFDGQAVAWLLEQLAEVNEDNLEQAQSWIRDIKIGS

SEQ ID NO: 3550 - protein, 52 aa, Artificial Sequence
  source: /note="Description of Artificial Sequence: Synthetic polypeptide"
  source: /note="p.V792G"
FSLTSNLSRAHLELNESAWGRLWLEGGPDSAAPDSVVMVTVTAGGREANPVP

SEQ ID NO: 3551 - protein, 52 aa, Artificial Sequence
  source: /note="Description of Artificial Sequence: Synthetic polypeptide"
  source: /note="p.K1720N"
LLDGSSSFPASYFDEMKSFAKAFISNNANIGPRLTQVSVLQYGSITTIDVPW

SEQ ID NO: 3552 - protein, 64 aa, Artificial Sequence
  source: /note="Description of Artificial Sequence: Synthetic polypeptide"
  source: /note="p.R522fs"
GFDDLSESEDDEDDDCQVERKTSKKELKQLHHPPCSLPQKAMIIPRTVSLVLTMQRTCLVCLKV

SEQ ID NO: 3553 - protein, 53 aa, Artificial Sequence
  source: /note="Description of Artificial Sequence: Synthetic polypeptide"
  source: /note="p.P305fs"
EHEYRPPSASARHMALNRPQQPPPPASPSGPRGVPGLCTDGSSRLRDAPSADN

SEQ ID NO: 3554 - protein, 52 aa, Artificial Sequence
  source: /note="Description of Artificial Sequence: Synthetic polypeptide"
  source: /note="p.G175S"
APREVVDPSGGRATLLESIRQAGGISSKAKLRSMKERKLEKKQQKEQEQVRA

SEQ ID NO: 3555 - protein, 52 aa, Artificial Sequence
  source: /note="Description of Artificial Sequence: Synthetic polypeptide"
  source: /note="p.L187V"
ATLLESIRQAGGIGKAKLRSMKERKVVEKKQQKEQEQVRATSQGGHLMSDLF

SEQ ID NO: 3556 - protein, 38 aa, Artificial Sequence
  source: /note="Description of Artificial Sequence: Synthetic polypeptide"
  source: /note="p.P138fs"
LRFLSTFKPPAYEDVVHRPGTPPPPLYCGPRPPLDCFQ

SEQ ID NO: 3557 - protein, 52 aa, Artificial Sequence
  source: /note="Description of Artificial Sequence: Synthetic polypeptide"
  source: /note="p.R228C"
LEEYVHKRYPGLVKVVRNQKREGLICCARIEGWKVATGQVTGFFDAHVEFTA

SEQ ID NO: 3558 - protein, 34 aa, Artificial Sequence
  source: /note="Description of Artificial Sequence: Synthetic polypeptide"
  source: /note="p.L1842fs"
FIFGVPASSGTVVSSIHNVCTEAVFYYWECSAAC

SEQ ID NO: 3559 - protein, 52 aa, Artificial Sequence
  source: /note="Description of Artificial Sequence: Synthetic polypeptide"
  source: /note="p.P278S"
SESLSCITTFNLPSAAASVQCLAWVSSSAPGMFITGDSQVGVLRIWNVSRTT

SEQ ID NO: 3560 - protein, 52 aa, Artificial Sequence
  source: /note="Description of Artificial Sequence: Synthetic polypeptide"
  source: /note="p.E841K"
KSSELEESLLVLPFSYVPDILKLFNKKFIQLGSDVELICRCLFFLLRIHFGQ

SEQ ID NO: 3561 - protein, 52 aa, Artificial Sequence
  source: /note="Description of Artificial Sequence: Synthetic polypeptide"
  source: /note="p.W60G"
PGPLQDETLGVASVPSQWRAVQGIRGGETKSCQTASIATASASAQARNHVDA

SEQ ID NO: 3562 - protein, 28 aa, Artificial Sequence
  source: /note="Description of Artificial Sequence: Synthetic peptide"
  source: /note="p.N214fs"
DGLCRIWDTASGQCLKTLIDDDNPPCLL

SEQ ID NO: 3563 - protein, 52 aa, Artificial Sequence
  source: /note="Description of Artificial Sequence: Synthetic polypeptide"
  source: /note="p.R837S"
EHLSSPWGESSPEELRFGSLTYSDPSSERERDQHDKNKRLLDPANTQQFDDF

SEQ ID NO: 3564 - protein, 52 aa, Artificial Sequence
  source: /note="Description of Artificial Sequence: Synthetic polypeptide"
  source: /note="p.N160fs"
IKDTRKPTVALSAVAGASQVKWNKKMLTALPPAMTAMCGYGIRGNPVQQWNI

SEQ ID NO: 3565 - protein, 46 aa, Artificial Sequence
  source: /note="Description of Artificial Sequence: Synthetic polypeptide"
  source: /note="p.Q412fs"
DGDDDESSNEPESREKLEELPLAQKRKYKKFKELLMQKMKGLASYL

SEQ ID NO: 3566 - protein, 68 aa, Artificial Sequence
  source: /note="Description of Artificial Sequence: Synthetic polypeptide"
  source: /note="p.G262fs"
RVFDAGDYSLLCSGPSENGQTWTGGTLSHQIKSSFGQKMGKVIFTNYLPVAFQLVIHSAVMWGRQLKI

SEQ ID NO: 3567 - protein, 68 aa, Artificial Sequence
  source: /note="Description of Artificial Sequence: Synthetic polypeptide"
  source: /note="p.DGTRSQ315del"
CLAISGFDGTVQVYDATSWDGTRSQVEPLFTHRGHIFLDGNGMDPAPLVTTHTWHPCRPRTLLSATND

SEQ ID NO: 3568 - protein, 52 aa, Artificial Sequence
  source: /note="Description of Artificial Sequence: Synthetic polypeptide"
  source: /note="p.P287Q"
SLLSGGRESVLVEWRDATEKNKEFLQQRLGATIEHISVSPAGDLFCTSHSDN

SEQ ID NO: 3569 - protein, 52 aa, Artificial Sequence
  source: /note="Description of Artificial Sequence: Synthetic polypeptide"
  source: /note="p.N110K"
NQSRMAVSKTVLIPPELKTVEKPNPKKIKTTQVFDINGTDVTPRPLYHPDPL

SEQ ID NO: 3570 - protein, 52 aa, Artificial Sequence
  source: /note="Description of Artificial Sequence: Synthetic polypeptide"
  source: /note="p.G100W"
KHQVPEKLIWGDQDPLSKIPFKILSWWHEHAVSTCHFCVDDTKLLSGSYDCT

SEQ ID NO: 3571 - protein, 31 aa, Artificial Sequence
  source: /note="Description of Artificial Sequence: Synthetic polypeptide"
  source: /note="p.M287fs"
RLRVLVATYVTFSPNGTELLVNMGGGTGLFV

SEQ ID NO: 3572 - protein, 52 aa, Artificial Sequence
  source: /note="Description of Artificial Sequence: Synthetic polypeptide"
  source: /note="p.K418fs"
YIDKQPEEALSQAKKSVASKTEVKKNPTTKICAEYSARTDQCRGGGLLTLKY

SEQ ID NO: 3573 - protein, 77 aa, Artificial Sequence
  source: /note="Description of Artificial Sequence: Synthetic polypeptide"
  source: /note="p.G606fs"
CETDGYLSSSGFLDASDPALQPPGGCHPAWLSPISACPRLLPYPFHVLALEVTFPPGTAMPQMQLQALAMWEKGWDK

SEQ ID NO: 3574 - protein, 54 aa, Artificial Sequence
  source: /note="Description of Artificial Sequence: Synthetic polypeptide"
  source: /note="p.W167fs"
SEGSIESCTCDYRRRGPGGPDWHWGAAATTLTSAASSAGSSWTPGRRGGTCASS

SEQ ID NO: 3575 - protein, 37 aa, Artificial Sequence
  source: /note="Description of Artificial Sequence: Synthetic polypeptide"
  source: /note="p.C344Y"
NPYTDRVVERCHCKYHWCCYVTCRRYYERTVERYVCK

SEQ ID NO: 3576 - protein, 41 aa, Artificial Sequence
  source: /note="Description of Artificial Sequence: Synthetic polypeptide"
  source: /note="p.W165fs"
GNMTECSCDTTLQNGGSASEGWHWGAAPMMSSMACGSAESS

SEQ ID NO: 3577 - protein, 52 aa, Artificial Sequence
  source: /note="Description of Artificial Sequence: Synthetic polypeptide"
  source: /note="p.K327E"
RLCNKTSEGMDGCELMCCGRGYNQFEESVQVERCHCKFHWCCFVRCKKCTEI

SEQ ID NO: 3578 - protein, 93 aa, Artificial Sequence
  source: /note="Description of Artificial Sequence: Synthetic polypeptide"
  source: /note="p.S381fs"
HTHGVFRGIQDVRRVPGVAPTLVRSGRHLRPVRNAPSCVLTQAAIRDILSCPTYRCTAGSTLVRNHTSVTSRTVNEGFLVQTSSKDTKGDIQV

SEQ ID NO: 3579 - protein, 52 aa, Artificial Sequence
  source: /note="Description of Artificial Sequence: Synthetic polypeptide"
  source: /note="p.G458A"
EDPRTQGMIQEPALPPGWEMKYTSEAAVRYFVDHNTRTTTFKDPRPGFESGT

SEQ ID NO: 3580 - protein, 52 aa, Artificial Sequence
  source: /note="Description of Artificial Sequence: Synthetic polypeptide"
  source: /note="p.E782K"
SDLAPGQSGMDDMKLLEQRAEQLAAKKAERDQPLRAQSKILFVRSDASREEL

SEQ ID NO: 3581 - protein, 52 aa, Artificial Sequence
  source: /note="Description of Artificial Sequence: Synthetic polypeptide"
  source: /note="p.P410S"
MDHTFFPGYRKTLLSPEEILLSIEISSYSREGEYFSAFKQASRREDDIAKVT

SEQ ID NO: 3582 - protein, 52 aa, Artificial Sequence
  source: /note="Description of Artificial Sequence: Synthetic polypeptide"
  source: /note="p.D2439N"
GKTGVLPPPTLPKPKLPKHIKDNKNNNFSPKVELATSLSDMECKITTSKDQK

SEQ ID NO: 3583 - protein, 52 aa, Artificial Sequence
  source: /note="Description of Artificial Sequence: Synthetic polypeptide"
  source: /note="p.V3008E"
IPGWLISEDKREYAVHIAMENNLEKEEKEEITHIKTQAEDMLVSYENIIQTA

SEQ ID NO: 3584 - protein, 52 aa, Artificial Sequence
  source: /note="Description of Artificial Sequence: Synthetic polypeptide"
  source: /note="p.R268Q"
SVIHLLQMGQVWRYIRTMYLGIQSQQQRKEHQRRFYWAMMYEYADVNMLRLL

SEQ ID NO: 3585 - protein, 52 aa, Artificial Sequence
  source: /note="Description of Artificial Sequence: Synthetic polypeptide"
  source: /note="p.E571K"
QYPRFLRAHWKFLKTVVNKLFEFMHKKTHDGVQDMACDTFIKIAQKCRRHFV

SEQ ID NO: 3586 - protein, 52 aa, Artificial Sequence
  source: /note="Description of Artificial Sequence: Synthetic polypeptide"
  source: /note="p.R541W"
EPQHIPCVLMAFLDHRGLRHSSAKVWWSRTAYLFSRFVKSLNKQMNPFIEDI

SEQ ID NO: 3587 - protein, 52 aa, Artificial Sequence
  source: /note="Description of Artificial Sequence: Synthetic polypeptide"
  source: /note="p.S87F"
TSPVLMWVQALDIILEKMKASGFDFFFQVLALSGAGQQHGSIYWKAGAQQAL

SEQ ID NO: 3588 - protein, 102 aa, Artificial Sequence
  source: /note="Description of Artificial Sequence: Synthetic polypeptide"
  source: /note="p.Y526fs"
RKFESTVNQEVLEILDFHLYGSYPPARQPSRPTGRTPTTRLMAPVGSVMSCSLLTQPSPASACTMPPLLHPQWAPHSAGLSPGACRPACTCISMTTISRATW

SEQ ID NO: 3589 - protein, 52 aa, Artificial Sequence
  source: /note="Description of Artificial Sequence: Synthetic polypeptide"
  source: /note="p.P250L"
GAGEQGRPVRQNMYRGYRPRFRRGPLLRQRQPREDGNEEDKENQGDETQGQQ

SEQ ID NO: 3590 - protein, 46 aa, Artificial Sequence
  source: /note="Description of Artificial Sequence: Synthetic polypeptide"
  source: /note="p.P226fs"
SAGTGPGSKGERAEDSGQRPRRWCPHPSSTDGGLCEAPGLPTSSSL

SEQ ID NO: 3591 - protein, 74 aa, Artificial Sequence
  source: /note="Description of Artificial Sequence: Synthetic polypeptide"
  source: /note="p.R131fs"
LGLLVFPYTHQNWEVQYSRDAPLPPGKTSTPLTSISPRWPSLLTCSWLGWHWAFRKGSPRRCWACVQAQRWCGW

SEQ ID NO: 3592 - protein, 51 aa, Artificial Sequence
  source: /note="Description of Artificial Sequence: Synthetic polypeptide"
  source: /note="p.E1178fs"
RGLGRSDFGRDRGPFRPEPGDGGEKCIHITGMSLLGLHGTMEKSEGMKSFH

SEQ ID NO: 3593 - protein, 52 aa, Artificial Sequence
  source: /note="Description of Artificial Sequence: Synthetic polypeptide"
  source: /note="p.E634K"
IMHLLYNICHSCDAGAVLIFLPGYDKKIVGLRDRILFDDKRFADSTHRYQVF

SEQ ID NO: 3594 - protein, 52 aa, Artificial Sequence
  source: /note="Description of Artificial Sequence: Synthetic polypeptide"
  source: /note="p.E185K"
NREMSKTSGRLNNGIPQIPVKRGESKKFDSFRQSLPVFEKQEEIVKIIKENK

SEQ ID NO: 3595 - protein, 52 aa, Artificial Sequence
  source: /note="Description of Artificial Sequence: Synthetic polypeptide"
  source: /note="p.Q42H"
CPPCSYRYPYPAATKGKGAAGGSWQHHRGRGCLPASSPCSAGAASLSFPGCG

SEQ ID NO: 3596 - protein, 52 aa, Artificial Sequence
  source: /note="Description of Artificial Sequence: Synthetic polypeptide"
  source: /note="p.R596I"
TKSSLLLQEIACRSKPITKQYQGLEIIFFIFDTNERLNLLPSHRLECNNSST

SEQ ID NO: 3597 - protein, 53 aa, Artificial Sequence
  source: /note="Description of Artificial Sequence: Synthetic polypeptide"
  source: /note="p.E151del"
KPKINGKVCGQCENKAALLVCLECGDYCSGCFAKVHQKGALKLHRTTLLQAKS

SEQ ID NO: 3598 - protein, 52 aa, Artificial Sequence
  source: /note="Description of Artificial Sequence: Synthetic polypeptide"
  source: /note="p.S385L"
PSLLPPEGELSSVSSSPVKPVRESPLLASSSPDRLTEDLQSHLNPGDGLMED

SEQ ID NO: 3599 - protein, 67 aa, Artificial Sequence
  source: /note="Description of Artificial Sequence: Synthetic polypeptide"
  source: /note="p.P692fs"
CKKKFSHKTLLERHVALHSASNGTPLQAHPQVPALAPQAWWPARRGPLTSAPSAQQSLTKSSSSTTT

SEQ ID NO: 3600 - protein, 52 aa, Artificial Sequence
  source: /note="Description of Artificial Sequence: Synthetic polypeptide"
  source: /note="p.L607I"
QNMTADQAANLTLLTQQPEQLQNLIIISAQQEQTEHIQSLNMIESQMGPSQT

SEQ ID NO: 3601 - protein, 32 aa, Artificial Sequence
  source: /note="Description of Artificial Sequence: Synthetic polypeptide"
  source: /note="p.L262fs"
QLNFLLENEGVFSDALMVTQDVLKKTRNVFRN

SEQ ID NO: 3602 - protein, 165 aa, Artificial Sequence
  source: /note="Description of Artificial Sequence: Synthetic polypeptide"
  source: /note="p.G342fs"
ELPPPPPPPFPNDFFKDMFPDLPGGASGTHQGGERLRCLSQLPECHPPGRPLPTLAPGRRAQAEAQGLSAVPHLPQSHHGGREAAAAHEDPYRGEAIHVHHLRGPLHQAGQAENPHAEAHRGAALPVHPLQRQVRAQLRPQEPHAHPHGRAALPVRVLLQELHAL

SEQ ID NO: 3603 - protein, 114 aa, Artificial Sequence
  source: /note="Description of Artificial Sequence: Synthetic polypeptide"
  source: /note="p.D154fs"
ILNAARMLEIQCIVNVCLEIMEPGGTGGRRMTRRTMTTTKMMMMRRTKRRRRKRRRMTMMTRRTLLTKKTCLTPRTSAATKALPRQTISQRRPIQTPPGTSLTPSRLAVLAIWG

SEQ ID NO: 3604 - protein, 111 aa, Artificial Sequence
  source: /note="Description of Artificial Sequence: Synthetic polypeptide"
  source: /note="p.E157fs"
AARMLEIQCIVNVCLEIMEPGGDGGRRMTRRTMTTTKMMMMRRTKRRRRKRRRMTMMTRRTLLTKKTCLTPRTSAATKALPRQTISQRRPIQTPPGTSLTPSRLAVLAIWG

SEQ ID NO: 3605 - protein, 52 aa, Artificial Sequence
  source: /note="Description of Artificial Sequence: Synthetic polypeptide"
  source: /note="p.P405S"
SAGGRVPGPLSLPSPESQFSPGDLPSSPPGLQLQPRGEHRPRDLHGDLLSPR

SEQ ID NO: 3606 - protein, 55 aa, Artificial Sequence
  source: /note="Description of Artificial Sequence: Synthetic polypeptide"
  source: /note="p.K1006fs"
NIETTSEDGQVFSPKKGQKKKSIEKNVKNPKVILIFLMKKQPSKVRRKEAHGLPL

SEQ ID NO: 3607 - protein, 38 aa, Artificial Sequence
  source: /note="Description of Artificial Sequence: Synthetic polypeptide"
  source: /note="p.T701fs"
PVPEPTKPGDPREARRKERPARTPPQEADAKRQRQWQW

SEQ ID NO: 3608 - protein, 39 aa, Artificial Sequence
  source: /note="Description of Artificial Sequence: Synthetic polypeptide"
  source: /note="p.P825fs"
PKSAKPPAGGKSSQQPSTPQQAPPGSPSRAHLWPTRRSS

SEQ ID NO: 3609 - protein, 52 aa, Artificial Sequence
  source: /note="Description of Artificial Sequence: Synthetic polypeptide"
  source: /note="p.E798K"
IQQKQQEEEERARRLAESSKQDRENKKEGDTGNWYSSDEDEGGSSVTSILKT

SEQ ID NO: 3610 - protein, 52 aa, Artificial Sequence
  source: /note="Description of Artificial Sequence: Synthetic polypeptide"
  source: /note="p.C575S"
NGKINLTVFKLLQEHLGEFIFLCEKSSFDHKPRMISKRNKDNSTACSHPVTK

SEQ ID NO: 3611 - protein, 52 aa, Artificial Sequence
  source: /note="Description of Artificial Sequence: Synthetic polypeptide"
  source: /note="p.K937N"
GKHVERALLVELNKISLKEENVCEENNNSPVDQSDFFYEFSKLIFTKGKSPT

SEQ ID NO: 3612 - protein, 52 aa, Artificial Sequence
  source: /note="Description of Artificial Sequence: Synthetic polypeptide"
  source: /note="p.L76F"
KGVAFILFLDKDSAQNCTRAINNKQFFFGRVIKASIAIDNGRAAEFIRRRNY

SEQ ID NO: 3613 - protein, 52 aa, Artificial Sequence
  source: /note="Description of Artificial Sequence: Synthetic polypeptide"
  source: /note="p.D144N"
DRFKGKYVTYDPDGNVEEYHIEFLGNNPHSRSWIKATFVGHYSITLKPEKCK

SEQ ID NO: 3614 - protein, 52 aa, Artificial Sequence
  source: /note="Description of Artificial Sequence: Synthetic polypeptide"
  source: /note="p.H250Q"
PVQVQTLIVVIIGMLVLLLDFLGLVQQLGQLLIFHIYLKAKKMTTFEYLINN

SEQ ID NO: 3615 - protein, 52 aa, Artificial Sequence
  source: /note="Description of Artificial Sequence: Synthetic polypeptide"
  source: /note="p.R300H"
LFVLYLAATNQTTNEWYRGDWAWCQHHCPLVAWPPSAEPQVHRNIHSHGLRS

SEQ ID NO: 3616 - protein, 53 aa, Artificial Sequence
  source: /note="Description of Artificial Sequence: Synthetic polypeptide"
  source: /note="p.E651del"
PTAPYLGRSMSYSSQKAQPGVSETEVALQPLLTPKDEVQLKTTYSKSNGQPKS

SEQ ID NO: 3617 - protein, 29 aa, Artificial Sequence
  source: /note="Description of Artificial Sequence: Synthetic peptide"
  source: /note="p.P316fs"
LKSEKPTWERRLRWEGMKSVFGGPPHSSG

SEQ ID NO: 3618 - protein, 52 aa, Artificial Sequence
  source: /note="Description of Artificial Sequence: Synthetic polypeptide"
  source: /note="p.E1094K"
SYSQHMNHRYSYCKREAEEREAAERKKAREKGHLEPTELLMNRAYLQSITPQ

SEQ ID NO: 3619 - protein, 52 aa, Artificial Sequence
  source: /note="Description of Artificial Sequence: Synthetic polypeptide"
  source: /note="p.R156H"
NNGTVKNANCTSDFEEYFAKRKLEEHHDGHAVSIEEYLQRSDTAIIYPEAPE

SEQ ID NO: 3620 - protein, 52 aa, Artificial Sequence
  source: /note="Description of Artificial Sequence: Synthetic polypeptide"
  source: /note="p.I149T"
IKHRHPLDHDCSGEGHPTSRAGLAATTSRAQAVASTSTVPSPSQTMPSCTSP

SEQ ID NO: 3621 - protein, 33 aa, Artificial Sequence
  source: /note="Description of Artificial Sequence: Synthetic polypeptide"
  source: /note="p.K385fs"
KKLGEDEEELSELQLRLLALQSASKNGNKKNSR

SEQ ID NO: 3622 - protein, 85 aa, Artificial Sequence
  source: /note="Description of Artificial Sequence: Synthetic polypeptide"
  source: /note="p.E763fs"
KGNLSIHMQSDKHLNNMQNLQNGGGSRSSATLPGRRRRRWLRRRRQPISVAPAGPPRRPNQKPNPPGGARCVIMRPTWPGTSAFT

SEQ ID NO: 3623 - protein, 53 aa, Artificial Sequence
  source: /note="Description of Artificial Sequence: Synthetic polypeptide"
  source: /note="p.V777del"
NNMQNLQNGGGEQVFSHTAGAAAAAAAAAAAANISSSCGAPSPTKPKTKPTWR

SEQ ID NO: 3624 - protein, 59 aa, Artificial Sequence
  source: /note="Description of Artificial Sequence: Synthetic polypeptide"
  source: /note="p.R1893fs"
LQPSQHPEKKNKLVIKEKEKESQREGQRRGGRGQHRSEGNTARCLEGQREERVGTRGWF

SEQ ID NO: 3625 - protein, 27 aa, Artificial Sequence
  source: /note="Description of Artificial Sequence: Synthetic peptide"
  source: /note="p.L408fs"
ASTSSSAEQPLGITQMPKAEVNLGGAV

SEQ ID NO: 3626 - protein, 52 aa, Artificial Sequence
  source: /note="Description of Artificial Sequence: Synthetic polypeptide"
  source: /note="p.L811F"
MTSEKHMHNMMLLQQNMKQIQHNLHFFGLAPAEAELYQYYLAQNIGLTGMKL

SEQ ID NO: 3627 - protein, 52 aa, Artificial Sequence
  source: /note="Description of Artificial Sequence: Synthetic polypeptide"
  source: /note="p.T1663N"
IAANVNSPGQGMLDSMSLAAVNSKDNNHLDAKELNKKQTPDLISAQPAHHPP

SEQ ID NO: 3628 - protein, 52 aa, Artificial Sequence
  source: /note="Description of Artificial Sequence: Synthetic polypeptide"
  source: /note="p.H2511Q"
LPPQLLQYQCDQCTVAFPTLELWQEQQQHMHFLAAQNQFLHSPFLERPMDMP

SEQ ID NO: 3629 - protein, 52 aa, Artificial Sequence
  source: /note="Description of Artificial Sequence: Synthetic polypeptide"
  source: /note="p.R386C"
SIHTGEKPYECKECGKTFRLRQQLVCCHQRIHTREKPYECMECWKTFSSYSQ

SEQ ID NO: 3630 - protein, 43 aa, Artificial Sequence
  source: /note="Description of Artificial Sequence: Synthetic polypeptide"
  source: /note="p.Q17L"
MAHGSVTFRDVAIDFSLLEEWEFLDPAQRDLYRDVMWENYSNF

SEQ ID NO: 3631 - protein, 52 aa, Artificial Sequence
  source: /note="Description of Artificial Sequence: Synthetic polypeptide"
  source: /note="p.R150I"
TGEKPYKCNVCGKHFIERSSLTVHQIIIHTGEKPYKCNECGKAFSQSMNLTV

SEQ ID NO: 3632 - protein, 52 aa, Artificial Sequence
  source: /note="Description of Artificial Sequence: Synthetic polypeptide"
  source: /note="p.R273I"
TGEKPYECNECGKTFRVSSQLIQHQIIIHTEERYHECNECGKAFKHSSGLIR

SEQ ID NO: 3633 - protein, 52 aa, Artificial Sequence
  source: /note="Description of Artificial Sequence: Synthetic polypeptide"
  source: /note="p.D240N"
IHNADERRPAPSGGASGDLRAFGTRNNALHLGFPREPRPKLHHSLSFSGFPS

SEQ ID NO: 3634 - protein, 52 aa, Artificial Sequence
  source: /note="Description of Artificial Sequence: Synthetic polypeptide"
  source: /note="p.V227I"
RAALRKHLLIHGPRDHVCAECGKAFIIESSKLKRHFLVHTGEKPFRCTFEGC

SEQ ID NO: 3635 - protein, 52 aa, Artificial Sequence
  source: /note="Description of Artificial Sequence: Synthetic polypeptide"
  source: /note="p.T264M"
HTGEKPFRCTFEGCGKRFSLDFNLRMMHVRIHTGEKRFVCPFQGCNRRFIQS

SEQ ID NO: 3636 - protein, 29 aa, Artificial Sequence
  source: /note="Description of Artificial Sequence: Synthetic peptide"
  source: /note="p.R591fs"
IQHERTHTGEKPYECNECGRAFRKKNQPA

SEQ ID NO: 3637 - protein, 251 aa, Artificial Sequence
  source: /note="Description of Artificial Sequence: Synthetic polypeptide"
  source: /note="p.E444fs"
GLAPTPSPGLDRKALAEATNGEARAASGPEWRQQRAPGGPQEHQGGGGGGAGGGPHPGPRRAWAPGPVADAVAAQPRPGQGQGRAVQPHAGLQPGARRAGPGRGPVPSAVRVRARRGAPRLGDPGQDVRAGAQPAAAGRGRGRRRRADRALPRGPQGRYVLRVRDHLQQRQQLLRAQAPLLFRPPCARGRACRAQAQGAPRPGPRAPRPARRTRRAALVPGPRSARGGGWGRGHARGRRGRPGQRGQPEPG

SEQ ID NO: 3638 - protein, 376 aa, Artificial Sequence
  source: /note="Description of Artificial Sequence: Synthetic polypeptide"
  source: /note="p.P445fs"
APTPSPGLDRKALAEATNGEARAEPWPRMEAAASPRRPPGASRWRRWRSRRRPPSWAPESLGPRPRRGRRRRAAPPRPGSRPSCPAPRRAPARCPASWAWPGPCSFRSTCSGPTRRPPPRRSWPRCPSWCTAGCSRARARAPAARRPGSSPGPPRALRASSARSPSATSTTTTCTSASTVQAAVRPRTRLPRAGPRRPPARPARPPASPPNPTRRARPRAPERARRGLGARPRPRTARAAGAARAARARVAPWTTRRTTPAARCARPATSASAATRPTPCTSGTTAPRATTRRRADRPRPRDPLGRPRPRPPLPPRLCARADAASSTSCTRPAPRPPRRPATPPRPSRRGPEAEAEAAPASPLRARPAPRPTAPST

SEQ ID NO: 3639 - protein, 52 aa, Artificial Sequence
  source: /note="Description of Artificial Sequence: Synthetic polypeptide"
  source: /note="p.Y107N"
TTMATYQDSYSYGQSAAARSYEDRPNNFQSAALQSGRMTAADSGQPGTQEAC

SEQ ID NO: 3640 - protein, 52 aa, Artificial Sequence
  source: /note="Description of Artificial Sequence: Synthetic polypeptide"
  source: /note="p.R266Q"
GATVNLSQRTRLLLKVLAISDLVIYQQTHADRLHNDLFKFLGDASEAYLKHF

SEQ ID NO: 3641 - protein, 52 aa, Artificial Sequence
  source: /note="Description of Artificial Sequence: Synthetic polypeptide"
  source: /note="p.M1147I"
VVQGLVVDMEVRKTSIKIPSNRYNEIIMKAMNKSNEHVLAGGACFNEKADSH

SEQ ID NO: 3642 - protein, 52 aa, Artificial Sequence
  source: /note="Description of Artificial Sequence: Synthetic polypeptide"
  source: /note="p.N249K"
EVREGDHSFINGAVPVSQASASSAKKKPHAANGPLIGTVPVLPAGIAQFLSL

SEQ ID NO: 3643 - protein, 52 aa, Artificial Sequence
  source: /note="Description of Artificial Sequence: Synthetic polypeptide"
  source: /note="p.A112E"
GSYSSAAFNSTRDFLFRNRGFGDAAEEAASAQHSLFAASAGGFGGPHGHTDA

SEQ ID NO: 3644 - protein, 52 aa, Artificial Sequence
  source: /note="Description of Artificial Sequence: Synthetic polypeptide"
  source: /note="p.S305L"
GEKPFRCEFEGCERRFANSSDRKKHLLHVHTSDKPYTCKVRGCDKCYTHPSS

SEQ ID NO: 3645 - protein, 52 aa, Artificial Sequence
  source: /note="Description of Artificial Sequence: Synthetic polypeptide"
  source: /note="p.D352N"
RIHTGEKPYKCSICEKAFSQKSNVINNHEKIHTGKRAYECDLCGNTFIQKKN

SEQ ID NO: 3646 - protein, 73 aa, Artificial Sequence
  source: /note="Description of Artificial Sequence: Synthetic polypeptide"
  source: /note="p.I384fs"
GKRAYECDLCGNTFIQKKNLIQHKKSILGKSPMNVTDVEKPSFRSQTFIAIRKLIAERGPIDVVNVEKPSSGN

SEQ ID NO: 3647 - protein, 27 aa, Artificial Sequence
  source: /note="Description of Artificial Sequence: Synthetic peptide"
  source: /note="p.R541fs"
KCTKCGKAFTRSSTLTLHHRIHARESL

SEQ ID NO: 3648 - protein, 53 aa, Artificial Sequence
  source: /note="Description of Artificial Sequence: Synthetic polypeptide"
  source: /note="p.K200A"
VGSQPLQDRVLQVPVLAHGGCCREDAAVVASRLTPESQGLLKVEDVALTLTPE

SEQ ID NO: 3649 - protein, 52 aa, Artificial Sequence
  source: /note="Description of Artificial Sequence: Synthetic polypeptide"
  source: /note="p.R319Q"
IPTHAEAGEQEGRLQRKQKNAIGSRQQHYCHECGKSFAQSSGLTKHRRIHTG

SEQ ID NO: 3650 - protein, 26 aa, Artificial Sequence
  source: /note="Description of Artificial Sequence: Synthetic peptide"
  source: /note="p.D13fs"
MIMTESREVIDLDPQLRLPRSRKTFS

SEQ ID NO: 3651 - protein, 97 aa, Artificial Sequence
  source: /note="Description of Artificial Sequence: Synthetic polypeptide"
  source: /note="p.D1048fs"
MPEPSLDLLPELTNPDELLSYLDPPTCRAIVTMTSCLYLRTTEGHPVGAIPPHSASYPTYPTHFSTWEPVPSDRPAPEPRAVGRGALPRCSPLRTEG

SEQ ID NO: 3652 - protein, 95 aa, Artificial Sequence
  source: /note="Description of Artificial Sequence: Synthetic polypeptide"
  source: /note="p.VAAAAATATATATAT153del"
LGLPSHAARPSTDFTQAAAAAAVAALQEKQSQELSQYGAMGAGQSFNSQFLQHGGPRGPSVPAGMNPTGIGGVMGPSGLSPLAMNPTRAAGMTPL

SEQ ID NO: 3653 - protein, 75 aa, Artificial Sequence
  source: /note="Description of Artificial Sequence: Synthetic polypeptide"
  source: /note="p.K345fs"
SSGMNKMLPSVPATAVRVSCSGCKKSSRRGKLLIRGKGLLSYSAPHCASLDIQFHLPAHRLLSPRKLVQVAQKTF

SEQ ID NO: 3654 - protein, 52 aa, Artificial Sequence
  source: /note="Description of Artificial Sequence: Synthetic polypeptide"
  source: /note="p.T367I"
SGCKKILQKGQTAYQRKGSTQLFCSIILCLTGYTVPPARPPPPLTKKTCSSC

SEQ ID NO: 3655 - protein, 52 aa, Artificial Sequence
  source: /note="Description of Artificial Sequence: Synthetic polypeptide"
  source: /note="p.R1446Q"
TYLRFFPPLQKQESEPDKLTVGKRKQQNEDDEVPVGVEMAENTDNPLRCPVR

SEQ ID NO: 3656 - protein, 52 aa, Artificial Sequence
  source: /note="Description of Artificial Sequence: Synthetic polypeptide"
  source: /note="p.R185I"
TGEKPYKCKECGKAFNQTSHLIRHKIIIHTEEKPYKCEECGKAFNQSSTLTT

SEQ ID NO: 3657 - protein, 55 aa, Artificial Sequence
  source: /note="Description of Artificial Sequence: Synthetic polypeptide"
  source: /note="p.T339fs"
GEKPYECQKCGKAFSRASTLWKHKKLILEKSPINVKKCKGFNHYSFCQKHEQSHT

SEQ ID NO: 3658 - protein, 52 aa, Artificial Sequence
  source: /note="Description of Artificial Sequence: Synthetic polypeptide"
  source: /note="p.T408N"
RPYECSECGKSFTQNSGLIKHRRVHNNGEKPYECTECGKSFSHNSSLIKHQR

SEQ ID NO: 3659 - protein, 52 aa, Artificial Sequence
  source: /note="Description of Artificial Sequence: Synthetic polypeptide"
  source: /note="p.R452W"
HTGEKPYKCSDCGKAFSQSSSLIQHWWRIHTGEKPHVCNVCGKAFSYSSVLR

SEQ ID NO: 3660 - protein, 52 aa, Artificial Sequence
  source: /note="Description of Artificial Sequence: Synthetic polypeptide"
  source: /note="p.R683I"
TGEKPYECNECGKVFSYSSSLMVHQIITHTGEKPYKCNDCGKAFSDSSQLIV

SEQ ID NO: 3661 - protein, 52 aa, Artificial Sequence
  source: /note="Description of Artificial Sequence: Synthetic polypeptide"
  source: /note="p.P353T"
CDDCGKSFTWNSELKRHKRVHTGERTTYTCGECGNCFGRQSTLKLHQRIHTG

SEQ ID NO: 3662 - protein, 52 aa, Artificial Sequence
  source: /note="Description of Artificial Sequence: Synthetic polypeptide"
  source: /note="p.R401I"
TGEKPYECSECGKSFSRSSHLVSHQIITHTGEKPYRCNQCGKSFSQSYVLVV

SEQ ID NO: 3663 - protein, 52 aa, Artificial Sequence
  source: /note="Description of Artificial Sequence: Synthetic polypeptide"
  source: /note="p.R569I"
TGEKPYECSECGKSFNRSSHLVMHQIIIHTGEKPYECNQCGKSFSQSYVLVV

SEQ ID NO: 3664 - protein, 52 aa, Artificial Sequence
  source: /note="Description of Artificial Sequence: Synthetic polypeptide"
  source: /note="p.R625I"
TGEKPYECSQCGKSFRQSSCLTQHQIITHTGEKPFECNQCGKTFSLSARLIV

SEQ ID NO: 3665 - protein, 52 aa, Artificial Sequence
  source: /note="Description of Artificial Sequence: Synthetic polypeptide"
  source: /note="p.R349I"
TGEKPYSCKVCGQAFNFHTKLTRHQIIIHSEEKPFDCVDCGKAFSAQEQLKR

SEQ ID NO: 3666 - protein, 52 aa, Artificial Sequence
  source: /note="Description of Artificial Sequence: Synthetic polypeptide"
  source: /note="p.R59Q"
LENYRNLFSVGLTVCKPGLITCLEQQQKEPWNVKRQEAADGHPEMGFHHATQ

SEQ ID NO: 3667 - protein, 52 aa, Artificial Sequence
  source: /note="Description of Artificial Sequence: Synthetic polypeptide"
  source: /note="p.R384C"
TGEKPYTCPACRKSFSHHSTLIQHQCCIHTGEKPYVCDRCAKRFTRRSDLVT

SEQ ID NO: 3668 - protein, 49 aa, Artificial Sequence
  source: /note="Description of Artificial Sequence: Synthetic polypeptide"
  source: /note="p.G23W"
MTMSKEAVTFKDVAVVFTEEELWWLLDLAQRKLYRDVMLENFRNLLSVG

SEQ ID NO: 3669 - protein, 59 aa, Artificial Sequence
  source: /note="Description of Artificial Sequence: Synthetic polypeptide"
  source: /note="p.F122fs"
NIKKEKSNTIDGTVKDETSPVEECFLVKVQTHISVIPSLESSPLGVQDWGNPSALIQNS

SEQ ID NO: 3670 - protein, 52 aa, Artificial Sequence
  source: /note="Description of Artificial Sequence: Synthetic polypeptide"
  source: /note="p.T1410M"
NITLQIDPSILQQTLQQGNLLAQQLMMGEPGLAPQNSSLQTSDSTVPASVVI

SEQ ID NO: 3671 - protein, 52 aa, Artificial Sequence
  source: /note="Description of Artificial Sequence: Synthetic polypeptide"
  source: /note="p.S1480L"
GPLSEQDSVLTTNSSGTQDLTQVMTLLQGLVSPSGGPHEITLTINNSSLSQV

SEQ ID NO: 3672 - protein, 38 aa, Artificial Sequence
  source: /note="Description of Artificial Sequence: Synthetic polypeptide"
  source: /note="p.R568I"
TGEKPYECNACGKTFSQRSVLTKHQIIIHTRVKALSTS

SEQ ID NO: 3673 - protein, 52 aa, Artificial Sequence
  source: /note="Description of Artificial Sequence: Synthetic polypeptide"
  source: /note="p.K179N"
FQCDKYLKVFYKFLNSNRPKIRHTENNKSFKCKKRVKLFCMLSHKTQHKSIY

SEQ ID NO: 3674 - protein, 52 aa, Artificial Sequence
  source: /note="Description of Artificial Sequence: Synthetic polypeptide"
  source: /note="p.R392I"
TKEKPYKCEECGKAFNRSSHLTKHKIIIHTREKAYKCDEYCKAFNWSSALTT

SEQ ID NO: 3675 - protein, 52 aa, Artificial Sequence
  source: /note="Description of Artificial Sequence: Synthetic polypeptide"
  source: /note="p.R174I"
LITRAISGLEQDQPARRANKDATAEIIIDEFIVKLKELKQVASPFTLIIDDP

SEQ ID NO: 3676 - protein, 52 aa, Artificial Sequence
  source: /note="Description of Artificial Sequence: Synthetic polypeptide"
  source: /note="p.R510I"
TGEKPYKCPECGEIFAHSSNLLRHQIIIHTGERPYKCPECGKSFSRSSHLVI

SEQ ID NO: 3677 - protein, 52 aa, Artificial Sequence
  source: /note="Description of Artificial Sequence: Synthetic polypeptide"
  source: /note="p.R344Q"
TAKDPFECKICGKSFRNSSCLSDHFQQIHTGIKPYKCKDCGKAFTQNSDLTK

SEQ ID NO: 3678 - protein, 52 aa, Artificial Sequence
  source: /note="Description of Artificial Sequence: Synthetic polypeptide"
  source: /note="p.R512Q"
TGEKPYKCKQCGKSFSYSNSFQLHEQQTHTGEKPYECKECGKAFSSSSSFRN

SEQ ID NO: 3679 - protein, 53 aa, Artificial Sequence
  source: /note="Description of Artificial Sequence: Synthetic polypeptide"
  source: /note="p.F901del"
NSQLIVHQRTHSGEKPYGCNECGKTSQKSILSAHQRTHTGEKPCKCTECGKAF

SEQ ID NO: 3680 - protein, 52 aa, Artificial Sequence
  source: /note="Description of Artificial Sequence: Synthetic polypeptide"
  source: /note="p.N319K"
DCGKVFSVFSVLTKHKIIHTGTKPYKKCEECGKGFSIFSTLTKHKIIHTGEK

SEQ ID NO: 3681 - protein, 52 aa, Artificial Sequence
  source: /note="Description of Artificial Sequence: Synthetic polypeptide"
  source: /note="p.E363K"
SWENHTTCQHCHRQFPTPFQLQCHIKKNVHTAQEPSTVCKICELSFETDQVL

SEQ ID NO: 3682 - protein, 52 aa, Artificial Sequence
  source: /note="Description of Artificial Sequence: Synthetic polypeptide"
  source: /note="p.E400K"
CKICELSFETDQVLLQHMKDHHKPGKKMPYVCQVCHYRSSVFADVETHFRTC

SEQ ID NO: 3683 - protein, 52 aa, Artificial Sequence
  source: /note="Description of Artificial Sequence: Synthetic polypeptide"
  source: /note="p.R392Q"
KIHTGKKPYECKICGKAFCWGYQLTQQHQIFHTGEKPYECKECGKAFNCGSS

SEQ ID NO: 3684 - protein, 52 aa, Artificial Sequence
  source: /note="Description of Artificial Sequence: Synthetic polypeptide"
  source: /note="p.S62L"
EATGSSSWDIQNSFRREKLEQKSPDLLKTLQEDSPGVRQRVYECQECGKSFR

SEQ ID NO: 3685 - protein, 52 aa, Artificial Sequence
  source: /note="Description of Artificial Sequence: Synthetic polypeptide"
  source: /note="p.K106N"
VQSSDLTSHQRIHNYEKPYKCSKCENNSFWHHLVLSGHQRTHAGKKFYTCDI

SEQ ID NO: 3686 - protein, 52 aa, Artificial Sequence
  source: /note="Description of Artificial Sequence: Synthetic polypeptide"
  source: /note="p.R554Q"
TGEKLYECATCGQVLSRLSTLKSHMQQTHTGEKPYVCQECGRAFSEPSSLRK

SEQ ID NO: 3687 - protein, 75 aa, Artificial Sequence
  source: /note="Description of Artificial Sequence: Synthetic polypeptide"
  source: /note="p.K426fs"
ECKECGKTFFCQSALTAHQRIHTGENPMNVVNVRKPSFVNLPSMCIEEVIQERSPMNAVNVENFYVRNQPSLHIR

SEQ ID NO: 3688 - protein, 52 aa, Artificial Sequence
  source: /note="Description of Artificial Sequence: Synthetic polypeptide"
  source: /note="p.R402I"
TGEKPFKCSECGRAFSQSASLIQHEIIIHTGEKPYRCNECGKGFTSISRLNR

SEQ ID NO: 3689 - protein, 30 aa, Artificial Sequence
  source: /note="Description of Artificial Sequence: Synthetic polypeptide"
  source: /note="p.D609N"
GKLFSQRSSLTNHYKIHIEEDSLKANNLHV

SEQ ID NO: 3690 - protein, 59 aa, Artificial Sequence
  source: /note="Description of Artificial Sequence: Synthetic polypeptide"
  source: /note="p.T130fs"
DPNSDTLSPGDPKVDPISSGLTATPRSWPPAPRCSPPPPARPGPSPARIAGEPSAAAPG

SEQ ID NO: 3691 - protein, 52 aa, Artificial Sequence
  source: /note="Description of Artificial Sequence: Synthetic polypeptide"
  source: /note="p.H186Q"
FGDSTGWEKSLLNTKHEKIHPAVNLQQKQTERVLSGKQELIQHQKVQAPEQP

SEQ ID NO: 3692 - protein, 52 aa, Artificial Sequence
  source: /note="Description of Artificial Sequence: Synthetic polypeptide"
  source: /note="p.T226S"
KRLLYCSLCKVAVNSASQLEAHNSGSSKHKTMLEARNGSGTIKAFPRAGVKG

SEQ ID NO: 3693 - protein, 52 aa, Artificial Sequence
  source: /note="Description of Artificial Sequence: Synthetic polypeptide"
  source: /note="p.N251fs"
GEKPYTCEECGKVFNWSSRLTTHKKIILDTNSTNVKNVAKLLTSPQSLLPIR

SEQ ID NO: 3694 - protein, 52 aa, Artificial Sequence
  source: /note="Description of Artificial Sequence: Synthetic polypeptide"
  source: /note="p.R280C"
YKLYKCEECGKAFNKSSILTTHKIICCTGEKFYKCKECAKAFNQSSNLTEHK

SEQ ID NO: 3695 - protein, 52 aa, Artificial Sequence
  source: /note="Description of Artificial Sequence: Synthetic polypeptide"
  source: /note="p.R306C"
QNSQIYRAMAEGLWEQGFLRTPEQCCCTKFKSLQLSYRKVRRGRVPEPCIFY

SEQ ID NO: 3696 - protein, 52 aa, Artificial Sequence
  source: /note="Description of Artificial Sequence: Synthetic polypeptide"
  source: /note="p.R262I"
TGEKPYECKQCGKSFSYSATHRIHEIITHIGEKPYECQECGKAFHSPRSCHR

SEQ ID NO: 3697 - protein, 52 aa, Artificial Sequence
  source: /note="Description of Artificial Sequence: Synthetic polypeptide"
  source: /note="p.R309Q"
ERTHTGEKPYKCKRCGRAFSVSSSLQQIHERTHTGEKPYECKQCGKAFHHLG

SEQ ID NO: 3698 - protein, 52 aa, Artificial Sequence
  source: /note="Description of Artificial Sequence: Synthetic polypeptide"
  source: /note="p.R301I"
TGEKPYKCKQCSKAFPDSSSCLIHEIITHTGEKPYTCKQCGKAFSVSGSLQR

SEQ ID NO: 3699 - protein, 52 aa, Artificial Sequence
  source: /note="Description of Artificial Sequence: Synthetic polypeptide"
  source: /note="p.L682M"
ECREGFRQSPDCSQPQGAPAVEKTFMMCQQCGKTFTRKKTLVDHQRIHTGEK

SEQ ID NO: 3700 - protein, 52 aa, Artificial Sequence
  source: /note="Description of Artificial Sequence: Synthetic polypeptide"
  source: /note="p.R376I"
TGEKPFECNECGKAFRVNSSLTEHQIIIHTGEKPYKCNECGKAFRDNSSFAR

SEQ ID NO: 3701 - protein, 52 aa, Artificial Sequence
  source: /note="Description of Artificial Sequence: Synthetic polypeptide"
  source: /note="p.S190I"
SDQSQGFQPSKNAFECSECGKVFSKIISTLNKHQKIHNEKNANQKIHIKEKR

SEQ ID NO: 3702 - protein, 52 aa, Artificial Sequence
  source: /note="Description of Artificial Sequence: Synthetic polypeptide"
  source: /note="p.S650T"
FCDNLPKFEGQPSSLPLENETDSHPTTSSNTVKKSQTSILGLSSKNNFVAKA

SEQ ID NO: 3703 - protein, 52 aa, Artificial Sequence
  source: /note="Description of Artificial Sequence: Synthetic polypeptide"
  source: /note="p.R641I"
TGEKPYECNVCGKAFSHRKSLTLHQIIIHTGEKPYECKECSKAFSQVAHLTL

SEQ ID NO: 3704 - protein, 52 aa, Artificial Sequence
  source: /note="Description of Artificial Sequence: Synthetic polypeptide"
  source: /note="p.R282I"
TGEKLFECKECRKAFKQSEHLIQHQIIIHTGEKPYKCKECRKAFRQPAHLAQ

SEQ ID NO: 3705 - protein, 52 aa, Artificial Sequence
  source: /note="Description of Artificial Sequence: Synthetic polypeptide"
  source: /note="p.R235H"
HQRTHTGEKPYKCGICGKGFGDSSAHHIKHQRTHRGEQPPRPVVPRRQPSRA

SEQ ID NO: 3706 - protein, 67 aa, Artificial Sequence
  source: /note="Description of Artificial Sequence: Synthetic polypeptide"
  source: /note="p.P247fs"
ICGKGFGDSSARIKHQRTHRGEQPPDQWCPDGSHLGQPRQLPRDRRPRTSHISALIAARGLCSAAAS

SEQ ID NO: 3707 - protein, 52 aa, Artificial Sequence
  source: /note="Description of Artificial Sequence: Synthetic polypeptide"
  source: /note="p.R138C"
SILEELWKDDEHTRKCGENQNKPLSCCVVFINKKTLANDSIFEYKDIGEIVH

SEQ ID NO: 3708 - protein, 52 aa, Artificial Sequence
  source: /note="Description of Artificial Sequence: Synthetic polypeptide"
  source: /note="p.R374I"
SGNKPYQCRDCGKAFTKSSTLTGHQIIIHTGEKPYHCKKCGKAFRHSSGLVE

SEQ ID NO: 3709 - protein, 52 aa, Artificial Sequence
  source: /note="Description of Artificial Sequence: Synthetic polypeptide"
  source: /note="p.R206Q"
PAGESADALGELSGLLNTTDLACWGQQLSTPKLLVGDLWNLQALPQNAPLCS

SEQ ID NO: 3710 - protein, 52 aa, Artificial Sequence
  source: /note="Description of Artificial Sequence: Synthetic polypeptide"
  source: /note="p.R343Q"
ERTHTGEKPDGCKQCGKAFRSAKYIQQIHGRTHTGEKPYECKQCGKAFHCVS

SEQ ID NO: 3711 - protein, 52 aa, Artificial Sequence
  source: /note="Description of Artificial Sequence: Synthetic polypeptide"
  source: /note="p.P392H"
CEVCSKAFSRFSHLTTHKRIHTGEKHHYKCEECGKAFNLSSQLTTHKIIHTG

SEQ ID NO: 3712 - protein, 52 aa, Artificial Sequence
  source: /note="Description of Artificial Sequence: Synthetic polypeptide"
  source: /note="p.V81G"
PGEEGTTNSFLKARPRDLMTFEDVAGGEFSQWEWGQLNPAQKDLYREVMLEN

SEQ ID NO: 3713 - protein, 52 aa, Artificial Sequence
  source: /note="Description of Artificial Sequence: Synthetic polypeptide"
  source: /note="p.H431Y"
CKECGKAFNRASHLTQHQRIHTGEKYYFKCKECGKAFNRGSHLTRHQRIHTG

SEQ ID NO: 3714 - protein, 52 aa, Artificial Sequence
  source: /note="Description of Artificial Sequence: Synthetic polypeptide"
  source: /note="p.G640C"
TSLKMMQAVGGAPARPTGEYICNQCCCAKYTSLDSFQTHLKTHLDTVLPKLT

SEQ ID NO: 3715 - protein, 52 aa, Artificial Sequence
  source: /note="Description of Artificial Sequence: Synthetic polypeptide"
  source: /note="p.P270H"
TQKCSQCEEGFDFPEDLQKHIAECHHHECSPNEDRAALQCVYCHELFVEETS

SEQ ID NO: 3716 - protein, 52 aa, Artificial Sequence
  source: /note="Description of Artificial Sequence: Synthetic polypeptide"
  source: /note="p.R279Q"
SNLSQHQRIHTGEKPYKCHECDKVFQQSSSKLAQHQRIHTGEKPYKCHECDK

SEQ ID NO: 3717 - protein, 52 aa, Artificial Sequence
  source: /note="Description of Artificial Sequence: Synthetic polypeptide"
  source: /note="p.N583K"
TGEKPYSCNECGKVFSRNSHLARHRKKIHTGEKPHSCNECGKVFSRNSHLAR

SEQ ID NO: 3718 - protein, 52 aa, Artificial Sequence
  source: /note="Description of Artificial Sequence: Synthetic polypeptide"
  source: /note="p.G663W"
RVFRTYHQVVVHSRVHKRDRKGEEDWWLHVGLDERRGSGSDQESQSVSRSTT

SEQ ID NO: 3719 - protein, 52 aa, Artificial Sequence
  source: /note="Description of Artificial Sequence: Synthetic polypeptide"
  source: /note="p.G186C"
PYCDHRAAQKGNLKIHLRTHKLGNLCCKGRGRVREENRLLHELEERAILRDK

SEQ ID NO: 3720 - protein, 52 aa, Artificial Sequence
  source: /note="Description of Artificial Sequence: Synthetic polypeptide"
  source: /note="p.E284K"
PSSSHLRECVRIYGGERPYTHKEYVKKTFSHSTALFVHMQTQDGEKFYECKA

SEQ ID NO: 3721 - protein, 86 aa, Artificial Sequence
  source: /note="Description of Artificial Sequence: Synthetic polypeptide"
  source: /note="p.W208fs"
NLRRHMVVQGGNRPYKCKLCGKAFFGPVYYVCMKELTLERNRMNVSSVLKPFLFTVPIEDMRECTLGRNRMNVSSVLKPCLIPVPI

SEQ ID NO: 3722 - protein, 52 aa, Artificial Sequence
  source: /note="Description of Artificial Sequence: Synthetic polypeptide"
  source: /note="p.K26N"
MDAVAFEDVAVNFTQEEWALLGPSQNNNLYRYVMQETIRNLDCIRMIWEEQN

SEQ ID NO: 3723 - protein, 52 aa, Artificial Sequence
  source: /note="Description of Artificial Sequence: Synthetic polypeptide"
  source: /note="p.R350I"
TGKKPYECKECGKGYTTASYFLLHQIIIHKGGKPYECKECKKTFTLYRNLTR

SEQ ID NO: 3724 - protein, 52 aa, Artificial Sequence
  source: /note="Description of Artificial Sequence: Synthetic polypeptide"
  source: /note="p.G311S"
PYKCNECGKSFSYKSSLTCHRRCHTSSEKPYKCNECGKSFSYKSSLTCHHRC

SEQ ID NO: 3725 - protein, 52 aa, Artificial Sequence
  source: /note="Description of Artificial Sequence: Synthetic polypeptide"
  source: /note="p.R344I"
TGERPFECIECGKAFSNGSFLAQHQIIIHTGEKPYVCNVCGKAFSHRGYLIV

SEQ ID NO: 3726 - protein, 52 aa, Artificial Sequence
  source: /note="Description of Artificial Sequence: Synthetic polypeptide"
  source: /note="p.E491D"
YMCNKCGKAFTNRSNLITHQKTHTGDDKSYICSKCGKAFTQRSDLITHQRIH

SEQ ID NO: 3727 - protein, 52 aa, Artificial Sequence
  source: /note="Description of Artificial Sequence: Synthetic polypeptide"
  source: /note="p.E638K"
KSFTSKSQLLVHQPVHTGEKPYVCAKKCGKAFSGRSNLSKHQKTHTGEKPYI

SEQ ID NO: 3728 - protein, 52 aa, Artificial Sequence
  source: /note="Description of Artificial Sequence: Synthetic polypeptide"
  source: /note="p.P500T"
PGSQTGKKQQSTALQASTLAPANLLTTKAVHLANLNLVPHSVAASVTAKSSV

SEQ ID NO: 3729 - protein, 52 aa, Artificial Sequence
  source: /note="Description of Artificial Sequence: Synthetic polypeptide"
  source: /note="p.K324Q"
VTKEDQPGHTKDLSGPTKESSKGSPQQMPKSPKSPRSPLEATRKSIKPSDSP

SEQ ID NO: 3730 - protein, 52 aa, Artificial Sequence
  source: /note="Description of Artificial Sequence: Synthetic polypeptide"
  source: /note="p.R287I"
TGEKPYECYDCGQMFSQSSHLVPHQIIIHTGEKPLKCNECEKAFRQHSHLTE

SEQ ID NO: 3731 - protein, 51 aa, Artificial Sequence
  source: /note="Description of Artificial Sequence: Synthetic polypeptide"
  source: /note="p.E25G"
MAAAGGAEGRRADMEAEAAAAPERGGGGSCVLCCGDLEATALGRCDHPVCY

SEQ ID NO: 3732 - protein, 70 aa, Artificial Sequence
  source: /note="Description of Artificial Sequence: Synthetic polypeptide"
  source: /note="p.A465fs"
SAAAAPGSEASFTESRGLQNKNRGGPMGKGGGAASMPADEGHPQIVLLRISKPALPPPTKGKTSLQWSWT

SEQ ID NO: 3733 - protein, 52 aa, Artificial Sequence
  source: /note="Description of Artificial Sequence: Synthetic polypeptide"
  source: /note="p.R390I"
TGEKPYKCEECDKVFSRKSTIETHKIIIHTGEKPYRCKVCDTAFTWHSQLAR

SEQ ID NO: 3734 - protein, 52 aa, Artificial Sequence
  source: /note="Description of Artificial Sequence: Synthetic polypeptide"
  source: /note="p.R235Q"
TGEKPYECSECGKAFHSSTCLHAHKQKTHTGEKPYECKQCGKAFVSFNSVRY

SEQ ID NO: 3735 - protein, 52 aa, Artificial Sequence
  source: /note="Description of Artificial Sequence: Synthetic polypeptide"
  source: /note="p.K473R"
TGEKFYKCEECGKAFKCSSNLTTHKRRIHTGERPYKCEECGKAFNQSSILTT

SEQ ID NO: 3736 - protein, 52 aa, Artificial Sequence
  source: /note="Description of Artificial Sequence: Synthetic polypeptide"
  source: /note="p.D400N"
SQADIPIRSPFGIVKASWLPKFSHANNAQKMKRLPTPSMMNDYYAASPRIFP

SEQ ID NO: 3737 - protein, 47 aa, Artificial Sequence
  source: /note="Description of Artificial Sequence: Synthetic polypeptide"
  source: /note="p.G21W"
MRSFLQQDVNKTKSRLNVLNWWLANNMDDLKINTDITGAKEELLDDN

SEQ ID NO: 3738 - protein, 52 aa, Artificial Sequence
  source: /note="Description of Artificial Sequence: Synthetic polypeptide"
  source: /note="p.R154C"
SLQAHIKRRHKRARKQVTSASLEKVCCPHIAPPQTEISDIPKRLQDRDHLSY

SEQ ID NO: 3739 - protein, 52 aa, Artificial Sequence
  source: /note="Description of Artificial Sequence: Synthetic polypeptide"
  source: /note="p.R198I"
NIEKAHECTDCGKAFLKKSQLTEHKIIIHTGKKPHVCSLCGKAFYKKYRLTE

SEQ ID NO: 3740 - protein, 52 aa, Artificial Sequence
  source: /note="Description of Artificial Sequence: Synthetic polypeptide"
  source: /note="p.K327N"
VSCNKSFKKLWSLHEHIKIVHGYAENNKFSCEICEKKFYTMAHVRKHMVAHT

SEQ ID NO: 3741 - protein, 52 aa, Artificial Sequence
  source: /note="Description of Artificial Sequence: Synthetic polypeptide"
  source: /note="p.R405I"
TKENIYECSKCGKSFRGKSHLSVHQIIIHTGEKPYECSICGKTFSGKSHLSV

SEQ ID NO: 3742 - protein, 52 aa, Artificial Sequence
  source: /note="Description of Artificial Sequence: Synthetic polypeptide"
  source: /note="p.R220I"
TKVNFCKCEECEKAVNQSSKLTKHKIIIYTCEKLYKCQECDRTFNQFSNLTE

SEQ ID NO: 3743 - protein, 52 aa, Artificial Sequence
  source: /note="Description of Artificial Sequence: Synthetic polypeptide"
  source: /note="p.P43T"
PDLIIFLEQGKEPWNMKRHEMVEEPTTVICSHFSQEFWPEQGIEDSFQKMIL

SEQ ID NO: 3744 - protein, 52 aa, Artificial Sequence
  source: /note="Description of Artificial Sequence: Synthetic polypeptide"
  source: /note="p.R451I"
PGEKPHKCNVCGRAFIQSSSLVEHQIIIHTGEKPYKCNKCDKAFIKRSHLWG

SEQ ID NO: 3745 - protein, 52 aa, Artificial Sequence
  source: /note="Description of Artificial Sequence: Synthetic polypeptide"
  source: /note="p.R131T"
FDSLWDYDVKNYKGMPLTCNKNLTHTTKDQQHNKSSIHFSLKQSVSIRDSAH

SEQ ID NO: 3746 - protein, 52 aa, Artificial Sequence
  source: /note="Description of Artificial Sequence: Synthetic polypeptide"
  source: /note="p.R501W"
TLANHKRIHAREKPYKCEECGKAFNWWSSHLTRHKKIHTGEKLYKPEKCDNN

SEQ ID NO: 3747 - protein, 52 aa, Artificial Sequence
  source: /note="Description of Artificial Sequence: Synthetic polypeptide"
  source: /note="p.F858C"
DTVFTHKPLLSSHFDQHLLPQRVSVCCKCPSCPLLFAQKRTMLEHLKNTHQS

SEQ ID NO: 3748 - protein, 52 aa, Artificial Sequence
  source: /note="Description of Artificial Sequence: Synthetic polypeptide"
  source: /note="p.R41I"
QDSVVFEDVAVDFTQEEWALLDLAQIINLYRDVMLENFQNLASLGYPLHTPH

SEQ ID NO: 3749 - protein, 52 aa, Artificial Sequence
  source: /note="Description of Artificial Sequence: Synthetic polypeptide"
  source: /note="p.R337I"
TGEKPYRCEECGKAFGQSSSLIHHQIIIHTGERPYGCRECGKAFSQQSQLVR

SEQ ID NO: 3750 - protein, 52 aa, Artificial Sequence
  source: /note="Description of Artificial Sequence: Synthetic polypeptide"
  source: /note="p.R244I"
TGKRPYECRECGKDFSRSSSLRKHEIIIHTGERPYQCKECGKSFNQSSGLSQ

SEQ ID NO: 3751 - protein, 52 aa, Artificial Sequence
  source: /note="Description of Artificial Sequence: Synthetic polypeptide"
  source: /note="p.S649C"
NLRKHGRTHTGEKPYECKQCGKAFRCCASNLQMHERTHTGEKPYECKECEKA

SEQ ID NO: 3752 - protein, 52 aa, Artificial Sequence
  source: /note="Description of Artificial Sequence: Synthetic polypeptide"
  source: /note="p.N652H"
KHGRTHTGEKPYECKQCGKAFRSASHHLQMHERTHTGEKPYECKECEKAFCK

SEQ ID NO: 3753 - protein, 52 aa, Artificial Sequence
  source: /note="Description of Artificial Sequence: Synthetic polypeptide"
  source: /note="p.Q654R"
GRTHTGEKPYECKQCGKAFRSASNLRRMHERTHTGEKPYECKECEKAFCKFS

SEQ ID NO: 3754 - protein, 29 aa, Artificial Sequence
  source: /note="Description of Artificial Sequence: Synthetic peptide"
  source: /note="p.D298N"
GNKIIHTGEKPHACLLCGKAFSLSSNNLR

SEQ ID NO: 3755 - protein, 34 aa, Artificial Sequence
  source: /note="Description of Artificial Sequence: Synthetic polypeptide"
  source: /note="p.I8N"
MARGQQKNNQSQQKNAKKQAGQKKKQGHDQKAAA

SEQ ID NO: 3756 - protein, 52 aa, Artificial Sequence
  source: /note="Description of Artificial Sequence: Synthetic polypeptide"
  source: /note="p.R468I"
TGEKPYECKQCGKAFSCSSSFRMHEIIIHTGEKPYECKQCGKAFSFSSSFRM

SEQ ID NO: 3757 - protein, 52 aa, Artificial Sequence
  source: /note="Description of Artificial Sequence: Synthetic polypeptide"
  source: /note="p.V411L"
ICKKHFTGRSSLIVHQIVHTGEKPYLLCGECGKAFSQSAYLIEHQRIHTGEK

SEQ ID NO: 3758 - protein, 27 aa, Artificial Sequence
  source: /note="Description of Artificial Sequence: Synthetic peptide"
  source: /note="p.L737fs"
SVHTKDQPLKCKRCKRGFRQQNELKNI

SEQ ID NO: 3759 - protein, 52 aa, Artificial Sequence
  source: /note="Description of Artificial Sequence: Synthetic polypeptide"
  source: /note="p.H263L"
EKPYRCEECGKAFSWSASLTKHKRILLTGEKPYTCEERGKVFSRSTLTNYKR

SEQ ID NO: 3760 - protein, 52 aa, Artificial Sequence
  source: /note="Description of Artificial Sequence: Synthetic polypeptide"
  source: /note="p.N594I"
GKSFHCKSFLTIHQRTHAGKKPYECIIECEKTFINKLNLGIHKRTHTGERPY

SEQ ID NO: 3761 - protein, 52 aa, Artificial Sequence
  source: /note="Description of Artificial Sequence: Synthetic polypeptide"
  source: /note="p.C844S"
CRKTFSQKSKLFVHHRTHTGEKPFRSSNECRKTFSQKSGLSIHQRTHTGEKP

SEQ ID NO: 3762 - protein, 52 aa, Artificial Sequence
  source: /note="Description of Artificial Sequence: Synthetic polypeptide"
  source: /note="p.W315C"
KPSISKSDLMLQCKMPTEEKPYACNCCCEKLFSYKSSLIIHQRIHTGEKPYG

SEQ ID NO: 3763 - protein, 149 aa, Artificial Sequence
  source: /note="Description of Artificial Sequence: Synthetic polypeptide"
  source: /note="p.S96fs"
LDPKQTNQPDATAKPASSKSVANGLCLRLEASAQLCQGRHQGKPGAASPGNPQVPGTEASPPQGITLQEPSSGSRPRCPACSGRRSSAFCICSSRRAQTQGARQRRGARDTGFTQPHCQGRVFPHQVGLPHSWLPLESRLTFPSTRVST

SEQ ID NO: 3764 - protein, 52 aa, Artificial Sequence
  source: /note="Description of Artificial Sequence: Synthetic polypeptide"
  source: /note="p.S254L"
LLRKHQLIHLGEKQYKCDICGKVFNLLKRYVARHRRCHTGEKPYKCNECGKT

SEQ ID NO: 3765 - protein, 52 aa, Artificial Sequence
  source: /note="Description of Artificial Sequence: Synthetic polypeptide"
  source: /note="p.R423Q"
TGERPYKCGECGKSFNQSSHFITHQQQIHLGDRPYRCPECGKTFNQRSHFLT

SEQ ID NO: 3766 - protein, 52 aa, Artificial Sequence
  source: /note="Description of Artificial Sequence: Synthetic polypeptide"
  source: /note="p.R466Q"
SNEKPFVCRECEMAFRYHCQLIEHSQQIHTGDKPFECQDCGKAFNRGSSLVQ

SEQ ID NO: 3767 - protein, 52 aa, Artificial Sequence
  source: /note="Description of Artificial Sequence: Synthetic polypeptide"
  source: /note="p.G484W"
FNYKSILIVHQRTHTGEKPFECNECWWKSFSHMSGLRNHRRTHTGERPYKCD

SEQ ID NO: 3768 - protein, 52 aa, Artificial Sequence
  source: /note="Description of Artificial Sequence: Synthetic polypeptide"
  source: /note="p.C145F"
KPHNRDINIFRARMMPCKCDIAGSAFFQGLSLMAPHCQYSKEKAHERNVCDK

SEQ ID NO: 3769 - protein, 52 aa, Artificial Sequence
  source: /note="Description of Artificial Sequence: Synthetic polypeptide"
  source: /note="p.K247T"
KAFLEKAALVTSNSTHPKGKSYNFNTTFGENKYDKSTFIIPQNMNPEKSHYE

SEQ ID NO: 3770 - protein, 52 aa, Artificial Sequence
  source: /note="Description of Artificial Sequence: Synthetic polypeptide"
  source: /note="p.W41G"
IRVDAGHKPHEYQEYGEKRNTRKQFGGKTFSYCHSFQTHKISHTGHKPYDCK

SEQ ID NO: 3771 - protein, 52 aa, Artificial Sequence
  source: /note="Description of Artificial Sequence: Synthetic polypeptide"
  source: /note="p.T43A"
VDAGHKPHEYQEYGEKRNTRKQFWKAAFSYCHSFQTHKISHTGHKPYDCKEC

SEQ ID NO: 3772 - protein, 52 aa, Artificial Sequence
  source: /note="Description of Artificial Sequence: Synthetic polypeptide"
  source: /note="p.C453R"
KAYRISSSLRRHETTHTGEKPYKCKRRGKAFIDFYSFQNHKTTHAGEKPYEC

SEQ ID NO: 3773 - protein, 53 aa, Artificial Sequence
  source: /note="Description of Artificial Sequence: Synthetic polypeptide"
  source: /note="p.P644S"
NDIDEDLSFPSYISRFKKHKLIPCSSSHLEFEDERQFNCKSSPCTVGGHSDHG

SEQ ID NO: 3774 - protein, 53 aa, Artificial Sequence
  source: /note="Description of Artificial Sequence: Synthetic polypeptide"
  source: /note="p.G320E"
KHECGECGKSFSKYVSFSNHQRVHTEEKRPYECGECGKSFSKYASFSNHQRVH

SEQ ID NO: 3775 - protein, 52 aa, Artificial Sequence
  source: /note="Description of Artificial Sequence: Synthetic polypeptide"
  source: /note="p.P323H"
CGECGKSFSKYVSFSNHQRVHTGKRHHYECGECGKSFSKYASFSNHQRVHTE

SEQ ID NO: 3776 - protein, 52 aa, Artificial Sequence
  source: /note="Description of Artificial Sequence: Synthetic polypeptide"
  source: /note="p.Y324H"
GECGKSFSKYVSFSNHQRVHTGKRPHHECGECGKSFSKYASFSNHQRVHTEK

SEQ ID NO: 3777 - protein, 52 aa, Artificial Sequence
  source: /note="Description of Artificial Sequence: Synthetic polypeptide"
  source: /note="p.R547I"
SGEKPYECKECGKAFSWLTCLLRHEIIIHTGEKPYECLQCGKAFTRSRFLRG

SEQ ID NO: 3778 - protein, 71 aa, Artificial Sequence
  source: /note="Description of Artificial Sequence: Synthetic polypeptide"
  source: /note="p.A49fs"
PGGQASPHLTLGPVLLPPEQGLAPPHCVPEGPAHPTVPHGASRGPPAPRPASDGQPRWGQRALHTQPCAAA

SEQ ID NO: 3779 - protein, 52 aa, Artificial Sequence
  source: /note="Description of Artificial Sequence: Synthetic polypeptide"
  source: /note="p.Q617K"
AREAMAGKGRAGGRKCGQRRLKMFSKKEKWQVYGDETFKRIYQKMKASPHGG

SEQ ID NO: 3780 - protein, 52 aa, Artificial Sequence
  source: /note="Description of Artificial Sequence: Synthetic polypeptide"
  source: /note="p.E949D"
QAPRVLSALADNAFSPKYLLRLPQADDTPLPLPIPWGPRHSQDSLCSSGWPE

SEQ ID NO: 3781 - protein, 52 aa, Artificial Sequence
  source: /note="Description of Artificial Sequence: Synthetic polypeptide"
  source: /note="p.R1393Q"
EGDCRQTLGTLSLGTSSRIVREMDKQQTVKDISPSAGEHGDCTTHSTAATSG

SEQ ID NO: 3782 - protein, 52 aa, Artificial Sequence
  source: /note="Description of Artificial Sequence: Synthetic polypeptide"
  source: /note="p.I571N"
RIHTGEQPYKCNVCGKVFNYSGNLSNNHKRIHTGEKPFQCNECGTVFRNYSC

SEQ ID NO: 3783 - protein, 52 aa, Artificial Sequence
  source: /note="Description of Artificial Sequence: Synthetic polypeptide"
  source: /note="p.K608Q"
QCNECGTVFRNYSCLARHLRIHTGQQQPYKCNVCGKVFNDSGNLSNHKRIHT

SEQ ID NO: 3784 - protein, 52 aa, Artificial Sequence
  source: /note="Description of Artificial Sequence: Synthetic polypeptide"
  source: /note="p.R630I"
TGQKPYKCNVCGKVFNDSGNLSNHKIIIHTGEKPFQCNECGKVFSYYSCLAR

SEQ ID NO: 3785 - protein, 52 aa, Artificial Sequence
  source: /note="Description of Artificial Sequence: Synthetic polypeptide"
  source: /note="p.R854I"
TGDKPYKCNECGKAFIERSKLVYHQIINHTGEKPYKCIECGKAFGRFSCLNK

SEQ ID NO: 3786 - protein, 52 aa, Artificial Sequence
  source: /note="Description of Artificial Sequence: Synthetic polypeptide"
  source: /note="p.R757I"
TGEMPYKCIECGKVFNSTTTLARHRIIIHTGEKPYKCNECGKVFRYRSGLAR

SEQ ID NO: 3787 - protein, 52 aa, Artificial Sequence
  source: /note="Description of Artificial Sequence: Synthetic polypeptide"
  source: /note="p.M423I"
LTRHRRLHTGEKPYKCNDCGKTFSQIISSLVYHRRLHTGEKPYKCEECDEAF

SEQ ID NO: 3788 - protein, 52 aa, Artificial Sequence
  source: /note="Description of Artificial Sequence: Synthetic polypeptide"
  source: /note="p.R925H"
AHLACHHRIHTGEKPYKCNECGKTFHHHNSVLVIHKTIHTGEKPYKCNECGK

SEQ ID NO: 3789 - protein, 52 aa, Artificial Sequence
  source: /note="Description of Artificial Sequence: Synthetic polypeptide"
  source: /note="p.Q406R"
ECKECGKVFRHKFCLTNHHRMHTGERRPYKCNECGKAFRDCSGLTAHLLIHT

SEQ ID NO: 3790 - protein, 34 aa, Artificial Sequence
  source: /note="Description of Artificial Sequence: Synthetic polypeptide"
  source: /note="p.V362fs"
VMSQWSRSASRNRRHVTEEADVTVGATDLPGQEG

SEQ ID NO: 3791 - protein, 52 aa, Artificial Sequence
  source: /note="Description of Artificial Sequence: Synthetic polypeptide"
  source: /note="p.R154C"
NFEESMSGIYTCFLEYKPTVEEIVKCCLQLKYAIYAYREPHYYYQFTARYHA

SEQ ID NO: 3792 - protein, 38 aa, Artificial Sequence
  source: /note="Description of Artificial Sequence: Synthetic polypeptide"
  source: /note="p.P225fs"
SSILSDGVYERHMDPLLLPGELASPQPGPWSWGDPGTF

SEQ ID NO: 3793 - protein, 52 aa, Artificial Sequence
  source: /note="Description of Artificial Sequence: Synthetic polypeptide"
  source: /note="p.S214Y"
TSMLKCPLCRKEFAPLKLILEEFKNYYSKLVAAAEKERLDKHLGIPCNNCKQ

SEQ ID NO: 3794 - protein, 52 aa, Artificial Sequence
  source: /note="Description of Artificial Sequence: Synthetic polypeptide"
  source: /note="p.E407K"
GPSLQPTMAPAPELLQKGSTCITNTKKGWVGHPLDPIGCLCRALLEACRLEE

SEQ ID NO: 3795 - protein, 31 aa, Artificial Sequence
  source: /note="Description of Artificial Sequence: Synthetic polypeptide"
  source: /note="p.Q610fs"
LAIAIVNTLRRQQQKQLEMFRTQKKSYPIKT

SEQ ID NO: 3796 - protein, 52 aa, Artificial Sequence
  source: /note="Description of Artificial Sequence: Synthetic polypeptide"
  source: /note="p.V30A"
PSHSSEDEAAAAGGEGWGPHQDWAAAASGTTPGPGVAAPALPPAAALLEPAR

SEQ ID NO: 3797 - protein, 31 aa, Artificial Sequence
  source: /note="Description of Artificial Sequence: Synthetic polypeptide"
  source: /note="p.R5Q"
MAASQQSTRVTRSTVGLNGLDESFCGRTLRN

SEQ ID NO: 3798 - protein, 52 aa, Artificial Sequence
  source: /note="Description of Artificial Sequence: Synthetic polypeptide"
  source: /note="p.R162Q"
IKSDKESVEQRSTVVDNDADFQGTKQQACRCLILDDCEKREIKKVNVSEEGP

SEQ ID NO: 3799 - protein, 9 aa, Artificial Sequence
  source: /note="Description of Artificial Sequence: Synthetic peptide"
VQKYFPETW

SEQ ID NO: 3800 - protein, 9 aa, Artificial Sequence
  source: /note="Description of Artificial Sequence: Synthetic peptide"
QKYFPETWI

SEQ ID NO: 3801 - protein, 10 aa, Artificial Sequence
  source: /note="Description of Artificial Sequence: Synthetic peptide"
ETVQKYFPET

SEQ ID NO: 3802 - protein, 10 aa, Artificial Sequence
  source: /note="Description of Artificial Sequence: Synthetic peptide"
VQKYFPETWI

SEQ ID NO: 3803 - protein, 10 aa, Artificial Sequence
  source: /note="Description of Artificial Sequence: Synthetic peptide"
QKYFPETWIW

SEQ ID NO: 3804 - protein, 10 aa, Artificial Sequence
  source: /note="Description of Artificial Sequence: Synthetic peptide"
EPHTETVQKY

SEQ ID NO: 3805 - protein, 9 aa, Artificial Sequence
  source: /note="Description of Artificial Sequence: Synthetic peptide"
HSEPAFHYL

SEQ ID NO: 3806 - protein, 9 aa, Artificial Sequence
  source: /note="Description of Artificial Sequence: Synthetic peptide"
MPQGHSEPA

SEQ ID NO: 3807 - protein, 9 aa, Artificial Sequence
  source: /note="Description of Artificial Sequence: Synthetic peptide"
PQGHSEPAF

SEQ ID NO: 3808 - protein, 9 aa, Artificial Sequence
  source: /note="Description of Artificial Sequence: Synthetic peptide"
GHSEPAFHY

SEQ ID NO: 3809 - protein, 9 aa, Artificial Sequence
  source: /note="Description of Artificial Sequence: Synthetic peptide"
FHYLEALVL

SEQ ID NO: 3810 - protein, 9 aa, Artificial Sequence
  source: /note="Description of Artificial Sequence: Synthetic peptide"
EPAFHYLEA

SEQ ID NO: 3811 - protein, 10 aa, Artificial Sequence
  source: /note="Description of Artificial Sequence: Synthetic peptide"
QGHSEPAFHY

SEQ ID NO: 3812 - protein, 10 aa, Artificial Sequence
  source: /note="Description of Artificial Sequence: Synthetic peptide"
EPAFHYLEAL

SEQ ID NO: 3813 - protein, 10 aa, Artificial Sequence
  source: /note="Description of Artificial Sequence: Synthetic peptide"
MPQGHSEPAF

SEQ ID NO: 3814 - protein, 10 aa, Artificial Sequence
  source: /note="Description of Artificial Sequence: Synthetic peptide"
SEPAFHYLEA

SEQ ID NO: 3815 - protein, 9 aa, Artificial Sequence
  source: /note="Description of Artificial Sequence: Synthetic peptide"
IDLSWRDTI

SEQ ID NO: 3816 - protein, 9 aa, Artificial Sequence
  source: /note="Description of Artificial Sequence: Synthetic peptide"
SWRDTILNG

SEQ ID NO: 3817 - protein, 9 aa, Artificial Sequence
  source: /note="Description of Artificial Sequence: Synthetic peptide"
DTILNGTCV

SEQ ID NO: 3818 - protein, 10 aa, Artificial Sequence
  source: /note="Description of Artificial Sequence: Synthetic peptide"
IDLSWRDTIL

SEQ ID NO: 3819 - protein, 10 aa, Artificial Sequence
  source: /note="Description of Artificial Sequence: Synthetic peptide"
MAKTVGLPTR

SEQ ID NO: 3820 - protein, 10 aa, Artificial Sequence
  source: /note="Description of Artificial Sequence: Synthetic peptide"
LPTRHGSQNV

SEQ ID NO: 3821 - protein, 10 aa, Artificial Sequence
  source: /note="Description of Artificial Sequence: Synthetic peptide"
VHRIIHTGEK

SEQ ID NO: 3822 - protein, 10 aa, Artificial Sequence
  source: /note="Description of Artificial Sequence: Synthetic peptide"
QSANLYVHRI

SEQ ID NO: 3823 - protein, 9 aa, Artificial Sequence
  source: /note="Description of Artificial Sequence: Synthetic peptide"
KTVTDTVRR

SEQ ID NO: 3824 - protein, 10 aa, Artificial Sequence
  source: /note="Description of Artificial Sequence: Synthetic peptide"
VTDTVRRALV

SEQ ID NO: 3825 - protein, 10 aa, Artificial Sequence
  source: /note="Description of Artificial Sequence: Synthetic peptide"
AAKTVTDTVR

SEQ ID NO: 3826 - protein, 10 aa, Artificial Sequence
  source: /note="Description of Artificial Sequence: Synthetic peptide"
DAAKTVTDTV

SEQ ID NO: 3827 - protein, 10 aa, Artificial Sequence
  source: /note="Description of Artificial Sequence: Synthetic peptide"
TVTDTVRRAL

SEQ ID NO: 3828 - protein, 9 aa, Artificial Sequence
  source: /note="Description of Artificial Sequence: Synthetic peptide"
HMWRAIQTA

SEQ ID NO: 3829 - protein, 9 aa, Artificial Sequence
  source: /note="Description of Artificial Sequence: Synthetic peptide"
IQTAFKNRK

SEQ ID NO: 3830 - protein, 9 aa, Artificial Sequence
  source: /note="Description of Artificial Sequence: Synthetic peptide"
MWRAIQTAF

SEQ ID NO: 3831 - protein, 9 aa, Artificial Sequence
  source: /note="Description of Artificial Sequence: Synthetic peptide"
AIQTAFKNR

SEQ ID NO: 3832 - protein, 9 aa, Artificial Sequence
  source: /note="Description of Artificial Sequence: Synthetic peptide"
QTAFKNRKR

SEQ ID NO: 3833 - protein, 10 aa, Artificial Sequence
  source: /note="Description of Artificial Sequence: Synthetic peptide"
MWRAIQTAFK

SEQ ID NO: 3834 - protein, 10 aa, Artificial Sequence
  source: /note="Description of Artificial Sequence: Synthetic peptide"
AIQTAFKNRK

SEQ ID NO: 3835 - protein, 10 aa, Artificial Sequence
  source: /note="Description of Artificial Sequence: Synthetic peptide"
HMWRAIQTAF

SEQ ID NO: 3836 - protein, 10 aa, Artificial Sequence
  source: /note="Description of Artificial Sequence: Synthetic peptide"
KQHMWRAIQT

SEQ ID NO: 3837 - protein, 10 aa, Artificial Sequence
  source: /note="Description of Artificial Sequence: Synthetic peptide"
RAIQTAFKNR

SEQ ID NO: 3838 - protein, 10 aa, Artificial Sequence
  source: /note="Description of Artificial Sequence: Synthetic peptide"
QHMWRAIQTA

SEQ ID NO: 3839 - protein, 9 aa, Artificial Sequence
  source: /note="Description of Artificial Sequence: Synthetic peptide"
MVIFILFFY

SEQ ID NO: 3840 - protein, 9 aa, Artificial Sequence
  source: /note="Description of Artificial Sequence: Synthetic peptide"
VIFILFFYM

SEQ ID NO: 3841 - protein, 9 aa, Artificial Sequence
  source: /note="Description of Artificial Sequence: Synthetic peptide"
ILFFYMAYL

SEQ ID NO: 3842 - protein, 9 aa, Artificial Sequence
  source: /note="Description of Artificial Sequence: Synthetic peptide"
LFFYMAYLW

SEQ ID NO: 3843 - protein, 9 aa, Artificial Sequence
  source: /note="Description of Artificial Sequence: Synthetic peptide"
FILFFYMAY

SEQ ID NO: 3844 - protein, 10 aa, Artificial Sequence
  source: /note="Description of Artificial Sequence: Synthetic peptide"
MVIFILFFYM

SEQ ID NO: 3845 - protein, 10 aa, Artificial Sequence
  source: /note="Description of Artificial Sequence: Synthetic peptide"
VIFILFFYMA

SEQ ID NO: 3846 - protein, 10 aa, Artificial Sequence
  source: /note="Description of Artificial Sequence: Synthetic peptide"
FILFFYMAYL

SEQ ID NO: 3847 - protein, 10 aa, Artificial Sequence
  source: /note="Description of Artificial Sequence: Synthetic peptide"
ILFFYMAYLW

SEQ ID NO: 3848 - protein, 10 aa, Artificial Sequence
  source: /note="Description of Artificial Sequence: Synthetic peptide"
FMVIFILFFY

SEQ ID NO: 3849 - protein, 10 aa, Artificial Sequence
  source: /note="Description of Artificial Sequence: Synthetic peptide"
IFILFFYMAY

SEQ ID NO: 3850 - protein, 9 aa, Artificial Sequence
  source: /note="Description of Artificial Sequence: Synthetic peptide"
KLKCTGSSL

SEQ ID NO: 3851 - protein, 9 aa, Artificial Sequence
  source: /note="Description of Artificial Sequence: Synthetic peptide"
CTGSSLFLK

SEQ ID NO: 3852 - protein, 9 aa, Artificial Sequence
  source: /note="Description of Artificial Sequence: Synthetic peptide"
TGSSLFLKK

SEQ ID NO: 3853 - protein, 9 aa, Artificial Sequence
  source: /note="Description of Artificial Sequence: Synthetic peptide"
LKCTGSSLF

SEQ ID NO: 3854 - protein, 10 aa, Artificial Sequence
  source: /note="Description of Artificial Sequence: Synthetic peptide"
FLSQGKLKCT

SEQ ID NO: 3855 - protein, 10 aa, Artificial Sequence
  source: /note="Description of Artificial Sequence: Synthetic peptide"
CTGSSLFLKK

SEQ ID NO: 3856 - protein, 10 aa, Artificial Sequence
  source: /note="Description of Artificial Sequence: Synthetic peptide"
KCTGSSLFLK

SEQ ID NO: 3857 - protein, 10 aa, Artificial Sequence
  source: /note="Description of Artificial Sequence: Synthetic peptide"
KLKCTGSSLF

SEQ ID NO: 3858 - protein, 10 aa, Artificial Sequence
  source: /note="Description of Artificial Sequence: Synthetic peptide"
GKLKCTGSSL

SEQ ID NO: 3859 - protein, 10 aa, Artificial Sequence
  source: /note="Description of Artificial Sequence: Synthetic peptide"
LKCTGSSLFL

SEQ ID NO: 3860 - protein, 9 aa, Artificial Sequence
  source: /note="Description of Artificial Sequence: Synthetic peptide"
ALWQQQICA

SEQ ID NO: 3861 - protein, 9 aa, Artificial Sequence
  source: /note="Description of Artificial Sequence: Synthetic peptide"
WQQQICAIA

SEQ ID NO: 3862 - protein, 10 aa, Artificial Sequence
  source: /note="Description of Artificial Sequence: Synthetic peptide"
ALWQQQICAI

SEQ ID NO: 3863 - protein, 9 aa, Artificial Sequence
  source: /note="Description of Artificial Sequence: Synthetic peptide"
AGFAFSIFK

SEQ ID NO: 3864 - protein, 9 aa, Artificial Sequence
  source: /note="Description of Artificial Sequence: Synthetic peptide"
IFKSDIPFI

SEQ ID NO: 3865 - protein, 9 aa, Artificial Sequence
  source: /note="Description of Artificial Sequence: Synthetic peptide"
SIFKSDIPF

SEQ ID NO: 3866 - protein, 9 aa, Artificial Sequence
  source: /note="Description of Artificial Sequence: Synthetic peptide"
FKSDIPFIF

SEQ ID NO: 3867 - protein, 10 aa, Artificial Sequence
  source: /note="Description of Artificial Sequence: Synthetic peptide"
SIFKSDIPFI

SEQ ID NO: 3868 - protein, 10 aa, Artificial Sequence
  source: /note="Description of Artificial Sequence: Synthetic peptide"
VAGFAFSIFK

SEQ ID NO: 3869 - protein, 10 aa, Artificial Sequence
  source: /note="Description of Artificial Sequence: Synthetic peptide"
IFKSDIPFIF

SEQ ID NO: 3870 - protein, 10 aa, Artificial Sequence
  source: /note="Description of Artificial Sequence: Synthetic peptide"
KSDIPFIFTF

SEQ ID NO: 3871 - protein, 10 aa, Artificial Sequence
  source: /note="Description of Artificial Sequence: Synthetic peptide"
FAFSIFKSDI

SEQ ID NO: 3872 - protein, 10 aa, Artificial Sequence
  source: /note="Description of Artificial Sequence: Synthetic peptide"
FSIFKSDIPF

SEQ ID NO: 3873 - protein, 9 aa, Artificial Sequence
  source: /note="Description of Artificial Sequence: Synthetic peptide"
RTINVRFLL

SEQ ID NO: 3874 - protein, 9 aa, Artificial Sequence
  source: /note="Description of Artificial Sequence: Synthetic peptide"
FLLEIIGVV

SEQ ID NO: 3875 - protein, 9 aa, Artificial Sequence
  source: /note="Description of Artificial Sequence: Synthetic peptide"
RFLLEIIGV

SEQ ID NO: 3876 - protein, 9 aa, Artificial Sequence
  source: /note="Description of Artificial Sequence: Synthetic peptide"
INVRFLLEI

SEQ ID NO: 3877 - protein, 10 aa, Artificial Sequence
  source: /note="Description of Artificial Sequence: Synthetic peptide"
FLLEIIGVVS

SEQ ID NO: 3878 - protein, 10 aa, Artificial Sequence
  source: /note="Description of Artificial Sequence: Synthetic peptide"
TINVRFLLEI

SEQ ID NO: 3879 - protein, 10 aa, Artificial Sequence
  source: /note="Description of Artificial Sequence: Synthetic peptide"
RFLLEIIGVV

SEQ ID NO: 3880 - protein, 10 aa, Artificial Sequence
  source: /note="Description of Artificial Sequence: Synthetic peptide"
RTINVRFLLE

SEQ ID NO: 3881 - protein, 9 aa, Artificial Sequence
  source: /note="Description of Artificial Sequence: Synthetic peptide"
TLVGERGPV

SEQ ID NO: 3882 - protein, 9 aa, Artificial Sequence
  source: /note="Description of Artificial Sequence: Synthetic peptide"
GERGPVEWW

SEQ ID NO: 3883 - protein, 9 aa, Artificial Sequence
  source: /note="Description of Artificial Sequence: Synthetic peptide"
AEAEDRHCT

SEQ ID NO: 3884 - protein, 10 aa, Artificial Sequence
  source: /note="Description of Artificial Sequence: Synthetic peptide"
DTLVGERGPV

SEQ ID NO: 3885 - protein, 10 aa, Artificial Sequence
  source: /note="Description of Artificial Sequence: Synthetic peptide"
GERGPVEWWA

SEQ ID NO: 3886 - protein, 9 aa, Artificial Sequence
  source: /note="Description of Artificial Sequence: Synthetic peptide"
FLQGVALAV

SEQ ID NO: 3887 - protein, 9 aa, Artificial Sequence
  source: /note="Description of Artificial Sequence: Synthetic peptide"
FLKFLQGVA

SEQ ID NO: 3888 - protein, 9 aa, Artificial Sequence
  source: /note="Description of Artificial Sequence: Synthetic peptide"
LKFLQGVAL

SEQ ID NO: 3889 - protein, 10 aa, Artificial Sequence
  source: /note="Description of Artificial Sequence: Synthetic peptide"
YVFLKFLQGV

SEQ ID NO: 3890 - protein, 10 aa, Artificial Sequence
  source: /note="Description of Artificial Sequence: Synthetic peptide"
FLKFLQGVAL

SEQ ID NO: 3891 - protein, 10 aa, Artificial Sequence
  source: /note="Description of Artificial Sequence: Synthetic peptide"
KFLQGVALAV

SEQ ID NO: 3892 - protein, 10 aa, Artificial Sequence
  source: /note="Description of Artificial Sequence: Synthetic peptide"
LKFLQGVALA

SEQ ID NO: 3893 - protein, 9 aa, Artificial Sequence
  source: /note="Description of Artificial Sequence: Synthetic peptide"
NVRTVHAFA

SEQ ID NO: 3894 - protein, 9 aa, Artificial Sequence
  source: /note="Description of Artificial Sequence: Synthetic peptide"
GNVRTVHAF

SEQ ID NO: 3895 - protein, 9 aa, Artificial Sequence
  source: /note="Description of Artificial Sequence: Synthetic peptide"
VRTVHAFAM

SEQ ID NO: 3896 - protein, 10 aa, Artificial Sequence
  source: /note="Description of Artificial Sequence: Synthetic peptide"
ALGNVRTVHA

SEQ ID NO: 3897 - protein, 10 aa, Artificial Sequence
  source: /note="Description of Artificial Sequence: Synthetic peptide"
TVHAFAMEQR

SEQ ID NO: 3898 - protein, 10 aa, Artificial Sequence
  source: /note="Description of Artificial Sequence: Synthetic peptide"
NVRTVHAFAM

SEQ ID NO: 3899 - protein, 10 aa, Artificial Sequence
  source: /note="Description of Artificial Sequence: Synthetic peptide"
LGNVRTVHAF

SEQ ID NO: 3900 - protein, 9 aa, Artificial Sequence
  source: /note="Description of Artificial Sequence: Synthetic peptide"
SLDWIQLFL

SEQ ID NO: 3901 - protein, 9 aa, Artificial Sequence
  source: /note="Description of Artificial Sequence: Synthetic peptide"
VSLDWIQLF

SEQ ID NO: 3902 - protein, 9 aa, Artificial Sequence
  source: /note="Description of Artificial Sequence: Synthetic peptide"
DWIQLFLDL

SEQ ID NO: 3903 - protein, 9 aa, Artificial Sequence
  source: /note="Description of Artificial Sequence: Synthetic peptide"
LEAKVSLDW

SEQ ID NO: 3904 - protein, 10 aa, Artificial Sequence
  source: /note="Description of Artificial Sequence: Synthetic peptide"
KVSLDWIQLF

SEQ ID NO: 3905 - protein, 10 aa, Artificial Sequence
  source: /note="Description of Artificial Sequence: Synthetic peptide"
AKVSLDWIQL

SEQ ID NO: 3906 - protein, 10 aa, Artificial Sequence
  source: /note="Description of Artificial Sequence: Synthetic peptide"
LEAKVSLDWI

SEQ ID NO: 3907 - protein, 10 aa, Artificial Sequence
  source: /note="Description of Artificial Sequence: Synthetic peptide"
LDWIQLFLDL

SEQ ID NO: 3908 - protein, 9 aa, Artificial Sequence
  source: /note="Description of Artificial Sequence: Synthetic peptide"
IFLRRYFWK

SEQ ID NO: 3909 - protein, 9 aa, Artificial Sequence
  source: /note="Description of Artificial Sequence: Synthetic peptide"
FIFLRRYFW

SEQ ID NO: 3910 - protein, 9 aa, Artificial Sequence
  source: /note="Description of Artificial Sequence: Synthetic peptide"
RYFWKRQEM

SEQ ID NO: 3911 - protein, 9 aa, Artificial Sequence
  source: /note="Description of Artificial Sequence: Synthetic peptide"
FLRRYFWKR

SEQ ID NO: 3912 - protein, 10 aa, Artificial Sequence
  source: /note="Description of Artificial Sequence: Synthetic peptide"
FIFLRRYFWK

SEQ ID NO: 3913 - protein, 10 aa, Artificial Sequence
  source: /note="Description of Artificial Sequence: Synthetic peptide"
IFIFLRRYFW

SEQ ID NO: 3914 - protein, 10 aa, Artificial Sequence
  source: /note="Description of Artificial Sequence: Synthetic peptide"
IFLRRYFWKR

SEQ ID NO: 3915 - protein, 10 aa, Artificial Sequence
  source: /note="Description of Artificial Sequence: Synthetic peptide"
RRYFWKRQEM

SEQ ID NO: 3916 - protein, 9 aa, Artificial Sequence
  source: /note="Description of Artificial Sequence: Synthetic peptide"
WLCGWTSSA

SEQ ID NO: 3917 - protein, 9 aa, Artificial Sequence
  source: /note="Description of Artificial Sequence: Synthetic peptide"
SASPSSPPR

SEQ ID NO: 3918 - protein, 9 aa, Artificial Sequence
  source: /note="Description of Artificial Sequence: Synthetic peptide"
RVRCGGWLC

SEQ ID NO: 3919 - protein, 9 aa, Artificial Sequence
  source: /note="Description of Artificial Sequence: Synthetic peptide"
NQAPFFCLR

SEQ ID NO: 3920 - protein, 9 aa, Artificial Sequence
  source: /note="Description of Artificial Sequence: Synthetic peptide"
QAPFFCLRV

SEQ ID NO: 3921 - protein, 10 aa, Artificial Sequence
  source: /note="Description of Artificial Sequence: Synthetic peptide"
NQAPFFCLRV

SEQ ID NO: 3922 - protein, 10 aa, Artificial Sequence
  source: /note="Description of Artificial Sequence: Synthetic peptide"
SSASPSSPPR

SEQ ID NO: 3923 - protein, 10 aa, Artificial Sequence
  source: /note="Description of Artificial Sequence: Synthetic peptide"
RVRCGGWLCG

SEQ ID NO: 3924 - protein, 10 aa, Artificial Sequence
  source: /note="Description of Artificial Sequence: Synthetic peptide"
DNQAPFFCLR

SEQ ID NO: 3925 - protein, 10 aa, Artificial Sequence
  source: /note="Description of Artificial Sequence: Synthetic peptide"
CLRVRCGGWL

SEQ ID NO: 3926 - protein, 9 aa, Artificial Sequence
  source: /note="Description of Artificial Sequence: Synthetic peptide"
IKLLKLCAW

SEQ ID NO: 3927 - protein, 9 aa, Artificial Sequence
  source: /note="Description of Artificial Sequence: Synthetic peptide"
LKLCAWENI

SEQ ID NO: 3928 - protein, 9 aa, Artificial Sequence
  source: /note="Description of Artificial Sequence: Synthetic peptide"
KLCAWENIF

SEQ ID NO: 3929 - protein, 10 aa, Artificial Sequence
  source: /note="Description of Artificial Sequence: Synthetic peptide"
LLKLCAWENI

SEQ ID NO: 3930 - protein, 10 aa, Artificial Sequence
  source: /note="Description of Artificial Sequence: Synthetic peptide"
KLCAWENIFR

SEQ ID NO: 3931 - protein, 10 aa, Artificial Sequence
  source: /note="Description of Artificial Sequence: Synthetic peptide"
CAWENIFRTR

SEQ ID NO: 3932 - protein, 10 aa, Artificial Sequence
  source: /note="Description of Artificial Sequence: Synthetic peptide"
LKLCAWENIF

SEQ ID NO: 3933 - protein, 9 aa, Artificial Sequence
  source: /note="Description of Artificial Sequence: Synthetic peptide"
AVIVLPAPI

SEQ ID NO: 3934 - protein, 9 aa, Artificial Sequence
  source: /note="Description of Artificial Sequence: Synthetic peptide"
IVLPAPIQY

SEQ ID NO: 3935 - protein, 9 aa, Artificial Sequence
  source: /note="Description of Artificial Sequence: Synthetic peptide"
VLPAPIQYF

SEQ ID NO: 3936 - protein, 9 aa, Artificial Sequence
  source: /note="Description of Artificial Sequence: Synthetic peptide"
LPAPIQYFI

SEQ ID NO: 3937 - protein, 10 aa, Artificial Sequence
  source: /note="Description of Artificial Sequence: Synthetic peptide"
VLPAPIQYFI

SEQ ID NO: 3938 - protein, 10 aa, Artificial Sequence
  source: /note="Description of Artificial Sequence: Synthetic peptide"
IVLPAPIQYF

SEQ ID NO: 3939 - protein, 10 aa, Artificial Sequence
  source: /note="Description of Artificial Sequence: Synthetic peptide"
AAVIVLPAPI

SEQ ID NO: 3940 - protein, 10 aa, Artificial Sequence
  source: /note="Description of Artificial Sequence: Synthetic peptide"
VIVLPAPIQY

SEQ ID NO: 3941 - protein, 10 aa, Artificial Sequence
  source: /note="Description of Artificial Sequence: Synthetic peptide"
LPAPIQYFIA

SEQ ID NO: 3942 - protein, 9 aa, Artificial Sequence
  source: /note="Description of Artificial Sequence: Synthetic peptide"
LPGGEKQRI

SEQ ID NO: 3943 - protein, 10 aa, Artificial Sequence
  source: /note="Description of Artificial Sequence: Synthetic peptide"
DVLPGGEKQR

SEQ ID NO: 3944 - protein, 9 aa, Artificial Sequence
  source: /note="Description of Artificial Sequence: Synthetic peptide"
RLVAQAYRL

SEQ ID NO: 3945 - protein, 9 aa, Artificial Sequence
  source: /note="Description of Artificial Sequence: Synthetic peptide"
VAQAYRLYF

SEQ ID NO: 3946 - protein, 9 aa, Artificial Sequence
  source: /note="Description of Artificial Sequence: Synthetic peptide"
RSRLVAQAY

SEQ ID NO: 3947 - protein, 9 aa, Artificial Sequence
  source: /note="Description of Artificial Sequence: Synthetic peptide"
LVAQAYRLY

SEQ ID NO: 3948 - protein, 10 aa, Artificial Sequence
  source: /note="Description of Artificial Sequence: Synthetic peptide"
RLVAQAYRLY

SEQ ID NO: 3949 - protein, 10 aa, Artificial Sequence
  source: /note="Description of Artificial Sequence: Synthetic peptide"
RSRLVAQAYR

SEQ ID NO: 3950 - protein, 10 aa, Artificial Sequence
  source: /note="Description of Artificial Sequence: Synthetic peptide"
LVAQAYRLYF

SEQ ID NO: 3951 - protein, 10 aa, Artificial Sequence
  source: /note="Description of Artificial Sequence: Synthetic peptide"
SFRSRLVAQA

SEQ ID NO: 3952 - protein, 10 aa, Artificial Sequence
  source: /note="Description of Artificial Sequence: Synthetic peptide"
FRSRLVAQAY

SEQ ID NO: 3953 - protein, 10 aa, Artificial Sequence
  source: /note="Description of Artificial Sequence: Synthetic peptide"
SRLVAQAYRL

SEQ ID NO: 3954 - protein, 9 aa, Artificial Sequence
  source: /note="Description of Artificial Sequence: Synthetic peptide"
DPAWAPNNY

SEQ ID NO: 3955 - protein, 10 aa, Artificial Sequence
  source: /note="Description of Artificial Sequence: Synthetic peptide"
AWAPNNYIEK

SEQ ID NO: 3956 - protein, 10 aa, Artificial Sequence
  source: /note="Description of Artificial Sequence: Synthetic peptide"
WAPNNYIEKV

SEQ ID NO: 3957 - protein, 10 aa, Artificial Sequence
  source: /note="Description of Artificial Sequence: Synthetic peptide"
DPAWAPNNYI

SEQ ID NO: 3958 - protein, 9 aa, Artificial Sequence
  source: /note="Description of Artificial Sequence: Synthetic peptide"
LQQPQTRGI

SEQ ID NO: 3959 - protein, 10 aa, Artificial Sequence
  source: /note="Description of Artificial Sequence: Synthetic peptide"
QTRGIRGSSA

SEQ ID NO: 3960 - protein, 9 aa, Artificial Sequence
  source: /note="Description of Artificial Sequence: Synthetic peptide"
CALPPRAPR

SEQ ID NO: 3961 - protein, 10 aa, Artificial Sequence
  source: /note="Description of Artificial Sequence: Synthetic peptide"
LLADCALPPR

SEQ ID NO: 3962 - protein, 10 aa, Artificial Sequence
  source: /note="Description of Artificial Sequence: Synthetic peptide"
DCALPPRAPR

SEQ ID NO: 3963 - protein, 9 aa, Artificial Sequence
  source: /note="Description of Artificial Sequence: Synthetic peptide"
GLAEEICHM

SEQ ID NO: 3964 - protein, 9 aa, Artificial Sequence
  source: /note="Description of Artificial Sequence: Synthetic peptide"
EICHMFHVA

SEQ ID NO: 3965 - protein, 9 aa, Artificial Sequence
  source: /note="Description of Artificial Sequence: Synthetic peptide"
LAEEICHMF

SEQ ID NO: 3966 - protein, 9 aa, Artificial Sequence
  source: /note="Description of Artificial Sequence: Synthetic peptide"
ICHMFHVAW

SEQ ID NO: 3967 - protein, 9 aa, Artificial Sequence
  source: /note="Description of Artificial Sequence: Synthetic peptide"
EEICHMFHV

SEQ ID NO: 3968 - protein, 10 aa, Artificial Sequence
  source: /note="Description of Artificial Sequence: Synthetic peptide"
GLAEEICHMF

SEQ ID NO: 3969 - protein, 10 aa, Artificial Sequence
  source: /note="Description of Artificial Sequence: Synthetic peptide"
IGLAEEICHM

SEQ ID NO: 3970 - protein, 10 aa, Artificial Sequence
  source: /note="Description of Artificial Sequence: Synthetic peptide"
EEICHMFHVA

SEQ ID NO: 3971 - protein, 10 aa, Artificial Sequence
  source: /note="Description of Artificial Sequence: Synthetic peptide"
AEEICHMFHV

SEQ ID NO: 3972 - protein, 9 aa, Artificial Sequence
  source: /note="Description of Artificial Sequence: Synthetic peptide"
ILQWKTART

SEQ ID NO: 3973 - protein, 9 aa, Artificial Sequence
  source: /note="Description of Artificial Sequence: Synthetic peptide"
VISDILQWK

SEQ ID NO: 3974 - protein, 9 aa, Artificial Sequence
  source: /note="Description of Artificial Sequence: Synthetic peptide"
QWKTARTFL

SEQ ID NO: 3975 - protein, 9 aa, Artificial Sequence
  source: /note="Description of Artificial Sequence: Synthetic peptide"
DILQWKTAR

SEQ ID NO: 3976 - protein, 9 aa, Artificial Sequence
  source: /note="Description of Artificial Sequence: Synthetic peptide"
LQWKTARTF

SEQ ID NO: 3977 - protein, 10 aa, Artificial Sequence
  source: /note="Description of Artificial Sequence: Synthetic peptide"
GVISDILQWK

SEQ ID NO: 3978 - protein, 10 aa, Artificial Sequence
  source: /note="Description of Artificial Sequence: Synthetic peptide"
ILQWKTARTF

SEQ ID NO: 3979 - protein, 10 aa, Artificial Sequence
  source: /note="Description of Artificial Sequence: Synthetic peptide"
QWKTARTFLY

SEQ ID NO: 3980 - protein, 10 aa, Artificial Sequence
  source: /note="Description of Artificial Sequence: Synthetic peptide"
LQWKTARTFL

SEQ ID NO: 3981 - protein, 9 aa, Artificial Sequence
  source: /note="Description of Artificial Sequence: Synthetic peptide"
SSRRCLLPT

SEQ ID NO: 3982 - protein, 9 aa, Artificial Sequence
  source: /note="Description of Artificial Sequence: Synthetic peptide"
RFGGIGSSR

SEQ ID NO: 3983 - protein, 9 aa, Artificial Sequence
  source: /note="Description of Artificial Sequence: Synthetic peptide"
RCLLPTTGL

SEQ ID NO: 3984 - protein, 10 aa, Artificial Sequence
  source: /note="Description of Artificial Sequence: Synthetic peptide"
SSRRCLLPTT

SEQ ID NO: 3985 - protein, 10 aa, Artificial Sequence
  source: /note="Description of Artificial Sequence: Synthetic peptide"
AEFVTRFGGI

SEQ ID NO: 3986 - protein, 10 aa, Artificial Sequence
  source: /note="Description of Artificial Sequence: Synthetic peptide"
RRCLLPTTGL

SEQ ID NO: 3987 - protein, 9 aa, Artificial Sequence
  source: /note="Description of Artificial Sequence: Synthetic peptide"
QQKECQATA

SEQ ID NO: 3988 - protein, 10 aa, Artificial Sequence
  source: /note="Description of Artificial Sequence: Synthetic peptide"
QQKECQATAR

SEQ ID NO: 3989 - protein, 10 aa, Artificial Sequence
  source: /note="Description of Artificial Sequence: Synthetic peptide"
CQATARKFAR

SEQ ID NO: 3990 - protein, 10 aa, Artificial Sequence
  source: /note="Description of Artificial Sequence: Synthetic peptide"
KECQATARKF

SEQ ID NO: 3991 - protein, 10 aa, Artificial Sequence
  source: /note="Description of Artificial Sequence: Synthetic peptide"
TEQQKECQAT

SEQ ID NO: 3992 - protein, 9 aa, Artificial Sequence
  source: /note="Description of Artificial Sequence: Synthetic peptide"
RLLTWHAAM

SEQ ID NO: 3993 - protein, 9 aa, Artificial Sequence
  source: /note="Description of Artificial Sequence: Synthetic peptide"
LLTWHAAML

SEQ ID NO: 3994 - protein, 9 aa, Artificial Sequence
  source: /note="Description of Artificial Sequence: Synthetic peptide"
LTWHAAMLK

SEQ ID NO: 3995 - protein, 9 aa, Artificial Sequence
  source: /note="Description of Artificial Sequence: Synthetic peptide"
HAAMLKDNK

SEQ ID NO: 3996 - protein, 9 aa, Artificial Sequence
  source: /note="Description of Artificial Sequence: Synthetic peptide"
SARLLTWHA

SEQ ID NO: 3997 - protein, 9 aa, Artificial Sequence
  source: /note="Description of Artificial Sequence: Synthetic peptide"
ARLLTWHAA

SEQ ID NO: 3998 - protein, 10 aa, Artificial Sequence
  source: /note="Description of Artificial Sequence: Synthetic peptide"
RLLTWHAAML

SEQ ID NO: 3999 - protein, 10 aa, Artificial Sequence
  source: /note="Description of Artificial Sequence: Synthetic peptide"
LLTWHAAMLK

SEQ ID NO: 4000 - protein, 10 aa, Artificial Sequence
  source: /note="Description of Artificial Sequence: Synthetic peptide"
SARLLTWHAA

SEQ ID NO: 4001 - protein, 10 aa, Artificial Sequence
  source: /note="Description of Artificial Sequence: Synthetic peptide"
HAAMLKDNKK

SEQ ID NO: 4002 - protein, 10 aa, Artificial Sequence
  source: /note="Description of Artificial Sequence: Synthetic peptide"
ESARLLTWHA

SEQ ID NO: 4003 - protein, 10 aa, Artificial Sequence
  source: /note="Description of Artificial Sequence: Synthetic peptide"
LESARLLTWH

SEQ ID NO: 4004 - protein, 10 aa, Artificial Sequence
  source: /note="Description of Artificial Sequence: Synthetic peptide"
ARLLTWHAAM

SEQ ID NO: 4005 - protein, 9 aa, Artificial Sequence
  source: /note="Description of Artificial Sequence: Synthetic peptide"
REEEERLRL

SEQ ID NO: 4006 - protein, 9 aa, Artificial Sequence
  source: /note="Description of Artificial Sequence: Synthetic peptide"
VQDKLREIV

SEQ ID NO: 4007 - protein, 10 aa, Artificial Sequence
  source: /note="Description of Artificial Sequence: Synthetic peptide"
SIHVNHVQDK

SEQ ID NO: 4008 - protein, 10 aa, Artificial Sequence
  source: /note="Description of Artificial Sequence: Synthetic peptide"
HVNHVQDKLR

SEQ ID NO: 4009 - protein, 9 aa, Artificial Sequence
  source: /note="Description of Artificial Sequence: Synthetic peptide"
SLTRPHPEV

SEQ ID NO: 4010 - protein, 9 aa, Artificial Sequence
  source: /note="Description of Artificial Sequence: Synthetic peptide"
LLKIPIMGM

SEQ ID NO: 4011 - protein, 9 aa, Artificial Sequence
  source: /note="Description of Artificial Sequence: Synthetic peptide"
TLRRCTSSV

SEQ ID NO: 4012 - protein, 9 aa, Artificial Sequence
  source: /note="Description of Artificial Sequence: Synthetic peptide"
IMGMTLTLR

SEQ ID NO: 4013 - protein, 9 aa, Artificial Sequence
  source: /note="Description of Artificial Sequence: Synthetic peptide"
MGMTLTLRR

SEQ ID NO: 4014 - protein, 9 aa, Artificial Sequence
  source: /note="Description of Artificial Sequence: Synthetic peptide"
SSVSGAAER

SEQ ID NO: 4015 - protein, 9 aa, Artificial Sequence
  source: /note="Description of Artificial Sequence: Synthetic peptide"
RSWRRPTEA

SEQ ID NO: 4016 - protein, 9 aa, Artificial Sequence
  source: /note="Description of Artificial Sequence: Synthetic peptide"
LTRPHPEVL

SEQ ID NO: 4017 - protein, 9 aa, Artificial Sequence
  source: /note="Description of Artificial Sequence: Synthetic peptide"
GAAERSWRR

SEQ ID NO: 4018 - protein, 9 aa, Artificial Sequence
  source: /note="Description of Artificial Sequence: Synthetic peptide"
CTSSVSGAA

SEQ ID NO: 4019 - protein, 9 aa, Artificial Sequence
  source: /note="Description of Artificial Sequence: Synthetic peptide"
EVLHFSVGV

SEQ ID NO: 4020 - protein, 9 aa, Artificial Sequence
  source: /note="Description of Artificial Sequence: Synthetic peptide"
RPHPEVLHF

SEQ ID NO: 4021 - protein, 9 aa, Artificial Sequence
  source: /note="Description of Artificial Sequence: Synthetic peptide"
HPEVLHFSV

SEQ ID NO: 4022 - protein, 9 aa, Artificial Sequence
  source: /note="Description of Artificial Sequence: Synthetic peptide"
NLLLKIPIM

SEQ ID NO: 4023 - protein, 9 aa, Artificial Sequence
  source: /note="Description of Artificial Sequence: Synthetic peptide"
GSYDPQNNL

SEQ ID NO: 4024 - protein, 9 aa, Artificial Sequence
  source: /note="Description of Artificial Sequence: Synthetic peptide"
TEAGSCPAA

SEQ ID NO: 4025 - protein, 9 aa, Artificial Sequence
  source: /note="Description of Artificial Sequence: Synthetic peptide"
GSCPAAASL

SEQ ID NO: 4026 - protein, 9 aa, Artificial Sequence
  source: /note="Description of Artificial Sequence: Synthetic peptide"
AAASLTRPH

SEQ ID NO: 4027 - protein, 9 aa, Artificial Sequence
  source: /note="Description of Artificial Sequence: Synthetic peptide"
AERSWRRPT

SEQ ID NO: 4028 - protein, 10 aa, Artificial Sequence
  source: /note="Description of Artificial Sequence: Synthetic peptide"
LLLKIPIMGM

SEQ ID NO: 4029 - protein, 10 aa, Artificial Sequence
  source: /note="Description of Artificial Sequence: Synthetic peptide"
LTLRRCTSSV

SEQ ID NO: 4030 - protein, 10 aa, Artificial Sequence
  source: /note="Description of Artificial Sequence: Synthetic peptide"
SLTRPHPEVL

SEQ ID NO: 4031 - protein, 10 aa, Artificial Sequence
  source: /note="Description of Artificial Sequence: Synthetic peptide"
IMGMTLTLRR

SEQ ID NO: 4032 - protein, 10 aa, Artificial Sequence
  source: /note="Description of Artificial Sequence: Synthetic peptide"
SYDPQNNLLL

SEQ ID NO: 4033 - protein, 10 aa, Artificial Sequence
  source: /note="Description of Artificial Sequence: Synthetic peptide"
ASLTRPHPEV

SEQ ID NO: 4034 - protein, 10 aa, Artificial Sequence
  source: /note="Description of Artificial Sequence: Synthetic peptide"
LTRPHPEVLH

SEQ ID NO: 4035 - protein, 10 aa, Artificial Sequence
  source: /note="Description of Artificial Sequence: Synthetic peptide"
PIMGMTLTLR

SEQ ID NO: 4036 - protein, 10 aa, Artificial Sequence
  source: /note="Description of Artificial Sequence: Synthetic peptide"
SGAAERSWRR

SEQ ID NO: 4037 - protein, 10 aa, Artificial Sequence
  source: /note="Description of Artificial Sequence: Synthetic peptide"
IPIMGMTLTL

SEQ ID NO: 4038 - protein, 10 aa, Artificial Sequence
  source: /note="Description of Artificial Sequence: Synthetic peptide"
RPTEAGSCPA

SEQ ID NO: 4039 - protein, 10 aa, Artificial Sequence
  source: /note="Description of Artificial Sequence: Synthetic peptide"
GSYDPQNNLL

SEQ ID NO: 4040 - protein, 10 aa, Artificial Sequence
  source: /note="Description of Artificial Sequence: Synthetic peptide"
LKIPIMGMTL

SEQ ID NO: 4041 - protein, 10 aa, Artificial Sequence
  source: /note="Description of Artificial Sequence: Synthetic peptide"
TEAGSCPAAA

SEQ ID NO: 4042 - protein, 10 aa, Artificial Sequence
  source: /note="Description of Artificial Sequence: Synthetic peptide"
PEVLHFSVGV

SEQ ID NO: 4043 - protein, 10 aa, Artificial Sequence
  source: /note="Description of Artificial Sequence: Synthetic peptide"
DPQNNLLLKI

SEQ ID NO: 4044 - protein, 9 aa, Artificial Sequence
  source: /note="Description of Artificial Sequence: Synthetic peptide"
CLHQRRGAL

SEQ ID NO: 4045 - protein, 9 aa, Artificial Sequence
  source: /note="Description of Artificial Sequence: Synthetic peptide"
HQRRGALAE

SEQ ID NO: 4046 - protein, 9 aa, Artificial Sequence
  source: /note="Description of Artificial Sequence: Synthetic peptide"
QRRGALAEL

SEQ ID NO: 4047 - protein, 10 aa, Artificial Sequence
  source: /note="Description of Artificial Sequence: Synthetic peptide"
CLHQRRGALA

SEQ ID NO: 4048 - protein, 10 aa, Artificial Sequence
  source: /note="Description of Artificial Sequence: Synthetic peptide"
HQRRGALAEL

SEQ ID NO: 4049 - protein, 10 aa, Artificial Sequence
  source: /note="Description of Artificial Sequence: Synthetic peptide"
YCLHQRRGAL

SEQ ID NO: 4050 - protein, 9 aa, Artificial Sequence
  source: /note="Description of Artificial Sequence: Synthetic peptide"
TLVFWHGDR

SEQ ID NO: 4051 - protein, 9 aa, Artificial Sequence
  source: /note="Description of Artificial Sequence: Synthetic peptide"
LKFVTLVFW

SEQ ID NO: 4052 - protein, 9 aa, Artificial Sequence
  source: /note="Description of Artificial Sequence: Synthetic peptide"
FWHGDRSPI

SEQ ID NO: 4053 - protein, 10 aa, Artificial Sequence
  source: /note="Description of Artificial Sequence: Synthetic peptide"
VTLVFWHGDR

SEQ ID NO: 4054 - protein, 10 aa, Artificial Sequence
  source: /note="Description of Artificial Sequence: Synthetic peptide"
VFWHGDRSPI

SEQ ID NO: 4055 - protein, 9 aa, Artificial Sequence
  source: /note="Description of Artificial Sequence: Synthetic peptide"
HEQVYIQST

SEQ ID NO: 4056 - protein, 10 aa, Artificial Sequence
  source: /note="Description of Artificial Sequence: Synthetic peptide"
IQSTDVDRTL

SEQ ID NO: 4057 - protein, 9 aa, Artificial Sequence
  source: /note="Description of Artificial Sequence: Synthetic peptide"
HLTELYFKK

SEQ ID NO: 4058 - protein, 9 aa, Artificial Sequence
  source: /note="Description of Artificial Sequence: Synthetic peptide"
LYFKKGEYF

SEQ ID NO: 4059 - protein, 9 aa, Artificial Sequence
  source: /note="Description of Artificial Sequence: Synthetic peptide"
ELYFKKGEY

SEQ ID NO: 4060 - protein, 9 aa, Artificial Sequence
  source: /note="Description of Artificial Sequence: Synthetic peptide"
KKGEYFVEM

SEQ ID NO: 4061 - protein, 10 aa, Artificial Sequence
  source: /note="Description of Artificial Sequence: Synthetic peptide"
LYFKKGEYFV

SEQ ID NO: 4062 - protein, 10 aa, Artificial Sequence
  source: /note="Description of Artificial Sequence: Synthetic peptide"
SCHLTELYFK

SEQ ID NO: 4063 - protein, 10 aa, Artificial Sequence
  source: /note="Description of Artificial Sequence: Synthetic peptide"
ELYFKKGEYF

SEQ ID NO: 4064 - protein, 10 aa, Artificial Sequence
  source: /note="Description of Artificial Sequence: Synthetic peptide"
TELYFKKGEY

SEQ ID NO: 4065 - protein, 10 aa, Artificial Sequence
  source: /note="Description of Artificial Sequence: Synthetic peptide"
FKKGEYFVEM

SEQ ID NO: 4066 - protein, 10 aa, Artificial Sequence
  source: /note="Description of Artificial Sequence: Synthetic peptide"
KKGEYFVEMY

SEQ ID NO: 4067 - protein, 9 aa, Artificial Sequence
  source: /note="Description of Artificial Sequence: Synthetic peptide"
GIYTATCPY

SEQ ID NO: 4068 - protein, 9 aa, Artificial Sequence
  source: /note="Description of Artificial Sequence: Synthetic peptide"
IYTATCPYL

SEQ ID NO: 4069 - protein, 9 aa, Artificial Sequence
  source: /note="Description of Artificial Sequence: Synthetic peptide"
CPYLNWIAS

SEQ ID NO: 4070 - protein, 9 aa, Artificial Sequence
  source: /note="Description of Artificial Sequence: Synthetic peptide"
TATCPYLNW

SEQ ID NO: 4071 - protein, 10 aa, Artificial Sequence
  source: /note="Description of Artificial Sequence: Synthetic peptide"
GIYTATCPYL

SEQ ID NO: 4072 - protein, 10 aa, Artificial Sequence
  source: /note="Description of Artificial Sequence: Synthetic peptide"
YTATCPYLNW

SEQ ID NO: 4073 - protein, 10 aa, Artificial Sequence
  source: /note="Description of Artificial Sequence: Synthetic peptide"
TATCPYLNWI

SEQ ID NO: 4074 - protein, 9 aa, Artificial Sequence
  source: /note="Description of Artificial Sequence: Synthetic peptide"
NITWMAGAV

SEQ ID NO: 4075 - protein, 9 aa, Artificial Sequence
  source: /note="Description of Artificial Sequence: Synthetic peptide"
TWMAGAVTK

SEQ ID NO: 4076 - protein, 9 aa, Artificial Sequence
  source: /note="Description of Artificial Sequence: Synthetic peptide"
MAGAVTKDF

SEQ ID NO: 4077 - protein, 9 aa, Artificial Sequence
  source: /note="Description of Artificial Sequence: Synthetic peptide"
LSHDNITWM

SEQ ID NO: 4078 - protein, 10 aa, Artificial Sequence
  source: /note="Description of Artificial Sequence: Synthetic peptide"
MLSHDNITWM

SEQ ID NO: 4079 - protein, 10 aa, Artificial Sequence
  source: /note="Description of Artificial Sequence: Synthetic peptide"
ITWMAGAVTK

SEQ ID NO: 4080 - protein, 10 aa, Artificial Sequence
  source: /note="Description of Artificial Sequence: Synthetic peptide"
MAGAVTKDFK

SEQ ID NO: 4081 - protein, 10 aa, Artificial Sequence
  source: /note="Description of Artificial Sequence: Synthetic peptide"
DNITWMAGAV

SEQ ID NO: 4082 - protein, 10 aa, Artificial Sequence
  source: /note="Description of Artificial Sequence: Synthetic peptide"
WMAGAVTKDF

SEQ ID NO: 4083 - protein, 9 aa, Artificial Sequence
  source: /note="Description of Artificial Sequence: Synthetic peptide"
FMYNFQLVS

SEQ ID NO: 4084 - protein, 9 aa, Artificial Sequence
  source: /note="Description of Artificial Sequence: Synthetic peptide"
FQLVSLYAT

SEQ ID NO: 4085 - protein, 9 aa, Artificial Sequence
  source: /note="Description of Artificial Sequence: Synthetic peptide"
QLVSLYATL

SEQ ID NO: 4086 - protein, 9 aa, Artificial Sequence
  source: /note="Description of Artificial Sequence: Synthetic peptide"
MYNFQLVSL

SEQ ID NO: 4087 - protein, 9 aa, Artificial Sequence
  source: /note="Description of Artificial Sequence: Synthetic peptide"
YNFQLVSLY

SEQ ID NO: 4088 - protein, 10 aa, Artificial Sequence
  source: /note="Description of Artificial Sequence: Synthetic peptide"
FMYNFQLVSL

SEQ ID NO: 4089 - protein, 10 aa, Artificial Sequence
  source: /note="Description of Artificial Sequence: Synthetic peptide"
FQLVSLYATL

SEQ ID NO: 4090 - protein, 10 aa, Artificial Sequence
  source: /note="Description of Artificial Sequence: Synthetic peptide"
SLYATLGGPA

SEQ ID NO: 4091 - protein, 10 aa, Artificial Sequence
  source: /note="Description of Artificial Sequence: Synthetic peptide"
MYNFQLVSLY

SEQ ID NO: 4092 - protein, 10 aa, Artificial Sequence
  source: /note="Description of Artificial Sequence: Synthetic peptide"
YNFQLVSLYA

SEQ ID NO: 4093 - protein, 9 aa, Artificial Sequence
  source: /note="Description of Artificial Sequence: Synthetic peptide"
HQAYRHLLW

SEQ ID NO: 4094 - protein, 9 aa, Artificial Sequence
  source: /note="Description of Artificial Sequence: Synthetic peptide"
AYRHLLWLC

SEQ ID NO: 4095 - protein, 9 aa, Artificial Sequence
  source: /note="Description of Artificial Sequence: Synthetic peptide"
SSQHSRRLL

SEQ ID NO: 4096 - protein, 9 aa, Artificial Sequence
  source: /note="Description of Artificial Sequence: Synthetic peptide"
SQHSRRLLA

SEQ ID NO: 4097 - protein, 9 aa, Artificial Sequence
  source: /note="Description of Artificial Sequence: Synthetic peptide"
HSRRLLAPW

SEQ ID NO: 4098 - protein, 9 aa, Artificial Sequence
  source: /note="Description of Artificial Sequence: Synthetic peptide"
RLLAPWRPG

SEQ ID NO: 4099 - protein, 9 aa, Artificial Sequence
  source: /note="Description of Artificial Sequence: Synthetic peptide"
HQGQTHQAY

SEQ ID NO: 4100 - protein, 9 aa, Artificial Sequence
  source: /note="Description of Artificial Sequence: Synthetic peptide"
NVLPPRHRR

SEQ ID NO: 4101 - protein, 9 aa, Artificial Sequence
  source: /note="Description of Artificial Sequence: Synthetic peptide"
VLPPRHRRR

SEQ ID NO: 4102 - protein, 9 aa, Artificial Sequence
  source: /note="Description of Artificial Sequence: Synthetic peptide"
QGQTHQAYR

SEQ ID NO: 4103 - protein, 9 aa, Artificial Sequence
  source: /note="Description of Artificial Sequence: Synthetic peptide"
RHWHQGQTH

SEQ ID NO: 4104 - protein, 9 aa, Artificial Sequence
  source: /note="Description of Artificial Sequence: Synthetic peptide"
QAYRHLLWL

SEQ ID NO: 4105 - protein, 10 aa, Artificial Sequence
  source: /note="Description of Artificial Sequence: Synthetic peptide"
HQAYRHLLWL

SEQ ID NO: 4106 - protein, 10 aa, Artificial Sequence
  source: /note="Description of Artificial Sequence: Synthetic peptide"
THQAYRHLLW

SEQ ID NO: 4107 - protein, 10 aa, Artificial Sequence
  source: /note="Description of Artificial Sequence: Synthetic peptide"
QTHQAYRHLL

SEQ ID NO: 4108 - protein, 10 aa, Artificial Sequence
  source: /note="Description of Artificial Sequence: Synthetic peptide"
SSQHSRRLLA

SEQ ID NO: 4109 - protein, 10 aa, Artificial Sequence
  source: /note="Description of Artificial Sequence: Synthetic peptide"
HSRRLLAPWR

SEQ ID NO: 4110 - protein, 10 aa, Artificial Sequence
  source: /note="Description of Artificial Sequence: Synthetic peptide"
WHQGQTHQAY

SEQ ID NO: 4111 - protein, 10 aa, Artificial Sequence
  source: /note="Description of Artificial Sequence: Synthetic peptide"
NVLPPRHRRR

SEQ ID NO: 4112 - protein, 10 aa, Artificial Sequence
  source: /note="Description of Artificial Sequence: Synthetic peptide"
HQGQTHQAYR

SEQ ID NO: 4113 - protein, 10 aa, Artificial Sequence
  source: /note="Description of Artificial Sequence: Synthetic peptide"
HLLWLCGQSR

SEQ ID NO: 4114 - protein, 10 aa, Artificial Sequence
  source: /note="Description of Artificial Sequence: Synthetic peptide"
LAPWRPGNQR

SEQ ID NO: 4115 - protein, 10 aa, Artificial Sequence
  source: /note="Description of Artificial Sequence: Synthetic peptide"
GQTHQAYRHL

SEQ ID NO: 4116 - protein, 10 aa, Artificial Sequence
  source: /note="Description of Artificial Sequence: Synthetic peptide"
GQSRQDSSQH

SEQ ID NO: 4117 - protein, 10 aa, Artificial Sequence
  source: /note="Description of Artificial Sequence: Synthetic peptide"
SQHSRRLLAP

SEQ ID NO: 4118 - protein, 10 aa, Artificial Sequence
  source: /note="Description of Artificial Sequence: Synthetic peptide"
QHSRRLLAPW

SEQ ID NO: 4119 - protein, 9 aa, Artificial Sequence
  source: /note="Description of Artificial Sequence: Synthetic peptide"
GWLNFNKLL

SEQ ID NO: 4120 - protein, 9 aa, Artificial Sequence
  source: /note="Description of Artificial Sequence: Synthetic peptide"
FIGMESACI

SEQ ID NO: 4121 - protein, 9 aa, Artificial Sequence
  source: /note="Description of Artificial Sequence: Synthetic peptide"
SACIHETTY

SEQ ID NO: 4122 - protein, 9 aa, Artificial Sequence
  source: /note="Description of Artificial Sequence: Synthetic peptide"
ESACIHETT

SEQ ID NO: 4123 - protein, 9 aa, Artificial Sequence
  source: /note="Description of Artificial Sequence: Synthetic peptide"
MESACIHET

SEQ ID NO: 4124 - protein, 10 aa, Artificial Sequence
  source: /note="Description of Artificial Sequence: Synthetic peptide"
ESACIHETTY

SEQ ID NO: 4125 - protein, 10 aa, Artificial Sequence
  source: /note="Description of Artificial Sequence: Synthetic peptide"
CIHETTYNSI

SEQ ID NO: 4126 - protein, 10 aa, Artificial Sequence
  source: /note="Description of Artificial Sequence: Synthetic peptide"
SFIGMESACI

SEQ ID NO: 4127 - protein, 10 aa, Artificial Sequence
  source: /note="Description of Artificial Sequence: Synthetic peptide"
MESACIHETT

SEQ ID NO: 4128 - protein, 9 aa, Artificial Sequence
  source: /note="Description of Artificial Sequence: Synthetic peptide"
FPGDDAPRA

SEQ ID NO: 4129 - protein, 10 aa, Artificial Sequence
  source: /note="Description of Artificial Sequence: Synthetic peptide"
FPGDDAPRAV

SEQ ID NO: 4130 - protein, 9 aa, Artificial Sequence
  source: /note="Description of Artificial Sequence: Synthetic peptide"
KMGWLKTGI

SEQ ID NO: 4131 - protein, 9 aa, Artificial Sequence
  source: /note="Description of Artificial Sequence: Synthetic peptide"
GIVSKLFWI

SEQ ID NO: 4132 - protein, 9 aa, Artificial Sequence
  source: /note="Description of Artificial Sequence: Synthetic peptide"
WLKTGIVSK

SEQ ID NO: 4133 - protein, 9 aa, Artificial Sequence
  source: /note="Description of Artificial Sequence: Synthetic peptide"
KLFWIIPTK

SEQ ID NO: 4134 - protein, 9 aa, Artificial Sequence
  source: /note="Description of Artificial Sequence: Synthetic peptide"
ILFSCQRHR

SEQ ID NO: 4135 - protein, 9 aa, Artificial Sequence
  source: /note="Description of Artificial Sequence: Synthetic peptide"
VSILFSCQR

SEQ ID NO: 4136 - protein, 9 aa, Artificial Sequence
  source: /note="Description of Artificial Sequence: Synthetic peptide"
IVSKLFWII

SEQ ID NO: 4137 - protein, 9 aa, Artificial Sequence
  source: /note="Description of Artificial Sequence: Synthetic peptide"
NQKPVSILF

SEQ ID NO: 4138 - protein, 9 aa, Artificial Sequence
  source: /note="Description of Artificial Sequence: Synthetic peptide"
PTKCMSNQK

SEQ ID NO: 4139 - protein, 9 aa, Artificial Sequence
  source: /note="Description of Artificial Sequence: Synthetic peptide"
MEAISPLKM

SEQ ID NO: 4140 - protein, 9 aa, Artificial Sequence
  source: /note="Description of Artificial Sequence: Synthetic peptide"
LKTGIVSKL

SEQ ID NO: 4141 - protein, 9 aa, Artificial Sequence
  source: /note="Description of Artificial Sequence: Synthetic peptide"
SKLFWIIPT

SEQ ID NO: 4142 - protein, 9 aa, Artificial Sequence
  source: /note="Description of Artificial Sequence: Synthetic peptide"
MSNQKPVSI

SEQ ID NO: 4143 - protein, 10 aa, Artificial Sequence
  source: /note="Description of Artificial Sequence: Synthetic peptide"
KMGWLKTGIV

SEQ ID NO: 4144 - protein, 10 aa, Artificial Sequence
  source: /note="Description of Artificial Sequence: Synthetic peptide"
WLKTGIVSKL

SEQ ID NO: 4145 - protein, 10 aa, Artificial Sequence
  source: /note="Description of Artificial Sequence: Synthetic peptide"
GIVSKLFWII

SEQ ID NO: 4146 - protein, 10 aa, Artificial Sequence
  source: /note="Description of Artificial Sequence: Synthetic peptide"
KLFWIIPTKC

SEQ ID NO: 4147 - protein, 10 aa, Artificial Sequence
  source: /note="Description of Artificial Sequence: Synthetic peptide"
AISPLKMGWL

SEQ ID NO: 4148 - protein, 10 aa, Artificial Sequence
  source: /note="Description of Artificial Sequence: Synthetic peptide"
CMSNQKPVSI

SEQ ID NO: 4149 - protein, 10 aa, Artificial Sequence
  source: /note="Description of Artificial Sequence: Synthetic peptide"
ISPLKMGWLK

SEQ ID NO: 4150 - protein, 10 aa, Artificial Sequence
  source: /note="Description of Artificial Sequence: Synthetic peptide"
GWLKTGIVSK

SEQ ID NO: 4151 - protein, 10 aa, Artificial Sequence
  source: /note="Description of Artificial Sequence: Synthetic peptide"
SILFSCQRHR

SEQ ID NO: 4152 - protein, 10 aa, Artificial Sequence
  source: /note="Description of Artificial Sequence: Synthetic peptide"
NMEAISPLKM

SEQ ID NO: 4153 - protein, 10 aa, Artificial Sequence
  source: /note="Description of Artificial Sequence: Synthetic peptide"
LKMGWLKTGI

SEQ ID NO: 4154 - protein, 10 aa, Artificial Sequence
  source: /note="Description of Artificial Sequence: Synthetic peptide"
LKTGIVSKLF

SEQ ID NO: 4155 - protein, 10 aa, Artificial Sequence
  source: /note="Description of Artificial Sequence: Synthetic peptide"
MSNQKPVSIL

SEQ ID NO: 4156 - protein, 10 aa, Artificial Sequence
  source: /note="Description of Artificial Sequence: Synthetic peptide"
SNQKPVSILF

SEQ ID NO: 4157 - protein, 10 aa, Artificial Sequence
  source: /note="Description of Artificial Sequence: Synthetic peptide"
FSCQRHRGIL

SEQ ID NO: 4158 - protein, 10 aa, Artificial Sequence
  source: /note="Description of Artificial Sequence: Synthetic peptide"
EAISPLKMGW

SEQ ID NO: 4159 - protein, 9 aa, Artificial Sequence
  source: /note="Description of Artificial Sequence: Synthetic peptide"
HFQRELSLL

SEQ ID NO: 4160 - protein, 9 aa, Artificial Sequence
  source: /note="Description of Artificial Sequence: Synthetic peptide"
DGFPEHFQR

SEQ ID NO: 4161 - protein, 9 aa, Artificial Sequence
  source: /note="Description of Artificial Sequence: Synthetic peptide"
FPEHFQREL

SEQ ID NO: 4162 - protein, 9 aa, Artificial Sequence
  source: /note="Description of Artificial Sequence: Synthetic peptide"
TMLDGFPEH

SEQ ID NO: 4163 - protein, 9 aa, Artificial Sequence
  source: /note="Description of Artificial Sequence: Synthetic peptide"
MLDGFPEHF

SEQ ID NO: 4164 - protein, 9 aa, Artificial Sequence
  source: /note="Description of Artificial Sequence: Synthetic peptide"
EHFQRELSL

SEQ ID NO: 4165 - protein, 10 aa, Artificial Sequence
  source: /note="Description of Artificial Sequence: Synthetic peptide"
TMLDGFPEHF

SEQ ID NO: 4166 - protein, 9 aa, Artificial Sequence
  source: /note="Description of Artificial Sequence: Synthetic peptide"
VSHVVPISK

SEQ ID NO: 4167 - protein, 9 aa, Artificial Sequence
  source: /note="Description of Artificial Sequence: Synthetic peptide"
VPISKGDVL

SEQ ID NO: 4168 - protein, 10 aa, Artificial Sequence
  source: /note="Description of Artificial Sequence: Synthetic peptide"
GVSHVVPISK

SEQ ID NO: 4169 - protein, 10 aa, Artificial Sequence
  source: /note="Description of Artificial Sequence: Synthetic peptide"
HVVPISKGDV

SEQ ID NO: 4170 - protein, 9 aa, Artificial Sequence
  source: /note="Description of Artificial Sequence: Synthetic peptide"
LEMHADLAQ

SEQ ID NO: 4171 - protein, 9 aa, Artificial Sequence
  source: /note="Description of Artificial Sequence: Synthetic peptide"
HADLAQNVL

SEQ ID NO: 4172 - protein, 10 aa, Artificial Sequence
  source: /note="Description of Artificial Sequence: Synthetic peptide"
KLSLEMHADL

SEQ ID NO: 4173 - protein, 10 aa, Artificial Sequence
  source: /note="Description of Artificial Sequence: Synthetic peptide"
EMHADLAQNV

SEQ ID NO: 4174 - protein, 10 aa, Artificial Sequence
  source: /note="Description of Artificial Sequence: Synthetic peptide"
MHADLAQNVL

SEQ ID NO: 4175 - protein, 9 aa, Artificial Sequence
  source: /note="Description of Artificial Sequence: Synthetic peptide"
SSALYGESY

SEQ ID NO: 4176 - protein, 9 aa, Artificial Sequence
  source: /note="Description of Artificial Sequence: Synthetic peptide"
SALYGESYL

SEQ ID NO: 4177 - protein, 10 aa, Artificial Sequence
  source: /note="Description of Artificial Sequence: Synthetic peptide"
FSSALYGESY

SEQ ID NO: 4178 - protein, 10 aa, Artificial Sequence
  source: /note="Description of Artificial Sequence: Synthetic peptide"
SSALYGESYL

SEQ ID NO: 4179 - protein, 9 aa, Artificial Sequence
  source: /note="Description of Artificial Sequence: Synthetic peptide"
HQITLLECV

SEQ ID NO: 4180 - protein, 9 aa, Artificial Sequence
  source: /note="Description of Artificial Sequence: Synthetic peptide"
TVAHQITLL

SEQ ID NO: 4181 - protein, 9 aa, Artificial Sequence
  source: /note="Description of Artificial Sequence: Synthetic peptide"
RTVAHQITL

SEQ ID NO: 4182 - protein, 9 aa, Artificial Sequence
  source: /note="Description of Artificial Sequence: Synthetic peptide"
FLVQRTVAH

SEQ ID NO: 4183 - protein, 9 aa, Artificial Sequence
  source: /note="Description of Artificial Sequence: Synthetic peptide"
VQRTVAHQI

SEQ ID NO: 4184 - protein, 10 aa, Artificial Sequence
  source: /note="Description of Artificial Sequence: Synthetic peptide"
RTVAHQITLL

SEQ ID NO: 4185 - protein, 10 aa, Artificial Sequence
  source: /note="Description of Artificial Sequence: Synthetic peptide"
VQRTVAHQIT

SEQ ID NO: 4186 - protein, 10 aa, Artificial Sequence
  source: /note="Description of Artificial Sequence: Synthetic peptide"
QRTVAHQITL

SEQ ID NO: 4187 - protein, 10 aa, Artificial Sequence
  source: /note="Description of Artificial Sequence: Synthetic peptide"
HQITLLECVG

SEQ ID NO: 4188 - protein, 9 aa, Artificial Sequence
  source: /note="Description of Artificial Sequence: Synthetic peptide"
GLLYDYLQL

SEQ ID NO: 4189 - protein, 9 aa, Artificial Sequence
  source: /note="Description of Artificial Sequence: Synthetic peptide"
LLYDYLQLT

SEQ ID NO: 4190 - protein, 9 aa, Artificial Sequence
  source: /note="Description of Artificial Sequence: Synthetic peptide"
ITHYHEMGL

SEQ ID NO: 4191 - protein, 9 aa, Artificial Sequence
  source: /note="Description of Artificial Sequence: Synthetic peptide"
HYHEMGLLY

SEQ ID NO: 4192 - protein, 9 aa, Artificial Sequence
  source: /note="Description of Artificial Sequence: Synthetic peptide"
HEMGLLYDY

SEQ ID NO: 4193 - protein, 10 aa, Artificial Sequence
  source: /note="Description of Artificial Sequence: Synthetic peptide"
GLLYDYLQLT

SEQ ID NO: 4194 - protein, 10 aa, Artificial Sequence
  source: /note="Description of Artificial Sequence: Synthetic peptide"
LLYDYLQLTT

SEQ ID NO: 4195 - protein, 10 aa, Artificial Sequence
  source: /note="Description of Artificial Sequence: Synthetic peptide"
ITHYHEMGLL

SEQ ID NO: 4196 - protein, 10 aa, Artificial Sequence
  source: /note="Description of Artificial Sequence: Synthetic peptide"
THYHEMGLLY

SEQ ID NO: 4197 - protein, 10 aa, Artificial Sequence
  source: /note="Description of Artificial Sequence: Synthetic peptide"
YHEMGLLYDY

SEQ ID NO: 4198 - protein, 10 aa, Artificial Sequence
  source: /note="Description of Artificial Sequence: Synthetic peptide"
HEMGLLYDYL

SEQ ID NO: 4199 - protein, 10 aa, Artificial Sequence
  source: /note="Description of Artificial Sequence: Synthetic peptide"
MGLLYDYLQL

SEQ ID NO: 4200 - protein, 9 aa, Artificial Sequence
  source: /note="Description of Artificial Sequence: Synthetic peptide"
SNNHWFQSL

SEQ ID NO: 4201 - protein, 9 aa, Artificial Sequence
  source: /note="Description of Artificial Sequence: Synthetic peptide"
FQSLQVPSF

SEQ ID NO: 4202 - protein, 9 aa, Artificial Sequence
  source: /note="Description of Artificial Sequence: Synthetic peptide"
LQVPSFAQM

SEQ ID NO: 4203 - protein, 10 aa, Artificial Sequence
  source: /note="Description of Artificial Sequence: Synthetic peptide"
FQSLQVPSFA

SEQ ID NO: 4204 - protein, 10 aa, Artificial Sequence
  source: /note="Description of Artificial Sequence: Synthetic peptide"
SLQVPSFAQM

SEQ ID NO: 4205 - protein, 10 aa, Artificial Sequence
  source: /note="Description of Artificial Sequence: Synthetic peptide"
LQVPSFAQML

SEQ ID NO: 4206 - protein, 10 aa, Artificial Sequence
  source: /note="Description of Artificial Sequence: Synthetic peptide"
WFQSLQVPSF

SEQ ID NO: 4207 - protein, 10 aa, Artificial Sequence
  source: /note="Description of Artificial Sequence: Synthetic peptide"
ASNNHWFQSL

SEQ ID NO: 4208 - protein, 9 aa, Artificial Sequence
  source: /note="Description of Artificial Sequence: Synthetic peptide"
QSAWEPAPA

SEQ ID NO: 4209 - protein, 9 aa, Artificial Sequence
  source: /note="Description of Artificial Sequence: Synthetic peptide"
EPAPAPATY

SEQ ID NO: 4210 - protein, 9 aa, Artificial Sequence
  source: /note="Description of Artificial Sequence: Synthetic peptide"
AQAQSAWEP

SEQ ID NO: 4211 - protein, 9 aa, Artificial Sequence
  source: /note="Description of Artificial Sequence: Synthetic peptide"
AQSAWEPAP

SEQ ID NO: 4212 - protein, 9 aa, Artificial Sequence
  source: /note="Description of Artificial Sequence: Synthetic peptide"
WEPAPAPAT

SEQ ID NO: 4213 - protein, 10 aa, Artificial Sequence
  source: /note="Description of Artificial Sequence: Synthetic peptide"
AQSAWEPAPA

SEQ ID NO: 4214 - protein, 10 aa, Artificial Sequence
  source: /note="Description of Artificial Sequence: Synthetic peptide"
AQAQSAWEPA

SEQ ID NO: 4215 - protein, 10 aa, Artificial Sequence
  source: /note="Description of Artificial Sequence: Synthetic peptide"
SAWEPAPAPA

SEQ ID NO: 4216 - protein, 10 aa, Artificial Sequence
  source: /note="Description of Artificial Sequence: Synthetic peptide"
WEPAPAPATY

SEQ ID NO: 4217 - protein, 9 aa, Artificial Sequence
  source: /note="Description of Artificial Sequence: Synthetic peptide"
RIMQHADAV

SEQ ID NO: 4218 - protein, 9 aa, Artificial Sequence
  source: /note="Description of Artificial Sequence: Synthetic peptide"
MQHADAVHL

SEQ ID NO: 4219 - protein, 9 aa, Artificial Sequence
  source: /note="Description of Artificial Sequence: Synthetic peptide"
KYRQRIMQH

SEQ ID NO: 4220 - protein, 9 aa, Artificial Sequence
  source: /note="Description of Artificial Sequence: Synthetic peptide"
FSKYRQRIM

SEQ ID NO: 4221 - protein, 9 aa, Artificial Sequence
  source: /note="Description of Artificial Sequence: Synthetic peptide"
IMQHADAVH

SEQ ID NO: 4222 - protein, 10 aa, Artificial Sequence
  source: /note="Description of Artificial Sequence: Synthetic peptide"
IMQHADAVHL

SEQ ID NO: 4223 - protein, 10 aa, Artificial Sequence
  source: /note="Description of Artificial Sequence: Synthetic peptide"
MQHADAVHLI

SEQ ID NO: 4224 - protein, 10 aa, Artificial Sequence
  source: /note="Description of Artificial Sequence: Synthetic peptide"
KYRQRIMQHA

SEQ ID NO: 4225 - protein, 10 aa, Artificial Sequence
  source: /note="Description of Artificial Sequence: Synthetic peptide"
RQRIMQHADA

SEQ ID NO: 4226 - protein, 10 aa, Artificial Sequence
  source: /note="Description of Artificial Sequence: Synthetic peptide"
SKYRQRIMQH

SEQ ID NO: 4227 - protein, 10 aa, Artificial Sequence
  source: /note="Description of Artificial Sequence: Synthetic peptide"
RIMQHADAVH

SEQ ID NO: 4228 - protein, 9 aa, Artificial Sequence
  source: /note="Description of Artificial Sequence: Synthetic peptide"
CTRLHGNIL

SEQ ID NO: 4229 - protein, 9 aa, Artificial Sequence
  source: /note="Description of Artificial Sequence: Synthetic peptide"
KQEPPCTRL

SEQ ID NO: 4230 - protein, 10 aa, Artificial Sequence
  source: /note="Description of Artificial Sequence: Synthetic peptide"
KIAVLYLKKK

SEQ ID NO: 4231 - protein, 10 aa, Artificial Sequence
  source: /note="Description of Artificial Sequence: Synthetic peptide"
YLKKKQEPPC

SEQ ID NO: 4232 - protein, 10 aa, Artificial Sequence
  source: /note="Description of Artificial Sequence: Synthetic peptide"
KKQEPPCTRL

SEQ ID NO: 4233 - protein, 10 aa, Artificial Sequence
  source: /note="Description of Artificial Sequence: Synthetic peptide"
KQEPPCTRLH

SEQ ID NO: 4234 - protein, 9 aa, Artificial Sequence
  source: /note="Description of Artificial Sequence: Synthetic peptide"
RIVEIVVII

SEQ ID NO: 4235 - protein, 9 aa, Artificial Sequence
  source: /note="Description of Artificial Sequence: Synthetic peptide"
VIIDNYLYI

SEQ ID NO: 4236 - protein, 9 aa, Artificial Sequence
  source: /note="Description of Artificial Sequence: Synthetic peptide"
VVIIDNYLY

SEQ ID NO: 4237 - protein, 9 aa, Artificial Sequence
  source: /note="Description of Artificial Sequence: Synthetic peptide"
IVVIIDNYL

SEQ ID NO: 4238 - protein, 9 aa, Artificial Sequence
  source: /note="Description of Artificial Sequence: Synthetic peptide"
FRIVEIVVI

SEQ ID NO: 4239 - protein, 10 aa, Artificial Sequence
  source: /note="Description of Artificial Sequence: Synthetic peptide"
IIDNYLYIRY

SEQ ID NO: 4240 - protein, 10 aa, Artificial Sequence
  source: /note="Description of Artificial Sequence: Synthetic peptide"
VVIIDNYLYI

SEQ ID NO: 4241 - protein, 10 aa, Artificial Sequence
  source: /note="Description of Artificial Sequence: Synthetic peptide"
VIIDNYLYIR

SEQ ID NO: 4242 - protein, 10 aa, Artificial Sequence
  source: /note="Description of Artificial Sequence: Synthetic peptide"
HFRIVEIVVI

SEQ ID NO: 4243 - protein, 10 aa, Artificial Sequence
  source: /note="Description of Artificial Sequence: Synthetic peptide"
IVVIIDNYLY

SEQ ID NO: 4244 - protein, 10 aa, Artificial Sequence
  source: /note="Description of Artificial Sequence: Synthetic peptide"
EIVVIIDNYL

SEQ ID NO: 4245 - protein, 10 aa, Artificial Sequence
  source: /note="Description of Artificial Sequence: Synthetic peptide"
VEIVVIIDNY

SEQ ID NO: 4246 - protein, 9 aa, Artificial Sequence
  source: /note="Description of Artificial Sequence: Synthetic peptide"
KTKTVHEES

SEQ ID NO: 4247 - protein, 10 aa, Artificial Sequence
  source: /note="Description of Artificial Sequence: Synthetic peptide"
KTKTVHEESK

SEQ ID NO: 4248 - protein, 10 aa, Artificial Sequence
  source: /note="Description of Artificial Sequence: Synthetic peptide"
KTVHEESKTK

SEQ ID NO: 4249 - protein, 9 aa, Artificial Sequence
  source: /note="Description of Artificial Sequence: Synthetic peptide"
RVFSFTEHL

SEQ ID NO: 4250 - protein, 9 aa, Artificial Sequence
  source: /note="Description of Artificial Sequence: Synthetic peptide"
SFTEHLELL

SEQ ID NO: 4251 - protein, 9 aa, Artificial Sequence
  source: /note="Description of Artificial Sequence: Synthetic peptide"
FSFTEHLEL

SEQ ID NO: 4252 - protein, 9 aa, Artificial Sequence
  source: /note="Description of Artificial Sequence: Synthetic peptide"
LELLEDHPY

SEQ ID NO: 4253 - protein, 10 aa, Artificial Sequence
  source: /note="Description of Artificial Sequence: Synthetic peptide"
HLELLEDHPY

SEQ ID NO: 4254 - protein, 10 aa, Artificial Sequence
  source: /note="Description of Artificial Sequence: Synthetic peptide"
VFSFTEHLEL

SEQ ID NO: 4255 - protein, 10 aa, Artificial Sequence
  source: /note="Description of Artificial Sequence: Synthetic peptide"
LRVFSFTEHL

SEQ ID NO: 4256 - protein, 10 aa, Artificial Sequence
  source: /note="Description of Artificial Sequence: Synthetic peptide"
FSFTEHLELL

SEQ ID NO: 4257 - protein, 10 aa, Artificial Sequence
  source: /note="Description of Artificial Sequence: Synthetic peptide"
LELLEDHPYI

SEQ ID NO: 4258 - protein, 9 aa, Artificial Sequence
  source: /note="Description of Artificial Sequence: Synthetic peptide"
WSFGKVCYL

SEQ ID NO: 4259 - protein, 9 aa, Artificial Sequence
  source: /note="Description of Artificial Sequence: Synthetic peptide"
CYLEYAGSV

SEQ ID NO: 4260 - protein, 9 aa, Artificial Sequence
  source: /note="Description of Artificial Sequence: Synthetic peptide"
AWSFGKVCY

SEQ ID NO: 4261 - protein, 9 aa, Artificial Sequence
  source: /note="Description of Artificial Sequence: Synthetic peptide"
FGKVCYLEY

SEQ ID NO: 4262 - protein, 10 aa, Artificial Sequence
  source: /note="Description of Artificial Sequence: Synthetic peptide"
SFGKVCYLEY

SEQ ID NO: 4263 - protein, 10 aa, Artificial Sequence
  source: /note="Description of Artificial Sequence: Synthetic peptide"
LAWSFGKVCY

SEQ ID NO: 4264 - protein, 9 aa, Artificial Sequence
  source: /note="Description of Artificial Sequence: Synthetic peptide"
LVCTYPTQK

SEQ ID NO: 4265 - protein, 9 aa, Artificial Sequence
  source: /note="Description of Artificial Sequence: Synthetic peptide"
CTYPTQKPF

SEQ ID NO: 4266 - protein, 10 aa, Artificial Sequence
  source: /note="Description of Artificial Sequence: Synthetic peptide"
RLVCTYPTQK

SEQ ID NO: 4267 - protein, 10 aa, Artificial Sequence
  source: /note="Description of Artificial Sequence: Synthetic peptide"
CTYPTQKPFH

SEQ ID NO: 4268 - protein, 10 aa, Artificial Sequence
  source: /note="Description of Artificial Sequence: Synthetic peptide"
VCTYPTQKPF

SEQ ID NO: 4269 - protein, 9 aa, Artificial Sequence
  source: /note="Description of Artificial Sequence: Synthetic peptide"
YIMLNIQIV

SEQ ID NO: 4270 - protein, 9 aa, Artificial Sequence
  source: /note="Description of Artificial Sequence: Synthetic peptide"
IMLNIQIVL

SEQ ID NO: 4271 - protein, 9 aa, Artificial Sequence
  source: /note="Description of Artificial Sequence: Synthetic peptide"
MLNIQIVLV

SEQ ID NO: 4272 - protein, 9 aa, Artificial Sequence
  source: /note="Description of Artificial Sequence: Synthetic peptide"
MYIMLNIQI

SEQ ID NO: 4273 - protein, 10 aa, Artificial Sequence
  source: /note="Description of Artificial Sequence: Synthetic peptide"
SMYIMLNIQI

SEQ ID NO: 4274 - protein, 10 aa, Artificial Sequence
  source: /note="Description of Artificial Sequence: Synthetic peptide"
YIMLNIQIVL

SEQ ID NO: 4275 - protein, 10 aa, Artificial Sequence
  source: /note="Description of Artificial Sequence: Synthetic peptide"
IMLNIQIVLV

SEQ ID NO: 4276 - protein, 10 aa, Artificial Sequence
  source: /note="Description of Artificial Sequence: Synthetic peptide"
MYIMLNIQIV

SEQ ID NO: 4277 - protein, 10 aa, Artificial Sequence
  source: /note="Description of Artificial Sequence: Synthetic peptide"
IQIVLVGLEI

SEQ ID NO: 4278 - protein, 9 aa, Artificial Sequence
  source: /note="Description of Artificial Sequence: Synthetic peptide"
CAGFNRPCK

SEQ ID NO: 4279 - protein, 9 aa, Artificial Sequence
  source: /note="Description of Artificial Sequence: Synthetic peptide"
CKTLGLSHL

SEQ ID NO: 4280 - protein, 10 aa, Artificial Sequence
  source: /note="Description of Artificial Sequence: Synthetic peptide"
KTLGLSHLSG

SEQ ID NO: 4281 - protein, 10 aa, Artificial Sequence
  source: /note="Description of Artificial Sequence: Synthetic peptide"
FNRPCKTLGL

SEQ ID NO: 4282 - protein, 10 aa, Artificial Sequence
  source: /note="Description of Artificial Sequence: Synthetic peptide"
AGFNRPCKTL

SEQ ID NO: 4283 - protein, 9 aa, Artificial Sequence
  source: /note="Description of Artificial Sequence: Synthetic peptide"
TPAISSPSA

SEQ ID NO: 4284 - protein, 9 aa, Artificial Sequence
  source: /note="Description of Artificial Sequence: Synthetic peptide"
ISSPSATTA

SEQ ID NO: 4285 - protein, 10 aa, Artificial Sequence
  source: /note="Description of Artificial Sequence: Synthetic peptide"
AISSPSATTA

SEQ ID NO: 4286 - protein, 10 aa, Artificial Sequence
  source: /note="Description of Artificial Sequence: Synthetic peptide"
SSPSATTASK

SEQ ID NO: 4287 - protein, 10 aa, Artificial Sequence
  source: /note="Description of Artificial Sequence: Synthetic peptide"
STPAISSPSA

SEQ ID NO: 4288 - protein, 10 aa, Artificial Sequence
  source: /note="Description of Artificial Sequence: Synthetic peptide"
TPAISSPSAT

SEQ ID NO: 4289 - protein, 9 aa, Artificial Sequence
  source: /note="Description of Artificial Sequence: Synthetic peptide"
DLPNLLCLV

SEQ ID NO: 4290 - protein, 10 aa, Artificial Sequence
  source: /note="Description of Artificial Sequence: Synthetic peptide"
NLLCLVGDQL

SEQ ID NO: 4291 - protein, 9 aa, Artificial Sequence
  source: /note="Description of Artificial Sequence: Synthetic peptide"
FSGTTFNYR

SEQ ID NO: 4292 - protein, 9 aa, Artificial Sequence
  source: /note="Description of Artificial Sequence: Synthetic peptide"
KFSGTTFNY

SEQ ID NO: 4293 - protein, 9 aa, Artificial Sequence
  source: /note="Description of Artificial Sequence: Synthetic peptide"
TTFNYRRSY

SEQ ID NO: 4294 - protein, 9 aa, Artificial Sequence
  source: /note="Description of Artificial Sequence: Synthetic peptide"
SGTTFNYRR

SEQ ID NO: 4295 - protein, 10 aa, Artificial Sequence
  source: /note="Description of Artificial Sequence: Synthetic peptide"
FSGTTFNYRR

SEQ ID NO: 4296 - protein, 10 aa, Artificial Sequence
  source: /note="Description of Artificial Sequence: Synthetic peptide"
KFSGTTFNYR

SEQ ID NO: 4297 - protein, 10 aa, Artificial Sequence
  source: /note="Description of Artificial Sequence: Synthetic peptide"
YKFSGTTFNY

SEQ ID NO: 4298 - protein, 10 aa, Artificial Sequence
  source: /note="Description of Artificial Sequence: Synthetic peptide"
GTTFNYRRSY

SEQ ID NO: 4299 - protein, 9 aa, Artificial Sequence
  source: /note="Description of Artificial Sequence: Synthetic peptide"
RQRKCDTPP

SEQ ID NO: 4300 - protein, 10 aa, Artificial Sequence
  source: /note="Description of Artificial Sequence: Synthetic peptide"
RQRKCDTPPP

SEQ ID NO: 4301 - protein, 9 aa, Artificial Sequence
  source: /note="Description of Artificial Sequence: Synthetic peptide"
LHNNTTRSV

SEQ ID NO: 4302 - protein, 10 aa, Artificial Sequence
  source: /note="Description of Artificial Sequence: Synthetic peptide"
SVRCIQPLHN

SEQ ID NO: 4303 - protein, 10 aa, Artificial Sequence
  source: /note="Description of Artificial Sequence: Synthetic peptide"
LHNNTTRSVH

SEQ ID NO: 4304 - protein, 9 aa, Artificial Sequence
  source: /note="Description of Artificial Sequence: Synthetic peptide"
CLHGLCVNK

SEQ ID NO: 4305 - protein, 10 aa, Artificial Sequence
  source: /note="Description of Artificial Sequence: Synthetic peptide"
GMHCLHGLCV

SEQ ID NO: 4306 - protein, 10 aa, Artificial Sequence
  source: /note="Description of Artificial Sequence: Synthetic peptide"
GPGMHCLHGL

SEQ ID NO: 4307 - protein, 10 aa, Artificial Sequence
  source: /note="Description of Artificial Sequence: Synthetic peptide"
SPLMEQECSL

SEQ ID NO: 4308 - protein, 9 aa, Artificial Sequence
  source: /note="Description of Artificial Sequence: Synthetic peptide"
VLQYWGAEL

SEQ ID NO: 4309 - protein, 9 aa, Artificial Sequence
  source: /note="Description of Artificial Sequence: Synthetic peptide"
ALLGVLQYW

SEQ ID NO: 4310 - protein, 9 aa, Artificial Sequence
  source: /note="Description of Artificial Sequence: Synthetic peptide"
QYWGAELHL

SEQ ID NO: 4311 - protein, 9 aa, Artificial Sequence
  source: /note="Description of Artificial Sequence: Synthetic peptide"
LQYWGAELH

SEQ ID NO: 4312 - protein, 10 aa, Artificial Sequence
  source: /note="Description of Artificial Sequence: Synthetic peptide"
LLGVLQYWGA

SEQ ID NO: 4313 - protein, 10 aa, Artificial Sequence
  source: /note="Description of Artificial Sequence: Synthetic peptide"
LQYWGAELHL

SEQ ID NO: 4314 - protein, 10 aa, Artificial Sequence
  source: /note="Description of Artificial Sequence: Synthetic peptide"
GALLGVLQYW

SEQ ID NO: 4315 - protein, 10 aa, Artificial Sequence
  source: /note="Description of Artificial Sequence: Synthetic peptide"
WGAELHLQPL

SEQ ID NO: 4316 - protein, 9 aa, Artificial Sequence
  source: /note="Description of Artificial Sequence: Synthetic peptide"
KGRICMQGK

SEQ ID NO: 4317 - protein, 10 aa, Artificial Sequence
  source: /note="Description of Artificial Sequence: Synthetic peptide"
TPCGKGRICM

SEQ ID NO: 4318 - protein, 9 aa, Artificial Sequence
  source: /note="Description of Artificial Sequence: Synthetic peptide"
KPMADGGWA

SEQ ID NO: 4319 - protein, 9 aa, Artificial Sequence
  source: /note="Description of Artificial Sequence: Synthetic peptide"
EEVERPKPM

SEQ ID NO: 4320 - protein, 9 aa, Artificial Sequence
  source: /note="Description of Artificial Sequence: Synthetic peptide"
MADGGWAPW

SEQ ID NO: 4321 - protein, 10 aa, Artificial Sequence
  source: /note="Description of Artificial Sequence: Synthetic peptide"
PMADGGWAPW

SEQ ID NO: 4322 - protein, 10 aa, Artificial Sequence
  source: /note="Description of Artificial Sequence: Synthetic peptide"
EEEVERPKPM

SEQ ID NO: 4323 - protein, 9 aa, Artificial Sequence
  source: /note="Description of Artificial Sequence: Synthetic peptide"
HFDWKHFNI

SEQ ID NO: 4324 - protein, 9 aa, Artificial Sequence
  source: /note="Description of Artificial Sequence: Synthetic peptide"
CAHFDWKHF

SEQ ID NO: 4325 - protein, 9 aa, Artificial Sequence
  source: /note="Description of Artificial Sequence: Synthetic peptide"
WKHFNINGL

SEQ ID NO: 4326 - protein, 9 aa, Artificial Sequence
  source: /note="Description of Artificial Sequence: Synthetic peptide"
DEQCAHFDW

SEQ ID NO: 4327 - protein, 10 aa, Artificial Sequence
  source: /note="Description of Artificial Sequence: Synthetic peptide"
AHFDWKHFNI

SEQ ID NO: 4328 - protein, 10 aa, Artificial Sequence
  source: /note="Description of Artificial Sequence: Synthetic peptide"
WKHFNINGLL

SEQ ID NO: 4329 - protein, 9 aa, Artificial Sequence
  source: /note="Description of Artificial Sequence: Synthetic peptide"
WLLGAPGAL

SEQ ID NO: 4330 - protein, 9 aa, Artificial Sequence
  source: /note="Description of Artificial Sequence: Synthetic peptide"
GSWLSLEPV

SEQ ID NO: 4331 - protein, 9 aa, Artificial Sequence
  source: /note="Description of Artificial Sequence: Synthetic peptide"
SLEPVLRAV

SEQ ID NO: 4332 - protein, 9 aa, Artificial Sequence
  source: /note="Description of Artificial Sequence: Synthetic peptide"
RAVRPGPEK

SEQ ID NO: 4333 - protein, 9 aa, Artificial Sequence
  source: /note="Description of Artificial Sequence: Synthetic peptide"
SWLSLEPVL

SEQ ID NO: 4334 - protein, 9 aa, Artificial Sequence
  source: /note="Description of Artificial Sequence: Synthetic peptide"
HPVLPAAPL

SEQ ID NO: 4335 - protein, 9 aa, Artificial Sequence
  source: /note="Description of Artificial Sequence: Synthetic peptide"
LPAAPLWPL

SEQ ID NO: 4336 - protein, 9 aa, Artificial Sequence
  source: /note="Description of Artificial Sequence: Synthetic peptide"
SPPAQHHPV

SEQ ID NO: 4337 - protein, 9 aa, Artificial Sequence
  source: /note="Description of Artificial Sequence: Synthetic peptide"
PPAQHHPVL

SEQ ID NO: 4338 - protein, 9 aa, Artificial Sequence
  source: /note="Description of Artificial Sequence: Synthetic peptide"
WPLGSWLSL

SEQ ID NO: 4339 - protein, 9 aa, Artificial Sequence
  source: /note="Description of Artificial Sequence: Synthetic peptide"
GPEKPAGSL

SEQ ID NO: 4340 - protein, 9 aa, Artificial Sequence
  source: /note="Description of Artificial Sequence: Synthetic peptide"
RQEFGGGWL

SEQ ID NO: 4341 - protein, 9 aa, Artificial Sequence
  source: /note="Description of Artificial Sequence: Synthetic peptide"
QEFGGGWLL

SEQ ID NO: 4342 - protein, 9 aa, Artificial Sequence
  source: /note="Description of Artificial Sequence: Synthetic peptide"
LLGAPGALW

SEQ ID NO: 4343 - protein, 9 aa, Artificial Sequence
  source: /note="Description of Artificial Sequence: Synthetic peptide"
AQHHPVLPA

SEQ ID NO: 4344 - protein, 9 aa, Artificial Sequence
  source: /note="Description of Artificial Sequence: Synthetic peptide"
QHHPVLPAA

SEQ ID NO: 4345 - protein, 9 aa, Artificial Sequence
  source: /note="Description of Artificial Sequence: Synthetic peptide"
APLWPLGSW

SEQ ID NO: 4346 - protein, 10 aa, Artificial Sequence
  source: /note="Description of Artificial Sequence: Synthetic peptide"
VLPAAPLWPL

SEQ ID NO: 4347 - protein, 10 aa, Artificial Sequence
  source: /note="Description of Artificial Sequence: Synthetic peptide"
AQHHPVLPAA

SEQ ID NO: 4348 - protein, 10 aa, Artificial Sequence
  source: /note="Description of Artificial Sequence: Synthetic peptide"
WLSLEPVLRA

SEQ ID NO: 4349 - protein, 10 aa, Artificial Sequence
  source: /note="Description of Artificial Sequence: Synthetic peptide"
LWPLGSWLSL

SEQ ID NO: 4350 - protein, 10 aa, Artificial Sequence
  source: /note="Description of Artificial Sequence: Synthetic peptide"
AVRPGPEKPA

SEQ ID NO: 4351 - protein, 10 aa, Artificial Sequence
  source: /note="Description of Artificial Sequence: Synthetic peptide"
SWLSLEPVLR

SEQ ID NO: 4352 - protein, 10 aa, Artificial Sequence
  source: /note="Description of Artificial Sequence: Synthetic peptide"
SLEPVLRAVR

SEQ ID NO: 4353 - protein, 10 aa, Artificial Sequence
  source: /note="Description of Artificial Sequence: Synthetic peptide"
TSPPAQHHPV

SEQ ID NO: 4354 - protein, 10 aa, Artificial Sequence
  source: /note="Description of Artificial Sequence: Synthetic peptide"
SPPAQHHPVL

SEQ ID NO: 4355 - protein, 10 aa, Artificial Sequence
  source: /note="Description of Artificial Sequence: Synthetic peptide"
APLWPLGSWL

SEQ ID NO: 4356 - protein, 10 aa, Artificial Sequence
  source: /note="Description of Artificial Sequence: Synthetic peptide"
RQEFGGGWLL

SEQ ID NO: 4357 - protein, 10 aa, Artificial Sequence
  source: /note="Description of Artificial Sequence: Synthetic peptide"
WLLGAPGALW

SEQ ID NO: 4358 - protein, 10 aa, Artificial Sequence
  source: /note="Description of Artificial Sequence: Synthetic peptide"
GSWLSLEPVL

SEQ ID NO: 4359 - protein, 10 aa, Artificial Sequence
  source: /note="Description of Artificial Sequence: Synthetic peptide"
QEFGGGWLLG

SEQ ID NO: 4360 - protein, 10 aa, Artificial Sequence
  source: /note="Description of Artificial Sequence: Synthetic peptide"
HPVLPAAPLW

SEQ ID NO: 4361 - protein, 9 aa, Artificial Sequence
  source: /note="Description of Artificial Sequence: Synthetic peptide"
LVIFFAIFI

SEQ ID NO: 4362 - protein, 9 aa, Artificial Sequence
  source: /note="Description of Artificial Sequence: Synthetic peptide"
VIFFAIFIL

SEQ ID NO: 4363 - protein, 9 aa, Artificial Sequence
  source: /note="Description of Artificial Sequence: Synthetic peptide"
LITVPTALV

SEQ ID NO: 4364 - protein, 9 aa, Artificial Sequence
  source: /note="Description of Artificial Sequence: Synthetic peptide"
TVPTALVIF

SEQ ID NO: 4365 - protein, 9 aa, Artificial Sequence
  source: /note="Description of Artificial Sequence: Synthetic peptide"
TALVIFFAI

SEQ ID NO: 4366 - protein, 9 aa, Artificial Sequence
  source: /note="Description of Artificial Sequence: Synthetic peptide"
PTALVIFFA

SEQ ID NO: 4367 - protein, 9 aa, Artificial Sequence
  source: /note="Description of Artificial Sequence: Synthetic peptide"
ALVIFFAIF

SEQ ID NO: 4368 - protein, 9 aa, Artificial Sequence
  source: /note="Description of Artificial Sequence: Synthetic peptide"
ITVPTALVI

SEQ ID NO: 4369 - protein, 9 aa, Artificial Sequence
  source: /note="Description of Artificial Sequence: Synthetic peptide"
VPTALVIFF

SEQ ID NO: 4370 - protein, 10 aa, Artificial Sequence
  source: /note="Description of Artificial Sequence: Synthetic peptide"
FLITVPTALV

SEQ ID NO: 4371 - protein, 10 aa, Artificial Sequence
  source: /note="Description of Artificial Sequence: Synthetic peptide"
ALVIFFAIFI

SEQ ID NO: 4372 - protein, 10 aa, Artificial Sequence
  source: /note="Description of Artificial Sequence: Synthetic peptide"
VIFFAIFILV

SEQ ID NO: 4373 - protein, 10 aa, Artificial Sequence
  source: /note="Description of Artificial Sequence: Synthetic peptide"
ITVPTALVIF

SEQ ID NO: 4374 - protein, 10 aa, Artificial Sequence
  source: /note="Description of Artificial Sequence: Synthetic peptide"
TVPTALVIFF

SEQ ID NO: 4375 - protein, 10 aa, Artificial Sequence
  source: /note="Description of Artificial Sequence: Synthetic peptide"
TALVIFFAIF

SEQ ID NO: 4376 - protein, 10 aa, Artificial Sequence
  source: /note="Description of Artificial Sequence: Synthetic peptide"
PTALVIFFAI

SEQ ID NO: 4377 - protein, 10 aa, Artificial Sequence
  source: /note="Description of Artificial Sequence: Synthetic peptide"
LVIFFAIFIL

SEQ ID NO: 4378 - protein, 10 aa, Artificial Sequence
  source: /note="Description of Artificial Sequence: Synthetic peptide"
VPTALVIFFA

SEQ ID NO: 4379 - protein, 9 aa, Artificial Sequence
  source: /note="Description of Artificial Sequence: Synthetic peptide"
SYDCVCIMF

SEQ ID NO: 4380 - protein, 9 aa, Artificial Sequence
  source: /note="Description of Artificial Sequence: Synthetic peptide"
IMFASIPDF

SEQ ID NO: 4381 - protein, 9 aa, Artificial Sequence
  source: /note="Description of Artificial Sequence: Synthetic peptide"
QSYDCVCIM

SEQ ID NO: 4382 - protein, 9 aa, Artificial Sequence
  source: /note="Description of Artificial Sequence: Synthetic peptide"
HQSYDCVCI

SEQ ID NO: 4383 - protein, 10 aa, Artificial Sequence
  source: /note="Description of Artificial Sequence: Synthetic peptide"
IMFASIPDFK

SEQ ID NO: 4384 - protein, 10 aa, Artificial Sequence
  source: /note="Description of Artificial Sequence: Synthetic peptide"
CIMFASIPDF

SEQ ID NO: 4385 - protein, 10 aa, Artificial Sequence
  source: /note="Description of Artificial Sequence: Synthetic peptide"
HQSYDCVCIM

SEQ ID NO: 4386 - protein, 10 aa, Artificial Sequence
  source: /note="Description of Artificial Sequence: Synthetic peptide"
QSYDCVCIMF

SEQ ID NO: 4387 - protein, 9 aa, Artificial Sequence
  source: /note="Description of Artificial Sequence: Synthetic peptide"
AQKTQYDIW

SEQ ID NO: 4388 - protein, 10 aa, Artificial Sequence
  source: /note="Description of Artificial Sequence: Synthetic peptide"
TQYDIWGNTV

SEQ ID NO: 4389 - protein, 10 aa, Artificial Sequence
  source: /note="Description of Artificial Sequence: Synthetic peptide"
GVIGAQKTQY

SEQ ID NO: 4390 - protein, 9 aa, Artificial Sequence
  source: /note="Description of Artificial Sequence: Synthetic peptide"
MIAKMNHQR

SEQ ID NO: 4391 - protein, 9 aa, Artificial Sequence
  source: /note="Description of Artificial Sequence: Synthetic peptide"
KAMIAKMNH

SEQ ID NO: 4392 - protein, 9 aa, Artificial Sequence
  source: /note="Description of Artificial Sequence: Synthetic peptide"
KMNHQRTNS

SEQ ID NO: 4393 - protein, 9 aa, Artificial Sequence
  source: /note="Description of Artificial Sequence: Synthetic peptide"
HQRTNSIGH

SEQ ID NO: 4394 - protein, 9 aa, Artificial Sequence
  source: /note="Description of Artificial Sequence: Synthetic peptide"
MNHQRTNSI

SEQ ID NO: 4395 - protein, 10 aa, Artificial Sequence
  source: /note="Description of Artificial Sequence: Synthetic peptide"
KMNHQRTNSI

SEQ ID NO: 4396 - protein, 10 aa, Artificial Sequence
  source: /note="Description of Artificial Sequence: Synthetic peptide"
AMIAKMNHQR

SEQ ID NO: 4397 - protein, 9 aa, Artificial Sequence
  source: /note="Description of Artificial Sequence: Synthetic peptide"
TIKRKQQGL

SEQ ID NO: 4398 - protein, 10 aa, Artificial Sequence
  source: /note="Description of Artificial Sequence: Synthetic peptide"
RTIKRKQQGL

SEQ ID NO: 4399 - protein, 9 aa, Artificial Sequence
  source: /note="Description of Artificial Sequence: Synthetic peptide"
ILFRYLVKV

SEQ ID NO: 4400 - protein, 9 aa, Artificial Sequence
  source: /note="Description of Artificial Sequence: Synthetic peptide"
KILFRYLVK

SEQ ID NO: 4401 - protein, 9 aa, Artificial Sequence
  source: /note="Description of Artificial Sequence: Synthetic peptide"
LFRYLVKVL

SEQ ID NO: 4402 - protein, 9 aa, Artificial Sequence
  source: /note="Description of Artificial Sequence: Synthetic peptide"
KKILFRYLV

SEQ ID NO: 4403 - protein, 10 aa, Artificial Sequence
  source: /note="Description of Artificial Sequence: Synthetic peptide"
KILFRYLVKV

SEQ ID NO: 4404 - protein, 10 aa, Artificial Sequence
  source: /note="Description of Artificial Sequence: Synthetic peptide"
ILFRYLVKVL

SEQ ID NO: 4405 - protein, 10 aa, Artificial Sequence
  source: /note="Description of Artificial Sequence: Synthetic peptide"
KKILFRYLVK

SEQ ID NO: 4406 - protein, 10 aa, Artificial Sequence
  source: /note="Description of Artificial Sequence: Synthetic peptide"
LVKVLTPQPA

SEQ ID NO: 4407 - protein, 9 aa, Artificial Sequence
  source: /note="Description of Artificial Sequence: Synthetic peptide"
YTVVVENAV

SEQ ID NO: 4408 - protein, 9 aa, Artificial Sequence
  source: /note="Description of Artificial Sequence: Synthetic peptide"
VVVENAVAK

SEQ ID NO: 4409 - protein, 9 aa, Artificial Sequence
  source: /note="Description of Artificial Sequence: Synthetic peptide"
TFSQYTVVV

SEQ ID NO: 4410 - protein, 9 aa, Artificial Sequence
  source: /note="Description of Artificial Sequence: Synthetic peptide"
SQYTVVVEN

SEQ ID NO: 4411 - protein, 10 aa, Artificial Sequence
  source: /note="Description of Artificial Sequence: Synthetic peptide"
STFSQYTVVV

SEQ ID NO: 4412 - protein, 10 aa, Artificial Sequence
  source: /note="Description of Artificial Sequence: Synthetic peptide"
SQYTVVVENA

SEQ ID NO: 4413 - protein, 10 aa, Artificial Sequence
  source: /note="Description of Artificial Sequence: Synthetic peptide"
VVVENAVAKI

SEQ ID NO: 4414 - protein, 10 aa, Artificial Sequence
  source: /note="Description of Artificial Sequence: Synthetic peptide"
TVVVENAVAK

SEQ ID NO: 4415 - protein, 10 aa, Artificial Sequence
  source: /note="Description of Artificial Sequence: Synthetic peptide"
YTVVVENAVA

SEQ ID NO: 4416 - protein, 10 aa, Artificial Sequence
  source: /note="Description of Artificial Sequence: Synthetic peptide"
VENAVAKIDA

SEQ ID NO: 4417 - protein, 9 aa, Artificial Sequence
  source: /note="Description of Artificial Sequence: Synthetic peptide"
SLTHSPLLL

SEQ ID NO: 4418 - protein, 9 aa, Artificial Sequence
  source: /note="Description of Artificial Sequence: Synthetic peptide"
GSLTHSPLL

SEQ ID NO: 4419 - protein, 9 aa, Artificial Sequence
  source: /note="Description of Artificial Sequence: Synthetic peptide"
LTHSPLLLA

SEQ ID NO: 4420 - protein, 10 aa, Artificial Sequence
  source: /note="Description of Artificial Sequence: Synthetic peptide"
SLTHSPLLLA

SEQ ID NO: 4421 - protein, 10 aa, Artificial Sequence
  source: /note="Description of Artificial Sequence: Synthetic peptide"
APGSLTHSPL

SEQ ID NO: 4422 - protein, 9 aa, Artificial Sequence
  source: /note="Description of Artificial Sequence: Synthetic peptide"
KAHPRPTQK

SEQ ID NO: 4423 - protein, 9 aa, Artificial Sequence
  source: /note="Description of Artificial Sequence: Synthetic peptide"
LIREKAHPR

SEQ ID NO: 4424 - protein, 9 aa, Artificial Sequence
  source: /note="Description of Artificial Sequence: Synthetic peptide"
REKAHPRPT

SEQ ID NO: 4425 - protein, 10 aa, Artificial Sequence
  source: /note="Description of Artificial Sequence: Synthetic peptide"
KAHPRPTQKI

SEQ ID NO: 4426 - protein, 10 aa, Artificial Sequence
  source: /note="Description of Artificial Sequence: Synthetic peptide"
SLIREKAHPR

SEQ ID NO: 4427 - protein, 9 aa, Artificial Sequence
  source: /note="Description of Artificial Sequence: Synthetic peptide"
ASKHKYTSK

SEQ ID NO: 4428 - protein, 10 aa, Artificial Sequence
  source: /note="Description of Artificial Sequence: Synthetic peptide"
TSKDLTSSSR

SEQ ID NO: 4429 - protein, 10 aa, Artificial Sequence
  source: /note="Description of Artificial Sequence: Synthetic peptide"
SKHKYTSKDL

SEQ ID NO: 4430 - protein, 9 aa, Artificial Sequence
  source: /note="Description of Artificial Sequence: Synthetic peptide"
LLWGARYDK

SEQ ID NO: 4431 - protein, 9 aa, Artificial Sequence
  source: /note="Description of Artificial Sequence: Synthetic peptide"
LWGARYDKI

SEQ ID NO: 4432 - protein, 9 aa, Artificial Sequence
  source: /note="Description of Artificial Sequence: Synthetic peptide"
TILLWGARY

SEQ ID NO: 4433 - protein, 9 aa, Artificial Sequence
  source: /note="Description of Artificial Sequence: Synthetic peptide"
PTILLWGAR

SEQ ID NO: 4434 - protein, 10 aa, Artificial Sequence
  source: /note="Description of Artificial Sequence: Synthetic peptide"
PTILLWGARY

SEQ ID NO: 4435 - protein, 10 aa, Artificial Sequence
  source: /note="Description of Artificial Sequence: Synthetic peptide"
YAPTILLWGA

SEQ ID NO: 4436 - protein, 10 aa, Artificial Sequence
  source: /note="Description of Artificial Sequence: Synthetic peptide"
LLWGARYDKI

SEQ ID NO: 4437 - protein, 10 aa, Artificial Sequence
  source: /note="Description of Artificial Sequence: Synthetic peptide"
ILLWGARYDK

SEQ ID NO: 4438 - protein, 10 aa, Artificial Sequence
  source: /note="Description of Artificial Sequence: Synthetic peptide"
LYAPTILLWG

SEQ ID NO: 4439 - protein, 9 aa, Artificial Sequence
  source: /note="Description of Artificial Sequence: Synthetic peptide"
LPCGWTLLY

SEQ ID NO: 4440 - protein, 9 aa, Artificial Sequence
  source: /note="Description of Artificial Sequence: Synthetic peptide"
SLPCGWTLL

SEQ ID NO: 4441 - protein, 9 aa, Artificial Sequence
  source: /note="Description of Artificial Sequence: Synthetic peptide"
LLYLSSAWR

SEQ ID NO: 4442 - protein, 9 aa, Artificial Sequence
  source: /note="Description of Artificial Sequence: Synthetic peptide"
YLSSAWRMK

SEQ ID NO: 4443 - protein, 9 aa, Artificial Sequence
  source: /note="Description of Artificial Sequence: Synthetic peptide"
RSLPCGWTL

SEQ ID NO: 4444 - protein, 9 aa, Artificial Sequence
  source: /note="Description of Artificial Sequence: Synthetic peptide"
LYLSSAWRM

SEQ ID NO: 4445 - protein, 9 aa, Artificial Sequence
  source: /note="Description of Artificial Sequence: Synthetic peptide"
WTLLYLSSA

SEQ ID NO: 4446 - protein, 9 aa, Artificial Sequence
  source: /note="Description of Artificial Sequence: Synthetic peptide"
GPRRRSLPC

SEQ ID NO: 4447 - protein, 9 aa, Artificial Sequence
  source: /note="Description of Artificial Sequence: Synthetic peptide"
TLLYLSSAW

SEQ ID NO: 4448 - protein, 10 aa, Artificial Sequence
  source: /note="Description of Artificial Sequence: Synthetic peptide"
LLYLSSAWRM

SEQ ID NO: 4449 - protein, 10 aa, Artificial Sequence
  source: /note="Description of Artificial Sequence: Synthetic peptide"
RSLPCGWTLL

SEQ ID NO: 4450 - protein, 10 aa, Artificial Sequence
  source: /note="Description of Artificial Sequence: Synthetic peptide"
LIRDEGGPRR

SEQ ID NO: 4451 - protein, 10 aa, Artificial Sequence
  source: /note="Description of Artificial Sequence: Synthetic peptide"
LYLSSAWRMK

SEQ ID NO: 4452 - protein, 10 aa, Artificial Sequence
  source: /note="Description of Artificial Sequence: Synthetic peptide"
SLPCGWTLLY

SEQ ID NO: 4453 - protein, 10 aa, Artificial Sequence
  source: /note="Description of Artificial Sequence: Synthetic peptide"
TLLYLSSAWR

SEQ ID NO: 4454 - protein, 10 aa, Artificial Sequence
  source: /note="Description of Artificial Sequence: Synthetic peptide"
RRSLPCGWTL

SEQ ID NO: 4455 - protein, 10 aa, Artificial Sequence
  source: /note="Description of Artificial Sequence: Synthetic peptide"
WTLLYLSSAW

SEQ ID NO: 4456 - protein, 10 aa, Artificial Sequence
  source: /note="Description of Artificial Sequence: Synthetic peptide"
LPCGWTLLYL

SEQ ID NO: 4457 - protein, 9 aa, Artificial Sequence
  source: /note="Description of Artificial Sequence: Synthetic peptide"
WIWAKYEQK

SEQ ID NO: 4458 - protein, 9 aa, Artificial Sequence
  source: /note="Description of Artificial Sequence: Synthetic peptide"
IWAKYEQKL

SEQ ID NO: 4459 - protein, 9 aa, Artificial Sequence
  source: /note="Description of Artificial Sequence: Synthetic peptide"
KERWIWAKY

SEQ ID NO: 4460 - protein, 9 aa, Artificial Sequence
  source: /note="Description of Artificial Sequence: Synthetic peptide"
WAKYEQKLF

SEQ ID NO: 4461 - protein, 9 aa, Artificial Sequence
  source: /note="Description of Artificial Sequence: Synthetic peptide"
EEKERWIWA

SEQ ID NO: 4462 - protein, 10 aa, Artificial Sequence
  source: /note="Description of Artificial Sequence: Synthetic peptide"
WIWAKYEQKL

SEQ ID NO: 4463 - protein, 10 aa, Artificial Sequence
  source: /note="Description of Artificial Sequence: Synthetic peptide"
IWAKYEQKLF

SEQ ID NO: 4464 - protein, 10 aa, Artificial Sequence
  source: /note="Description of Artificial Sequence: Synthetic peptide"
RWIWAKYEQK

SEQ ID NO: 4465 - protein, 10 aa, Artificial Sequence
  source: /note="Description of Artificial Sequence: Synthetic peptide"
REEKERWIWA

SEQ ID NO: 4466 - protein, 9 aa, Artificial Sequence
  source: /note="Description of Artificial Sequence: Synthetic peptide"
TLKQKLWSL

SEQ ID NO: 4467 - protein, 9 aa, Artificial Sequence
  source: /note="Description of Artificial Sequence: Synthetic peptide"
HVRDGRCLK

SEQ ID NO: 4468 - protein, 9 aa, Artificial Sequence
  source: /note="Description of Artificial Sequence: Synthetic peptide"
CLKLWSLTF

SEQ ID NO: 4469 - protein, 9 aa, Artificial Sequence
  source: /note="Description of Artificial Sequence: Synthetic peptide"
LWSLTFLPI

SEQ ID NO: 4470 - protein, 9 aa, Artificial Sequence
  source: /note="Description of Artificial Sequence: Synthetic peptide"
YSRGTLKQK

SEQ ID NO: 4471 - protein, 9 aa, Artificial Sequence
  source: /note="Description of Artificial Sequence: Synthetic peptide"
KQKLWSLTL

SEQ ID NO: 4472 - protein, 9 aa, Artificial Sequence
  source: /note="Description of Artificial Sequence: Synthetic peptide"
HMHHVRDGR

SEQ ID NO: 4473 - protein, 9 aa, Artificial Sequence
  source: /note="Description of Artificial Sequence: Synthetic peptide"
LPIQSQAQY

SEQ ID NO: 4474 - protein, 9 aa, Artificial Sequence
  source: /note="Description of Artificial Sequence: Synthetic peptide"
LKLWSLTFL

SEQ ID NO: 4475 - protein, 9 aa, Artificial Sequence
  source: /note="Description of Artificial Sequence: Synthetic peptide"
SQAQYSRGT

SEQ ID NO: 4476 - protein, 9 aa, Artificial Sequence
  source: /note="Description of Artificial Sequence: Synthetic peptide"
QKLWSLTLL

SEQ ID NO: 4477 - protein, 10 aa, Artificial Sequence
  source: /note="Description of Artificial Sequence: Synthetic peptide"
KLWSLTFLPI

SEQ ID NO: 4478 - protein, 10 aa, Artificial Sequence
  source: /note="Description of Artificial Sequence: Synthetic peptide"
KLWSLTLLPI

SEQ ID NO: 4479 - protein, 10 aa, Artificial Sequence
  source: /note="Description of Artificial Sequence: Synthetic peptide"
CLKLWSLTFL

SEQ ID NO: 4480 - protein, 10 aa, Artificial Sequence
  source: /note="Description of Artificial Sequence: Synthetic peptide"
KQKLWSLTLL

SEQ ID NO: 4481 - protein, 10 aa, Artificial Sequence
  source: /note="Description of Artificial Sequence: Synthetic peptide"
RCLKLWSLTF

SEQ ID NO: 4482 - protein, 10 aa, Artificial Sequence
  source: /note="Description of Artificial Sequence: Synthetic peptide"
HVRDGRCLKL

SEQ ID NO: 4483 - protein, 10 aa, Artificial Sequence
  source: /note="Description of Artificial Sequence: Synthetic peptide"
FLPIQSQAQY

SEQ ID NO: 4484 - protein, 10 aa, Artificial Sequence
  source: /note="Description of Artificial Sequence: Synthetic peptide"
LTFLPIQSQA

SEQ ID NO: 4485 - protein, 10 aa, Artificial Sequence
  source: /note="Description of Artificial Sequence: Synthetic peptide"
DGRCLKLWSL

SEQ ID NO: 4486 - protein, 10 aa, Artificial Sequence
  source: /note="Description of Artificial Sequence: Synthetic peptide"
SQAQYSRGTL

SEQ ID NO: 4487 - protein, 10 aa, Artificial Sequence
  source: /note="Description of Artificial Sequence: Synthetic peptide"
LKQKLWSLTL

SEQ ID NO: 4488 - protein, 10 aa, Artificial Sequence
  source: /note="Description of Artificial Sequence: Synthetic peptide"
YSRGTLKQML

SEQ ID NO: 4489 - protein, 9 aa, Artificial Sequence
  source: /note="Description of Artificial Sequence: Synthetic peptide"
RRINCTNHV

SEQ ID NO: 4490 - protein, 10 aa, Artificial Sequence
  source: /note="Description of Artificial Sequence: Synthetic peptide"
RINCTNHVSA

SEQ ID NO: 4491 - protein, 9 aa, Artificial Sequence
  source: /note="Description of Artificial Sequence: Synthetic peptide"
HMHHVRDRR

SEQ ID NO: 4492 - protein, 9 aa, Artificial Sequence
  source: /note="Description of Artificial Sequence: Synthetic peptide"
HVRDRRCLK

SEQ ID NO: 4493 - protein, 9 aa, Artificial Sequence
  source: /note="Description of Artificial Sequence: Synthetic peptide"
CLKLWSLTL

SEQ ID NO: 4494 - protein, 9 aa, Artificial Sequence
  source: /note="Description of Artificial Sequence: Synthetic peptide"
RRCLKLWSL

SEQ ID NO: 4495 - protein, 9 aa, Artificial Sequence
  source: /note="Description of Artificial Sequence: Synthetic peptide"
LKLWSLTLL

SEQ ID NO: 4496 - protein, 10 aa, Artificial Sequence
  source: /note="Description of Artificial Sequence: Synthetic peptide"
KLWSLTLLPI

SEQ ID NO: 4497 - protein, 10 aa, Artificial Sequence
  source: /note="Description of Artificial Sequence: Synthetic peptide"
CLKLWSLTLL

SEQ ID NO: 4498 - protein, 10 aa, Artificial Sequence
  source: /note="Description of Artificial Sequence: Synthetic peptide"
HVRDRRCLKL

SEQ ID NO: 4499 - protein, 10 aa, Artificial Sequence
  source: /note="Description of Artificial Sequence: Synthetic peptide"
DRRCLKLWSL

SEQ ID NO: 4500 - protein, 10 aa, Artificial Sequence
  source: /note="Description of Artificial Sequence: Synthetic peptide"
RCLKLWSLTL

SEQ ID NO: 4501 - protein, 10 aa, Artificial Sequence
  source: /note="Description of Artificial Sequence: Synthetic peptide"
YSRGTLKQML

SEQ ID NO: 4502 - protein, 9 aa, Artificial Sequence
  source: /note="Description of Artificial Sequence: Synthetic peptide"
KLSVRWSNL

SEQ ID NO: 4503 - protein, 9 aa, Artificial Sequence
  source: /note="Description of Artificial Sequence: Synthetic peptide"
LSVRWSNLF

SEQ ID NO: 4504 - protein, 9 aa, Artificial Sequence
  source: /note="Description of Artificial Sequence: Synthetic peptide"
SVRWSNLFT

SEQ ID NO: 4505 - protein, 10 aa, Artificial Sequence
  source: /note="Description of Artificial Sequence: Synthetic peptide"
KLSVRWSNLF

SEQ ID NO: 4506 - protein, 10 aa, Artificial Sequence
  source: /note="Description of Artificial Sequence: Synthetic peptide"
SVRWSNLFTS

SEQ ID NO: 4507 - protein, 10 aa, Artificial Sequence
  source: /note="Description of Artificial Sequence: Synthetic peptide"
TPTPVCKLSV

SEQ ID NO: 4508 - protein, 10 aa, Artificial Sequence
  source: /note="Description of Artificial Sequence: Synthetic peptide"
CKLSVRWSNL

SEQ ID NO: 4509 - protein, 10 aa, Artificial Sequence
  source: /note="Description of Artificial Sequence: Synthetic peptide"
TPVCKLSVRW

SEQ ID NO: 4510 - protein, 9 aa, Artificial Sequence
  source: /note="Description of Artificial Sequence: Synthetic peptide"
CFQKGLLHV

SEQ ID NO: 4511 - protein, 9 aa, Artificial Sequence
  source: /note="Description of Artificial Sequence: Synthetic peptide"
TIPPQREWR

SEQ ID NO: 4512 - protein, 9 aa, Artificial Sequence
  source: /note="Description of Artificial Sequence: Synthetic peptide"
FQKGLLHVR

SEQ ID NO: 4513 - protein, 9 aa, Artificial Sequence
  source: /note="Description of Artificial Sequence: Synthetic peptide"
RCLLCGPAW

SEQ ID NO: 4514 - protein, 9 aa, Artificial Sequence
  source: /note="Description of Artificial Sequence: Synthetic peptide"
LCGPAWTCF

SEQ ID NO: 4515 - protein, 9 aa, Artificial Sequence
  source: /note="Description of Artificial Sequence: Synthetic peptide"
REWRCLLCG

SEQ ID NO: 4516 - protein, 10 aa, Artificial Sequence
  source: /note="Description of Artificial Sequence: Synthetic peptide"
CGPAWTCFQK

SEQ ID NO: 4517 - protein, 10 aa, Artificial Sequence
  source: /note="Description of Artificial Sequence: Synthetic peptide"
DTIPPQREWR

SEQ ID NO: 4518 - protein, 10 aa, Artificial Sequence
  source: /note="Description of Artificial Sequence: Synthetic peptide"
CFQKGLLHVR

SEQ ID NO: 4519 - protein, 10 aa, Artificial Sequence
  source: /note="Description of Artificial Sequence: Synthetic peptide"
LLCGPAWTCF

SEQ ID NO: 4520 - protein, 10 aa, Artificial Sequence
  source: /note="Description of Artificial Sequence: Synthetic peptide"
WRCLLCGPAW

SEQ ID NO: 4521 - protein, 10 aa, Artificial Sequence
  source: /note="Description of Artificial Sequence: Synthetic peptide"
REWRCLLCGP

SEQ ID NO: 4522 - protein, 9 aa, Artificial Sequence
  source: /note="Description of Artificial Sequence: Synthetic peptide"
MMGCDLVEV

SEQ ID NO: 4523 - protein, 9 aa, Artificial Sequence
  source: /note="Description of Artificial Sequence: Synthetic peptide"
IRGCQGLNM

SEQ ID NO: 4524 - protein, 9 aa, Artificial Sequence
  source: /note="Description of Artificial Sequence: Synthetic peptide"
RGCQGLNMM

SEQ ID NO: 4525 - protein, 10 aa, Artificial Sequence
  source: /note="Description of Artificial Sequence: Synthetic peptide"
GLNMMGCDLV

SEQ ID NO: 4526 - protein, 10 aa, Artificial Sequence
  source: /note="Description of Artificial Sequence: Synthetic peptide"
NMMGCDLVEV

SEQ ID NO: 4527 - protein, 10 aa, Artificial Sequence
  source: /note="Description of Artificial Sequence: Synthetic peptide"
IIRGCQGLNM

SEQ ID NO: 4528 - protein, 10 aa, Artificial Sequence
  source: /note="Description of Artificial Sequence: Synthetic peptide"
IRGCQGLNMM

SEQ ID NO: 4529 - protein, 9 aa, Artificial Sequence
  source: /note="Description of Artificial Sequence: Synthetic peptide"
RTKGFTITV

SEQ ID NO: 4530 - protein, 9 aa, Artificial Sequence
  source: /note="Description of Artificial Sequence: Synthetic peptide"
FTITVRSLR

SEQ ID NO: 4531 - protein, 9 aa, Artificial Sequence
  source: /note="Description of Artificial Sequence: Synthetic peptide"
LPRTKGFTI

SEQ ID NO: 4532 - protein, 10 aa, Artificial Sequence
  source: /note="Description of Artificial Sequence: Synthetic peptide"
LLPRTKGFTI

SEQ ID NO: 4533 - protein, 10 aa, Artificial Sequence
  source: /note="Description of Artificial Sequence: Synthetic peptide"
RTKGFTITVR

SEQ ID NO: 4534 - protein, 10 aa, Artificial Sequence
  source: /note="Description of Artificial Sequence: Synthetic peptide"
KGFTITVRSL

SEQ ID NO: 4535 - protein, 10 aa, Artificial Sequence
  source: /note="Description of Artificial Sequence: Synthetic peptide"
GFTITVRSLR

SEQ ID NO: 4536 - protein, 10 aa, Artificial Sequence
  source: /note="Description of Artificial Sequence: Synthetic peptide"
LPRTKGFTIT

SEQ ID NO: 4537 - protein, 9 aa, Artificial Sequence
  source: /note="Description of Artificial Sequence: Synthetic peptide"
ASRLPSSAA

SEQ ID NO: 4538 - protein, 9 aa, Artificial Sequence
  source: /note="Description of Artificial Sequence: Synthetic peptide"
RLPSSAAPR

SEQ ID NO: 4539 - protein, 9 aa, Artificial Sequence
  source: /note="Description of Artificial Sequence: Synthetic peptide"
SSAAPRAPH

SEQ ID NO: 4540 - protein, 9 aa, Artificial Sequence
  source: /note="Description of Artificial Sequence: Synthetic peptide"
APRAPHPSH

SEQ ID NO: 4541 - protein, 9 aa, Artificial Sequence
  source: /note="Description of Artificial Sequence: Synthetic peptide"
LPSSAAPRA

SEQ ID NO: 4542 - protein, 10 aa, Artificial Sequence
  source: /note="Description of Artificial Sequence: Synthetic peptide"
RLPSSAAPRA

SEQ ID NO: 4543 - protein, 10 aa, Artificial Sequence
  source: /note="Description of Artificial Sequence: Synthetic peptide"
APRAPHPSHT

SEQ ID NO: 4544 - protein, 9 aa, Artificial Sequence
  source: /note="Description of Artificial Sequence: Synthetic peptide"
FAVEVFCSA

SEQ ID NO: 4545 - protein, 9 aa, Artificial Sequence
  source: /note="Description of Artificial Sequence: Synthetic peptide"
FCSALTQHM

SEQ ID NO: 4546 - protein, 9 aa, Artificial Sequence
  source: /note="Description of Artificial Sequence: Synthetic peptide"
VEVFCSALT

SEQ ID NO: 4547 - protein, 10 aa, Artificial Sequence
  source: /note="Description of Artificial Sequence: Synthetic peptide"
FAVEVFCSAL

SEQ ID NO: 4548 - protein, 10 aa, Artificial Sequence
  source: /note="Description of Artificial Sequence: Synthetic peptide"
CSALTQHMER

SEQ ID NO: 4549 - protein, 10 aa, Artificial Sequence
  source: /note="Description of Artificial Sequence: Synthetic peptide"
VFCSALTQHM

SEQ ID NO: 4550 - protein, 9 aa, Artificial Sequence
  source: /note="Description of Artificial Sequence: Synthetic peptide"
KPKPKKNKK

SEQ ID NO: 4551 - protein, 9 aa, Artificial Sequence
  source: /note="Description of Artificial Sequence: Synthetic peptide"
KMKGDVDVF

SEQ ID NO: 4552 - protein, 10 aa, Artificial Sequence
  source: /note="Description of Artificial Sequence: Synthetic peptide"
KMKGDVDVFL

SEQ ID NO: 4553 - protein, 10 aa, Artificial Sequence
  source: /note="Description of Artificial Sequence: Synthetic peptide"
KGDVDVFLPK

SEQ ID NO: 4554 - protein, 10 aa, Artificial Sequence
  source: /note="Description of Artificial Sequence: Synthetic peptide"
PKMKGDVDVF

SEQ ID NO: 4555 - protein, 9 aa, Artificial Sequence
  source: /note="Description of Artificial Sequence: Synthetic peptide"
KEEETTREL

SEQ ID NO: 4556 - protein, 9 aa, Artificial Sequence
  source: /note="Description of Artificial Sequence: Synthetic peptide"
EEETTRELL

SEQ ID NO: 4557 - protein, 10 aa, Artificial Sequence
  source: /note="Description of Artificial Sequence: Synthetic peptide"
KEEETTRELL

SEQ ID NO: 4558 - protein, 10 aa, Artificial Sequence
  source: /note="Description of Artificial Sequence: Synthetic peptide"
EEETTRELLL

SEQ ID NO: 4559 - protein, 10 aa, Artificial Sequence
  source: /note="Description of Artificial Sequence: Synthetic peptide"
IEGEMKVPDV

SEQ ID NO: 4560 - protein, 10 aa, Artificial Sequence
  source: /note="Description of Artificial Sequence: Synthetic peptide"
VPKIEGEMKV

SEQ ID NO: 4561 - protein, 9 aa, Artificial Sequence
  source: /note="Description of Artificial Sequence: Synthetic peptide"
HFKGPKISM

SEQ ID NO: 4562 - protein, 10 aa, Artificial Sequence
  source: /note="Description of Artificial Sequence: Synthetic peptide"
MHFKGPKISM

SEQ ID NO: 4563 - protein, 10 aa, Artificial Sequence
  source: /note="Description of Artificial Sequence: Synthetic peptide"
PEMHFKGPKI

SEQ ID NO: 4564 - protein, 9 aa, Artificial Sequence
  source: /note="Description of Artificial Sequence: Synthetic peptide"
VQGPHWHLK

SEQ ID NO: 4565 - protein, 9 aa, Artificial Sequence
  source: /note="Description of Artificial Sequence: Synthetic peptide"
NVQGPHWHL

SEQ ID NO: 4566 - protein, 10 aa, Artificial Sequence
  source: /note="Description of Artificial Sequence: Synthetic peptide"
NVQGPHWHLK

SEQ ID NO: 4567 - protein, 10 aa, Artificial Sequence
  source: /note="Description of Artificial Sequence: Synthetic peptide"
HWHLKMPKMK

SEQ ID NO: 4568 - protein, 10 aa, Artificial Sequence
  source: /note="Description of Artificial Sequence: Synthetic peptide"
VQGPHWHLKM

SEQ ID NO: 4569 - protein, 9 aa, Artificial Sequence
  source: /note="Description of Artificial Sequence: Synthetic peptide"
SPSADLEVH

SEQ ID NO: 4570 - protein, 9 aa, Artificial Sequence
  source: /note="Description of Artificial Sequence: Synthetic peptide"
AQMEGDLSL

SEQ ID NO: 4571 - protein, 9 aa, Artificial Sequence
  source: /note="Description of Artificial Sequence: Synthetic peptide"
QMEGDLSLA

SEQ ID NO: 4572 - protein, 9 aa, Artificial Sequence
  source: /note="Description of Artificial Sequence: Synthetic peptide"
RAKLDGAQM

SEQ ID NO: 4573 - protein, 10 aa, Artificial Sequence
  source: /note="Description of Artificial Sequence: Synthetic peptide"
AQMEGDLSLA

SEQ ID NO: 4574 - protein, 9 aa, Artificial Sequence
  source: /note="Description of Artificial Sequence: Synthetic peptide"
KMPSFGVFA

SEQ ID NO: 4575 - protein, 9 aa, Artificial Sequence
  source: /note="Description of Artificial Sequence: Synthetic peptide"
SFGVFAPGK

SEQ ID NO: 4576 - protein, 9 aa, Artificial Sequence
  source: /note="Description of Artificial Sequence: Synthetic peptide"
FKMPSFGVF

SEQ ID NO: 4577 - protein, 9 aa, Artificial Sequence
  source: /note="Description of Artificial Sequence: Synthetic peptide"
GVFAPGKSI

SEQ ID NO: 4578 - protein, 9 aa, Artificial Sequence
  source: /note="Description of Artificial Sequence: Synthetic peptide"
MPSFGVFAP

SEQ ID NO: 4579 - protein, 10 aa, Artificial Sequence
  source: /note="Description of Artificial Sequence: Synthetic peptide"
PSFGVFAPGK

SEQ ID NO: 4580 - protein, 10 aa, Artificial Sequence
  source: /note="Description of Artificial Sequence: Synthetic peptide"
KFKMPSFGVF

SEQ ID NO: 4581 - protein, 10 aa, Artificial Sequence
  source: /note="Description of Artificial Sequence: Synthetic peptide"
MPSFGVFAPG

SEQ ID NO: 4582 - protein, 10 aa, Artificial Sequence
  source: /note="Description of Artificial Sequence: Synthetic peptide"
FKMPSFGVFA

SEQ ID NO: 4583 - protein, 9 aa, Artificial Sequence
  source: /note="Description of Artificial Sequence: Synthetic peptide"
RLHGAGVQI

SEQ ID NO: 4584 - protein, 10 aa, Artificial Sequence
  source: /note="Description of Artificial Sequence: Synthetic peptide"
GLRRLHGAGV

SEQ ID NO: 4585 - protein, 10 aa, Artificial Sequence
  source: /note="Description of Artificial Sequence: Synthetic peptide"
RLHGAGVQIA

SEQ ID NO: 4586 - protein, 10 aa, Artificial Sequence
  source: /note="Description of Artificial Sequence: Synthetic peptide"
RRLHGAGVQI

SEQ ID NO: 4587 - protein, 10 aa, Artificial Sequence
  source: /note="Description of Artificial Sequence: Synthetic peptide"
LHGAGVQIAI

SEQ ID NO: 4588 - protein, 10 aa, Artificial Sequence
  source: /note="Description of Artificial Sequence: Synthetic peptide"
HGAGVQIAIM

SEQ ID NO: 4589 - protein, 9 aa, Artificial Sequence
  source: /note="Description of Artificial Sequence: Synthetic peptide"
IMTFKDFFY

SEQ ID NO: 4590 - protein, 9 aa, Artificial Sequence
  source: /note="Description of Artificial Sequence: Synthetic peptide"
MTFKDFFYC

SEQ ID NO: 4591 - protein, 9 aa, Artificial Sequence
  source: /note="Description of Artificial Sequence: Synthetic peptide"
FFYCWNTFV

SEQ ID NO: 4592 - protein, 9 aa, Artificial Sequence
  source: /note="Description of Artificial Sequence: Synthetic peptide"
TFKDFFYCW

SEQ ID NO: 4593 - protein, 9 aa, Artificial Sequence
  source: /note="Description of Artificial Sequence: Synthetic peptide"
DFFYCWNTF

SEQ ID NO: 4594 - protein, 9 aa, Artificial Sequence
  source: /note="Description of Artificial Sequence: Synthetic peptide"
IAIMTFKDF

SEQ ID NO: 4595 - protein, 9 aa, Artificial Sequence
  source: /note="Description of Artificial Sequence: Synthetic peptide"
AIMTFKDFF

SEQ ID NO: 4596 - protein, 9 aa, Artificial Sequence
  source: /note="Description of Artificial Sequence: Synthetic peptide"
KDFFYCWNT

SEQ ID NO: 4597 - protein, 10 aa, Artificial Sequence
  source: /note="Description of Artificial Sequence: Synthetic peptide"
AIMTFKDFFY

SEQ ID NO: 4598 - protein, 10 aa, Artificial Sequence
  source: /note="Description of Artificial Sequence: Synthetic peptide"
IAIMTFKDFF

SEQ ID NO: 4599 - protein, 10 aa, Artificial Sequence
  source: /note="Description of Artificial Sequence: Synthetic peptide"
MTFKDFFYCW

SEQ ID NO: 4600 - protein, 10 aa, Artificial Sequence
  source: /note="Description of Artificial Sequence: Synthetic peptide"
KDFFYCWNTF

SEQ ID NO: 4601 - protein, 10 aa, Artificial Sequence
  source: /note="Description of Artificial Sequence: Synthetic peptide"
DFFYCWNTFV

SEQ ID NO: 4602 - protein, 9 aa, Artificial Sequence
  source: /note="Description of Artificial Sequence: Synthetic peptide"
IFFEFKHYM

SEQ ID NO: 4603 - protein, 9 aa, Artificial Sequence
  source: /note="Description of Artificial Sequence: Synthetic peptide"
EFKHYMPKK

SEQ ID NO: 4604 - protein, 9 aa, Artificial Sequence
  source: /note="Description of Artificial Sequence: Synthetic peptide"
MPKKRFTST

SEQ ID NO: 4605 - protein, 9 aa, Artificial Sequence
  source: /note="Description of Artificial Sequence: Synthetic peptide"
FEFKHYMPK

SEQ ID NO: 4606 - protein, 9 aa, Artificial Sequence
  source: /note="Description of Artificial Sequence: Synthetic peptide"
KHYMPKKRF

SEQ ID NO: 4607 - protein, 10 aa, Artificial Sequence
  source: /note="Description of Artificial Sequence: Synthetic peptide"
YMPKKRFTST

SEQ ID NO: 4608 - protein, 10 aa, Artificial Sequence
  source: /note="Description of Artificial Sequence: Synthetic peptide"
MPKKRFTSTK

SEQ ID NO: 4609 - protein, 10 aa, Artificial Sequence
  source: /note="Description of Artificial Sequence: Synthetic peptide"
FFEFKHYMPK

SEQ ID NO: 4610 - protein, 10 aa, Artificial Sequence
  source: /note="Description of Artificial Sequence: Synthetic peptide"
EFKHYMPKKR

SEQ ID NO: 4611 - protein, 10 aa, Artificial Sequence
  source: /note="Description of Artificial Sequence: Synthetic peptide"
AIFFEFKHYM

SEQ ID NO: 4612 - protein, 10 aa, Artificial Sequence
  source: /note="Description of Artificial Sequence: Synthetic peptide"
FKHYMPKKRF

SEQ ID NO: 4613 - protein, 9 aa, Artificial Sequence
  source: /note="Description of Artificial Sequence: Synthetic peptide"
AVLQWRLQR

SEQ ID NO: 4614 - protein, 9 aa, Artificial Sequence
  source: /note="Description of Artificial Sequence: Synthetic peptide"
QWRLQRTIK

SEQ ID NO: 4615 - protein, 9 aa, Artificial Sequence
  source: /note="Description of Artificial Sequence: Synthetic peptide"
RTIKEQALL

SEQ ID NO: 4616 - protein, 9 aa, Artificial Sequence
  source: /note="Description of Artificial Sequence: Synthetic peptide"
LQWRLQRTI

SEQ ID NO: 4617 - protein, 10 aa, Artificial Sequence
  source: /note="Description of Artificial Sequence: Synthetic peptide"
VLQWRLQRTI

SEQ ID NO: 4618 - protein, 10 aa, Artificial Sequence
  source: /note="Description of Artificial Sequence: Synthetic peptide"
EAVLQWRLQR

SEQ ID NO: 4619 - protein, 10 aa, Artificial Sequence
  source: /note="Description of Artificial Sequence: Synthetic peptide"
LQRTIKEQAL

SEQ ID NO: 4620 - protein, 9 aa, Artificial Sequence
  source: /note="Description of Artificial Sequence: Synthetic peptide"
LLSTVMTWV

SEQ ID NO: 4621 - protein, 9 aa, Artificial Sequence
  source: /note="Description of Artificial Sequence: Synthetic peptide"
VMTWVRSKA

SEQ ID NO: 4622 - protein, 9 aa, Artificial Sequence
  source: /note="Description of Artificial Sequence: Synthetic peptide"
TVMTWVRSK

SEQ ID NO: 4623 - protein, 9 aa, Artificial Sequence
  source: /note="Description of Artificial Sequence: Synthetic peptide"
MTWVRSKAL

SEQ ID NO: 4624 - protein, 9 aa, Artificial Sequence
  source: /note="Description of Artificial Sequence: Synthetic peptide"
LSTVMTWVR

SEQ ID NO: 4625 - protein, 10 aa, Artificial Sequence
  source: /note="Description of Artificial Sequence: Synthetic peptide"
ILLSTVMTWV

SEQ ID NO: 4626 - protein, 10 aa, Artificial Sequence
  source: /note="Description of Artificial Sequence: Synthetic peptide"
TVMTWVRSKA

SEQ ID NO: 4627 - protein, 10 aa, Artificial Sequence
  source: /note="Description of Artificial Sequence: Synthetic peptide"
VMTWVRSKAL

SEQ ID NO: 4628 - protein, 10 aa, Artificial Sequence
  source: /note="Description of Artificial Sequence: Synthetic peptide"
STVMTWVRSK

SEQ ID NO: 4629 - protein, 10 aa, Artificial Sequence
  source: /note="Description of Artificial Sequence: Synthetic peptide"
LLSTVMTWVR

SEQ ID NO: 4630 - protein, 9 aa, Artificial Sequence
  source: /note="Description of Artificial Sequence: Synthetic peptide"
KILKVISAA

SEQ ID NO: 4631 - protein, 9 aa, Artificial Sequence
  source: /note="Description of Artificial Sequence: Synthetic peptide"
VISAAQPCV

SEQ ID NO: 4632 - protein, 9 aa, Artificial Sequence
  source: /note="Description of Artificial Sequence: Synthetic peptide"
AQPCVDVFY

SEQ ID NO: 4633 - protein, 9 aa, Artificial Sequence
  source: /note="Description of Artificial Sequence: Synthetic peptide"
AAQPCVDVF

SEQ ID NO: 4634 - protein, 10 aa, Artificial Sequence
  source: /note="Description of Artificial Sequence: Synthetic peptide"
KVISAAQPCV

SEQ ID NO: 4635 - protein, 10 aa, Artificial Sequence
  source: /note="Description of Artificial Sequence: Synthetic peptide"
AAQPCVDVFY

SEQ ID NO: 4636 - protein, 10 aa, Artificial Sequence
  source: /note="Description of Artificial Sequence: Synthetic peptide"
SAAQPCVDVF

SEQ ID NO: 4637 - protein, 9 aa, Artificial Sequence
  source: /note="Description of Artificial Sequence: Synthetic peptide"
KTKDVPFFK

SEQ ID NO: 4638 - protein, 9 aa, Artificial Sequence
  source: /note="Description of Artificial Sequence: Synthetic peptide"
KDVPFFKGL

SEQ ID NO: 4639 - protein, 10 aa, Artificial Sequence
  source: /note="Description of Artificial Sequence: Synthetic peptide"
KTKDVPFFKG

SEQ ID NO: 4640 - protein, 9 aa, Artificial Sequence
  source: /note="Description of Artificial Sequence: Synthetic peptide"
ALSPVMVPR

SEQ ID NO: 4641 - protein, 9 aa, Artificial Sequence
  source: /note="Description of Artificial Sequence: Synthetic peptide"
KRRTKPAAL

SEQ ID NO: 4642 - protein, 9 aa, Artificial Sequence
  source: /note="Description of Artificial Sequence: Synthetic peptide"
RTKPAALSP

SEQ ID NO: 4643 - protein, 9 aa, Artificial Sequence
  source: /note="Description of Artificial Sequence: Synthetic peptide"
RQKYQQRVK

SEQ ID NO: 4644 - protein, 9 aa, Artificial Sequence
  source: /note="Description of Artificial Sequence: Synthetic peptide"
QQRVKRSSA

SEQ ID NO: 4645 - protein, 9 aa, Artificial Sequence
  source: /note="Description of Artificial Sequence: Synthetic peptide"
RVKRSSADP

SEQ ID NO: 4646 - protein, 9 aa, Artificial Sequence
  source: /note="Description of Artificial Sequence: Synthetic peptide"
RSSADPLPL

SEQ ID NO: 4647 - protein, 9 aa, Artificial Sequence
  source: /note="Description of Artificial Sequence: Synthetic peptide"
KPAALSPVM

SEQ ID NO: 4648 - protein, 9 aa, Artificial Sequence
  source: /note="Description of Artificial Sequence: Synthetic peptide"
EKKRRTKPA

SEQ ID NO: 4649 - protein, 9 aa, Artificial Sequence
  source: /note="Description of Artificial Sequence: Synthetic peptide"
YQQRVKRSS

SEQ ID NO: 4650 - protein, 9 aa, Artificial Sequence
  source: /note="Description of Artificial Sequence: Synthetic peptide"
VKRSSADPL

SEQ ID NO: 4651 - protein, 10 aa, Artificial Sequence
  source: /note="Description of Artificial Sequence: Synthetic peptide"
RTKPAALSPV

SEQ ID NO: 4652 - protein, 10 aa, Artificial Sequence
  source: /note="Description of Artificial Sequence: Synthetic peptide"
AALSPVMVPR

SEQ ID NO: 4653 - protein, 10 aa, Artificial Sequence
  source: /note="Description of Artificial Sequence: Synthetic peptide"
RQKYQQRVKR

SEQ ID NO: 4654 - protein, 10 aa, Artificial Sequence
  source: /note="Description of Artificial Sequence: Synthetic peptide"
RVKRSSADPL

SEQ ID NO: 4655 - protein, 10 aa, Artificial Sequence
  source: /note="Description of Artificial Sequence: Synthetic peptide"
MVPRQKYQQR

SEQ ID NO: 4656 - protein, 10 aa, Artificial Sequence
  source: /note="Description of Artificial Sequence: Synthetic peptide"
KPAALSPVMV

SEQ ID NO: 4657 - protein, 10 aa, Artificial Sequence
  source: /note="Description of Artificial Sequence: Synthetic peptide"
VPRQKYQQRV

SEQ ID NO: 4658 - protein, 10 aa, Artificial Sequence
  source: /note="Description of Artificial Sequence: Synthetic peptide"
KKRRTKPAAL

SEQ ID NO: 4659 - protein, 10 aa, Artificial Sequence
  source: /note="Description of Artificial Sequence: Synthetic peptide"
TKPAALSPVM

SEQ ID NO: 4660 - protein, 10 aa, Artificial Sequence
  source: /note="Description of Artificial Sequence: Synthetic peptide"
YQQRVKRSSA

SEQ ID NO: 4661 - protein, 10 aa, Artificial Sequence
  source: /note="Description of Artificial Sequence: Synthetic peptide"
KRSSADPLPL

SEQ ID NO: 4662 - protein, 10 aa, Artificial Sequence
  source: /note="Description of Artificial Sequence: Synthetic peptide"
SPVMVPRQKY

SEQ ID NO: 4663 - protein, 9 aa, Artificial Sequence
  source: /note="Description of Artificial Sequence: Synthetic peptide"
RTRNWVIQQ

SEQ ID NO: 4664 - protein, 9 aa, Artificial Sequence
  source: /note="Description of Artificial Sequence: Synthetic peptide"
SDRTRNWVI

SEQ ID NO: 4665 - protein, 9 aa, Artificial Sequence
  source: /note="Description of Artificial Sequence: Synthetic peptide"
RNWVIQQKI

SEQ ID NO: 4666 - protein, 10 aa, Artificial Sequence
  source: /note="Description of Artificial Sequence: Synthetic peptide"
RTRNWVIQQK

SEQ ID NO: 4667 - protein, 9 aa, Artificial Sequence
  source: /note="Description of Artificial Sequence: Synthetic peptide"
RMGGSQLSR

SEQ ID NO: 4668 - protein, 9 aa, Artificial Sequence
  source: /note="Description of Artificial Sequence: Synthetic peptide"
LARMGGSQL

SEQ ID NO: 4669 - protein, 10 aa, Artificial Sequence
  source: /note="Description of Artificial Sequence: Synthetic peptide"
RMGGSQLSRI

SEQ ID NO: 4670 - protein, 10 aa, Artificial Sequence
  source: /note="Description of Artificial Sequence: Synthetic peptide"
LLARMGGSQL

SEQ ID NO: 4671 - protein, 9 aa, Artificial Sequence
  source: /note="Description of Artificial Sequence: Synthetic peptide"
MLLEMMKRL

SEQ ID NO: 4672 - protein, 9 aa, Artificial Sequence
  source: /note="Description of Artificial Sequence: Synthetic peptide"
TMMILKTSL

SEQ ID NO: 4673 - protein, 9 aa, Artificial Sequence
  source: /note="Description of Artificial Sequence: Synthetic peptide"
NLKKTMMIL

SEQ ID NO: 4674 - protein, 9 aa, Artificial Sequence
  source: /note="Description of Artificial Sequence: Synthetic peptide"
RMLLEMMKR

SEQ ID NO: 4675 - protein, 9 aa, Artificial Sequence
  source: /note="Description of Artificial Sequence: Synthetic peptide"
EMMKRLVRK

SEQ ID NO: 4676 - protein, 9 aa, Artificial Sequence
  source: /note="Description of Artificial Sequence: Synthetic peptide"
RLVRKNLKK

SEQ ID NO: 4677 - protein, 9 aa, Artificial Sequence
  source: /note="Description of Artificial Sequence: Synthetic peptide"
MMILKTSLK

SEQ ID NO: 4678 - protein, 9 aa, Artificial Sequence
  source: /note="Description of Artificial Sequence: Synthetic peptide"
TSLKMSFQK

SEQ ID NO: 4679 - protein, 9 aa, Artificial Sequence
  source: /note="Description of Artificial Sequence: Synthetic peptide"
KMSFQKMRK

SEQ ID NO: 4680 - protein, 9 aa, Artificial Sequence
  source: /note="Description of Artificial Sequence: Synthetic peptide"
MSFQKMRKR

SEQ ID NO: 4681 - protein, 9 aa, Artificial Sequence
  source: /note="Description of Artificial Sequence: Synthetic peptide"
KRLVRKNLK

SEQ ID NO: 4682 - protein, 9 aa, Artificial Sequence
  source: /note="Description of Artificial Sequence: Synthetic peptide"
KNLKKTMMI

SEQ ID NO: 4683 - protein, 9 aa, Artificial Sequence
  source: /note="Description of Artificial Sequence: Synthetic peptide"
LKKTMMILK

SEQ ID NO: 4684 - protein, 9 aa, Artificial Sequence
  source: /note="Description of Artificial Sequence: Synthetic peptide"
KTMMILKTS

SEQ ID NO: 4685 - protein, 9 aa, Artificial Sequence
  source: /note="Description of Artificial Sequence: Synthetic peptide"
KTSLKMSFQ

SEQ ID NO: 4686 - protein, 9 aa, Artificial Sequence
  source: /note="Description of Artificial Sequence: Synthetic peptide"
SLKMSFQKM

SEQ ID NO: 4687 - protein, 9 aa, Artificial Sequence
  source: /note="Description of Artificial Sequence: Synthetic peptide"
MKRLVRKNL

SEQ ID NO: 4688 - protein, 9 aa, Artificial Sequence
  source: /note="Description of Artificial Sequence: Synthetic peptide"
MILKTSLKM

SEQ ID NO: 4689 - protein, 9 aa, Artificial Sequence
  source: /note="Description of Artificial Sequence: Synthetic peptide"
KGGRMLLEM

SEQ ID NO: 4690 - protein, 9 aa, Artificial Sequence
  source: /note="Description of Artificial Sequence: Synthetic peptide"
RKNLKKTMM

SEQ ID NO: 4691 - protein, 9 aa, Artificial Sequence
  source: /note="Description of Artificial Sequence: Synthetic peptide"
LKTSLKMSF

SEQ ID NO: 4692 - protein, 10 aa, Artificial Sequence
  source: /note="Description of Artificial Sequence: Synthetic peptide"
MLLEMMKRLV

SEQ ID NO: 4693 - protein, 10 aa, Artificial Sequence
  source: /note="Description of Artificial Sequence: Synthetic peptide"
MMILKTSLKM

SEQ ID NO: 4694 - protein, 10 aa, Artificial Sequence
  source: /note="Description of Artificial Sequence: Synthetic peptide"
NLKKTMMILK

SEQ ID NO: 4695 - protein, 10 aa, Artificial Sequence
  source: /note="Description of Artificial Sequence: Synthetic peptide"
TMMILKTSLK

SEQ ID NO: 4696 - protein, 10 aa, Artificial Sequence
  source: /note="Description of Artificial Sequence: Synthetic peptide"
KTSLKMSFQK

SEQ ID NO: 4697 - protein, 10 aa, Artificial Sequence
  source: /note="Description of Artificial Sequence: Synthetic peptide"
KMSFQKMRKR

SEQ ID NO: 4698 - protein, 10 aa, Artificial Sequence
  source: /note="Description of Artificial Sequence: Synthetic peptide"
GGRMLLEMMK

SEQ ID NO: 4699 - protein, 10 aa, Artificial Sequence
  source: /note="Description of Artificial Sequence: Synthetic peptide"
MMKRLVRKNL

SEQ ID NO: 4700 - protein, 10 aa, Artificial Sequence
  source: /note="Description of Artificial Sequence: Synthetic peptide"
MKRLVRKNLK

SEQ ID NO: 4701 - protein, 10 aa, Artificial Sequence
  source: /note="Description of Artificial Sequence: Synthetic peptide"
KRLVRKNLKK

SEQ ID NO: 4702 - protein, 10 aa, Artificial Sequence
  source: /note="Description of Artificial Sequence: Synthetic peptide"
KTMMILKTSL

SEQ ID NO: 4703 - protein, 10 aa, Artificial Sequence
  source: /note="Description of Artificial Sequence: Synthetic peptide"
SLKMSFQKMR

SEQ ID NO: 4704 - protein, 10 aa, Artificial Sequence
  source: /note="Description of Artificial Sequence: Synthetic peptide"
ILKTSLKMSF

SEQ ID NO: 4705 - protein, 10 aa, Artificial Sequence
  source: /note="Description of Artificial Sequence: Synthetic peptide"
LERDKKGGRM

SEQ ID NO: 4706 - protein, 10 aa, Artificial Sequence
  source: /note="Description of Artificial Sequence: Synthetic peptide"
KKGGRMLLEM

SEQ ID NO: 4707 - protein, 10 aa, Artificial Sequence
  source: /note="Description of Artificial Sequence: Synthetic peptide"
RMLLEMMKRL

SEQ ID NO: 4708 - protein, 10 aa, Artificial Sequence
  source: /note="Description of Artificial Sequence: Synthetic peptide"
RKNLKKTMMI

SEQ ID NO: 4709 - protein, 10 aa, Artificial Sequence
  source: /note="Description of Artificial Sequence: Synthetic peptide"
TSLKMSFQKM

SEQ ID NO: 4710 - protein, 9 aa, Artificial Sequence
  source: /note="Description of Artificial Sequence: Synthetic peptide"
NVEKRGHGR

SEQ ID NO: 4711 - protein, 10 aa, Artificial Sequence
  source: /note="Description of Artificial Sequence: Synthetic peptide"
RGHGRINCGR

SEQ ID NO: 4712 - protein, 9 aa, Artificial Sequence
  source: /note="Description of Artificial Sequence: Synthetic peptide"
WLHKRGKYI

SEQ ID NO: 4713 - protein, 9 aa, Artificial Sequence
  source: /note="Description of Artificial Sequence: Synthetic peptide"
LHKRGKYIK

SEQ ID NO: 4714 - protein, 9 aa, Artificial Sequence
  source: /note="Description of Artificial Sequence: Synthetic peptide"
RGKYIKTWR

SEQ ID NO: 4715 - protein, 9 aa, Artificial Sequence
  source: /note="Description of Artificial Sequence: Synthetic peptide"
KYIKTWRPR

SEQ ID NO: 4716 - protein, 9 aa, Artificial Sequence
  source: /note="Description of Artificial Sequence: Synthetic peptide"
GWLHKRGKY

SEQ ID NO: 4717 - protein, 10 aa, Artificial Sequence
  source: /note="Description of Artificial Sequence: Synthetic peptide"
WLHKRGKYIK

SEQ ID NO: 4718 - protein, 10 aa, Artificial Sequence
  source: /note="Description of Artificial Sequence: Synthetic peptide"
KYIKTWRPRY

SEQ ID NO: 4719 - protein, 10 aa, Artificial Sequence
  source: /note="Description of Artificial Sequence: Synthetic peptide"
HKRGKYIKTW

SEQ ID NO: 4720 - protein, 9 aa, Artificial Sequence
  source: /note="Description of Artificial Sequence: Synthetic peptide"
LMLDKDGHM

SEQ ID NO: 4721 - protein, 9 aa, Artificial Sequence
  source: /note="Description of Artificial Sequence: Synthetic peptide"
HMKITDFGL

SEQ ID NO: 4722 - protein, 9 aa, Artificial Sequence
  source: /note="Description of Artificial Sequence: Synthetic peptide"
MLDKDGHMK

SEQ ID NO: 4723 - protein, 10 aa, Artificial Sequence
  source: /note="Description of Artificial Sequence: Synthetic peptide"
MLDKDGHMKI

SEQ ID NO: 4724 - protein, 10 aa, Artificial Sequence
  source: /note="Description of Artificial Sequence: Synthetic peptide"
LMLDKDGHMK

SEQ ID NO: 4725 - protein, 9 aa, Artificial Sequence
  source: /note="Description of Artificial Sequence: Synthetic peptide"
GTRNISRTS

SEQ ID NO: 4726 - protein, 9 aa, Artificial Sequence
  source: /note="Description of Artificial Sequence: Synthetic peptide"
ISRTSKFHV

SEQ ID NO: 4727 - protein, 9 aa, Artificial Sequence
  source: /note="Description of Artificial Sequence: Synthetic peptide"
RTSKFHVDL

SEQ ID NO: 4728 - protein, 9 aa, Artificial Sequence
  source: /note="Description of Artificial Sequence: Synthetic peptide"
RNISRTSKF

SEQ ID NO: 4729 - protein, 10 aa, Artificial Sequence
  source: /note="Description of Artificial Sequence: Synthetic peptide"
NISRTSKFHV

SEQ ID NO: 4730 - protein, 10 aa, Artificial Sequence
  source: /note="Description of Artificial Sequence: Synthetic peptide"
GTRNISRTSK

SEQ ID NO: 4731 - protein, 10 aa, Artificial Sequence
  source: /note="Description of Artificial Sequence: Synthetic peptide"
TRNISRTSKF

SEQ ID NO: 4732 - protein, 9 aa, Artificial Sequence
  source: /note="Description of Artificial Sequence: Synthetic peptide"
YICENQDLI

SEQ ID NO: 4733 - protein, 9 aa, Artificial Sequence
  source: /note="Description of Artificial Sequence: Synthetic peptide"
KYICENQDL

SEQ ID NO: 4734 - protein, 9 aa, Artificial Sequence
  source: /note="Description of Artificial Sequence: Synthetic peptide"
NQDLISSKL

SEQ ID NO: 4735 - protein, 9 aa, Artificial Sequence
  source: /note="Description of Artificial Sequence: Synthetic peptide"
CENQDLISS

SEQ ID NO: 4736 - protein, 10 aa, Artificial Sequence
  source: /note="Description of Artificial Sequence: Synthetic peptide"
KYICENQDLI

SEQ ID NO: 4737 - protein, 10 aa, Artificial Sequence
  source: /note="Description of Artificial Sequence: Synthetic peptide"
AKYICENQDL

SEQ ID NO: 4738 - protein, 9 aa, Artificial Sequence
  source: /note="Description of Artificial Sequence: Synthetic peptide"
CLAFSLGSV

SEQ ID NO: 4739 - protein, 9 aa, Artificial Sequence
  source: /note="Description of Artificial Sequence: Synthetic peptide"
QAACLAFSL

SEQ ID NO: 4740 - protein, 9 aa, Artificial Sequence
  source: /note="Description of Artificial Sequence: Synthetic peptide"
AVQAACLAF

SEQ ID NO: 4741 - protein, 10 aa, Artificial Sequence
  source: /note="Description of Artificial Sequence: Synthetic peptide"
VQAACLAFSL

SEQ ID NO: 4742 - protein, 10 aa, Artificial Sequence
  source: /note="Description of Artificial Sequence: Synthetic peptide"
KAVQAACLAF

SEQ ID NO: 4743 - protein, 10 aa, Artificial Sequence
  source: /note="Description of Artificial Sequence: Synthetic peptide"
CLAFSLGSVW

SEQ ID NO: 4744 - protein, 9 aa, Artificial Sequence
  source: /note="Description of Artificial Sequence: Synthetic peptide"
VATPFGGFK

SEQ ID NO: 4745 - protein, 9 aa, Artificial Sequence
  source: /note="Description of Artificial Sequence: Synthetic peptide"
DVATPFGGF

SEQ ID NO: 4746 - protein, 9 aa, Artificial Sequence
  source: /note="Description of Artificial Sequence: Synthetic peptide"
NKTDVATPF

SEQ ID NO: 4747 - protein, 10 aa, Artificial Sequence
  source: /note="Description of Artificial Sequence: Synthetic peptide"
DVATPFGGFK

SEQ ID NO: 4748 - protein, 10 aa, Artificial Sequence
  source: /note="Description of Artificial Sequence: Synthetic peptide"
YNKTDVATPF

SEQ ID NO: 4749 - protein, 10 aa, Artificial Sequence
  source: /note="Description of Artificial Sequence: Synthetic peptide"
TDVATPFGGF

SEQ ID NO: 4750 - protein, 9 aa, Artificial Sequence
  source: /note="Description of Artificial Sequence: Synthetic peptide"
SMMSLWSGA

SEQ ID NO: 4751 - protein, 9 aa, Artificial Sequence
  source: /note="Description of Artificial Sequence: Synthetic peptide"
MMSLWSGAL

SEQ ID NO: 4752 - protein, 9 aa, Artificial Sequence
  source: /note="Description of Artificial Sequence: Synthetic peptide"
SLGWSGTPL

SEQ ID NO: 4753 - protein, 9 aa, Artificial Sequence
  source: /note="Description of Artificial Sequence: Synthetic peptide"
VVGALLLTV

SEQ ID NO: 4754 - protein, 9 aa, Artificial Sequence
  source: /note="Description of Artificial Sequence: Synthetic peptide"
KLSLRRSSA

SEQ ID NO: 4755 - protein, 9 aa, Artificial Sequence
  source: /note="Description of Artificial Sequence: Synthetic peptide"
ATSTRGSKR

SEQ ID NO: 4756 - protein, 9 aa, Artificial Sequence
  source: /note="Description of Artificial Sequence: Synthetic peptide"
QMPIWIGPW

SEQ ID NO: 4757 - protein, 9 aa, Artificial Sequence
  source: /note="Description of Artificial Sequence: Synthetic peptide"
STRASAAVP

SEQ ID NO: 4758 - protein, 9 aa, Artificial Sequence
  source: /note="Description of Artificial Sequence: Synthetic peptide"
RTSMMSLWS

SEQ ID NO: 4759 - protein, 9 aa, Artificial Sequence
  source: /note="Description of Artificial Sequence: Synthetic peptide"
IARPSRGRR

SEQ ID NO: 4760 - protein, 9 aa, Artificial Sequence
  source: /note="Description of Artificial Sequence: Synthetic peptide"
PSRGRRWMK

SEQ ID NO: 4761 - protein, 9 aa, Artificial Sequence
  source: /note="Description of Artificial Sequence: Synthetic peptide"
RGRRWMKLS

SEQ ID NO: 4762 - protein, 9 aa, Artificial Sequence
  source: /note="Description of Artificial Sequence: Synthetic peptide"
RWMKLSLRR

SEQ ID NO: 4763 - protein, 9 aa, Artificial Sequence
  source: /note="Description of Artificial Sequence: Synthetic peptide"
SLRRSSATS

SEQ ID NO: 4764 - protein, 9 aa, Artificial Sequence
  source: /note="Description of Artificial Sequence: Synthetic peptide"
SATSTRGSK

SEQ ID NO: 4765 - protein, 9 aa, Artificial Sequence
  source: /note="Description of Artificial Sequence: Synthetic peptide"
STRGSKRGR

SEQ ID NO: 4766 - protein, 9 aa, Artificial Sequence
  source: /note="Description of Artificial Sequence: Synthetic peptide"
RGRSCCVVG

SEQ ID NO: 4767 - protein, 9 aa, Artificial Sequence
  source: /note="Description of Artificial Sequence: Synthetic peptide"
SSSPLCLEM

SEQ ID NO: 4768 - protein, 9 aa, Artificial Sequence
  source: /note="Description of Artificial Sequence: Synthetic peptide"
PIWIGPWNR

SEQ ID NO: 4769 - protein, 9 aa, Artificial Sequence
  source: /note="Description of Artificial Sequence: Synthetic peptide"
SSTRASAAV

SEQ ID NO: 4770 - protein, 9 aa, Artificial Sequence
  source: /note="Description of Artificial Sequence: Synthetic peptide"
TVVTSSSPL

SEQ ID NO: 4771 - protein, 9 aa, Artificial Sequence
  source: /note="Description of Artificial Sequence: Synthetic peptide"
RPTSPCSST

SEQ ID NO: 4772 - protein, 9 aa, Artificial Sequence
  source: /note="Description of Artificial Sequence: Synthetic peptide"
GPSCRRTSM

SEQ ID NO: 4773 - protein, 9 aa, Artificial Sequence
  source: /note="Description of Artificial Sequence: Synthetic peptide"
RPSRGRRWM

SEQ ID NO: 4774 - protein, 9 aa, Artificial Sequence
  source: /note="Description of Artificial Sequence: Synthetic peptide"
LELGGRAPT

SEQ ID NO: 4775 - protein, 9 aa, Artificial Sequence
  source: /note="Description of Artificial Sequence: Synthetic peptide"
RAPTSSCQM

SEQ ID NO: 4776 - protein, 9 aa, Artificial Sequence
  source: /note="Description of Artificial Sequence: Synthetic peptide"
CRRTSMMSL

SEQ ID NO: 4777 - protein, 9 aa, Artificial Sequence
  source: /note="Description of Artificial Sequence: Synthetic peptide"
RRTSMMSLW

SEQ ID NO: 4778 - protein, 9 aa, Artificial Sequence
  source: /note="Description of Artificial Sequence: Synthetic peptide"
SLWSGALPG

SEQ ID NO: 4779 - protein, 9 aa, Artificial Sequence
  source: /note="Description of Artificial Sequence: Synthetic peptide"
SGALPGPSL

SEQ ID NO: 4780 - protein, 9 aa, Artificial Sequence
  source: /note="Description of Artificial Sequence: Synthetic peptide"
LGWSGTPLI

SEQ ID NO: 4781 - protein, 9 aa, Artificial Sequence
  source: /note="Description of Artificial Sequence: Synthetic peptide"
GRRWMKLSL

SEQ ID NO: 4782 - protein, 9 aa, Artificial Sequence
  source: /note="Description of Artificial Sequence: Synthetic peptide"
RSCCVVGAL

SEQ ID NO: 4783 - protein, 9 aa, Artificial Sequence
  source: /note="Description of Artificial Sequence: Synthetic peptide"
MPIWIGPWN

SEQ ID NO: 4784 - protein, 10 aa, Artificial Sequence
  source: /note="Description of Artificial Sequence: Synthetic peptide"
SMMSLWSGAL

SEQ ID NO: 4785 - protein, 10 aa, Artificial Sequence
  source: /note="Description of Artificial Sequence: Synthetic peptide"
SLGWSGTPLI

SEQ ID NO: 4786 - protein, 10 aa, Artificial Sequence
  source: /note="Description of Artificial Sequence: Synthetic peptide"
CVVGALLLTV

SEQ ID NO: 4787 - protein, 10 aa, Artificial Sequence
  source: /note="Description of Artificial Sequence: Synthetic peptide"
VVGALLLTVV

SEQ ID NO: 4788 - protein, 10 aa, Artificial Sequence
  source: /note="Description of Artificial Sequence: Synthetic peptide"
SSATSTRGSK

SEQ ID NO: 4789 - protein, 10 aa, Artificial Sequence
  source: /note="Description of Artificial Sequence: Synthetic peptide"
CQMPIWIGPW

SEQ ID NO: 4790 - protein, 10 aa, Artificial Sequence
  source: /note="Description of Artificial Sequence: Synthetic peptide"
STRASAAVPA

SEQ ID NO: 4791 - protein, 10 aa, Artificial Sequence
  source: /note="Description of Artificial Sequence: Synthetic peptide"
RASAAVPAPG

SEQ ID NO: 4792 - protein, 10 aa, Artificial Sequence
  source: /note="Description of Artificial Sequence: Synthetic peptide"
SCRRTSMMSL

SEQ ID NO: 4793 - protein, 10 aa, Artificial Sequence
  source: /note="Description of Artificial Sequence: Synthetic peptide"
RTSMMSLWSG

SEQ ID NO: 4794 - protein, 10 aa, Artificial Sequence
  source: /note="Description of Artificial Sequence: Synthetic peptide"
TSMMSLWSGA

SEQ ID NO: 4795 - protein, 10 aa, Artificial Sequence
  source: /note="Description of Artificial Sequence: Synthetic peptide"
RPSRGRRWMK

SEQ ID NO: 4796 - protein, 10 aa, Artificial Sequence
  source: /note="Description of Artificial Sequence: Synthetic peptide"
RGRRWMKLSL

SEQ ID NO: 4797 - protein, 10 aa, Artificial Sequence
  source: /note="Description of Artificial Sequence: Synthetic peptide"
GSKRGRSCCV

SEQ ID NO: 4798 - protein, 10 aa, Artificial Sequence
  source: /note="Description of Artificial Sequence: Synthetic peptide"
RGRSCCVVGA

SEQ ID NO: 4799 - protein, 10 aa, Artificial Sequence
  source: /note="Description of Artificial Sequence: Synthetic peptide"
RSCCVVGALL

SEQ ID NO: 4800 - protein, 10 aa, Artificial Sequence
  source: /note="Description of Artificial Sequence: Synthetic peptide"
MPIWIGPWNR

SEQ ID NO: 4801 - protein, 10 aa, Artificial Sequence
  source: /note="Description of Artificial Sequence: Synthetic peptide"
LIARPSRGRR

SEQ ID NO: 4802 - protein, 10 aa, Artificial Sequence
  source: /note="Description of Artificial Sequence: Synthetic peptide"
SATSTRGSKR

SEQ ID NO: 4803 - protein, 10 aa, Artificial Sequence
  source: /note="Description of Artificial Sequence: Synthetic peptide"
CSSTRASAAV

SEQ ID NO: 4804 - protein, 10 aa, Artificial Sequence
  source: /note="Description of Artificial Sequence: Synthetic peptide"
LTVVTSSSPL

SEQ ID NO: 4805 - protein, 10 aa, Artificial Sequence
  source: /note="Description of Artificial Sequence: Synthetic peptide"
APTSSCQMPI

SEQ ID NO: 4806 - protein, 10 aa, Artificial Sequence
  source: /note="Description of Artificial Sequence: Synthetic peptide"
GPWNRPTSPC

SEQ ID NO: 4807 - protein, 10 aa, Artificial Sequence
  source: /note="Description of Artificial Sequence: Synthetic peptide"
SPCSSTRASA

SEQ ID NO: 4808 - protein, 10 aa, Artificial Sequence
  source: /note="Description of Artificial Sequence: Synthetic peptide"
GPSCRRTSMM

SEQ ID NO: 4809 - protein, 10 aa, Artificial Sequence
  source: /note="Description of Artificial Sequence: Synthetic peptide"
GRAPTSSCQM

SEQ ID NO: 4810 - protein, 10 aa, Artificial Sequence
  source: /note="Description of Artificial Sequence: Synthetic peptide"
CRRTSMMSLW

SEQ ID NO: 4811 - protein, 10 aa, Artificial Sequence
  source: /note="Description of Artificial Sequence: Synthetic peptide"
MSLWSGALPG

SEQ ID NO: 4812 - protein, 10 aa, Artificial Sequence
  source: /note="Description of Artificial Sequence: Synthetic peptide"
WSGALPGPSL

SEQ ID NO: 4813 - protein, 10 aa, Artificial Sequence
  source: /note="Description of Artificial Sequence: Synthetic peptide"
GALPGPSLGW

SEQ ID NO: 4814 - protein, 10 aa, Artificial Sequence
  source: /note="Description of Artificial Sequence: Synthetic peptide"
IARPSRGRRW

SEQ ID NO: 4815 - protein, 10 aa, Artificial Sequence
  source: /note="Description of Artificial Sequence: Synthetic peptide"
MKLSLRRSSA

SEQ ID NO: 4816 - protein, 10 aa, Artificial Sequence
  source: /note="Description of Artificial Sequence: Synthetic peptide"
GRSCCVVGAL

SEQ ID NO: 4817 - protein, 10 aa, Artificial Sequence
  source: /note="Description of Artificial Sequence: Synthetic peptide"
TSSSPLCLEM

SEQ ID NO: 4818 - protein, 10 aa, Artificial Sequence
  source: /note="Description of Artificial Sequence: Synthetic peptide"
LELGGRAPTS

SEQ ID NO: 4819 - protein, 10 aa, Artificial Sequence
  source: /note="Description of Artificial Sequence: Synthetic peptide"
SPLCLEMCRM

SEQ ID NO: 4820 - protein, 9 aa, Artificial Sequence
  source: /note="Description of Artificial Sequence: Synthetic peptide"
GLKVRYPRA

SEQ ID NO: 4821 - protein, 9 aa, Artificial Sequence
  source: /note="Description of Artificial Sequence: Synthetic peptide"
KVRYPRARP

SEQ ID NO: 4822 - protein, 9 aa, Artificial Sequence
  source: /note="Description of Artificial Sequence: Synthetic peptide"
EGLKVRYPR

SEQ ID NO: 4823 - protein, 10 aa, Artificial Sequence
  source: /note="Description of Artificial Sequence: Synthetic peptide"
GLKVRYPRAR

SEQ ID NO: 4824 - protein, 10 aa, Artificial Sequence
  source: /note="Description of Artificial Sequence: Synthetic peptide"
KVRYPRARPR

SEQ ID NO: 4825 - protein, 9 aa, Artificial Sequence
  source: /note="Description of Artificial Sequence: Synthetic peptide"
TFLRYFSDK

SEQ ID NO: 4826 - protein, 9 aa, Artificial Sequence
  source: /note="Description of Artificial Sequence: Synthetic peptide"
QYVTFLRYF

SEQ ID NO: 4827 - protein, 9 aa, Artificial Sequence
  source: /note="Description of Artificial Sequence: Synthetic peptide"
RYFSDKQKI

SEQ ID NO: 4828 - protein, 9 aa, Artificial Sequence
  source: /note="Description of Artificial Sequence: Synthetic peptide"
GQYVTFLRY

SEQ ID NO: 4829 - protein, 9 aa, Artificial Sequence
  source: /note="Description of Artificial Sequence: Synthetic peptide"
YVTFLRYFS

SEQ ID NO: 4830 - protein, 10 aa, Artificial Sequence
  source: /note="Description of Artificial Sequence: Synthetic peptide"
LGQYVTFLRY

SEQ ID NO: 4831 - protein, 10 aa, Artificial Sequence
  source: /note="Description of Artificial Sequence: Synthetic peptide"
VTFLRYFSDK

SEQ ID NO: 4832 - protein, 10 aa, Artificial Sequence
  source: /note="Description of Artificial Sequence: Synthetic peptide"
FLRYFSDKQK

SEQ ID NO: 4833 - protein, 10 aa, Artificial Sequence
  source: /note="Description of Artificial Sequence: Synthetic peptide"
GQYVTFLRYF

SEQ ID NO: 4834 - protein, 9 aa, Artificial Sequence
  source: /note="Description of Artificial Sequence: Synthetic peptide"
SEEETQDLW

SEQ ID NO: 4835 - protein, 10 aa, Artificial Sequence
  source: /note="Description of Artificial Sequence: Synthetic peptide"
HMSEEETQDL

SEQ ID NO: 4836 - protein, 10 aa, Artificial Sequence
  source: /note="Description of Artificial Sequence: Synthetic peptide"
MSEEETQDLW

SEQ ID NO: 4837 - protein, 9 aa, Artificial Sequence
  source: /note="Description of Artificial Sequence: Synthetic peptide"
LLGTEHVFY

SEQ ID NO: 4838 - protein, 10 aa, Artificial Sequence
  source: /note="Description of Artificial Sequence: Synthetic peptide"
NLLGTEHVFY

SEQ ID NO: 4839 - protein, 9 aa, Artificial Sequence
  source: /note="Description of Artificial Sequence: Synthetic peptide"
RVGGRTYGA

SEQ ID NO: 4840 - protein, 9 aa, Artificial Sequence
  source: /note="Description of Artificial Sequence: Synthetic peptide"
RTYGARGVQ

SEQ ID NO: 4841 - protein, 10 aa, Artificial Sequence
  source: /note="Description of Artificial Sequence: Synthetic peptide"
RVGGRTYGAR

SEQ ID NO: 4842 - protein, 10 aa, Artificial Sequence
  source: /note="Description of Artificial Sequence: Synthetic peptide"
RTYGARGVQG

SEQ ID NO: 4843 - protein, 10 aa, Artificial Sequence
  source: /note="Description of Artificial Sequence: Synthetic peptide"
TAADKRVGGR

SEQ ID NO: 4844 - protein, 10 aa, Artificial Sequence
  source: /note="Description of Artificial Sequence: Synthetic peptide"
ADKRVGGRTY

SEQ ID NO: 4845 - protein, 9 aa, Artificial Sequence
  source: /note="Description of Artificial Sequence: Synthetic peptide"
NGSGIISNY

SEQ ID NO: 4846 - protein, 9 aa, Artificial Sequence
  source: /note="Description of Artificial Sequence: Synthetic peptide"
GQAINGSGI

SEQ ID NO: 4847 - protein, 10 aa, Artificial Sequence
  source: /note="Description of Artificial Sequence: Synthetic peptide"
INGSGIISNY

SEQ ID NO: 4848 - protein, 10 aa, Artificial Sequence
  source: /note="Description of Artificial Sequence: Synthetic peptide"
GQAINGSGII

SEQ ID NO: 4849 - protein, 9 aa, Artificial Sequence
  source: /note="Description of Artificial Sequence: Synthetic peptide"
SNRQAAEAL

SEQ ID NO: 4850 - protein, 10 aa, Artificial Sequence
  source: /note="Description of Artificial Sequence: Synthetic peptide"
FSNRQAAEAL

SEQ ID NO: 4851 - protein, 9 aa, Artificial Sequence
  source: /note="Description of Artificial Sequence: Synthetic peptide"
YLQQGACKT

SEQ ID NO: 4852 - protein, 10 aa, Artificial Sequence
  source: /note="Description of Artificial Sequence: Synthetic peptide"
HLYLQQGACK

SEQ ID NO: 4853 - protein, 10 aa, Artificial Sequence
  source: /note="Description of Artificial Sequence: Synthetic peptide"
LQQGACKTPP

SEQ ID NO: 4854 - protein, 9 aa, Artificial Sequence
  source: /note="Description of Artificial Sequence: Synthetic peptide"
IFQIARLIY

SEQ ID NO: 4855 - protein, 9 aa, Artificial Sequence
  source: /note="Description of Artificial Sequence: Synthetic peptide"
FQIARLIYH

SEQ ID NO: 4856 - protein, 9 aa, Artificial Sequence
  source: /note="Description of Artificial Sequence: Synthetic peptide"
ARLIYHGPM

SEQ ID NO: 4857 - protein, 10 aa, Artificial Sequence
  source: /note="Description of Artificial Sequence: Synthetic peptide"
TIFQIARLIY

SEQ ID NO: 4858 - protein, 10 aa, Artificial Sequence
  source: /note="Description of Artificial Sequence: Synthetic peptide"
IARLIYHGPM

SEQ ID NO: 4859 - protein, 10 aa, Artificial Sequence
  source: /note="Description of Artificial Sequence: Synthetic peptide"
IYHGPMPQNK

SEQ ID NO: 4860 - protein, 10 aa, Artificial Sequence
  source: /note="Description of Artificial Sequence: Synthetic peptide"
FQIARLIYHG

SEQ ID NO: 4861 - protein, 9 aa, Artificial Sequence
  source: /note="Description of Artificial Sequence: Synthetic peptide"
MAGGHSLLL

SEQ ID NO: 4862 - protein, 9 aa, Artificial Sequence
  source: /note="Description of Artificial Sequence: Synthetic peptide"
APARPWSPS

SEQ ID NO: 4863 - protein, 10 aa, Artificial Sequence
  source: /note="Description of Artificial Sequence: Synthetic peptide"
RPWSPSQTRK

SEQ ID NO: 4864 - protein, 9 aa, Artificial Sequence
  source: /note="Description of Artificial Sequence: Synthetic peptide"
VSAPKPLSK

SEQ ID NO: 4865 - protein, 9 aa, Artificial Sequence
  source: /note="Description of Artificial Sequence: Synthetic peptide"
APKPLSKLL

SEQ ID NO: 4866 - protein, 10 aa, Artificial Sequence
  source: /note="Description of Artificial Sequence: Synthetic peptide"
GVSAPKPLSK

SEQ ID NO: 4867 - protein, 9 aa, Artificial Sequence
  source: /note="Description of Artificial Sequence: Synthetic peptide"
VLLLLQSGA

SEQ ID NO: 4868 - protein, 9 aa, Artificial Sequence
  source: /note="Description of Artificial Sequence: Synthetic peptide"
LQSGASPDV

SEQ ID NO: 4869 - protein, 10 aa, Artificial Sequence
  source: /note="Description of Artificial Sequence: Synthetic peptide"
LLQSGASPDV

SEQ ID NO: 4870 - protein, 10 aa, Artificial Sequence
  source: /note="Description of Artificial Sequence: Synthetic peptide"
LQSGASPDVT

SEQ ID NO: 4871 - protein, 9 aa, Artificial Sequence
  source: /note="Description of Artificial Sequence: Synthetic peptide"
GLMVDRQSL

SEQ ID NO: 4872 - protein, 9 aa, Artificial Sequence
  source: /note="Description of Artificial Sequence: Synthetic peptide"
RQSLGTTPD

SEQ ID NO: 4873 - protein, 10 aa, Artificial Sequence
  source: /note="Description of Artificial Sequence: Synthetic peptide"
LMVDRQSLGT

SEQ ID NO: 4874 - protein, 10 aa, Artificial Sequence
  source: /note="Description of Artificial Sequence: Synthetic peptide"
FGLMVDRQSL

SEQ ID NO: 4875 - protein, 10 aa, Artificial Sequence
  source: /note="Description of Artificial Sequence: Synthetic peptide"
RQSLGTTPDT

SEQ ID NO: 4876 - protein, 9 aa, Artificial Sequence
  source: /note="Description of Artificial Sequence: Synthetic peptide"
KMNEPVESS

SEQ ID NO: 4877 - protein, 10 aa, Artificial Sequence
  source: /note="Description of Artificial Sequence: Synthetic peptide"
VVFAKMNEPV

SEQ ID NO: 4878 - protein, 10 aa, Artificial Sequence
  source: /note="Description of Artificial Sequence: Synthetic peptide"
KMNEPVESSL

SEQ ID NO: 4879 - protein, 10 aa, Artificial Sequence
  source: /note="Description of Artificial Sequence: Synthetic peptide"
EPVESSLRCF

SEQ ID NO: 4880 - protein, 9 aa, Artificial Sequence
  source: /note="Description of Artificial Sequence: Synthetic peptide"
HEAAHQNNV

SEQ ID NO: 4881 - protein, 9 aa, Artificial Sequence
  source: /note="Description of Artificial Sequence: Synthetic peptide"
AHQNNVGRM

SEQ ID NO: 4882 - protein, 10 aa, Artificial Sequence
  source: /note="Description of Artificial Sequence: Synthetic peptide"
EAAHQNNVGR

SEQ ID NO: 4883 - protein, 10 aa, Artificial Sequence
  source: /note="Description of Artificial Sequence: Synthetic peptide"
LERQLHEAAH

SEQ ID NO: 4884 - protein, 10 aa, Artificial Sequence
  source: /note="Description of Artificial Sequence: Synthetic peptide"
RQLHEAAHQN

SEQ ID NO: 4885 - protein, 10 aa, Artificial Sequence
  source: /note="Description of Artificial Sequence: Synthetic peptide"
AAHQNNVGRM

SEQ ID NO: 4886 - protein, 9 aa, Artificial Sequence
  source: /note="Description of Artificial Sequence: Synthetic peptide"
EMPTNVCLI

SEQ ID NO: 4887 - protein, 9 aa, Artificial Sequence
  source: /note="Description of Artificial Sequence: Synthetic peptide"
LIVTSSTSL

SEQ ID NO: 4888 - protein, 9 aa, Artificial Sequence
  source: /note="Description of Artificial Sequence: Synthetic peptide"
MPTNVCLIV

SEQ ID NO: 4889 - protein, 10 aa, Artificial Sequence
  source: /note="Description of Artificial Sequence: Synthetic peptide"
CLIVTSSTSL

SEQ ID NO: 4890 - protein, 10 aa, Artificial Sequence
  source: /note="Description of Artificial Sequence: Synthetic peptide"
EMPTNVCLIV

SEQ ID NO: 4891 - protein, 10 aa, Artificial Sequence
  source: /note="Description of Artificial Sequence: Synthetic peptide"
IVTSSTSLTV

SEQ ID NO: 4892 - protein, 10 aa, Artificial Sequence
  source: /note="Description of Artificial Sequence: Synthetic peptide"
MPTNVCLIVT

SEQ ID NO: 4893 - protein, 10 aa, Artificial Sequence
  source: /note="Description of Artificial Sequence: Synthetic peptide"
PEMPTNVCLI

SEQ ID NO: 4894 - protein, 9 aa, Artificial Sequence
  source: /note="Description of Artificial Sequence: Synthetic peptide"
CVCREHPGR

SEQ ID NO: 4895 - protein, 9 aa, Artificial Sequence
  source: /note="Description of Artificial Sequence: Synthetic peptide"
REHPGRSPP

SEQ ID NO: 4896 - protein, 10 aa, Artificial Sequence
  source: /note="Description of Artificial Sequence: Synthetic peptide"
CVCVCVCVCR

SEQ ID NO: 4897 - protein, 10 aa, Artificial Sequence
  source: /note="Description of Artificial Sequence: Synthetic peptide"
REHPGRSPPG

SEQ ID NO: 4898 - protein, 9 aa, Artificial Sequence
  source: /note="Description of Artificial Sequence: Synthetic peptide"
RWYCWRGSK

SEQ ID NO: 4899 - protein, 9 aa, Artificial Sequence
  source: /note="Description of Artificial Sequence: Synthetic peptide"
CYRWYCWRG

SEQ ID NO: 4900 - protein, 9 aa, Artificial Sequence
  source: /note="Description of Artificial Sequence: Synthetic peptide"
QAERGLCYR

SEQ ID NO: 4901 - protein, 9 aa, Artificial Sequence
  source: /note="Description of Artificial Sequence: Synthetic peptide"
LCYRWYCWR

SEQ ID NO: 4902 - protein, 9 aa, Artificial Sequence
  source: /note="Description of Artificial Sequence: Synthetic peptide"
PQAERGLCY

SEQ ID NO: 4903 - protein, 9 aa, Artificial Sequence
  source: /note="Description of Artificial Sequence: Synthetic peptide"
AERGLCYRW

SEQ ID NO: 4904 - protein, 10 aa, Artificial Sequence
  source: /note="Description of Artificial Sequence: Synthetic peptide"
RGLCYRWYCW

SEQ ID NO: 4905 - protein, 10 aa, Artificial Sequence
  source: /note="Description of Artificial Sequence: Synthetic peptide"
GLCYRWYCWR

SEQ ID NO: 4906 - protein, 10 aa, Artificial Sequence
  source: /note="Description of Artificial Sequence: Synthetic peptide"
LPQAERGLCY

SEQ ID NO: 4907 - protein, 10 aa, Artificial Sequence
  source: /note="Description of Artificial Sequence: Synthetic peptide"
AERGLCYRWY

SEQ ID NO: 4908 - protein, 9 aa, Artificial Sequence
  source: /note="Description of Artificial Sequence: Synthetic peptide"
FIIIETPLL

SEQ ID NO: 4909 - protein, 9 aa, Artificial Sequence
  source: /note="Description of Artificial Sequence: Synthetic peptide"
IIIETPLLV

SEQ ID NO: 4910 - protein, 9 aa, Artificial Sequence
  source: /note="Description of Artificial Sequence: Synthetic peptide"
IIETPLLVK

SEQ ID NO: 4911 - protein, 9 aa, Artificial Sequence
  source: /note="Description of Artificial Sequence: Synthetic peptide"
IETPLLVKI

SEQ ID NO: 4912 - protein, 10 aa, Artificial Sequence
  source: /note="Description of Artificial Sequence: Synthetic peptide"
FIIIETPLLV

SEQ ID NO: 4913 - protein, 10 aa, Artificial Sequence
  source: /note="Description of Artificial Sequence: Synthetic peptide"
IIIETPLLVK

SEQ ID NO: 4914 - protein, 10 aa, Artificial Sequence
  source: /note="Description of Artificial Sequence: Synthetic peptide"
WFIIIETPLL

SEQ ID NO: 4915 - protein, 10 aa, Artificial Sequence
  source: /note="Description of Artificial Sequence: Synthetic peptide"
GEPWFIIIET

SEQ ID NO: 4916 - protein, 9 aa, Artificial Sequence
  source: /note="Description of Artificial Sequence: Synthetic peptide"
HLLKRDYRK

SEQ ID NO: 4917 - protein, 9 aa, Artificial Sequence
  source: /note="Description of Artificial Sequence: Synthetic peptide"
KHLLKRDYR

SEQ ID NO: 4918 - protein, 10 aa, Artificial Sequence
  source: /note="Description of Artificial Sequence: Synthetic peptide"
KHLLKRDYRK

SEQ ID NO: 4919 - protein, 9 aa, Artificial Sequence
  source: /note="Description of Artificial Sequence: Synthetic peptide"
SASEAPSPA

SEQ ID NO: 4920 - protein, 9 aa, Artificial Sequence
  source: /note="Description of Artificial Sequence: Synthetic peptide"
EAPSPAPPA

SEQ ID NO: 4921 - protein, 9 aa, Artificial Sequence
  source: /note="Description of Artificial Sequence: Synthetic peptide"
SPAPPASPA

SEQ ID NO: 4922 - protein, 10 aa, Artificial Sequence
  source: /note="Description of Artificial Sequence: Synthetic peptide"
FSASEAPSPA

SEQ ID NO: 4923 - protein, 10 aa, Artificial Sequence
  source: /note="Description of Artificial Sequence: Synthetic peptide"
SPAPPASPAP

SEQ ID NO: 4924 - protein, 10 aa, Artificial Sequence
  source: /note="Description of Artificial Sequence: Synthetic peptide"
SEAPSPAPPA

SEQ ID NO: 4925 - protein, 9 aa, Artificial Sequence
  source: /note="Description of Artificial Sequence: Synthetic peptide"
KSNAKIKDK

SEQ ID NO: 4926 - protein, 9 aa, Artificial Sequence
  source: /note="Description of Artificial Sequence: Synthetic peptide"
KDKDHSPTF

SEQ ID NO: 4927 - protein, 10 aa, Artificial Sequence
  source: /note="Description of Artificial Sequence: Synthetic peptide"
IKDKDHSPTF

SEQ ID NO: 4928 - protein, 9 aa, Artificial Sequence
  source: /note="Description of Artificial Sequence: Synthetic peptide"
LQKKSKLEK

SEQ ID NO: 4929 - protein, 10 aa, Artificial Sequence
  source: /note="Description of Artificial Sequence: Synthetic peptide"
TLQKKSKLEK

SEQ ID NO: 4930 - protein, 9 aa, Artificial Sequence
  source: /note="Description of Artificial Sequence: Synthetic peptide"
KSHKENTSV

SEQ ID NO: 4931 - protein, 9 aa, Artificial Sequence
  source: /note="Description of Artificial Sequence: Synthetic peptide"
NTSVHTDWL

SEQ ID NO: 4932 - protein, 10 aa, Artificial Sequence
  source: /note="Description of Artificial Sequence: Synthetic peptide"
NTSVHTDWLL

SEQ ID NO: 4933 - protein, 10 aa, Artificial Sequence
  source: /note="Description of Artificial Sequence: Synthetic peptide"
KSHKENTSVH

SEQ ID NO: 4934 - protein, 10 aa, Artificial Sequence
  source: /note="Description of Artificial Sequence: Synthetic peptide"
KENTSVHTDW

SEQ ID NO: 4935 - protein, 9 aa, Artificial Sequence
  source: /note="Description of Artificial Sequence: Synthetic peptide"
KSGTVLRAV

SEQ ID NO: 4936 - protein, 9 aa, Artificial Sequence
  source: /note="Description of Artificial Sequence: Synthetic peptide"
EQKSGTVLR

SEQ ID NO: 4937 - protein, 10 aa, Artificial Sequence
  source: /note="Description of Artificial Sequence: Synthetic peptide"
QKSGTVLRAV

SEQ ID NO: 4938 - protein, 9 aa, Artificial Sequence
  source: /note="Description of Artificial Sequence: Synthetic peptide"
RIISPRSIK

SEQ ID NO: 4939 - protein, 9 aa, Artificial Sequence
  source: /note="Description of Artificial Sequence: Synthetic peptide"
LYIPKRRII

SEQ ID NO: 4940 - protein, 9 aa, Artificial Sequence
  source: /note="Description of Artificial Sequence: Synthetic peptide"
KLYIPKRRI

SEQ ID NO: 4941 - protein, 9 aa, Artificial Sequence
  source: /note="Description of Artificial Sequence: Synthetic peptide"
KRRIISPRS

SEQ ID NO: 4942 - protein, 9 aa, Artificial Sequence
  source: /note="Description of Artificial Sequence: Synthetic peptide"
IPKRRIISP

SEQ ID NO: 4943 - protein, 9 aa, Artificial Sequence
  source: /note="Description of Artificial Sequence: Synthetic peptide"
RRIISPRSI

SEQ ID NO: 4944 - protein, 10 aa, Artificial Sequence
  source: /note="Description of Artificial Sequence: Synthetic peptide"
ISKLYIPKRR

SEQ ID NO: 4945 - protein, 10 aa, Artificial Sequence
  source: /note="Description of Artificial Sequence: Synthetic peptide"
KLYIPKRRII

SEQ ID NO: 4946 - protein, 10 aa, Artificial Sequence
  source: /note="Description of Artificial Sequence: Synthetic peptide"
KRRIISPRSI

SEQ ID NO: 4947 - protein, 10 aa, Artificial Sequence
  source: /note="Description of Artificial Sequence: Synthetic peptide"
IPKRRIISPR

SEQ ID NO: 4948 - protein, 10 aa, Artificial Sequence
  source: /note="Description of Artificial Sequence: Synthetic peptide"
RGKKYGEKTR

SEQ ID NO: 4949 - protein, 10 aa, Artificial Sequence
  source: /note="Description of Artificial Sequence: Synthetic peptide"
KKYGEKTRTV

SEQ ID NO: 4950 - protein, 9 aa, Artificial Sequence
  source: /note="Description of Artificial Sequence: Synthetic peptide"
SVPNTATEK

SEQ ID NO: 4951 - protein, 9 aa, Artificial Sequence
  source: /note="Description of Artificial Sequence: Synthetic peptide"
KEDSVPNTA

SEQ ID NO: 4952 - protein, 10 aa, Artificial Sequence
  source: /note="Description of Artificial Sequence: Synthetic peptide"
SVPNTATEKK

SEQ ID NO: 4953 - protein, 10 aa, Artificial Sequence
  source: /note="Description of Artificial Sequence: Synthetic peptide"
KEDSVPNTAT

SEQ ID NO: 4954 - protein, 9 aa, Artificial Sequence
  source: /note="Description of Artificial Sequence: Synthetic peptide"
IVKRKREDL

SEQ ID NO: 4955 - protein, 9 aa, Artificial Sequence
  source: /note="Description of Artificial Sequence: Synthetic peptide"
ALLYAGVKM

SEQ ID NO: 4956 - protein, 10 aa, Artificial Sequence
  source: /note="Description of Artificial Sequence: Synthetic peptide"
SALLYAGVKM

SEQ ID NO: 4957 - protein, 10 aa, Artificial Sequence
  source: /note="Description of Artificial Sequence: Synthetic peptide"
CLQQHSDTEK

SEQ ID NO: 4958 - protein, 10 aa, Artificial Sequence
  source: /note="Description of Artificial Sequence: Synthetic peptide"
AERTECLNCL

SEQ ID NO: 4959 - protein, 9 aa, Artificial Sequence
  source: /note="Description of Artificial Sequence: Synthetic peptide"
YQEWACYGV

SEQ ID NO: 4960 - protein, 9 aa, Artificial Sequence
  source: /note="Description of Artificial Sequence: Synthetic peptide"
WACYGVFYK

SEQ ID NO: 4961 - protein, 9 aa, Artificial Sequence
  source: /note="Description of Artificial Sequence: Synthetic peptide"
ACYGVFYKF

SEQ ID NO: 4962 - protein, 9 aa, Artificial Sequence
  source: /note="Description of Artificial Sequence: Synthetic peptide"
LLYQEWACY

SEQ ID NO: 4963 - protein, 9 aa, Artificial Sequence
  source: /note="Description of Artificial Sequence: Synthetic peptide"
EWACYGVFY

SEQ ID NO: 4964 - protein, 9 aa, Artificial Sequence
  source: /note="Description of Artificial Sequence: Synthetic peptide"
QEWACYGVF

SEQ ID NO: 4965 - protein, 10 aa, Artificial Sequence
  source: /note="Description of Artificial Sequence: Synthetic peptide"
LYQEWACYGV

SEQ ID NO: 4966 - protein, 10 aa, Artificial Sequence
  source: /note="Description of Artificial Sequence: Synthetic peptide"
YQEWACYGVF

SEQ ID NO: 4967 - protein, 10 aa, Artificial Sequence
  source: /note="Description of Artificial Sequence: Synthetic peptide"
WACYGVFYKF

SEQ ID NO: 4968 - protein, 10 aa, Artificial Sequence
  source: /note="Description of Artificial Sequence: Synthetic peptide"
KLLYQEWACY

SEQ ID NO: 4969 - protein, 10 aa, Artificial Sequence
  source: /note="Description of Artificial Sequence: Synthetic peptide"
EWACYGVFYK

SEQ ID NO: 4970 - protein, 10 aa, Artificial Sequence
  source: /note="Description of Artificial Sequence: Synthetic peptide"
QEWACYGVFY

SEQ ID NO: 4971 - protein, 9 aa, Artificial Sequence
  source: /note="Description of Artificial Sequence: Synthetic peptide"
LSQSYAYSK

SEQ ID NO: 4972 - protein, 9 aa, Artificial Sequence
  source: /note="Description of Artificial Sequence: Synthetic peptide"
SLPCLSQSY

SEQ ID NO: 4973 - protein, 10 aa, Artificial Sequence
  source: /note="Description of Artificial Sequence: Synthetic peptide"
SLPCLSQSYA

SEQ ID NO: 4974 - protein, 10 aa, Artificial Sequence
  source: /note="Description of Artificial Sequence: Synthetic peptide"
CLSQSYAYSK

SEQ ID NO: 4975 - protein, 10 aa, Artificial Sequence
  source: /note="Description of Artificial Sequence: Synthetic peptide"
RSLPCLSQSY

SEQ ID NO: 4976 - protein, 10 aa, Artificial Sequence
  source: /note="Description of Artificial Sequence: Synthetic peptide"
SQSYAYSKSL

SEQ ID NO: 4977 - protein, 10 aa, Artificial Sequence
  source: /note="Description of Artificial Sequence: Synthetic peptide"
LPCLSQSYAY

SEQ ID NO: 4978 - protein, 9 aa, Artificial Sequence
  source: /note="Description of Artificial Sequence: Synthetic peptide"
LVQEIMYEA

SEQ ID NO: 4979 - protein, 9 aa, Artificial Sequence
  source: /note="Description of Artificial Sequence: Synthetic peptide"
KYLVQEIMY

SEQ ID NO: 4980 - protein, 9 aa, Artificial Sequence
  source: /note="Description of Artificial Sequence: Synthetic peptide"
IMYEAELEH

SEQ ID NO: 4981 - protein, 9 aa, Artificial Sequence
  source: /note="Description of Artificial Sequence: Synthetic peptide"
REKYLVQEI

SEQ ID NO: 4982 - protein, 9 aa, Artificial Sequence
  source: /note="Description of Artificial Sequence: Synthetic peptide"
EKYLVQEIM

SEQ ID NO: 4983 - protein, 9 aa, Artificial Sequence
  source: /note="Description of Artificial Sequence: Synthetic peptide"
QEIMYEAEL

SEQ ID NO: 4984 - protein, 10 aa, Artificial Sequence
  source: /note="Description of Artificial Sequence: Synthetic peptide"
YLVQEIMYEA

SEQ ID NO: 4985 - protein, 10 aa, Artificial Sequence
  source: /note="Description of Artificial Sequence: Synthetic peptide"
IMYEAELEHL

SEQ ID NO: 4986 - protein, 10 aa, Artificial Sequence
  source: /note="Description of Artificial Sequence: Synthetic peptide"
RREKYLVQEI

SEQ ID NO: 4987 - protein, 10 aa, Artificial Sequence
  source: /note="Description of Artificial Sequence: Synthetic peptide"
REKYLVQEIM

SEQ ID NO: 4988 - protein, 10 aa, Artificial Sequence
  source: /note="Description of Artificial Sequence: Synthetic peptide"
EKYLVQEIMY

SEQ ID NO: 4989 - protein, 10 aa, Artificial Sequence
  source: /note="Description of Artificial Sequence: Synthetic peptide"
VQEIMYEAEL

SEQ ID NO: 4990 - protein, 9 aa, Artificial Sequence
  source: /note="Description of Artificial Sequence: Synthetic peptide"
IQGELSGDF

SEQ ID NO: 4991 - protein, 9 aa, Artificial Sequence
  source: /note="Description of Artificial Sequence: Synthetic peptide"
IEASIQGEL

SEQ ID NO: 4992 - protein, 9 aa, Artificial Sequence
  source: /note="Description of Artificial Sequence: Synthetic peptide"
GQLCLLSGV

SEQ ID NO: 4993 - protein, 9 aa, Artificial Sequence
  source: /note="Description of Artificial Sequence: Synthetic peptide"
CLLSGVAAA

SEQ ID NO: 4994 - protein, 9 aa, Artificial Sequence
  source: /note="Description of Artificial Sequence: Synthetic peptide"
RLLWQATPA

SEQ ID NO: 4995 - protein, 9 aa, Artificial Sequence
  source: /note="Description of Artificial Sequence: Synthetic peptide"
RFLTQRLGA

SEQ ID NO: 4996 - protein, 9 aa, Artificial Sequence
  source: /note="Description of Artificial Sequence: Synthetic peptide"
FLTQRLGAR

SEQ ID NO: 4997 - protein, 9 aa, Artificial Sequence
  source: /note="Description of Artificial Sequence: Synthetic peptide"
LWQATPAQR

SEQ ID NO: 4998 - protein, 9 aa, Artificial Sequence
  source: /note="Description of Artificial Sequence: Synthetic peptide"
SPGPALGQL

SEQ ID NO: 4999 - protein, 9 aa, Artificial Sequence
  source: /note="Description of Artificial Sequence: Synthetic peptide"
GPALGQLCL

SEQ ID NO: 5000 - protein, 9 aa, Artificial Sequence
  source: /note="Description of Artificial Sequence: Synthetic peptide"
CPGGTGHRL

SEQ ID NO: 5001 - protein, 9 aa, Artificial Sequence
  source: /note="Description of Artificial Sequence: Synthetic peptide"
TQRLGARAG

SEQ ID NO: 5002 - protein, 9 aa, Artificial Sequence
  source: /note="Description of Artificial Sequence: Synthetic peptide"
SQGCSPGSL

SEQ ID NO: 5003 - protein, 10 aa, Artificial Sequence
  source: /note="Description of Artificial Sequence: Synthetic peptide"
FLTQRLGARA

SEQ ID NO: 5004 - protein, 10 aa, Artificial Sequence
  source: /note="Description of Artificial Sequence: Synthetic peptide"
RFLTQRLGAR

SEQ ID NO: 5005 - protein, 10 aa, Artificial Sequence
  source: /note="Description of Artificial Sequence: Synthetic peptide"
LLWQATPAQR

SEQ ID NO: 5006 - protein, 10 aa, Artificial Sequence
  source: /note="Description of Artificial Sequence: Synthetic peptide"
GPALGQLCLL

SEQ ID NO: 5007 - protein, 10 aa, Artificial Sequence
  source: /note="Description of Artificial Sequence: Synthetic peptide"
CPGGTGHRLL

SEQ ID NO: 5008 - protein, 10 aa, Artificial Sequence
  source: /note="Description of Artificial Sequence: Synthetic peptide"
MRFLTQRLGA

SEQ ID NO: 5009 - protein, 10 aa, Artificial Sequence
  source: /note="Description of Artificial Sequence: Synthetic peptide"
GQLCLLSGVA

SEQ ID NO: 5010 - protein, 10 aa, Artificial Sequence
  source: /note="Description of Artificial Sequence: Synthetic peptide"
HRLLWQATPA

SEQ ID NO: 5011 - protein, 9 aa, Artificial Sequence
  source: /note="Description of Artificial Sequence: Synthetic peptide"
LLGSVPGGK

SEQ ID NO: 5012 - protein, 9 aa, Artificial Sequence
  source: /note="Description of Artificial Sequence: Synthetic peptide"
NEVSLLGSV

SEQ ID NO: 5013 - protein, 10 aa, Artificial Sequence
  source: /note="Description of Artificial Sequence: Synthetic peptide"
LLGSVPGGKV

SEQ ID NO: 5014 - protein, 10 aa, Artificial Sequence
  source: /note="Description of Artificial Sequence: Synthetic peptide"
SLLGSVPGGK

SEQ ID NO: 5015 - protein, 10 aa, Artificial Sequence
  source: /note="Description of Artificial Sequence: Synthetic peptide"
SVPGGKVEFK

SEQ ID NO: 5016 - protein, 10 aa, Artificial Sequence
  source: /note="Description of Artificial Sequence: Synthetic peptide"
GSVPGGKVEF

SEQ ID NO: 5017 - protein, 9 aa, Artificial Sequence
  source: /note="Description of Artificial Sequence: Synthetic peptide"
ELSNTNPSV

SEQ ID NO: 5018 - protein, 9 aa, Artificial Sequence
  source: /note="Description of Artificial Sequence: Synthetic peptide"
LKIEFTFEL

SEQ ID NO: 5019 - protein, 9 aa, Artificial Sequence
  source: /note="Description of Artificial Sequence: Synthetic peptide"
FELSNTNPS

SEQ ID NO: 5020 - protein, 9 aa, Artificial Sequence
  source: /note="Description of Artificial Sequence: Synthetic peptide"
IEFTFELSN

SEQ ID NO: 5021 - protein, 10 aa, Artificial Sequence
  source: /note="Description of Artificial Sequence: Synthetic peptide"
GLKIEFTFEL

SEQ ID NO: 5022 - protein, 10 aa, Artificial Sequence
  source: /note="Description of Artificial Sequence: Synthetic peptide"
IEFTFELSNT

SEQ ID NO: 5023 - protein, 10 aa, Artificial Sequence
  source: /note="Description of Artificial Sequence: Synthetic peptide"
FELSNTNPSV

SEQ ID NO: 5024 - protein, 9 aa, Artificial Sequence
  source: /note="Description of Artificial Sequence: Synthetic peptide"
GVSNPFLQV

SEQ ID NO: 5025 - protein, 9 aa, Artificial Sequence
  source: /note="Description of Artificial Sequence: Synthetic peptide"
NPFLQVQIL

SEQ ID NO: 5026 - protein, 9 aa, Artificial Sequence
  source: /note="Description of Artificial Sequence: Synthetic peptide"
SISGVSNPF

SEQ ID NO: 5027 - protein, 10 aa, Artificial Sequence
  source: /note="Description of Artificial Sequence: Synthetic peptide"
SISGVSNPFL

SEQ ID NO: 5028 - protein, 10 aa, Artificial Sequence
  source: /note="Description of Artificial Sequence: Synthetic peptide"
HSISGVSNPF

SEQ ID NO: 5029 - protein, 10 aa, Artificial Sequence
  source: /note="Description of Artificial Sequence: Synthetic peptide"
NPFLQVQILR

SEQ ID NO: 5030 - protein, 10 aa, Artificial Sequence
  source: /note="Description of Artificial Sequence: Synthetic peptide"
VSNPFLQVQI

SEQ ID NO: 5031 - protein, 9 aa, Artificial Sequence
  source: /note="Description of Artificial Sequence: Synthetic peptide"
LVSEMKMFV

SEQ ID NO: 5032 - protein, 9 aa, Artificial Sequence
  source: /note="Description of Artificial Sequence: Synthetic peptide"
TFHLVSEMK

SEQ ID NO: 5033 - protein, 9 aa, Artificial Sequence
  source: /note="Description of Artificial Sequence: Synthetic peptide"
ETFHLVSEM

SEQ ID NO: 5034 - protein, 9 aa, Artificial Sequence
  source: /note="Description of Artificial Sequence: Synthetic peptide"
FHLVSEMKM

SEQ ID NO: 5035 - protein, 9 aa, Artificial Sequence
  source: /note="Description of Artificial Sequence: Synthetic peptide"
HLVSEMKMF

SEQ ID NO: 5036 - protein, 9 aa, Artificial Sequence
  source: /note="Description of Artificial Sequence: Synthetic peptide"
SEMKMFVIS

SEQ ID NO: 5037 - protein, 9 aa, Artificial Sequence
  source: /note="Description of Artificial Sequence: Synthetic peptide"
RETFHLVSE

SEQ ID NO: 5038 - protein, 10 aa, Artificial Sequence
  source: /note="Description of Artificial Sequence: Synthetic peptide"
HLVSEMKMFV

SEQ ID NO: 5039 - protein, 10 aa, Artificial Sequence
  source: /note="Description of Artificial Sequence: Synthetic peptide"
LVSEMKMFVI

SEQ ID NO: 5040 - protein, 10 aa, Artificial Sequence
  source: /note="Description of Artificial Sequence: Synthetic peptide"
ETFHLVSEMK

SEQ ID NO: 5041 - protein, 10 aa, Artificial Sequence
  source: /note="Description of Artificial Sequence: Synthetic peptide"
RETFHLVSEM

SEQ ID NO: 5042 - protein, 10 aa, Artificial Sequence
  source: /note="Description of Artificial Sequence: Synthetic peptide"
FHLVSEMKMF

SEQ ID NO: 5043 - protein, 9 aa, Artificial Sequence
  source: /note="Description of Artificial Sequence: Synthetic peptide"
VQTDVLVWV

SEQ ID NO: 5044 - protein, 9 aa, Artificial Sequence
  source: /note="Description of Artificial Sequence: Synthetic peptide"
VLVWVKGPL

SEQ ID NO: 5045 - protein, 9 aa, Artificial Sequence
  source: /note="Description of Artificial Sequence: Synthetic peptide"
QTDVLVWVK

SEQ ID NO: 5046 - protein, 9 aa, Artificial Sequence
  source: /note="Description of Artificial Sequence: Synthetic peptide"
HVQTDVLVW

SEQ ID NO: 5047 - protein, 10 aa, Artificial Sequence
  source: /note="Description of Artificial Sequence: Synthetic peptide"
VLVWVKGPLL

SEQ ID NO: 5048 - protein, 10 aa, Artificial Sequence
  source: /note="Description of Artificial Sequence: Synthetic peptide"
HVQTDVLVWV

SEQ ID NO: 5049 - protein, 10 aa, Artificial Sequence
  source: /note="Description of Artificial Sequence: Synthetic peptide"
VQTDVLVWVK

SEQ ID NO: 5050 - protein, 10 aa, Artificial Sequence
  source: /note="Description of Artificial Sequence: Synthetic peptide"
DVLVWVKGPL

SEQ ID NO: 5051 - protein, 10 aa, Artificial Sequence
  source: /note="Description of Artificial Sequence: Synthetic peptide"
FLRANGINPK

SEQ ID NO: 5052 - protein, 10 aa, Artificial Sequence
  source: /note="Description of Artificial Sequence: Synthetic peptide"
GINPKDLSQK

SEQ ID NO: 5053 - protein, 10 aa, Artificial Sequence
  source: /note="Description of Artificial Sequence: Synthetic peptide"
NPKDLSQKEY

SEQ ID NO: 5054 - protein, 9 aa, Artificial Sequence
  source: /note="Description of Artificial Sequence: Synthetic peptide"
GLNNQSRVK

SEQ ID NO: 5055 - protein, 10 aa, Artificial Sequence
  source: /note="Description of Artificial Sequence: Synthetic peptide"
KGLNNQSRVK

SEQ ID NO: 5056 - protein, 10 aa, Artificial Sequence
  source: /note="Description of Artificial Sequence: Synthetic peptide"
IIKGLNNQSR

SEQ ID NO: 5057 - protein, 9 aa, Artificial Sequence
  source: /note="Description of Artificial Sequence: Synthetic peptide"
GAKTRLCTA

SEQ ID NO: 5058 - protein, 9 aa, Artificial Sequence
  source: /note="Description of Artificial Sequence: Synthetic peptide"
KTRLCTAPD

SEQ ID NO: 5059 - protein, 10 aa, Artificial Sequence
  source: /note="Description of Artificial Sequence: Synthetic peptide"
KTRLCTAPDP

SEQ ID NO: 5060 - protein, 10 aa, Artificial Sequence
  source: /note="Description of Artificial Sequence: Synthetic peptide"
HPKTGAKTRL

SEQ ID NO: 5061 - protein, 9 aa, Artificial Sequence
  source: /note="Description of Artificial Sequence: Synthetic peptide"
SSRSEKIEV

SEQ ID NO: 5062 - protein, 9 aa, Artificial Sequence
  source: /note="Description of Artificial Sequence: Synthetic peptide"
EVWRENAEL

SEQ ID NO: 5063 - protein, 10 aa, Artificial Sequence
  source: /note="Description of Artificial Sequence: Synthetic peptide"
EVWRENAELV

SEQ ID NO: 5064 - protein, 10 aa, Artificial Sequence
  source: /note="Description of Artificial Sequence: Synthetic peptide"
SSRSEKIEVW

SEQ ID NO: 5065 - protein, 10 aa, Artificial Sequence
  source: /note="Description of Artificial Sequence: Synthetic peptide"
IEVWRENAEL

SEQ ID NO: 5066 - protein, 9 aa, Artificial Sequence
  source: /note="Description of Artificial Sequence: Synthetic peptide"
CLADVLLSV

SEQ ID NO: 5067 - protein, 9 aa, Artificial Sequence
  source: /note="Description of Artificial Sequence: Synthetic peptide"
VLLSVHLIV

SEQ ID NO: 5068 - protein, 9 aa, Artificial Sequence
  source: /note="Description of Artificial Sequence: Synthetic peptide"
LLSVHLIVL

SEQ ID NO: 5069 - protein, 9 aa, Artificial Sequence
  source: /note="Description of Artificial Sequence: Synthetic peptide"
TMFRRPHSC

SEQ ID NO: 5070 - protein, 9 aa, Artificial Sequence
  source: /note="Description of Artificial Sequence: Synthetic peptide"
SVHLIVLRV

SEQ ID NO: 5071 - protein, 9 aa, Artificial Sequence
  source: /note="Description of Artificial Sequence: Synthetic peptide"
KVHLNTMFR

SEQ ID NO: 5072 - protein, 9 aa, Artificial Sequence
  source: /note="Description of Artificial Sequence: Synthetic peptide"
LSVHLIVLR

SEQ ID NO: 5073 - protein, 9 aa, Artificial Sequence
  source: /note="Description of Artificial Sequence: Synthetic peptide"
VVRLPAPFR

SEQ ID NO: 5074 - protein, 9 aa, Artificial Sequence
  source: /note="Description of Artificial Sequence: Synthetic peptide"
RVVRLPAPF

SEQ ID NO: 5075 - protein, 9 aa, Artificial Sequence
  source: /note="Description of Artificial Sequence: Synthetic peptide"
KVVLRHPKV

SEQ ID NO: 5076 - protein, 9 aa, Artificial Sequence
  source: /note="Description of Artificial Sequence: Synthetic peptide"
VLRHPKVHL

SEQ ID NO: 5077 - protein, 9 aa, Artificial Sequence
  source: /note="Description of Artificial Sequence: Synthetic peptide"
MFRRPHSCL

SEQ ID NO: 5078 - protein, 9 aa, Artificial Sequence
  source: /note="Description of Artificial Sequence: Synthetic peptide"
VLRVVRLPA

SEQ ID NO: 5079 - protein, 9 aa, Artificial Sequence
  source: /note="Description of Artificial Sequence: Synthetic peptide"
KAVEFLQER

SEQ ID NO: 5080 - protein, 9 aa, Artificial Sequence
  source: /note="Description of Artificial Sequence: Synthetic peptide"
NLPPKVVLR

SEQ ID NO: 5081 - protein, 9 aa, Artificial Sequence
  source: /note="Description of Artificial Sequence: Synthetic peptide"
HLIVLRVVR

SEQ ID NO: 5082 - protein, 9 aa, Artificial Sequence
  source: /note="Description of Artificial Sequence: Synthetic peptide"
DVLLSVHLI

SEQ ID NO: 5083 - protein, 9 aa, Artificial Sequence
  source: /note="Description of Artificial Sequence: Synthetic peptide"
HPKVHLNTM

SEQ ID NO: 5084 - protein, 9 aa, Artificial Sequence
  source: /note="Description of Artificial Sequence: Synthetic peptide"
RPHSCLADV

SEQ ID NO: 5085 - protein, 9 aa, Artificial Sequence
  source: /note="Description of Artificial Sequence: Synthetic peptide"
APFRVNHAV

SEQ ID NO: 5086 - protein, 9 aa, Artificial Sequence
  source: /note="Description of Artificial Sequence: Synthetic peptide"
ARHKAVEFL

SEQ ID NO: 5087 - protein, 9 aa, Artificial Sequence
  source: /note="Description of Artificial Sequence: Synthetic peptide"
RNLPPKVVL

SEQ ID NO: 5088 - protein, 9 aa, Artificial Sequence
  source: /note="Description of Artificial Sequence: Synthetic peptide"
FRVNHAVEW

SEQ ID NO: 5089 - protein, 9 aa, Artificial Sequence
  source: /note="Description of Artificial Sequence: Synthetic peptide"
LPAPFRVNH

SEQ ID NO: 5090 - protein, 9 aa, Artificial Sequence
  source: /note="Description of Artificial Sequence: Synthetic peptide"
VEFLQERNL

SEQ ID NO: 5091 - protein, 9 aa, Artificial Sequence
  source: /note="Description of Artificial Sequence: Synthetic peptide"
QERNLPPKV

SEQ ID NO: 5092 - protein, 9 aa, Artificial Sequence
  source: /note="Description of Artificial Sequence: Synthetic peptide"
ADVLLSVHL

SEQ ID NO: 5093 - protein, 10 aa, Artificial Sequence
  source: /note="Description of Artificial Sequence: Synthetic peptide"
TMFRRPHSCL

SEQ ID NO: 5094 - protein, 10 aa, Artificial Sequence
  source: /note="Description of Artificial Sequence: Synthetic peptide"
VLLSVHLIVL

SEQ ID NO: 5095 - protein, 10 aa, Artificial Sequence
  source: /note="Description of Artificial Sequence: Synthetic peptide"
SVHLIVLRVV

SEQ ID NO: 5096 - protein, 10 aa, Artificial Sequence
  source: /note="Description of Artificial Sequence: Synthetic peptide"
HLIVLRVVRL

SEQ ID NO: 5097 - protein, 10 aa, Artificial Sequence
  source: /note="Description of Artificial Sequence: Synthetic peptide"
FLQERNLPPK

SEQ ID NO: 5098 - protein, 10 aa, Artificial Sequence
  source: /note="Description of Artificial Sequence: Synthetic peptide"
KVHLNTMFRR

SEQ ID NO: 5099 - protein, 10 aa, Artificial Sequence
  source: /note="Description of Artificial Sequence: Synthetic peptide"
RVVRLPAPFR

SEQ ID NO: 5100 - protein, 10 aa, Artificial Sequence
  source: /note="Description of Artificial Sequence: Synthetic peptide"
SARHKAVEFL

SEQ ID NO: 5101 - protein, 10 aa, Artificial Sequence
  source: /note="Description of Artificial Sequence: Synthetic peptide"
RNLPPKVVLR

SEQ ID NO: 5102 - protein, 10 aa, Artificial Sequence
  source: /note="Description of Artificial Sequence: Synthetic peptide"
MFRRPHSCLA

SEQ ID NO: 5103 - protein, 10 aa, Artificial Sequence
  source: /note="Description of Artificial Sequence: Synthetic peptide"
VVRLPAPFRV

SEQ ID NO: 5104 - protein, 10 aa, Artificial Sequence
  source: /note="Description of Artificial Sequence: Synthetic peptide"
LLSVHLIVLR

SEQ ID NO: 5105 - protein, 10 aa, Artificial Sequence
  source: /note="Description of Artificial Sequence: Synthetic peptide"
DVLLSVHLIV

SEQ ID NO: 5106 - protein, 10 aa, Artificial Sequence
  source: /note="Description of Artificial Sequence: Synthetic peptide"
LSVHLIVLRV

SEQ ID NO: 5107 - protein, 10 aa, Artificial Sequence
  source: /note="Description of Artificial Sequence: Synthetic peptide"
HPKVHLNTMF

SEQ ID NO: 5108 - protein, 10 aa, Artificial Sequence
  source: /note="Description of Artificial Sequence: Synthetic peptide"
RPHSCLADVL

SEQ ID NO: 5109 - protein, 10 aa, Artificial Sequence
  source: /note="Description of Artificial Sequence: Synthetic peptide"
LPAPFRVNHA

SEQ ID NO: 5110 - protein, 10 aa, Artificial Sequence
  source: /note="Description of Artificial Sequence: Synthetic peptide"
NTMFRRPHSC

SEQ ID NO: 5111 - protein, 10 aa, Artificial Sequence
  source: /note="Description of Artificial Sequence: Synthetic peptide"
LQERNLPPKV

SEQ ID NO: 5112 - protein, 10 aa, Artificial Sequence
  source: /note="Description of Artificial Sequence: Synthetic peptide"
RHPKVHLNTM

SEQ ID NO: 5113 - protein, 10 aa, Artificial Sequence
  source: /note="Description of Artificial Sequence: Synthetic peptide"
HLNTMFRRPH

SEQ ID NO: 5114 - protein, 10 aa, Artificial Sequence
  source: /note="Description of Artificial Sequence: Synthetic peptide"
CLADVLLSVH

SEQ ID NO: 5115 - protein, 10 aa, Artificial Sequence
  source: /note="Description of Artificial Sequence: Synthetic peptide"
LRVVRLPAPF

SEQ ID NO: 5116 - protein, 10 aa, Artificial Sequence
  source: /note="Description of Artificial Sequence: Synthetic peptide"
ADVLLSVHLI

SEQ ID NO: 5117 - protein, 9 aa, Artificial Sequence
  source: /note="Description of Artificial Sequence: Synthetic peptide"
VTRFKHLRK

SEQ ID NO: 5118 - protein, 9 aa, Artificial Sequence
  source: /note="Description of Artificial Sequence: Synthetic peptide"
LVCPKDVTR

SEQ ID NO: 5119 - protein, 9 aa, Artificial Sequence
  source: /note="Description of Artificial Sequence: Synthetic peptide"
DVTRFKHLR

SEQ ID NO: 5120 - protein, 10 aa, Artificial Sequence
  source: /note="Description of Artificial Sequence: Synthetic peptide"
VTRFKHLRKY

SEQ ID NO: 5121 - protein, 10 aa, Artificial Sequence
  source: /note="Description of Artificial Sequence: Synthetic peptide"
SLVCPKDVTR

SEQ ID NO: 5122 - protein, 10 aa, Artificial Sequence
  source: /note="Description of Artificial Sequence: Synthetic peptide"
DVTRFKHLRK

SEQ ID NO: 5123 - protein, 10 aa, Artificial Sequence
  source: /note="Description of Artificial Sequence: Synthetic peptide"
LVCPKDVTRF

SEQ ID NO: 5124 - protein, 9 aa, Artificial Sequence
  source: /note="Description of Artificial Sequence: Synthetic peptide"
GMNYCTSGA

SEQ ID NO: 5125 - protein, 9 aa, Artificial Sequence
  source: /note="Description of Artificial Sequence: Synthetic peptide"
KQVFPGMNY

SEQ ID NO: 5126 - protein, 9 aa, Artificial Sequence
  source: /note="Description of Artificial Sequence: Synthetic peptide"
MNYCTSGAY

SEQ ID NO: 5127 - protein, 10 aa, Artificial Sequence
  source: /note="Description of Artificial Sequence: Synthetic peptide"
GMNYCTSGAY

SEQ ID NO: 5128 - protein, 10 aa, Artificial Sequence
  source: /note="Description of Artificial Sequence: Synthetic peptide"
SVCKQVFPGM

SEQ ID NO: 5129 - protein, 10 aa, Artificial Sequence
  source: /note="Description of Artificial Sequence: Synthetic peptide"
CKQVFPGMNY

SEQ ID NO: 5130 - protein, 10 aa, Artificial Sequence
  source: /note="Description of Artificial Sequence: Synthetic peptide"
KQVFPGMNYC

SEQ ID NO: 5131 - protein, 9 aa, Artificial Sequence
  source: /note="Description of Artificial Sequence: Synthetic peptide"
NQYKYNQNL

SEQ ID NO: 5132 - protein, 9 aa, Artificial Sequence
  source: /note="Description of Artificial Sequence: Synthetic peptide"
YKYNQNLSA

SEQ ID NO: 5133 - protein, 10 aa, Artificial Sequence
  source: /note="Description of Artificial Sequence: Synthetic peptide"
NLSAGNNENI

SEQ ID NO: 5134 - protein, 10 aa, Artificial Sequence
  source: /note="Description of Artificial Sequence: Synthetic peptide"
QYKYNQNLSA

SEQ ID NO: 5135 - protein, 10 aa, Artificial Sequence
  source: /note="Description of Artificial Sequence: Synthetic peptide"
FNQYKYNQNL

SEQ ID NO: 5136 - protein, 10 aa, Artificial Sequence
  source: /note="Description of Artificial Sequence: Synthetic peptide"
NQYKYNQNLS

SEQ ID NO: 5137 - protein, 10 aa, Artificial Sequence
  source: /note="Description of Artificial Sequence: Synthetic peptide"
YKYNQNLSAG

SEQ ID NO: 5138 - protein, 10 aa, Artificial Sequence
  source: /note="Description of Artificial Sequence: Synthetic peptide"
LSAGNNENIM

SEQ ID NO: 5139 - protein, 9 aa, Artificial Sequence
  source: /note="Description of Artificial Sequence: Synthetic peptide"
TIPEMCLPY

SEQ ID NO: 5140 - protein, 9 aa, Artificial Sequence
  source: /note="Description of Artificial Sequence: Synthetic peptide"
PEMCLPYTI

SEQ ID NO: 5141 - protein, 10 aa, Artificial Sequence
  source: /note="Description of Artificial Sequence: Synthetic peptide"
LTIPEMCLPY

SEQ ID NO: 5142 - protein, 10 aa, Artificial Sequence
  source: /note="Description of Artificial Sequence: Synthetic peptide"
PEMCLPYTII

SEQ ID NO: 5143 - protein, 10 aa, Artificial Sequence
  source: /note="Description of Artificial Sequence: Synthetic peptide"
IPLTIPEMCL

SEQ ID NO: 5144 - protein, 10 aa, Artificial Sequence
  source: /note="Description of Artificial Sequence: Synthetic peptide"
IPEMCLPYTI

SEQ ID NO: 5145 - protein, 9 aa, Artificial Sequence
  source: /note="Description of Artificial Sequence: Synthetic peptide"
VEAEESAGV

SEQ ID NO: 5146 - protein, 10 aa, Artificial Sequence
  source: /note="Description of Artificial Sequence: Synthetic peptide"
VEDSCGLDPA

SEQ ID NO: 5147 - protein, 9 aa, Artificial Sequence
  source: /note="Description of Artificial Sequence: Synthetic peptide"
FMPLAPYWI

SEQ ID NO: 5148 - protein, 9 aa, Artificial Sequence
  source: /note="Description of Artificial Sequence: Synthetic peptide"
WFMPLAPYW

SEQ ID NO: 5149 - protein, 9 aa, Artificial Sequence
  source: /note="Description of Artificial Sequence: Synthetic peptide"
KFSWFMPLA

SEQ ID NO: 5150 - protein, 9 aa, Artificial Sequence
  source: /note="Description of Artificial Sequence: Synthetic peptide"
SWFMPLAPY

SEQ ID NO: 5151 - protein, 9 aa, Artificial Sequence
  source: /note="Description of Artificial Sequence: Synthetic peptide"
MPLAPYWIL

SEQ ID NO: 5152 - protein, 9 aa, Artificial Sequence
  source: /note="Description of Artificial Sequence: Synthetic peptide"
VKFSWFMPL

SEQ ID NO: 5153 - protein, 10 aa, Artificial Sequence
  source: /note="Description of Artificial Sequence: Synthetic peptide"
FSWFMPLAPY

SEQ ID NO: 5154 - protein, 10 aa, Artificial Sequence
  source: /note="Description of Artificial Sequence: Synthetic peptide"
FMPLAPYWIL

SEQ ID NO: 5155 - protein, 10 aa, Artificial Sequence
  source: /note="Description of Artificial Sequence: Synthetic peptide"
SWFMPLAPYW

SEQ ID NO: 5156 - protein, 10 aa, Artificial Sequence
  source: /note="Description of Artificial Sequence: Synthetic peptide"
WFMPLAPYWI

SEQ ID NO: 5157 - protein, 10 aa, Artificial Sequence
  source: /note="Description of Artificial Sequence: Synthetic peptide"
EVKFSWFMPL

SEQ ID NO: 5158 - protein, 10 aa, Artificial Sequence
  source: /note="Description of Artificial Sequence: Synthetic peptide"
VKFSWFMPLA

SEQ ID NO: 5159 - protein, 10 aa, Artificial Sequence
  source: /note="Description of Artificial Sequence: Synthetic peptide"
MPLAPYWILA

SEQ ID NO: 5160 - protein, 9 aa, Artificial Sequence
  source: /note="Description of Artificial Sequence: Synthetic peptide"
RGRLVQYRG

SEQ ID NO: 5161 - protein, 9 aa, Artificial Sequence
  source: /note="Description of Artificial Sequence: Synthetic peptide"
MEDVRGRLV

SEQ ID NO: 5162 - protein, 10 aa, Artificial Sequence
  source: /note="Description of Artificial Sequence: Synthetic peptide"
DVRGRLVQYR

SEQ ID NO: 5163 - protein, 9 aa, Artificial Sequence
  source: /note="Description of Artificial Sequence: Synthetic peptide"
KLTYPLGLA

SEQ ID NO: 5164 - protein, 9 aa, Artificial Sequence
  source: /note="Description of Artificial Sequence: Synthetic peptide"
KFKKLTYPL

SEQ ID NO: 5165 - protein, 9 aa, Artificial Sequence
  source: /note="Description of Artificial Sequence: Synthetic peptide"
GSKFKKLTY

SEQ ID NO: 5166 - protein, 9 aa, Artificial Sequence
  source: /note="Description of Artificial Sequence: Synthetic peptide"
KKLTYPLGL

SEQ ID NO: 5167 - protein, 10 aa, Artificial Sequence
  source: /note="Description of Artificial Sequence: Synthetic peptide"
LTYPLGLATL

SEQ ID NO: 5168 - protein, 10 aa, Artificial Sequence
  source: /note="Description of Artificial Sequence: Synthetic peptide"
KFKKLTYPLG

SEQ ID NO: 5169 - protein, 10 aa, Artificial Sequence
  source: /note="Description of Artificial Sequence: Synthetic peptide"
KGSKFKKLTY

SEQ ID NO: 5170 - protein, 10 aa, Artificial Sequence
  source: /note="Description of Artificial Sequence: Synthetic peptide"
SKFKKLTYPL

SEQ ID NO: 5171 - protein, 10 aa, Artificial Sequence
  source: /note="Description of Artificial Sequence: Synthetic peptide"
FKKLTYPLGL

SEQ ID NO: 5172 - protein, 9 aa, Artificial Sequence
  source: /note="Description of Artificial Sequence: Synthetic peptide"
SWLIAASSR

SEQ ID NO: 5173 - protein, 9 aa, Artificial Sequence
  source: /note="Description of Artificial Sequence: Synthetic peptide"
LEEQSWLIA

SEQ ID NO: 5174 - protein, 9 aa, Artificial Sequence
  source: /note="Description of Artificial Sequence: Synthetic peptide"
EEQSWLIAA

SEQ ID NO: 5175 - protein, 10 aa, Artificial Sequence
  source: /note="Description of Artificial Sequence: Synthetic peptide"
QSWLIAASSR

SEQ ID NO: 5176 - protein, 10 aa, Artificial Sequence
  source: /note="Description of Artificial Sequence: Synthetic peptide"
IEKDLEEQSW

SEQ ID NO: 5177 - protein, 10 aa, Artificial Sequence
  source: /note="Description of Artificial Sequence: Synthetic peptide"
LEEQSWLIAA

SEQ ID NO: 5178 - protein, 10 aa, Artificial Sequence
  source: /note="Description of Artificial Sequence: Synthetic peptide"
EEQSWLIAAS

SEQ ID NO: 5179 - protein, 10 aa, Artificial Sequence
  source: /note="Description of Artificial Sequence: Synthetic peptide"
KDLEEQSWLI

SEQ ID NO: 5180 - protein, 9 aa, Artificial Sequence
  source: /note="Description of Artificial Sequence: Synthetic peptide"
GTATYLLLV

SEQ ID NO: 5181 - protein, 9 aa, Artificial Sequence
  source: /note="Description of Artificial Sequence: Synthetic peptide"
ATYLLLVAL

SEQ ID NO: 5182 - protein, 9 aa, Artificial Sequence
  source: /note="Description of Artificial Sequence: Synthetic peptide"
ATVGTATYL

SEQ ID NO: 5183 - protein, 9 aa, Artificial Sequence
  source: /note="Description of Artificial Sequence: Synthetic peptide"
TVGTATYLL

SEQ ID NO: 5184 - protein, 10 aa, Artificial Sequence
  source: /note="Description of Artificial Sequence: Synthetic peptide"
GTATYLLLVA

SEQ ID NO: 5185 - protein, 10 aa, Artificial Sequence
  source: /note="Description of Artificial Sequence: Synthetic peptide"
ATYLLLVALH

SEQ ID NO: 5186 - protein, 10 aa, Artificial Sequence
  source: /note="Description of Artificial Sequence: Synthetic peptide"
ATVGTATYLL

SEQ ID NO: 5187 - protein, 9 aa, Artificial Sequence
  source: /note="Description of Artificial Sequence: Synthetic peptide"
HITPAVTVA

SEQ ID NO: 5188 - protein, 9 aa, Artificial Sequence
  source: /note="Description of Artificial Sequence: Synthetic peptide"
SGAHITPAV

SEQ ID NO: 5189 - protein, 9 aa, Artificial Sequence
  source: /note="Description of Artificial Sequence: Synthetic peptide"
TPAVTVACL

SEQ ID NO: 5190 - protein, 9 aa, Artificial Sequence
  source: /note="Description of Artificial Sequence: Synthetic peptide"
AHITPAVTV

SEQ ID NO: 5191 - protein, 10 aa, Artificial Sequence
  source: /note="Description of Artificial Sequence: Synthetic peptide"
HISGAHITPA

SEQ ID NO: 5192 - protein, 10 aa, Artificial Sequence
  source: /note="Description of Artificial Sequence: Synthetic peptide"
ITPAVTVACL

SEQ ID NO: 5193 - protein, 10 aa, Artificial Sequence
  source: /note="Description of Artificial Sequence: Synthetic peptide"
TPAVTVACLV

SEQ ID NO: 5194 - protein, 10 aa, Artificial Sequence
  source: /note="Description of Artificial Sequence: Synthetic peptide"
AHITPAVTVA

SEQ ID NO: 5195 - protein, 9 aa, Artificial Sequence
  source: /note="Description of Artificial Sequence: Synthetic peptide"
HMPTYLVTF

SEQ ID NO: 5196 - protein, 9 aa, Artificial Sequence
  source: /note="Description of Artificial Sequence: Synthetic peptide"
PTYLVTFVI

SEQ ID NO: 5197 - protein, 9 aa, Artificial Sequence
  source: /note="Description of Artificial Sequence: Synthetic peptide"
TYLVTFVIC

SEQ ID NO: 5198 - protein, 9 aa, Artificial Sequence
  source: /note="Description of Artificial Sequence: Synthetic peptide"
LVTFVICDY

SEQ ID NO: 5199 - protein, 9 aa, Artificial Sequence
  source: /note="Description of Artificial Sequence: Synthetic peptide"
MPTYLVTFV

SEQ ID NO: 5200 - protein, 10 aa, Artificial Sequence
  source: /note="Description of Artificial Sequence: Synthetic peptide"
HMPTYLVTFV

SEQ ID NO: 5201 - protein, 10 aa, Artificial Sequence
  source: /note="Description of Artificial Sequence: Synthetic peptide"
PHMPTYLVTF

SEQ ID NO: 5202 - protein, 10 aa, Artificial Sequence
  source: /note="Description of Artificial Sequence: Synthetic peptide"
YLVTFVICDY

SEQ ID NO: 5203 - protein, 10 aa, Artificial Sequence
  source: /note="Description of Artificial Sequence: Synthetic peptide"
MPTYLVTFVI

SEQ ID NO: 5204 - protein, 9 aa, Artificial Sequence
  source: /note="Description of Artificial Sequence: Synthetic peptide"
GIRRESPLV

SEQ ID NO: 5205 - protein, 9 aa, Artificial Sequence
  source: /note="Description of Artificial Sequence: Synthetic peptide"
TGIRRESPL

SEQ ID NO: 5206 - protein, 9 aa, Artificial Sequence
  source: /note="Description of Artificial Sequence: Synthetic peptide"
RRESPLVGL

SEQ ID NO: 5207 - protein, 9 aa, Artificial Sequence
  source: /note="Description of Artificial Sequence: Synthetic peptide"
RESPLVGLL

SEQ ID NO: 5208 - protein, 10 aa, Artificial Sequence
  source: /note="Description of Artificial Sequence: Synthetic peptide"
FTGIRRESPL

SEQ ID NO: 5209 - protein, 10 aa, Artificial Sequence
  source: /note="Description of Artificial Sequence: Synthetic peptide"
IRRESPLVGL

SEQ ID NO: 5210 - protein, 9 aa, Artificial Sequence
  source: /note="Description of Artificial Sequence: Synthetic peptide"
SLHNRTWYV

SEQ ID NO: 5211 - protein, 9 aa, Artificial Sequence
  source: /note="Description of Artificial Sequence: Synthetic peptide"
HNRTWYVQA

SEQ ID NO: 5212 - protein, 9 aa, Artificial Sequence
  source: /note="Description of Artificial Sequence: Synthetic peptide"
QSLHNRTWY

SEQ ID NO: 5213 - protein, 9 aa, Artificial Sequence
  source: /note="Description of Artificial Sequence: Synthetic peptide"
LQSLHNRTW

SEQ ID NO: 5214 - protein, 10 aa, Artificial Sequence
  source: /note="Description of Artificial Sequence: Synthetic peptide"
QSLHNRTWYV

SEQ ID NO: 5215 - protein, 10 aa, Artificial Sequence
  source: /note="Description of Artificial Sequence: Synthetic peptide"
LQSLHNRTWY

SEQ ID NO: 5216 - protein, 10 aa, Artificial Sequence
  source: /note="Description of Artificial Sequence: Synthetic peptide"
KLGLQSLHNR

SEQ ID NO: 5217 - protein, 10 aa, Artificial Sequence
  source: /note="Description of Artificial Sequence: Synthetic peptide"
GLQSLHNRTW

SEQ ID NO: 5218 - protein, 9 aa, Artificial Sequence
  source: /note="Description of Artificial Sequence: Synthetic peptide"
SWANITYGV

SEQ ID NO: 5219 - protein, 9 aa, Artificial Sequence
  source: /note="Description of Artificial Sequence: Synthetic peptide"
NPSWANITY

SEQ ID NO: 5220 - protein, 9 aa, Artificial Sequence
  source: /note="Description of Artificial Sequence: Synthetic peptide"
WANITYGVF

SEQ ID NO: 5221 - protein, 9 aa, Artificial Sequence
  source: /note="Description of Artificial Sequence: Synthetic peptide"
AKNPSWANI

SEQ ID NO: 5222 - protein, 9 aa, Artificial Sequence
  source: /note="Description of Artificial Sequence: Synthetic peptide"
ANITYGVFL

SEQ ID NO: 5223 - protein, 10 aa, Artificial Sequence
  source: /note="Description of Artificial Sequence: Synthetic peptide"
SWANITYGVF

SEQ ID NO: 5224 - protein, 10 aa, Artificial Sequence
  source: /note="Description of Artificial Sequence: Synthetic peptide"
GAKNPSWANI

SEQ ID NO: 5225 - protein, 10 aa, Artificial Sequence
  source: /note="Description of Artificial Sequence: Synthetic peptide"
KNPSWANITY

SEQ ID NO: 5226 - protein, 10 aa, Artificial Sequence
  source: /note="Description of Artificial Sequence: Synthetic peptide"
NITYGVFLCI

SEQ ID NO: 5227 - protein, 10 aa, Artificial Sequence
  source: /note="Description of Artificial Sequence: Synthetic peptide"
WANITYGVFL

SEQ ID NO: 5228 - protein, 9 aa, Artificial Sequence
  source: /note="Description of Artificial Sequence: Synthetic peptide"
KMLTQTDSA

SEQ ID NO: 5229 - protein, 9 aa, Artificial Sequence
  source: /note="Description of Artificial Sequence: Synthetic peptide"
EIAEVLFHI

SEQ ID NO: 5230 - protein, 9 aa, Artificial Sequence
  source: /note="Description of Artificial Sequence: Synthetic peptide"
KMNISGKKM

SEQ ID NO: 5231 - protein, 9 aa, Artificial Sequence
  source: /note="Description of Artificial Sequence: Synthetic peptide"
DSAWDLEIA

SEQ ID NO: 5232 - protein, 9 aa, Artificial Sequence
  source: /note="Description of Artificial Sequence: Synthetic peptide"
MLTQTDSAW

SEQ ID NO: 5233 - protein, 9 aa, Artificial Sequence
  source: /note="Description of Artificial Sequence: Synthetic peptide"
TQTDSAWDL

SEQ ID NO: 5234 - protein, 9 aa, Artificial Sequence
  source: /note="Description of Artificial Sequence: Synthetic peptide"
LEIAEVLFH

SEQ ID NO: 5235 - protein, 9 aa, Artificial Sequence
  source: /note="Description of Artificial Sequence: Synthetic peptide"
WDLEIAEVL

SEQ ID NO: 5236 - protein, 10 aa, Artificial Sequence
  source: /note="Description of Artificial Sequence: Synthetic peptide"
QTDSAWDLEI

SEQ ID NO: 5237 - protein, 10 aa, Artificial Sequence
  source: /note="Description of Artificial Sequence: Synthetic peptide"
SAWDLEIAEV

SEQ ID NO: 5238 - protein, 10 aa, Artificial Sequence
  source: /note="Description of Artificial Sequence: Synthetic peptide"
KMNISGKKML

SEQ ID NO: 5239 - protein, 10 aa, Artificial Sequence
  source: /note="Description of Artificial Sequence: Synthetic peptide"
EKMNISGKKM

SEQ ID NO: 5240 - protein, 10 aa, Artificial Sequence
  source: /note="Description of Artificial Sequence: Synthetic peptide"
KKMLTQTDSA

SEQ ID NO: 5241 - protein, 10 aa, Artificial Sequence
  source: /note="Description of Artificial Sequence: Synthetic peptide"
KMLTQTDSAW

SEQ ID NO: 5242 - protein, 10 aa, Artificial Sequence
  source: /note="Description of Artificial Sequence: Synthetic peptide"
LEIAEVLFHI

SEQ ID NO: 5243 - protein, 10 aa, Artificial Sequence
  source: /note="Description of Artificial Sequence: Synthetic peptide"
WDLEIAEVLF

SEQ ID NO: 5244 - protein, 9 aa, Artificial Sequence
  source: /note="Description of Artificial Sequence: Synthetic peptide"
ETAPPTSIS

SEQ ID NO: 5245 - protein, 9 aa, Artificial Sequence
  source: /note="Description of Artificial Sequence: Synthetic peptide"
GETAPPTSI

SEQ ID NO: 5246 - protein, 10 aa, Artificial Sequence
  source: /note="Description of Artificial Sequence: Synthetic peptide"
ETAPPTSISC

SEQ ID NO: 5247 - protein, 9 aa, Artificial Sequence
  source: /note="Description of Artificial Sequence: Synthetic peptide"
ELIQTINNI

SEQ ID NO: 5248 - protein, 9 aa, Artificial Sequence
  source: /note="Description of Artificial Sequence: Synthetic peptide"
LIQTINNIV

SEQ ID NO: 5249 - protein, 9 aa, Artificial Sequence
  source: /note="Description of Artificial Sequence: Synthetic peptide"
QTINNIVFF

SEQ ID NO: 5250 - protein, 9 aa, Artificial Sequence
  source: /note="Description of Artificial Sequence: Synthetic peptide"
IQTINNIVF

SEQ ID NO: 5251 - protein, 10 aa, Artificial Sequence
  source: /note="Description of Artificial Sequence: Synthetic peptide"
TINNIVFFPA

SEQ ID NO: 5252 - protein, 10 aa, Artificial Sequence
  source: /note="Description of Artificial Sequence: Synthetic peptide"
ELIQTINNIV

SEQ ID NO: 5253 - protein, 10 aa, Artificial Sequence
  source: /note="Description of Artificial Sequence: Synthetic peptide"
IQTINNIVFF

SEQ ID NO: 5254 - protein, 10 aa, Artificial Sequence
  source: /note="Description of Artificial Sequence: Synthetic peptide"
LIQTINNIVF

SEQ ID NO: 5255 - protein, 10 aa, Artificial Sequence
  source: /note="Description of Artificial Sequence: Synthetic peptide"
LELIQTINNI

SEQ ID NO: 5256 - protein, 9 aa, Artificial Sequence
  source: /note="Description of Artificial Sequence: Synthetic peptide"
VALGIAGEK

SEQ ID NO: 5257 - protein, 9 aa, Artificial Sequence
  source: /note="Description of Artificial Sequence: Synthetic peptide"
ALGIAGEKF

SEQ ID NO: 5258 - protein, 9 aa, Artificial Sequence
  source: /note="Description of Artificial Sequence: Synthetic peptide"
DEVALGIAG

SEQ ID NO: 5259 - protein, 10 aa, Artificial Sequence
  source: /note="Description of Artificial Sequence: Synthetic peptide"
VALGIAGEKF

SEQ ID NO: 5260 - protein, 10 aa, Artificial Sequence
  source: /note="Description of Artificial Sequence: Synthetic peptide"
DEVALGIAGE

SEQ ID NO: 5261 - protein, 9 aa, Artificial Sequence
  source: /note="Description of Artificial Sequence: Synthetic peptide"
KAWHTRWFV

SEQ ID NO: 5262 - protein, 9 aa, Artificial Sequence
  source: /note="Description of Artificial Sequence: Synthetic peptide"
AWHTRWFVL

SEQ ID NO: 5263 - protein, 9 aa, Artificial Sequence
  source: /note="Description of Artificial Sequence: Synthetic peptide"
GFVKAWHTR

SEQ ID NO: 5264 - protein, 9 aa, Artificial Sequence
  source: /note="Description of Artificial Sequence: Synthetic peptide"
RKQGGFVKA

SEQ ID NO: 5265 - protein, 9 aa, Artificial Sequence
  source: /note="Description of Artificial Sequence: Synthetic peptide"
KQGGFVKAW

SEQ ID NO: 5266 - protein, 9 aa, Artificial Sequence
  source: /note="Description of Artificial Sequence: Synthetic peptide"
FVKAWHTRW

SEQ ID NO: 5267 - protein, 9 aa, Artificial Sequence
  source: /note="Description of Artificial Sequence: Synthetic peptide"
VKAWHTRWF

SEQ ID NO: 5268 - protein, 10 aa, Artificial Sequence
  source: /note="Description of Artificial Sequence: Synthetic peptide"
AWHTRWFVLK

SEQ ID NO: 5269 - protein, 10 aa, Artificial Sequence
  source: /note="Description of Artificial Sequence: Synthetic peptide"
GFVKAWHTRW

SEQ ID NO: 5270 - protein, 10 aa, Artificial Sequence
  source: /note="Description of Artificial Sequence: Synthetic peptide"
KAWHTRWFVL

SEQ ID NO: 5271 - protein, 10 aa, Artificial Sequence
  source: /note="Description of Artificial Sequence: Synthetic peptide"
FVKAWHTRWF

SEQ ID NO: 5272 - protein, 10 aa, Artificial Sequence
  source: /note="Description of Artificial Sequence: Synthetic peptide"
RKQGGFVKAW

SEQ ID NO: 5273 - protein, 9 aa, Artificial Sequence
  source: /note="Description of Artificial Sequence: Synthetic peptide"
SPKENTSTA

SEQ ID NO: 5274 - protein, 9 aa, Artificial Sequence
  source: /note="Description of Artificial Sequence: Synthetic peptide"
KENTSTATM

SEQ ID NO: 5275 - protein, 10 aa, Artificial Sequence
  source: /note="Description of Artificial Sequence: Synthetic peptide"
KIYPPSGSPK

SEQ ID NO: 5276 - protein, 10 aa, Artificial Sequence
  source: /note="Description of Artificial Sequence: Synthetic peptide"
SPKENTSTAT

SEQ ID NO: 5277 - protein, 10 aa, Artificial Sequence
  source: /note="Description of Artificial Sequence: Synthetic peptide"
KENTSTATMT

SEQ ID NO: 5278 - protein, 9 aa, Artificial Sequence
  source: /note="Description of Artificial Sequence: Synthetic peptide"
LVNEFTRCK

SEQ ID NO: 5279 - protein, 9 aa, Artificial Sequence
  source: /note="Description of Artificial Sequence: Synthetic peptide"
FTRCKHLEL

SEQ ID NO: 5280 - protein, 9 aa, Artificial Sequence
  source: /note="Description of Artificial Sequence: Synthetic peptide"
CKHLELTAT

SEQ ID NO: 5281 - protein, 9 aa, Artificial Sequence
  source: /note="Description of Artificial Sequence: Synthetic peptide"
NEFTRCKHL

SEQ ID NO: 5282 - protein, 10 aa, Artificial Sequence
  source: /note="Description of Artificial Sequence: Synthetic peptide"
VLVNEFTRCK

SEQ ID NO: 5283 - protein, 10 aa, Artificial Sequence
  source: /note="Description of Artificial Sequence: Synthetic peptide"
CKHLELTATM

SEQ ID NO: 5284 - protein, 9 aa, Artificial Sequence
  source: /note="Description of Artificial Sequence: Synthetic peptide"
VGRRRGNVV

SEQ ID NO: 5285 - protein, 9 aa, Artificial Sequence
  source: /note="Description of Artificial Sequence: Synthetic peptide"
VEEATGQAV

SEQ ID NO: 5286 - protein, 10 aa, Artificial Sequence
  source: /note="Description of Artificial Sequence: Synthetic peptide"
VGRRRGNVVR

SEQ ID NO: 5287 - protein, 9 aa, Artificial Sequence
  source: /note="Description of Artificial Sequence: Synthetic peptide"
KAARALCHR

SEQ ID NO: 5288 - protein, 9 aa, Artificial Sequence
  source: /note="Description of Artificial Sequence: Synthetic peptide"
AARALCHRI

SEQ ID NO: 5289 - protein, 9 aa, Artificial Sequence
  source: /note="Description of Artificial Sequence: Synthetic peptide"
RALCHRIMP

SEQ ID NO: 5290 - protein, 9 aa, Artificial Sequence
  source: /note="Description of Artificial Sequence: Synthetic peptide"
LKAARALCH

SEQ ID NO: 5291 - protein, 9 aa, Artificial Sequence
  source: /note="Description of Artificial Sequence: Synthetic peptide"
ARALCHRIM

SEQ ID NO: 5292 - protein, 9 aa, Artificial Sequence
  source: /note="Description of Artificial Sequence: Synthetic peptide"
HRIMPPLLL

SEQ ID NO: 5293 - protein, 10 aa, Artificial Sequence
  source: /note="Description of Artificial Sequence: Synthetic peptide"
ALCHRIMPPL

SEQ ID NO: 5294 - protein, 10 aa, Artificial Sequence
  source: /note="Description of Artificial Sequence: Synthetic peptide"
KAARALCHRI

SEQ ID NO: 5295 - protein, 10 aa, Artificial Sequence
  source: /note="Description of Artificial Sequence: Synthetic peptide"
AARALCHRIM

SEQ ID NO: 5296 - protein, 10 aa, Artificial Sequence
  source: /note="Description of Artificial Sequence: Synthetic peptide"
RALCHRIMPP

SEQ ID NO: 5297 - protein, 10 aa, Artificial Sequence
  source: /note="Description of Artificial Sequence: Synthetic peptide"
HRIMPPLLLL

SEQ ID NO: 5298 - protein, 9 aa, Artificial Sequence
  source: /note="Description of Artificial Sequence: Synthetic peptide"
YLANLPFTL

SEQ ID NO: 5299 - protein, 9 aa, Artificial Sequence
  source: /note="Description of Artificial Sequence: Synthetic peptide"
KYLANLPFT

SEQ ID NO: 5300 - protein, 9 aa, Artificial Sequence
  source: /note="Description of Artificial Sequence: Synthetic peptide"
QIRKDKYLA

SEQ ID NO: 5301 - protein, 9 aa, Artificial Sequence
  source: /note="Description of Artificial Sequence: Synthetic peptide"
LANLPFTLI

SEQ ID NO: 5302 - protein, 9 aa, Artificial Sequence
  source: /note="Description of Artificial Sequence: Synthetic peptide"
DKYLANLPF

SEQ ID NO: 5303 - protein, 9 aa, Artificial Sequence
  source: /note="Description of Artificial Sequence: Synthetic peptide"
SQIRKDKYL

SEQ ID NO: 5304 - protein, 9 aa, Artificial Sequence
  source: /note="Description of Artificial Sequence: Synthetic peptide"
RKDKYLANL

SEQ ID NO: 5305 - protein, 10 aa, Artificial Sequence
  source: /note="Description of Artificial Sequence: Synthetic peptide"
YLANLPFTLI

SEQ ID NO: 5306 - protein, 10 aa, Artificial Sequence
  source: /note="Description of Artificial Sequence: Synthetic peptide"
KYLANLPFTL

SEQ ID NO: 5307 - protein, 10 aa, Artificial Sequence
  source: /note="Description of Artificial Sequence: Synthetic peptide"
KDKYLANLPF

SEQ ID NO: 5308 - protein, 10 aa, Artificial Sequence
  source: /note="Description of Artificial Sequence: Synthetic peptide"
LANLPFTLIL

SEQ ID NO: 5309 - protein, 9 aa, Artificial Sequence
  source: /note="Description of Artificial Sequence: Synthetic peptide"
VTDSQADFL

SEQ ID NO: 5310 - protein, 9 aa, Artificial Sequence
  source: /note="Description of Artificial Sequence: Synthetic peptide"
FLKMRLSKS

SEQ ID NO: 5311 - protein, 9 aa, Artificial Sequence
  source: /note="Description of Artificial Sequence: Synthetic peptide"
DFLKMRLSK

SEQ ID NO: 5312 - protein, 10 aa, Artificial Sequence
  source: /note="Description of Artificial Sequence: Synthetic peptide"
VTDSQADFLK

SEQ ID NO: 5313 - protein, 10 aa, Artificial Sequence
  source: /note="Description of Artificial Sequence: Synthetic peptide"
SQADFLKMRL

SEQ ID NO: 5314 - protein, 10 aa, Artificial Sequence
  source: /note="Description of Artificial Sequence: Synthetic peptide"
DSQADFLKMR

SEQ ID NO: 5315 - protein, 9 aa, Artificial Sequence
  source: /note="Description of Artificial Sequence: Synthetic peptide"
SDWWLARCL

SEQ ID NO: 5316 - protein, 10 aa, Artificial Sequence
  source: /note="Description of Artificial Sequence: Synthetic peptide"
WLARCLEAPS

SEQ ID NO: 5317 - protein, 9 aa, Artificial Sequence
  source: /note="Description of Artificial Sequence: Synthetic peptide"
LEALTGQGM

SEQ ID NO: 5318 - protein, 10 aa, Artificial Sequence
  source: /note="Description of Artificial Sequence: Synthetic peptide"
QQDDGSDAPL

SEQ ID NO: 5319 - protein, 9 aa, Artificial Sequence
  source: /note="Description of Artificial Sequence: Synthetic peptide"
GSRLRKGTV

SEQ ID NO: 5320 - protein, 10 aa, Artificial Sequence
  source: /note="Description of Artificial Sequence: Synthetic peptide"
SQQEGSRLRK

SEQ ID NO: 5321 - protein, 9 aa, Artificial Sequence
  source: /note="Description of Artificial Sequence: Synthetic peptide"
RMMNWHWRK

SEQ ID NO: 5322 - protein, 9 aa, Artificial Sequence
  source: /note="Description of Artificial Sequence: Synthetic peptide"
NWHWRKPTW

SEQ ID NO: 5323 - protein, 9 aa, Artificial Sequence
  source: /note="Description of Artificial Sequence: Synthetic peptide"
CYNSPRYSA

SEQ ID NO: 5324 - protein, 9 aa, Artificial Sequence
  source: /note="Description of Artificial Sequence: Synthetic peptide"
LLECYNSPR

SEQ ID NO: 5325 - protein, 9 aa, Artificial Sequence
  source: /note="Description of Artificial Sequence: Synthetic peptide"
YNSPRYSAF

SEQ ID NO: 5326 - protein, 9 aa, Artificial Sequence
  source: /note="Description of Artificial Sequence: Synthetic peptide"
LECYNSPRY

SEQ ID NO: 5327 - protein, 10 aa, Artificial Sequence
  source: /note="Description of Artificial Sequence: Synthetic peptide"
LLECYNSPRY

SEQ ID NO: 5328 - protein, 10 aa, Artificial Sequence
  source: /note="Description of Artificial Sequence: Synthetic peptide"
MMNWHWRKPT

SEQ ID NO: 5329 - protein, 10 aa, Artificial Sequence
  source: /note="Description of Artificial Sequence: Synthetic peptide"
SAFEPTSPER

SEQ ID NO: 5330 - protein, 10 aa, Artificial Sequence
  source: /note="Description of Artificial Sequence: Synthetic peptide"
CYNSPRYSAF

SEQ ID NO: 5331 - protein, 10 aa, Artificial Sequence
  source: /note="Description of Artificial Sequence: Synthetic peptide"
RMMNWHWRKP

SEQ ID NO: 5332 - protein, 10 aa, Artificial Sequence
  source: /note="Description of Artificial Sequence: Synthetic peptide"
DLLECYNSPR

SEQ ID NO: 5333 - protein, 10 aa, Artificial Sequence
  source: /note="Description of Artificial Sequence: Synthetic peptide"
SPRYSAFEPT

SEQ ID NO: 5334 - protein, 10 aa, Artificial Sequence
  source: /note="Description of Artificial Sequence: Synthetic peptide"
MNWHWRKPTW

SEQ ID NO: 5335 - protein, 10 aa, Artificial Sequence
  source: /note="Description of Artificial Sequence: Synthetic peptide"
FEPTSPERMM

SEQ ID NO: 5336 - protein, 10 aa, Artificial Sequence
  source: /note="Description of Artificial Sequence: Synthetic peptide"
SPERMMNWHW

SEQ ID NO: 5337 - protein, 9 aa, Artificial Sequence
  source: /note="Description of Artificial Sequence: Synthetic peptide"
SLAPSMTSS

SEQ ID NO: 5338 - protein, 9 aa, Artificial Sequence
  source: /note="Description of Artificial Sequence: Synthetic peptide"
LAPSMTSSK

SEQ ID NO: 5339 - protein, 9 aa, Artificial Sequence
  source: /note="Description of Artificial Sequence: Synthetic peptide"
DSFGSQASL

SEQ ID NO: 5340 - protein, 9 aa, Artificial Sequence
  source: /note="Description of Artificial Sequence: Synthetic peptide"
SQASLAPSM

SEQ ID NO: 5341 - protein, 10 aa, Artificial Sequence
  source: /note="Description of Artificial Sequence: Synthetic peptide"
SLAPSMTSSK

SEQ ID NO: 5342 - protein, 10 aa, Artificial Sequence
  source: /note="Description of Artificial Sequence: Synthetic peptide"
DSFGSQASLA

SEQ ID NO: 5343 - protein, 10 aa, Artificial Sequence
  source: /note="Description of Artificial Sequence: Synthetic peptide"
GSQASLAPSM

SEQ ID NO: 5344 - protein, 10 aa, Artificial Sequence
  source: /note="Description of Artificial Sequence: Synthetic peptide"
SQASLAPSMT

SEQ ID NO: 5345 - protein, 9 aa, Artificial Sequence
  source: /note="Description of Artificial Sequence: Synthetic peptide"
SMWAHQAVL

SEQ ID NO: 5346 - protein, 9 aa, Artificial Sequence
  source: /note="Description of Artificial Sequence: Synthetic peptide"
NLQPTSMWA

SEQ ID NO: 5347 - protein, 9 aa, Artificial Sequence
  source: /note="Description of Artificial Sequence: Synthetic peptide"
TSMWAHQAV

SEQ ID NO: 5348 - protein, 9 aa, Artificial Sequence
  source: /note="Description of Artificial Sequence: Synthetic peptide"
WAHQAVLPA

SEQ ID NO: 5349 - protein, 9 aa, Artificial Sequence
  source: /note="Description of Artificial Sequence: Synthetic peptide"
LQPTSMWAH

SEQ ID NO: 5350 - protein, 10 aa, Artificial Sequence
  source: /note="Description of Artificial Sequence: Synthetic peptide"
TSMWAHQAVL

SEQ ID NO: 5351 - protein, 10 aa, Artificial Sequence
  source: /note="Description of Artificial Sequence: Synthetic peptide"
SMWAHQAVLP

SEQ ID NO: 5352 - protein, 10 aa, Artificial Sequence
  source: /note="Description of Artificial Sequence: Synthetic peptide"
MWAHQAVLPA

SEQ ID NO: 5353 - protein, 9 aa, Artificial Sequence
  source: /note="Description of Artificial Sequence: Synthetic peptide"
GQWMAHMAL

SEQ ID NO: 5354 - protein, 9 aa, Artificial Sequence
  source: /note="Description of Artificial Sequence: Synthetic peptide"
KMYTTSMAM

SEQ ID NO: 5355 - protein, 9 aa, Artificial Sequence
  source: /note="Description of Artificial Sequence: Synthetic peptide"
YTTSMAMPI

SEQ ID NO: 5356 - protein, 9 aa, Artificial Sequence
  source: /note="Description of Artificial Sequence: Synthetic peptide"
SMAMPILPL

SEQ ID NO: 5357 - protein, 9 aa, Artificial Sequence
  source: /note="Description of Artificial Sequence: Synthetic peptide"
HMALLPSGT

SEQ ID NO: 5358 - protein, 9 aa, Artificial Sequence
  source: /note="Description of Artificial Sequence: Synthetic peptide"
LLSADQQAA

SEQ ID NO: 5359 - protein, 9 aa, Artificial Sequence
  source: /note="Description of Artificial Sequence: Synthetic peptide"
MALLPSGTK

SEQ ID NO: 5360 - protein, 9 aa, Artificial Sequence
  source: /note="Description of Artificial Sequence: Synthetic peptide"
KLPSLPLSK

SEQ ID NO: 5361 - protein, 9 aa, Artificial Sequence
  source: /note="Description of Artificial Sequence: Synthetic peptide"
PMAISSPPK

SEQ ID NO: 5362 - protein, 9 aa, Artificial Sequence
  source: /note="Description of Artificial Sequence: Synthetic peptide"
QWMAHMALL

SEQ ID NO: 5363 - protein, 9 aa, Artificial Sequence
  source: /note="Description of Artificial Sequence: Synthetic peptide"
MYSPSRYPR

SEQ ID NO: 5364 - protein, 9 aa, Artificial Sequence
  source: /note="Description of Artificial Sequence: Synthetic peptide"
KGRCTACHT

SEQ ID NO: 5365 - protein, 9 aa, Artificial Sequence
  source: /note="Description of Artificial Sequence: Synthetic peptide"
LSKMYTTSM

SEQ ID NO: 5366 - protein, 9 aa, Artificial Sequence
  source: /note="Description of Artificial Sequence: Synthetic peptide"
RTNFHSSLA

SEQ ID NO: 5367 - protein, 9 aa, Artificial Sequence
  source: /note="Description of Artificial Sequence: Synthetic peptide"
HPLAPMPSK

SEQ ID NO: 5368 - protein, 9 aa, Artificial Sequence
  source: /note="Description of Artificial Sequence: Synthetic peptide"
LAAPSPASR

SEQ ID NO: 5369 - protein, 9 aa, Artificial Sequence
  source: /note="Description of Artificial Sequence: Synthetic peptide"
TACHTALGR

SEQ ID NO: 5370 - protein, 9 aa, Artificial Sequence
  source: /note="Description of Artificial Sequence: Synthetic peptide"
HTALGRGSL

SEQ ID NO: 5371 - protein, 9 aa, Artificial Sequence
  source: /note="Description of Artificial Sequence: Synthetic peptide"
TTSMAMPIL

SEQ ID NO: 5372 - protein, 9 aa, Artificial Sequence
  source: /note="Description of Artificial Sequence: Synthetic peptide"
ETVSLHPLA

SEQ ID NO: 5373 - protein, 9 aa, Artificial Sequence
  source: /note="Description of Artificial Sequence: Synthetic peptide"
YPRSSSSSS

SEQ ID NO: 5374 - protein, 9 aa, Artificial Sequence
  source: /note="Description of Artificial Sequence: Synthetic peptide"
IPMAISSPP

SEQ ID NO: 5375 - protein, 9 aa, Artificial Sequence
  source: /note="Description of Artificial Sequence: Synthetic peptide"
SPASRLQCI

SEQ ID NO: 5376 - protein, 9 aa, Artificial Sequence
  source: /note="Description of Artificial Sequence: Synthetic peptide"
LPASNKLPS

SEQ ID NO: 5377 - protein, 9 aa, Artificial Sequence
  source: /note="Description of Artificial Sequence: Synthetic peptide"
LPSLPLSKM

SEQ ID NO: 5378 - protein, 9 aa, Artificial Sequence
  source: /note="Description of Artificial Sequence: Synthetic peptide"
MPILPLPQL

SEQ ID NO: 5379 - protein, 9 aa, Artificial Sequence
  source: /note="Description of Artificial Sequence: Synthetic peptide"
APRTNFHSS

SEQ ID NO: 5380 - protein, 9 aa, Artificial Sequence
  source: /note="Description of Artificial Sequence: Synthetic peptide"
QQAAPRTNF

SEQ ID NO: 5381 - protein, 9 aa, Artificial Sequence
  source: /note="Description of Artificial Sequence: Synthetic peptide"
SSSNDMIPM

SEQ ID NO: 5382 - protein, 9 aa, Artificial Sequence
  source: /note="Description of Artificial Sequence: Synthetic peptide"
VSLHPLAPM

SEQ ID NO: 5383 - protein, 9 aa, Artificial Sequence
  source: /note="Description of Artificial Sequence: Synthetic peptide"
SSSSSSNDM

SEQ ID NO: 5384 - protein, 9 aa, Artificial Sequence
  source: /note="Description of Artificial Sequence: Synthetic peptide"
ISSPPKAPL

SEQ ID NO: 5385 - protein, 9 aa, Artificial Sequence
  source: /note="Description of Artificial Sequence: Synthetic peptide"
SRITSGQWM

SEQ ID NO: 5386 - protein, 9 aa, Artificial Sequence
  source: /note="Description of Artificial Sequence: Synthetic peptide"
MAHMALLPS

SEQ ID NO: 5387 - protein, 9 aa, Artificial Sequence
  source: /note="Description of Artificial Sequence: Synthetic peptide"
AHMALLPSG

SEQ ID NO: 5388 - protein, 9 aa, Artificial Sequence
  source: /note="Description of Artificial Sequence: Synthetic peptide"
RCTACHTAL

SEQ ID NO: 5389 - protein, 9 aa, Artificial Sequence
  source: /note="Description of Artificial Sequence: Synthetic peptide"
SNKLPSLPL

SEQ ID NO: 5390 - protein, 9 aa, Artificial Sequence
  source: /note="Description of Artificial Sequence: Synthetic peptide"
SKMYTTSMA

SEQ ID NO: 5391 - protein, 9 aa, Artificial Sequence
  source: /note="Description of Artificial Sequence: Synthetic peptide"
FHSSLAETV

SEQ ID NO: 5392 - protein, 9 aa, Artificial Sequence
  source: /note="Description of Artificial Sequence: Synthetic peptide"
SSLAETVSL

SEQ ID NO: 5393 - protein, 9 aa, Artificial Sequence
  source: /note="Description of Artificial Sequence: Synthetic peptide"
AETVSLHPL

SEQ ID NO: 5394 - protein, 9 aa, Artificial Sequence
  source: /note="Description of Artificial Sequence: Synthetic peptide"
LPLPQLLLS

SEQ ID NO: 5395 - protein, 10 aa, Artificial Sequence
  source: /note="Description of Artificial Sequence: Synthetic peptide"
GQWMAHMALL

SEQ ID NO: 5396 - protein, 10 aa, Artificial Sequence
  source: /note="Description of Artificial Sequence: Synthetic peptide"
AMPILPLPQL

SEQ ID NO: 5397 - protein, 10 aa, Artificial Sequence
  source: /note="Description of Artificial Sequence: Synthetic peptide"
LLLSADQQAA

SEQ ID NO: 5398 - protein, 10 aa, Artificial Sequence
  source: /note="Description of Artificial Sequence: Synthetic peptide"
WMAHMALLPS

SEQ ID NO: 5399 - protein, 10 aa, Artificial Sequence
  source: /note="Description of Artificial Sequence: Synthetic peptide"
KLPSLPLSKM

SEQ ID NO: 5400 - protein, 10 aa, Artificial Sequence
  source: /note="Description of Artificial Sequence: Synthetic peptide"
GMYSPSRYPR

SEQ ID NO: 5401 - protein, 10 aa, Artificial Sequence
  source: /note="Description of Artificial Sequence: Synthetic peptide"
HMALLPSGTK

SEQ ID NO: 5402 - protein, 10 aa, Artificial Sequence
  source: /note="Description of Artificial Sequence: Synthetic peptide"
CTACHTALGR

SEQ ID NO: 5403 - protein, 10 aa, Artificial Sequence
  source: /note="Description of Artificial Sequence: Synthetic peptide"
MYTTSMAMPI

SEQ ID NO: 5404 - protein, 10 aa, Artificial Sequence
  source: /note="Description of Artificial Sequence: Synthetic peptide"
IPMAISSPPK

SEQ ID NO: 5405 - protein, 10 aa, Artificial Sequence
  source: /note="Description of Artificial Sequence: Synthetic peptide"
RLQCINSNSR

SEQ ID NO: 5406 - protein, 10 aa, Artificial Sequence
  source: /note="Description of Artificial Sequence: Synthetic peptide"
KGRCTACHTA

SEQ ID NO: 5407 - protein, 10 aa, Artificial Sequence
  source: /note="Description of Artificial Sequence: Synthetic peptide"
ASNKLPSLPL

SEQ ID NO: 5408 - protein, 10 aa, Artificial Sequence
  source: /note="Description of Artificial Sequence: Synthetic peptide"
LSKMYTTSMA

SEQ ID NO: 5409 - protein, 10 aa, Artificial Sequence
  source: /note="Description of Artificial Sequence: Synthetic peptide"
TSMAMPILPL

SEQ ID NO: 5410 - protein, 10 aa, Artificial Sequence
  source: /note="Description of Artificial Sequence: Synthetic peptide"
RTNFHSSLAE

SEQ ID NO: 5411 - protein, 10 aa, Artificial Sequence
  source: /note="Description of Artificial Sequence: Synthetic peptide"
ITSGQWMAHM

SEQ ID NO: 5412 - protein, 10 aa, Artificial Sequence
  source: /note="Description of Artificial Sequence: Synthetic peptide"
LLAAPSPASR

SEQ ID NO: 5413 - protein, 10 aa, Artificial Sequence
  source: /note="Description of Artificial Sequence: Synthetic peptide"
LSADQQAAPR

SEQ ID NO: 5414 - protein, 10 aa, Artificial Sequence
  source: /note="Description of Artificial Sequence: Synthetic peptide"
SSNDMIPMAI

SEQ ID NO: 5415 - protein, 10 aa, Artificial Sequence
  source: /note="Description of Artificial Sequence: Synthetic peptide"
YTTSMAMPIL

SEQ ID NO: 5416 - protein, 10 aa, Artificial Sequence
  source: /note="Description of Artificial Sequence: Synthetic peptide"
TVSLHPLAPM

SEQ ID NO: 5417 - protein, 10 aa, Artificial Sequence
  source: /note="Description of Artificial Sequence: Synthetic peptide"
YPRSSSSSSS

SEQ ID NO: 5418 - protein, 10 aa, Artificial Sequence
  source: /note="Description of Artificial Sequence: Synthetic peptide"
SPPKAPLLAA

SEQ ID NO: 5419 - protein, 10 aa, Artificial Sequence
  source: /note="Description of Artificial Sequence: Synthetic peptide"
APLLAAPSPA

SEQ ID NO: 5420 - protein, 10 aa, Artificial Sequence
  source: /note="Description of Artificial Sequence: Synthetic peptide"
CPQPSPSLPA

SEQ ID NO: 5421 - protein, 10 aa, Artificial Sequence
  source: /note="Description of Artificial Sequence: Synthetic peptide"
SPSLPASNKL

SEQ ID NO: 5422 - protein, 10 aa, Artificial Sequence
  source: /note="Description of Artificial Sequence: Synthetic peptide"
LPASNKLPSL

SEQ ID NO: 5423 - protein, 10 aa, Artificial Sequence
  source: /note="Description of Artificial Sequence: Synthetic peptide"
MPILPLPQLL

SEQ ID NO: 5424 - protein, 10 aa, Artificial Sequence
  source: /note="Description of Artificial Sequence: Synthetic peptide"
APRTNFHSSL

SEQ ID NO: 5425 - protein, 10 aa, Artificial Sequence
  source: /note="Description of Artificial Sequence: Synthetic peptide"
SKMYTTSMAM

SEQ ID NO: 5426 - protein, 10 aa, Artificial Sequence
  source: /note="Description of Artificial Sequence: Synthetic peptide"
LPSLPLSKMY

SEQ ID NO: 5427 - protein, 10 aa, Artificial Sequence
  source: /note="Description of Artificial Sequence: Synthetic peptide"
SSSSSSSNDM

SEQ ID NO: 5428 - protein, 10 aa, Artificial Sequence
  source: /note="Description of Artificial Sequence: Synthetic peptide"
SSSSNDMIPM

SEQ ID NO: 5429 - protein, 10 aa, Artificial Sequence
  source: /note="Description of Artificial Sequence: Synthetic peptide"
ISSPPKAPLL

SEQ ID NO: 5430 - protein, 10 aa, Artificial Sequence
  source: /note="Description of Artificial Sequence: Synthetic peptide"
LAAPSPASRL

SEQ ID NO: 5431 - protein, 10 aa, Artificial Sequence
  source: /note="Description of Artificial Sequence: Synthetic peptide"
LQCINSNSRI

SEQ ID NO: 5432 - protein, 10 aa, Artificial Sequence
  source: /note="Description of Artificial Sequence: Synthetic peptide"
SGQWMAHMAL

SEQ ID NO: 5433 - protein, 10 aa, Artificial Sequence
  source: /note="Description of Artificial Sequence: Synthetic peptide"
GRCTACHTAL

SEQ ID NO: 5434 - protein, 10 aa, Artificial Sequence
  source: /note="Description of Artificial Sequence: Synthetic peptide"
SSCPQPSPSL

SEQ ID NO: 5435 - protein, 10 aa, Artificial Sequence
  source: /note="Description of Artificial Sequence: Synthetic peptide"
KMYTTSMAMP

SEQ ID NO: 5436 - protein, 10 aa, Artificial Sequence
  source: /note="Description of Artificial Sequence: Synthetic peptide"
DQQAAPRTNF

SEQ ID NO: 5437 - protein, 10 aa, Artificial Sequence
  source: /note="Description of Artificial Sequence: Synthetic peptide"
QQAAPRTNFH

SEQ ID NO: 5438 - protein, 10 aa, Artificial Sequence
  source: /note="Description of Artificial Sequence: Synthetic peptide"
HSSLAETVSL

SEQ ID NO: 5439 - protein, 10 aa, Artificial Sequence
  source: /note="Description of Artificial Sequence: Synthetic peptide"
LAETVSLHPL

SEQ ID NO: 5440 - protein, 10 aa, Artificial Sequence
  source: /note="Description of Artificial Sequence: Synthetic peptide"
LPLPQLLLSA

SEQ ID NO: 5441 - protein, 10 aa, Artificial Sequence
  source: /note="Description of Artificial Sequence: Synthetic peptide"
AETVSLHPLA

SEQ ID NO: 5442 - protein, 9 aa, Artificial Sequence
  source: /note="Description of Artificial Sequence: Synthetic peptide"
RQSCCLPGL

SEQ ID NO: 5443 - protein, 9 aa, Artificial Sequence
  source: /note="Description of Artificial Sequence: Synthetic peptide"
CLPGLTHPA

SEQ ID NO: 5444 - protein, 9 aa, Artificial Sequence
  source: /note="Description of Artificial Sequence: Synthetic peptide"
LSISRPTSR

SEQ ID NO: 5445 - protein, 9 aa, Artificial Sequence
  source: /note="Description of Artificial Sequence: Synthetic peptide"
ISRPTSRAR

SEQ ID NO: 5446 - protein, 9 aa, Artificial Sequence
  source: /note="Description of Artificial Sequence: Synthetic peptide"
RARQSCCLP

SEQ ID NO: 5447 - protein, 9 aa, Artificial Sequence
  source: /note="Description of Artificial Sequence: Synthetic peptide"
LTHPAHQPL

SEQ ID NO: 5448 - protein, 9 aa, Artificial Sequence
  source: /note="Description of Artificial Sequence: Synthetic peptide"
RPTSRARQS

SEQ ID NO: 5449 - protein, 9 aa, Artificial Sequence
  source: /note="Description of Artificial Sequence: Synthetic peptide"
WRIGGGTPL

SEQ ID NO: 5450 - protein, 9 aa, Artificial Sequence
  source: /note="Description of Artificial Sequence: Synthetic peptide"
LPGLTHPAH

SEQ ID NO: 5451 - protein, 10 aa, Artificial Sequence
  source: /note="Description of Artificial Sequence: Synthetic peptide"
GLTHPAHQPL

SEQ ID NO: 5452 - protein, 10 aa, Artificial Sequence
  source: /note="Description of Artificial Sequence: Synthetic peptide"
LLHWRIGGGT

SEQ ID NO: 5453 - protein, 10 aa, Artificial Sequence
  source: /note="Description of Artificial Sequence: Synthetic peptide"
SISRPTSRAR

SEQ ID NO: 5454 - protein, 10 aa, Artificial Sequence
  source: /note="Description of Artificial Sequence: Synthetic peptide"
HWRIGGGTPL

SEQ ID NO: 5455 - protein, 10 aa, Artificial Sequence
  source: /note="Description of Artificial Sequence: Synthetic peptide"
TSRARQSCCL

SEQ ID NO: 5456 - protein, 10 aa, Artificial Sequence
  source: /note="Description of Artificial Sequence: Synthetic peptide"
RARQSCCLPG

SEQ ID NO: 5457 - protein, 10 aa, Artificial Sequence
  source: /note="Description of Artificial Sequence: Synthetic peptide"
RPTSRARQSC

SEQ ID NO: 5458 - protein, 10 aa, Artificial Sequence
  source: /note="Description of Artificial Sequence: Synthetic peptide"
HPAHQPLGSM

SEQ ID NO: 5459 - protein, 10 aa, Artificial Sequence
  source: /note="Description of Artificial Sequence: Synthetic peptide"
RIGGGTPLSI

SEQ ID NO: 5460 - protein, 10 aa, Artificial Sequence
  source: /note="Description of Artificial Sequence: Synthetic peptide"
ARQSCCLPGL

SEQ ID NO: 5461 - protein, 10 aa, Artificial Sequence
  source: /note="Description of Artificial Sequence: Synthetic peptide"
RQSCCLPGLT

SEQ ID NO: 5462 - protein, 9 aa, Artificial Sequence
  source: /note="Description of Artificial Sequence: Synthetic peptide"
IALWCASSV

SEQ ID NO: 5463 - protein, 9 aa, Artificial Sequence
  source: /note="Description of Artificial Sequence: Synthetic peptide"
ALWCASSVT

SEQ ID NO: 5464 - protein, 9 aa, Artificial Sequence
  source: /note="Description of Artificial Sequence: Synthetic peptide"
WLRGTAWQL

SEQ ID NO: 5465 - protein, 9 aa, Artificial Sequence
  source: /note="Description of Artificial Sequence: Synthetic peptide"
GTAWQLVPL

SEQ ID NO: 5466 - protein, 9 aa, Artificial Sequence
  source: /note="Description of Artificial Sequence: Synthetic peptide"
ILATPPSAA

SEQ ID NO: 5467 - protein, 9 aa, Artificial Sequence
  source: /note="Description of Artificial Sequence: Synthetic peptide"
AWRSCIALW

SEQ ID NO: 5468 - protein, 9 aa, Artificial Sequence
  source: /note="Description of Artificial Sequence: Synthetic peptide"
RWLWYCWPT

SEQ ID NO: 5469 - protein, 9 aa, Artificial Sequence
  source: /note="Description of Artificial Sequence: Synthetic peptide"
WLWYCWPTW

SEQ ID NO: 5470 - protein, 9 aa, Artificial Sequence
  source: /note="Description of Artificial Sequence: Synthetic peptide"
LWYCWPTWL

SEQ ID NO: 5471 - protein, 9 aa, Artificial Sequence
  source: /note="Description of Artificial Sequence: Synthetic peptide"
RTRCAGRWL

SEQ ID NO: 5472 - protein, 9 aa, Artificial Sequence
  source: /note="Description of Artificial Sequence: Synthetic peptide"
RAVSATSWA

SEQ ID NO: 5473 - protein, 9 aa, Artificial Sequence
  source: /note="Description of Artificial Sequence: Synthetic peptide"
RCAGRWLWY

SEQ ID NO: 5474 - protein, 9 aa, Artificial Sequence
  source: /note="Description of Artificial Sequence: Synthetic peptide"
WYCWPTWLR

SEQ ID NO: 5475 - protein, 9 aa, Artificial Sequence
  source: /note="Description of Artificial Sequence: Synthetic peptide"
QLVPLQCRR

SEQ ID NO: 5476 - protein, 9 aa, Artificial Sequence
  source: /note="Description of Artificial Sequence: Synthetic peptide"
WPTWLRGTA

SEQ ID NO: 5477 - protein, 9 aa, Artificial Sequence
  source: /note="Description of Artificial Sequence: Synthetic peptide"
VPLQCRRAV

SEQ ID NO: 5478 - protein, 9 aa, Artificial Sequence
  source: /note="Description of Artificial Sequence: Synthetic peptide"
SAAWRSCIA

SEQ ID NO: 5479 - protein, 9 aa, Artificial Sequence
  source: /note="Description of Artificial Sequence: Synthetic peptide"
LATPPSAAW

SEQ ID NO: 5480 - protein, 9 aa, Artificial Sequence
  source: /note="Description of Artificial Sequence: Synthetic peptide"
AAWRSCIAL

SEQ ID NO: 5481 - protein, 9 aa, Artificial Sequence
  source: /note="Description of Artificial Sequence: Synthetic peptide"
LQCRRAVSA

SEQ ID NO: 5482 - protein, 9 aa, Artificial Sequence
  source: /note="Description of Artificial Sequence: Synthetic peptide"
RRAVSATSW

SEQ ID NO: 5483 - protein, 10 aa, Artificial Sequence
  source: /note="Description of Artificial Sequence: Synthetic peptide"
CIALWCASSV

SEQ ID NO: 5484 - protein, 10 aa, Artificial Sequence
  source: /note="Description of Artificial Sequence: Synthetic peptide"
WLWYCWPTWL

SEQ ID NO: 5485 - protein, 10 aa, Artificial Sequence
  source: /note="Description of Artificial Sequence: Synthetic peptide"
WLRGTAWQLV

SEQ ID NO: 5486 - protein, 10 aa, Artificial Sequence
  source: /note="Description of Artificial Sequence: Synthetic peptide"
CAGRWLWYCW

SEQ ID NO: 5487 - protein, 10 aa, Artificial Sequence
  source: /note="Description of Artificial Sequence: Synthetic peptide"
RWLWYCWPTW

SEQ ID NO: 5488 - protein, 10 aa, Artificial Sequence
  source: /note="Description of Artificial Sequence: Synthetic peptide"
TWLRGTAWQL

SEQ ID NO: 5489 - protein, 10 aa, Artificial Sequence
  source: /note="Description of Artificial Sequence: Synthetic peptide"
RTRCAGRWLW

SEQ ID NO: 5490 - protein, 10 aa, Artificial Sequence
  source: /note="Description of Artificial Sequence: Synthetic peptide"
LATPPSAAWR

SEQ ID NO: 5491 - protein, 10 aa, Artificial Sequence
  source: /note="Description of Artificial Sequence: Synthetic peptide"
LWCASSVTER

SEQ ID NO: 5492 - protein, 10 aa, Artificial Sequence
  source: /note="Description of Artificial Sequence: Synthetic peptide"
VTERTRCAGR

SEQ ID NO: 5493 - protein, 10 aa, Artificial Sequence
  source: /note="Description of Artificial Sequence: Synthetic peptide"
LWYCWPTWLR

SEQ ID NO: 5494 - protein, 10 aa, Artificial Sequence
  source: /note="Description of Artificial Sequence: Synthetic peptide"
SAAWRSCIAL

SEQ ID NO: 5495 - protein, 10 aa, Artificial Sequence
  source: /note="Description of Artificial Sequence: Synthetic peptide"
WPTWLRGTAW

SEQ ID NO: 5496 - protein, 10 aa, Artificial Sequence
  source: /note="Description of Artificial Sequence: Synthetic peptide"
ILATPPSAAW

SEQ ID NO: 5497 - protein, 10 aa, Artificial Sequence
  source: /note="Description of Artificial Sequence: Synthetic peptide"
AAWRSCIALW

SEQ ID NO: 5498 - protein, 10 aa, Artificial Sequence
  source: /note="Description of Artificial Sequence: Synthetic peptide"
TERTRCAGRW

SEQ ID NO: 5499 - protein, 10 aa, Artificial Sequence
  source: /note="Description of Artificial Sequence: Synthetic peptide"
RGTAWQLVPL

SEQ ID NO: 5500 - protein, 10 aa, Artificial Sequence
  source: /note="Description of Artificial Sequence: Synthetic peptide"
LQCRRAVSAT

SEQ ID NO: 5501 - protein, 10 aa, Artificial Sequence
  source: /note="Description of Artificial Sequence: Synthetic peptide"
CRRAVSATSW

SEQ ID NO: 5502 - protein, 10 aa, Artificial Sequence
  source: /note="Description of Artificial Sequence: Synthetic peptide"
RAVSATSWAS

SEQ ID NO: 5503 - protein, 9 aa, Artificial Sequence
  source: /note="Description of Artificial Sequence: Synthetic peptide"
QQRRRPGRK

SEQ ID NO: 5504 - protein, 9 aa, Artificial Sequence
  source: /note="Description of Artificial Sequence: Synthetic peptide"
AVHTLHIYL

SEQ ID NO: 5505 - protein, 9 aa, Artificial Sequence
  source: /note="Description of Artificial Sequence: Synthetic peptide"
GAVHTLHIY

SEQ ID NO: 5506 - protein, 9 aa, Artificial Sequence
  source: /note="Description of Artificial Sequence: Synthetic peptide"
WASGAVHTL

SEQ ID NO: 5507 - protein, 9 aa, Artificial Sequence
  source: /note="Description of Artificial Sequence: Synthetic peptide"
RPGWASGAV

SEQ ID NO: 5508 - protein, 9 aa, Artificial Sequence
  source: /note="Description of Artificial Sequence: Synthetic peptide"
NQRRPGWAS

SEQ ID NO: 5509 - protein, 10 aa, Artificial Sequence
  source: /note="Description of Artificial Sequence: Synthetic peptide"
AVHTLHIYLK

SEQ ID NO: 5510 - protein, 10 aa, Artificial Sequence
  source: /note="Description of Artificial Sequence: Synthetic peptide"
GWASGAVHTL

SEQ ID NO: 5511 - protein, 10 aa, Artificial Sequence
  source: /note="Description of Artificial Sequence: Synthetic peptide"
QQQRRRPGRK

SEQ ID NO: 5512 - protein, 10 aa, Artificial Sequence
  source: /note="Description of Artificial Sequence: Synthetic peptide"
SGAVHTLHIY

SEQ ID NO: 5513 - protein, 10 aa, Artificial Sequence
  source: /note="Description of Artificial Sequence: Synthetic peptide"
RQQQQRRRPG

SEQ ID NO: 5514 - protein, 9 aa, Artificial Sequence
  source: /note="Description of Artificial Sequence: Synthetic peptide"
HIKDGEKEK

SEQ ID NO: 5515 - protein, 9 aa, Artificial Sequence
  source: /note="Description of Artificial Sequence: Synthetic peptide"
KLRMKRNHL

SEQ ID NO: 5516 - protein, 9 aa, Artificial Sequence
  source: /note="Description of Artificial Sequence: Synthetic peptide"
RMKRNHLVE

SEQ ID NO: 5517 - protein, 9 aa, Artificial Sequence
  source: /note="Description of Artificial Sequence: Synthetic peptide"
LRMKRNHLV

SEQ ID NO: 5518 - protein, 9 aa, Artificial Sequence
  source: /note="Description of Artificial Sequence: Synthetic peptide"
KRNHLVEPL

SEQ ID NO: 5519 - protein, 10 aa, Artificial Sequence
  source: /note="Description of Artificial Sequence: Synthetic peptide"
KLRMKRNHLV

SEQ ID NO: 5520 - protein, 10 aa, Artificial Sequence
  source: /note="Description of Artificial Sequence: Synthetic peptide"
RMKRNHLVEP

SEQ ID NO: 5521 - protein, 10 aa, Artificial Sequence
  source: /note="Description of Artificial Sequence: Synthetic peptide"
MKRNHLVEPL

SEQ ID NO: 5522 - protein, 10 aa, Artificial Sequence
  source: /note="Description of Artificial Sequence: Synthetic peptide"
KKLRMKRNHL

SEQ ID NO: 5523 - protein, 9 aa, Artificial Sequence
  source: /note="Description of Artificial Sequence: Synthetic peptide"
RVAGRRALS

SEQ ID NO: 5524 - protein, 9 aa, Artificial Sequence
  source: /note="Description of Artificial Sequence: Synthetic peptide"
MRVAGRRAL

SEQ ID NO: 5525 - protein, 10 aa, Artificial Sequence
  source: /note="Description of Artificial Sequence: Synthetic peptide"
RVAGRRALSR

SEQ ID NO: 5526 - protein, 10 aa, Artificial Sequence
  source: /note="Description of Artificial Sequence: Synthetic peptide"
AGRRALSRGA

SEQ ID NO: 5527 - protein, 10 aa, Artificial Sequence
  source: /note="Description of Artificial Sequence: Synthetic peptide"
RRALSRGAEL

SEQ ID NO: 5528 - protein, 9 aa, Artificial Sequence
  source: /note="Description of Artificial Sequence: Synthetic peptide"
GVSCFVLFL

SEQ ID NO: 5529 - protein, 9 aa, Artificial Sequence
  source: /note="Description of Artificial Sequence: Synthetic peptide"
SGVSCFVLF

SEQ ID NO: 5530 - protein, 9 aa, Artificial Sequence
  source: /note="Description of Artificial Sequence: Synthetic peptide"
VLFLCLADY

SEQ ID NO: 5531 - protein, 9 aa, Artificial Sequence
  source: /note="Description of Artificial Sequence: Synthetic peptide"
LSGVSCFVL

SEQ ID NO: 5532 - protein, 10 aa, Artificial Sequence
  source: /note="Description of Artificial Sequence: Synthetic peptide"
VLSGVSCFVL

SEQ ID NO: 5533 - protein, 10 aa, Artificial Sequence
  source: /note="Description of Artificial Sequence: Synthetic peptide"
VLFLCLADYL

SEQ ID NO: 5534 - protein, 10 aa, Artificial Sequence
  source: /note="Description of Artificial Sequence: Synthetic peptide"
LSGVSCFVLF

SEQ ID NO: 5535 - protein, 10 aa, Artificial Sequence
  source: /note="Description of Artificial Sequence: Synthetic peptide"
FVLFLCLADY

SEQ ID NO: 5536 - protein, 10 aa, Artificial Sequence
  source: /note="Description of Artificial Sequence: Synthetic peptide"
TTNELCRLGA

SEQ ID NO: 5537 - protein, 9 aa, Artificial Sequence
  source: /note="Description of Artificial Sequence: Synthetic peptide"
KITPLNEAI

SEQ ID NO: 5538 - protein, 9 aa, Artificial Sequence
  source: /note="Description of Artificial Sequence: Synthetic peptide"
AGHGTGILK

SEQ ID NO: 5539 - protein, 9 aa, Artificial Sequence
  source: /note="Description of Artificial Sequence: Synthetic peptide"
TGILKITPL

SEQ ID NO: 5540 - protein, 9 aa, Artificial Sequence
  source: /note="Description of Artificial Sequence: Synthetic peptide"
LKITPLNEA

SEQ ID NO: 5541 - protein, 10 aa, Artificial Sequence
  source: /note="Description of Artificial Sequence: Synthetic peptide"
ILKITPLNEA

SEQ ID NO: 5542 - protein, 10 aa, Artificial Sequence
  source: /note="Description of Artificial Sequence: Synthetic peptide"
AAGHGTGILK

SEQ ID NO: 5543 - protein, 10 aa, Artificial Sequence
  source: /note="Description of Artificial Sequence: Synthetic peptide"
LKITPLNEAI

SEQ ID NO: 5544 - protein, 9 aa, Artificial Sequence
  source: /note="Description of Artificial Sequence: Synthetic peptide"
RQVLQMREK

SEQ ID NO: 5545 - protein, 9 aa, Artificial Sequence
  source: /note="Description of Artificial Sequence: Synthetic peptide"
LQMREKITT

SEQ ID NO: 5546 - protein, 10 aa, Artificial Sequence
  source: /note="Description of Artificial Sequence: Synthetic peptide"
AECHRQVLQM

SEQ ID NO: 5547 - protein, 10 aa, Artificial Sequence
  source: /note="Description of Artificial Sequence: Synthetic peptide"
RQVLQMREKI

SEQ ID NO: 5548 - protein, 10 aa, Artificial Sequence
  source: /note="Description of Artificial Sequence: Synthetic peptide"
LQMREKITTN

SEQ ID NO: 5549 - protein, 10 aa, Artificial Sequence
  source: /note="Description of Artificial Sequence: Synthetic peptide"
MREKITTNCY

SEQ ID NO: 5550 - protein, 9 aa, Artificial Sequence
  source: /note="Description of Artificial Sequence: Synthetic peptide"
WVHGVSLSA

SEQ ID NO: 5551 - protein, 9 aa, Artificial Sequence
  source: /note="Description of Artificial Sequence: Synthetic peptide"
SLSASGSRL

SEQ ID NO: 5552 - protein, 9 aa, Artificial Sequence
  source: /note="Description of Artificial Sequence: Synthetic peptide"
GGWVHGVSL

SEQ ID NO: 5553 - protein, 10 aa, Artificial Sequence
  source: /note="Description of Artificial Sequence: Synthetic peptide"
SLSASGSRLA

SEQ ID NO: 5554 - protein, 10 aa, Artificial Sequence
  source: /note="Description of Artificial Sequence: Synthetic peptide"
GVSLSASGSR

SEQ ID NO: 5555 - protein, 10 aa, Artificial Sequence
  source: /note="Description of Artificial Sequence: Synthetic peptide"
VSLSASGSRL

SEQ ID NO: 5556 - protein, 10 aa, Artificial Sequence
  source: /note="Description of Artificial Sequence: Synthetic peptide"
LSASGSRLAW

SEQ ID NO: 5557 - protein, 9 aa, Artificial Sequence
  source: /note="Description of Artificial Sequence: Synthetic peptide"
HNLKPAMTK

SEQ ID NO: 5558 - protein, 9 aa, Artificial Sequence
  source: /note="Description of Artificial Sequence: Synthetic peptide"
SNHNLKPAM

SEQ ID NO: 5559 - protein, 10 aa, Artificial Sequence
  source: /note="Description of Artificial Sequence: Synthetic peptide"
SSNHNLKPAM

SEQ ID NO: 5560 - protein, 9 aa, Artificial Sequence
  source: /note="Description of Artificial Sequence: Synthetic peptide"
SLSLQINNL

SEQ ID NO: 5561 - protein, 9 aa, Artificial Sequence
  source: /note="Description of Artificial Sequence: Synthetic peptide"
MQMFPPSPL

SEQ ID NO: 5562 - protein, 9 aa, Artificial Sequence
  source: /note="Description of Artificial Sequence: Synthetic peptide"
RLEHTFVFL

SEQ ID NO: 5563 - protein, 9 aa, Artificial Sequence
  source: /note="Description of Artificial Sequence: Synthetic peptide"
FVFLRNFSL

SEQ ID NO: 5564 - protein, 9 aa, Artificial Sequence
  source: /note="Description of Artificial Sequence: Synthetic peptide"
FLRNFSLML

SEQ ID NO: 5565 - protein, 9 aa, Artificial Sequence
  source: /note="Description of Artificial Sequence: Synthetic peptide"
LQINNLMQM

SEQ ID NO: 5566 - protein, 9 aa, Artificial Sequence
  source: /note="Description of Artificial Sequence: Synthetic peptide"
LFFFLQLLK

SEQ ID NO: 5567 - protein, 9 aa, Artificial Sequence
  source: /note="Description of Artificial Sequence: Synthetic peptide"
LMLLRYIGK

SEQ ID NO: 5568 - protein, 9 aa, Artificial Sequence
  source: /note="Description of Artificial Sequence: Synthetic peptide"
MLLRYIGKK

SEQ ID NO: 5569 - protein, 9 aa, Artificial Sequence
  source: /note="Description of Artificial Sequence: Synthetic peptide"
RNFSLMLLR

SEQ ID NO: 5570 - protein, 9 aa, Artificial Sequence
  source: /note="Description of Artificial Sequence: Synthetic peptide"
RATRFWDPR

SEQ ID NO: 5571 - protein, 9 aa, Artificial Sequence
  source: /note="Description of Artificial Sequence: Synthetic peptide"
RYLVPEQSL

SEQ ID NO: 5572 - protein, 9 aa, Artificial Sequence
  source: /note="Description of Artificial Sequence: Synthetic peptide"
QMFPPSPLF

SEQ ID NO: 5573 - protein, 9 aa, Artificial Sequence
  source: /note="Description of Artificial Sequence: Synthetic peptide"
MFPPSPLFF

SEQ ID NO: 5574 - protein, 9 aa, Artificial Sequence
  source: /note="Description of Artificial Sequence: Synthetic peptide"
RRLEHTFVF

SEQ ID NO: 5575 - protein, 9 aa, Artificial Sequence
  source: /note="Description of Artificial Sequence: Synthetic peptide"
VFLRNFSLM

SEQ ID NO: 5576 - protein, 9 aa, Artificial Sequence
  source: /note="Description of Artificial Sequence: Synthetic peptide"
HSKLGKKSR

SEQ ID NO: 5577 - protein, 9 aa, Artificial Sequence
  source: /note="Description of Artificial Sequence: Synthetic peptide"
KLGKKSRYL

SEQ ID NO: 5578 - protein, 9 aa, Artificial Sequence
  source: /note="Description of Artificial Sequence: Synthetic peptide"
LGKKSRYLV

SEQ ID NO: 5579 - protein, 9 aa, Artificial Sequence
  source: /note="Description of Artificial Sequence: Synthetic peptide"
KSRYLVPEQ

SEQ ID NO: 5580 - protein, 9 aa, Artificial Sequence
  source: /note="Description of Artificial Sequence: Synthetic peptide"
KQSSRRLEH

SEQ ID NO: 5581 - protein, 9 aa, Artificial Sequence
  source: /note="Description of Artificial Sequence: Synthetic peptide"
SSRRLEHTF

SEQ ID NO: 5582 - protein, 9 aa, Artificial Sequence
  source: /note="Description of Artificial Sequence: Synthetic peptide"
RYIGKKRRA

SEQ ID NO: 5583 - protein, 9 aa, Artificial Sequence
  source: /note="Description of Artificial Sequence: Synthetic peptide"
IGKKRRATR

SEQ ID NO: 5584 - protein, 9 aa, Artificial Sequence
  source: /note="Description of Artificial Sequence: Synthetic peptide"
ATRFWDPRR

SEQ ID NO: 5585 - protein, 9 aa, Artificial Sequence
  source: /note="Description of Artificial Sequence: Synthetic peptide"
NFSLMLLRY

SEQ ID NO: 5586 - protein, 9 aa, Artificial Sequence
  source: /note="Description of Artificial Sequence: Synthetic peptide"
LLRYIGKKR

SEQ ID NO: 5587 - protein, 9 aa, Artificial Sequence
  source: /note="Description of Artificial Sequence: Synthetic peptide"
SPLFFFLQL

SEQ ID NO: 5588 - protein, 9 aa, Artificial Sequence
  source: /note="Description of Artificial Sequence: Synthetic peptide"
LLKQSSRRL

SEQ ID NO: 5589 - protein, 9 aa, Artificial Sequence
  source: /note="Description of Artificial Sequence: Synthetic peptide"
YIGKKRRAT

SEQ ID NO: 5590 - protein, 9 aa, Artificial Sequence
  source: /note="Description of Artificial Sequence: Synthetic peptide"
QINNLMQMF

SEQ ID NO: 5591 - protein, 9 aa, Artificial Sequence
  source: /note="Description of Artificial Sequence: Synthetic peptide"
HTFVFLRNF

SEQ ID NO: 5592 - protein, 9 aa, Artificial Sequence
  source: /note="Description of Artificial Sequence: Synthetic peptide"
SKLGKKSRY

SEQ ID NO: 5593 - protein, 9 aa, Artificial Sequence
  source: /note="Description of Artificial Sequence: Synthetic peptide"
LSLQINNLM

SEQ ID NO: 5594 - protein, 9 aa, Artificial Sequence
  source: /note="Description of Artificial Sequence: Synthetic peptide"
LRNFSLMLL

SEQ ID NO: 5595 - protein, 9 aa, Artificial Sequence
  source: /note="Description of Artificial Sequence: Synthetic peptide"
GKKRRATRF

SEQ ID NO: 5596 - protein, 9 aa, Artificial Sequence
  source: /note="Description of Artificial Sequence: Synthetic peptide"
KKRRATRFW

SEQ ID NO: 5597 - protein, 9 aa, Artificial Sequence
  source: /note="Description of Artificial Sequence: Synthetic peptide"
FPPSPLFFF

SEQ ID NO: 5598 - protein, 9 aa, Artificial Sequence
  source: /note="Description of Artificial Sequence: Synthetic peptide"
PPSPLFFFL

SEQ ID NO: 5599 - protein, 10 aa, Artificial Sequence
  source: /note="Description of Artificial Sequence: Synthetic peptide"
KLGKKSRYLV

SEQ ID NO: 5600 - protein, 10 aa, Artificial Sequence
  source: /note="Description of Artificial Sequence: Synthetic peptide"
YLVPEQSLSL

SEQ ID NO: 5601 - protein, 10 aa, Artificial Sequence
  source: /note="Description of Artificial Sequence: Synthetic peptide"
LMQMFPPSPL

SEQ ID NO: 5602 - protein, 10 aa, Artificial Sequence
  source: /note="Description of Artificial Sequence: Synthetic peptide"
FVFLRNFSLM

SEQ ID NO: 5603 - protein, 10 aa, Artificial Sequence
  source: /note="Description of Artificial Sequence: Synthetic peptide"
FLRNFSLMLL

SEQ ID NO: 5604 - protein, 10 aa, Artificial Sequence
  source: /note="Description of Artificial Sequence: Synthetic peptide"
SLSLQINNLM

SEQ ID NO: 5605 - protein, 10 aa, Artificial Sequence
  source: /note="Description of Artificial Sequence: Synthetic peptide"
PLFFFLQLLK

SEQ ID NO: 5606 - protein, 10 aa, Artificial Sequence
  source: /note="Description of Artificial Sequence: Synthetic peptide"
RLEHTFVFLR

SEQ ID NO: 5607 - protein, 10 aa, Artificial Sequence
  source: /note="Description of Artificial Sequence: Synthetic peptide"
SLMLLRYIGK

SEQ ID NO: 5608 - protein, 10 aa, Artificial Sequence
  source: /note="Description of Artificial Sequence: Synthetic peptide"
LMLLRYIGKK

SEQ ID NO: 5609 - protein, 10 aa, Artificial Sequence
  source: /note="Description of Artificial Sequence: Synthetic peptide"
LQINNLMQMF

SEQ ID NO: 5610 - protein, 10 aa, Artificial Sequence
  source: /note="Description of Artificial Sequence: Synthetic peptide"
MQMFPPSPLF

SEQ ID NO: 5611 - protein, 10 aa, Artificial Sequence
  source: /note="Description of Artificial Sequence: Synthetic peptide"
QMFPPSPLFF

SEQ ID NO: 5612 - protein, 10 aa, Artificial Sequence
  source: /note="Description of Artificial Sequence: Synthetic peptide"
MFPPSPLFFF

SEQ ID NO: 5613 - protein, 10 aa, Artificial Sequence
  source: /note="Description of Artificial Sequence: Synthetic peptide"
RRLEHTFVFL

SEQ ID NO: 5614 - protein, 10 aa, Artificial Sequence
  source: /note="Description of Artificial Sequence: Synthetic peptide"
TFVFLRNFSL

SEQ ID NO: 5615 - protein, 10 aa, Artificial Sequence
  source: /note="Description of Artificial Sequence: Synthetic peptide"
VFLRNFSLML

SEQ ID NO: 5616 - protein, 10 aa, Artificial Sequence
  source: /note="Description of Artificial Sequence: Synthetic peptide"
KSRYLVPEQS

SEQ ID NO: 5617 - protein, 10 aa, Artificial Sequence
  source: /note="Description of Artificial Sequence: Synthetic peptide"
SSRRLEHTFV

SEQ ID NO: 5618 - protein, 10 aa, Artificial Sequence
  source: /note="Description of Artificial Sequence: Synthetic peptide"
HTFVFLRNFS

SEQ ID NO: 5619 - protein, 10 aa, Artificial Sequence
  source: /note="Description of Artificial Sequence: Synthetic peptide"
RATRFWDPRR

SEQ ID NO: 5620 - protein, 10 aa, Artificial Sequence
  source: /note="Description of Artificial Sequence: Synthetic peptide"
ATRFWDPRRG

SEQ ID NO: 5621 - protein, 10 aa, Artificial Sequence
  source: /note="Description of Artificial Sequence: Synthetic peptide"
HSKLGKKSRY

SEQ ID NO: 5622 - protein, 10 aa, Artificial Sequence
  source: /note="Description of Artificial Sequence: Synthetic peptide"
RNFSLMLLRY

SEQ ID NO: 5623 - protein, 10 aa, Artificial Sequence
  source: /note="Description of Artificial Sequence: Synthetic peptide"
FLQLLKQSSR

SEQ ID NO: 5624 - protein, 10 aa, Artificial Sequence
  source: /note="Description of Artificial Sequence: Synthetic peptide"
MLLRYIGKKR

SEQ ID NO: 5625 - protein, 10 aa, Artificial Sequence
  source: /note="Description of Artificial Sequence: Synthetic peptide"
LLRYIGKKRR

SEQ ID NO: 5626 - protein, 10 aa, Artificial Sequence
  source: /note="Description of Artificial Sequence: Synthetic peptide"
YIGKKRRATR

SEQ ID NO: 5627 - protein, 10 aa, Artificial Sequence
  source: /note="Description of Artificial Sequence: Synthetic peptide"
FPPSPLFFFL

SEQ ID NO: 5628 - protein, 10 aa, Artificial Sequence
  source: /note="Description of Artificial Sequence: Synthetic peptide"
SPLFFFLQLL

SEQ ID NO: 5629 - protein, 10 aa, Artificial Sequence
  source: /note="Description of Artificial Sequence: Synthetic peptide"
SRYLVPEQSL

SEQ ID NO: 5630 - protein, 10 aa, Artificial Sequence
  source: /note="Description of Artificial Sequence: Synthetic peptide"
SLQINNLMQM

SEQ ID NO: 5631 - protein, 10 aa, Artificial Sequence
  source: /note="Description of Artificial Sequence: Synthetic peptide"
LKQSSRRLEH

SEQ ID NO: 5632 - protein, 10 aa, Artificial Sequence
  source: /note="Description of Artificial Sequence: Synthetic peptide"
KQSSRRLEHT

SEQ ID NO: 5633 - protein, 10 aa, Artificial Sequence
  source: /note="Description of Artificial Sequence: Synthetic peptide"
QSSRRLEHTF

SEQ ID NO: 5634 - protein, 10 aa, Artificial Sequence
  source: /note="Description of Artificial Sequence: Synthetic peptide"
SRRLEHTFVF

SEQ ID NO: 5635 - protein, 10 aa, Artificial Sequence
  source: /note="Description of Artificial Sequence: Synthetic peptide"
VPEQSLSLQI

SEQ ID NO: 5636 - protein, 10 aa, Artificial Sequence
  source: /note="Description of Artificial Sequence: Synthetic peptide"
RPPPRLQDRL

SEQ ID NO: 5637 - protein, 9 aa, Artificial Sequence
  source: /note="Description of Artificial Sequence: Synthetic peptide"
RASASAAAL

SEQ ID NO: 5638 - protein, 9 aa, Artificial Sequence
  source: /note="Description of Artificial Sequence: Synthetic peptide"
ASASAAALA

SEQ ID NO: 5639 - protein, 9 aa, Artificial Sequence
  source: /note="Description of Artificial Sequence: Synthetic peptide"
SASAAALAV

SEQ ID NO: 5640 - protein, 9 aa, Artificial Sequence
  source: /note="Description of Artificial Sequence: Synthetic peptide"
CPRASASAA

SEQ ID NO: 5641 - protein, 9 aa, Artificial Sequence
  source: /note="Description of Artificial Sequence: Synthetic peptide"
ASAAALAVF

SEQ ID NO: 5642 - protein, 10 aa, Artificial Sequence
  source: /note="Description of Artificial Sequence: Synthetic peptide"
AAALAVFSEV

SEQ ID NO: 5643 - protein, 10 aa, Artificial Sequence
  source: /note="Description of Artificial Sequence: Synthetic peptide"
STCPRASASA

SEQ ID NO: 5644 - protein, 10 aa, Artificial Sequence
  source: /note="Description of Artificial Sequence: Synthetic peptide"
RASASAAALA

SEQ ID NO: 5645 - protein, 10 aa, Artificial Sequence
  source: /note="Description of Artificial Sequence: Synthetic peptide"
ASASAAALAV

SEQ ID NO: 5646 - protein, 10 aa, Artificial Sequence
  source: /note="Description of Artificial Sequence: Synthetic peptide"
CPRASASAAA

SEQ ID NO: 5647 - protein, 10 aa, Artificial Sequence
  source: /note="Description of Artificial Sequence: Synthetic peptide"
SASAAALAVF

SEQ ID NO: 5648 - protein, 9 aa, Artificial Sequence
  source: /note="Description of Artificial Sequence: Synthetic peptide"
MGGVGCLFF

SEQ ID NO: 5649 - protein, 9 aa, Artificial Sequence
  source: /note="Description of Artificial Sequence: Synthetic peptide"
SARAVTGMG

SEQ ID NO: 5650 - protein, 9 aa, Artificial Sequence
  source: /note="Description of Artificial Sequence: Synthetic peptide"
GMGGVGCLF

SEQ ID NO: 5651 - protein, 10 aa, Artificial Sequence
  source: /note="Description of Artificial Sequence: Synthetic peptide"
GMGGVGCLFF

SEQ ID NO: 5652 - protein, 10 aa, Artificial Sequence
  source: /note="Description of Artificial Sequence: Synthetic peptide"
SARAVTGMGG

SEQ ID NO: 5653 - protein, 10 aa, Artificial Sequence
  source: /note="Description of Artificial Sequence: Synthetic peptide"
TGMGGVGCLF

SEQ ID NO: 5654 - protein, 9 aa, Artificial Sequence
  source: /note="Description of Artificial Sequence: Synthetic peptide"
TGMGCLFFI

SEQ ID NO: 5655 - protein, 9 aa, Artificial Sequence
  source: /note="Description of Artificial Sequence: Synthetic peptide"
VTGMGCLFF

SEQ ID NO: 5656 - protein, 9 aa, Artificial Sequence
  source: /note="Description of Artificial Sequence: Synthetic peptide"
SARAVTGMG

SEQ ID NO: 5657 - protein, 9 aa, Artificial Sequence
  source: /note="Description of Artificial Sequence: Synthetic peptide"
AVTGMGCLF

SEQ ID NO: 5658 - protein, 10 aa, Artificial Sequence
  source: /note="Description of Artificial Sequence: Synthetic peptide"
GMGCLFFISW

SEQ ID NO: 5659 - protein, 10 aa, Artificial Sequence
  source: /note="Description of Artificial Sequence: Synthetic peptide"
MGCLFFISWY

SEQ ID NO: 5660 - protein, 10 aa, Artificial Sequence
  source: /note="Description of Artificial Sequence: Synthetic peptide"
RAVTGMGCLF

SEQ ID NO: 5661 - protein, 10 aa, Artificial Sequence
  source: /note="Description of Artificial Sequence: Synthetic peptide"
AVTGMGCLFF

SEQ ID NO: 5662 - protein, 9 aa, Artificial Sequence
  source: /note="Description of Artificial Sequence: Synthetic peptide"
QQAGYITGI

SEQ ID NO: 5663 - protein, 9 aa, Artificial Sequence
  source: /note="Description of Artificial Sequence: Synthetic peptide"
EVLQQAGYI

SEQ ID NO: 5664 - protein, 9 aa, Artificial Sequence
  source: /note="Description of Artificial Sequence: Synthetic peptide"
LQQAGYITG

SEQ ID NO: 5665 - protein, 10 aa, Artificial Sequence
  source: /note="Description of Artificial Sequence: Synthetic peptide"
LQQAGYITGI

SEQ ID NO: 5666 - protein, 10 aa, Artificial Sequence
  source: /note="Description of Artificial Sequence: Synthetic peptide"
QQAGYITGII

SEQ ID NO: 5667 - protein, 10 aa, Artificial Sequence
  source: /note="Description of Artificial Sequence: Synthetic peptide"
AGYITGIIGK

SEQ ID NO: 5668 - protein, 10 aa, Artificial Sequence
  source: /note="Description of Artificial Sequence: Synthetic peptide"
GYITGIIGKW

SEQ ID NO: 5669 - protein, 10 aa, Artificial Sequence
  source: /note="Description of Artificial Sequence: Synthetic peptide"
AEVLQQAGYI

SEQ ID NO: 5670 - protein, 9 aa, Artificial Sequence
  source: /note="Description of Artificial Sequence: Synthetic peptide"
LIPPLRPSK

SEQ ID NO: 5671 - protein, 9 aa, Artificial Sequence
  source: /note="Description of Artificial Sequence: Synthetic peptide"
EEEVLIPPL

SEQ ID NO: 5672 - protein, 10 aa, Artificial Sequence
  source: /note="Description of Artificial Sequence: Synthetic peptide"
VLIPPLRPSK

SEQ ID NO: 5673 - protein, 10 aa, Artificial Sequence
  source: /note="Description of Artificial Sequence: Synthetic peptide"
GEEEVLIPPL

SEQ ID NO: 5674 - protein, 9 aa, Artificial Sequence
  source: /note="Description of Artificial Sequence: Synthetic peptide"
ALNAACAGA

SEQ ID NO: 5675 - protein, 9 aa, Artificial Sequence
  source: /note="Description of Artificial Sequence: Synthetic peptide"
ETALNAACA

SEQ ID NO: 5676 - protein, 9 aa, Artificial Sequence
  source: /note="Description of Artificial Sequence: Synthetic peptide"
SQGETALNA

SEQ ID NO: 5677 - protein, 9 aa, Artificial Sequence
  source: /note="Description of Artificial Sequence: Synthetic peptide"
GETALNAAC

SEQ ID NO: 5678 - protein, 10 aa, Artificial Sequence
  source: /note="Description of Artificial Sequence: Synthetic peptide"
SQGETALNAA

SEQ ID NO: 5679 - protein, 10 aa, Artificial Sequence
  source: /note="Description of Artificial Sequence: Synthetic peptide"
GETALNAACA

SEQ ID NO: 5680 - protein, 9 aa, Artificial Sequence
  source: /note="Description of Artificial Sequence: Synthetic peptide"
YLTIGMLVL

SEQ ID NO: 5681 - protein, 9 aa, Artificial Sequence
  source: /note="Description of Artificial Sequence: Synthetic peptide"
FQNPKKLYL

SEQ ID NO: 5682 - protein, 9 aa, Artificial Sequence
  source: /note="Description of Artificial Sequence: Synthetic peptide"
KLYLTIGML

SEQ ID NO: 5683 - protein, 9 aa, Artificial Sequence
  source: /note="Description of Artificial Sequence: Synthetic peptide"
LYLTIGMLV

SEQ ID NO: 5684 - protein, 9 aa, Artificial Sequence
  source: /note="Description of Artificial Sequence: Synthetic peptide"
IFQNPKKLY

SEQ ID NO: 5685 - protein, 9 aa, Artificial Sequence
  source: /note="Description of Artificial Sequence: Synthetic peptide"
NPKKLYLTI

SEQ ID NO: 5686 - protein, 9 aa, Artificial Sequence
  source: /note="Description of Artificial Sequence: Synthetic peptide"
KKLYLTIGM

SEQ ID NO: 5687 - protein, 10 aa, Artificial Sequence
  source: /note="Description of Artificial Sequence: Synthetic peptide"
KLYLTIGMLV

SEQ ID NO: 5688 - protein, 10 aa, Artificial Sequence
  source: /note="Description of Artificial Sequence: Synthetic peptide"
YLTIGMLVLL

SEQ ID NO: 5689 - protein, 10 aa, Artificial Sequence
  source: /note="Description of Artificial Sequence: Synthetic peptide"
IFQNPKKLYL

SEQ ID NO: 5690 - protein, 10 aa, Artificial Sequence
  source: /note="Description of Artificial Sequence: Synthetic peptide"
LYLTIGMLVL

SEQ ID NO: 5691 - protein, 10 aa, Artificial Sequence
  source: /note="Description of Artificial Sequence: Synthetic peptide"
SIFQNPKKLY

SEQ ID NO: 5692 - protein, 10 aa, Artificial Sequence
  source: /note="Description of Artificial Sequence: Synthetic peptide"
KKLYLTIGML

SEQ ID NO: 5693 - protein, 9 aa, Artificial Sequence
  source: /note="Description of Artificial Sequence: Synthetic peptide"
LLQEKRFLL

SEQ ID NO: 5694 - protein, 9 aa, Artificial Sequence
  source: /note="Description of Artificial Sequence: Synthetic peptide"
FLLDYDALF

SEQ ID NO: 5695 - protein, 9 aa, Artificial Sequence
  source: /note="Description of Artificial Sequence: Synthetic peptide"
RFLLDYDAL

SEQ ID NO: 5696 - protein, 9 aa, Artificial Sequence
  source: /note="Description of Artificial Sequence: Synthetic peptide"
QEKRFLLDY

SEQ ID NO: 5697 - protein, 9 aa, Artificial Sequence
  source: /note="Description of Artificial Sequence: Synthetic peptide"
LDYDALFPV

SEQ ID NO: 5698 - protein, 10 aa, Artificial Sequence
  source: /note="Description of Artificial Sequence: Synthetic peptide"
SLLQEKRFLL

SEQ ID NO: 5699 - protein, 10 aa, Artificial Sequence
  source: /note="Description of Artificial Sequence: Synthetic peptide"
FLLDYDALFP

SEQ ID NO: 5700 - protein, 10 aa, Artificial Sequence
  source: /note="Description of Artificial Sequence: Synthetic peptide"
LLDYDALFPV

SEQ ID NO: 5701 - protein, 10 aa, Artificial Sequence
  source: /note="Description of Artificial Sequence: Synthetic peptide"
RFLLDYDALF

SEQ ID NO: 5702 - protein, 10 aa, Artificial Sequence
  source: /note="Description of Artificial Sequence: Synthetic peptide"
LQEKRFLLDY

SEQ ID NO: 5703 - protein, 10 aa, Artificial Sequence
  source: /note="Description of Artificial Sequence: Synthetic peptide"
KRFLLDYDAL

SEQ ID NO: 5704 - protein, 10 aa, Artificial Sequence
  source: /note="Description of Artificial Sequence: Synthetic peptide"
LDYDALFPVA

SEQ ID NO: 5705 - protein, 9 aa, Artificial Sequence
  source: /note="Description of Artificial Sequence: Synthetic peptide"
TVLQVTLSI

SEQ ID NO: 5706 - protein, 9 aa, Artificial Sequence
  source: /note="Description of Artificial Sequence: Synthetic peptide"
VLQVTLSIY

SEQ ID NO: 5707 - protein, 9 aa, Artificial Sequence
  source: /note="Description of Artificial Sequence: Synthetic peptide"
LQVTLSIYA

SEQ ID NO: 5708 - protein, 10 aa, Artificial Sequence
  source: /note="Description of Artificial Sequence: Synthetic peptide"
VLQVTLSIYA

SEQ ID NO: 5709 - protein, 10 aa, Artificial Sequence
  source: /note="Description of Artificial Sequence: Synthetic peptide"
ITRTVLQVTL

SEQ ID NO: 5710 - protein, 10 aa, Artificial Sequence
  source: /note="Description of Artificial Sequence: Synthetic peptide"
RTVLQVTLSI

SEQ ID NO: 5711 - protein, 10 aa, Artificial Sequence
  source: /note="Description of Artificial Sequence: Synthetic peptide"
TVLQVTLSIY

SEQ ID NO: 5712 - protein, 10 aa, Artificial Sequence
  source: /note="Description of Artificial Sequence: Synthetic peptide"
QPITRTVLQV

SEQ ID NO: 5713 - protein, 9 aa, Artificial Sequence
  source: /note="Description of Artificial Sequence: Synthetic peptide"
ATNQIISHF

SEQ ID NO: 5714 - protein, 10 aa, Artificial Sequence
  source: /note="Description of Artificial Sequence: Synthetic peptide"
TAACNATNQI

SEQ ID NO: 5715 - protein, 10 aa, Artificial Sequence
  source: /note="Description of Artificial Sequence: Synthetic peptide"
NATNQIISHF

SEQ ID NO: 5716 - protein, 9 aa, Artificial Sequence
  source: /note="Description of Artificial Sequence: Synthetic peptide"
RAGSGRAAA

SEQ ID NO: 5717 - protein, 9 aa, Artificial Sequence
  source: /note="Description of Artificial Sequence: Synthetic peptide"
STCPCRWTA

SEQ ID NO: 5718 - protein, 9 aa, Artificial Sequence
  source: /note="Description of Artificial Sequence: Synthetic peptide"
WTAPSSPPS

SEQ ID NO: 5719 - protein, 9 aa, Artificial Sequence
  source: /note="Description of Artificial Sequence: Synthetic peptide"
TPRAGSGRA

SEQ ID NO: 5720 - protein, 9 aa, Artificial Sequence
  source: /note="Description of Artificial Sequence: Synthetic peptide"
APSSPPSSA

SEQ ID NO: 5721 - protein, 9 aa, Artificial Sequence
  source: /note="Description of Artificial Sequence: Synthetic peptide"
DPSGSPCVW

SEQ ID NO: 5722 - protein, 10 aa, Artificial Sequence
  source: /note="Description of Artificial Sequence: Synthetic peptide"
RAGSGRAAAA

SEQ ID NO: 5723 - protein, 10 aa, Artificial Sequence
  source: /note="Description of Artificial Sequence: Synthetic peptide"
RWTAPSSPPS

SEQ ID NO: 5724 - protein, 10 aa, Artificial Sequence
  source: /note="Description of Artificial Sequence: Synthetic peptide"
SGSPCVWTPR

SEQ ID NO: 5725 - protein, 10 aa, Artificial Sequence
  source: /note="Description of Artificial Sequence: Synthetic peptide"
TPRAGSGRAA

SEQ ID NO: 5726 - protein, 9 aa, Artificial Sequence
  source: /note="Description of Artificial Sequence: Synthetic peptide"
ELALQGPGV

SEQ ID NO: 5727 - protein, 9 aa, Artificial Sequence
  source: /note="Description of Artificial Sequence: Synthetic peptide"
GELALQGPG

SEQ ID NO: 5728 - protein, 10 aa, Artificial Sequence
  source: /note="Description of Artificial Sequence: Synthetic peptide"
QPGGGRGGEL

SEQ ID NO: 5729 - protein, 10 aa, Artificial Sequence
  source: /note="Description of Artificial Sequence: Synthetic peptide"
GELALQGPGV

SEQ ID NO: 5730 - protein, 9 aa, Artificial Sequence
  source: /note="Description of Artificial Sequence: Synthetic peptide"
SATVTAFWR

SEQ ID NO: 5731 - protein, 9 aa, Artificial Sequence
  source: /note="Description of Artificial Sequence: Synthetic peptide"
TAFWRSLLA

SEQ ID NO: 5732 - protein, 9 aa, Artificial Sequence
  source: /note="Description of Artificial Sequence: Synthetic peptide"
RSLLACCQL

SEQ ID NO: 5733 - protein, 9 aa, Artificial Sequence
  source: /note="Description of Artificial Sequence: Synthetic peptide"
TVTAFWRSL

SEQ ID NO: 5734 - protein, 9 aa, Artificial Sequence
  source: /note="Description of Artificial Sequence: Synthetic peptide"
VTAFWRSLL

SEQ ID NO: 5735 - protein, 10 aa, Artificial Sequence
  source: /note="Description of Artificial Sequence: Synthetic peptide"
GSATVTAFWR

SEQ ID NO: 5736 - protein, 10 aa, Artificial Sequence
  source: /note="Description of Artificial Sequence: Synthetic peptide"
ATVTAFWRSL

SEQ ID NO: 5737 - protein, 10 aa, Artificial Sequence
  source: /note="Description of Artificial Sequence: Synthetic peptide"
TVTAFWRSLL

SEQ ID NO: 5738 - protein, 10 aa, Artificial Sequence
  source: /note="Description of Artificial Sequence: Synthetic peptide"
VTAFWRSLLA

SEQ ID NO: 5739 - protein, 10 aa, Artificial Sequence
  source: /note="Description of Artificial Sequence: Synthetic peptide"
WRSLLACCQL

SEQ ID NO: 5740 - protein, 9 aa, Artificial Sequence
  source: /note="Description of Artificial Sequence: Synthetic peptide"
ATCLPLFVR

SEQ ID NO: 5741 - protein, 9 aa, Artificial Sequence
  source: /note="Description of Artificial Sequence: Synthetic peptide"
HGATCLPLF

SEQ ID NO: 5742 - protein, 9 aa, Artificial Sequence
  source: /note="Description of Artificial Sequence: Synthetic peptide"
FVRRSTTYS

SEQ ID NO: 5743 - protein, 9 aa, Artificial Sequence
  source: /note="Description of Artificial Sequence: Synthetic peptide"
LFVRRSTTY

SEQ ID NO: 5744 - protein, 9 aa, Artificial Sequence
  source: /note="Description of Artificial Sequence: Synthetic peptide"
TCLPLFVRR

SEQ ID NO: 5745 - protein, 9 aa, Artificial Sequence
  source: /note="Description of Artificial Sequence: Synthetic peptide"
LPLFVRRST

SEQ ID NO: 5746 - protein, 10 aa, Artificial Sequence
  source: /note="Description of Artificial Sequence: Synthetic peptide"
ATCLPLFVRR

SEQ ID NO: 5747 - protein, 10 aa, Artificial Sequence
  source: /note="Description of Artificial Sequence: Synthetic peptide"
LPLFVRRSTT

SEQ ID NO: 5748 - protein, 10 aa, Artificial Sequence
  source: /note="Description of Artificial Sequence: Synthetic peptide"
PLFVRRSTTY

SEQ ID NO: 5749 - protein, 10 aa, Artificial Sequence
  source: /note="Description of Artificial Sequence: Synthetic peptide"
CHGATCLPLF

SEQ ID NO: 5750 - protein, 9 aa, Artificial Sequence
  source: /note="Description of Artificial Sequence: Synthetic peptide"
DVSAIHELY

SEQ ID NO: 5751 - protein, 9 aa, Artificial Sequence
  source: /note="Description of Artificial Sequence: Synthetic peptide"
SHFFHLICF

SEQ ID NO: 5752 - protein, 9 aa, Artificial Sequence
  source: /note="Description of Artificial Sequence: Synthetic peptide"
CFQCVHLDV

SEQ ID NO: 5753 - protein, 9 aa, Artificial Sequence
  source: /note="Description of Artificial Sequence: Synthetic peptide"
RSHFFHLIC

SEQ ID NO: 5754 - protein, 9 aa, Artificial Sequence
  source: /note="Description of Artificial Sequence: Synthetic peptide"
EPRSHFFHL

SEQ ID NO: 5755 - protein, 9 aa, Artificial Sequence
  source: /note="Description of Artificial Sequence: Synthetic peptide"
HLICFQCVH

SEQ ID NO: 5756 - protein, 9 aa, Artificial Sequence
  source: /note="Description of Artificial Sequence: Synthetic peptide"
LDVSAIHEL

SEQ ID NO: 5757 - protein, 10 aa, Artificial Sequence
  source: /note="Description of Artificial Sequence: Synthetic peptide"
HLICFQCVHL

SEQ ID NO: 5758 - protein, 10 aa, Artificial Sequence
  source: /note="Description of Artificial Sequence: Synthetic peptide"
HLDVSAIHEL

SEQ ID NO: 5759 - protein, 10 aa, Artificial Sequence
  source: /note="Description of Artificial Sequence: Synthetic peptide"
AIHELYIAQI

SEQ ID NO: 5760 - protein, 10 aa, Artificial Sequence
  source: /note="Description of Artificial Sequence: Synthetic peptide"
RSHFFHLICF

SEQ ID NO: 5761 - protein, 10 aa, Artificial Sequence
  source: /note="Description of Artificial Sequence: Synthetic peptide"
DVSAIHELYI

SEQ ID NO: 5762 - protein, 10 aa, Artificial Sequence
  source: /note="Description of Artificial Sequence: Synthetic peptide"
EPRSHFFHLI

SEQ ID NO: 5763 - protein, 10 aa, Artificial Sequence
  source: /note="Description of Artificial Sequence: Synthetic peptide"
REPRSHFFHL

SEQ ID NO: 5764 - protein, 10 aa, Artificial Sequence
  source: /note="Description of Artificial Sequence: Synthetic peptide"
FQCVHLDVSA

SEQ ID NO: 5765 - protein, 10 aa, Artificial Sequence
  source: /note="Description of Artificial Sequence: Synthetic peptide"
LDVSAIHELY

SEQ ID NO: 5766 - protein, 9 aa, Artificial Sequence
  source: /note="Description of Artificial Sequence: Synthetic peptide"
LIALLLLLV

SEQ ID NO: 5767 - protein, 9 aa, Artificial Sequence
  source: /note="Description of Artificial Sequence: Synthetic peptide"
ALLLLLVFT

SEQ ID NO: 5768 - protein, 9 aa, Artificial Sequence
  source: /note="Description of Artificial Sequence: Synthetic peptide"
IALLLLLVF

SEQ ID NO: 5769 - protein, 10 aa, Artificial Sequence
  source: /note="Description of Artificial Sequence: Synthetic peptide"
GLIALLLLLV

SEQ ID NO: 5770 - protein, 10 aa, Artificial Sequence
  source: /note="Description of Artificial Sequence: Synthetic peptide"
ALLLLLVFTV

SEQ ID NO: 5771 - protein, 10 aa, Artificial Sequence
  source: /note="Description of Artificial Sequence: Synthetic peptide"
LIALLLLLVF

SEQ ID NO: 5772 - protein, 9 aa, Artificial Sequence
  source: /note="Description of Artificial Sequence: Synthetic peptide"
RVRRQNLLL

SEQ ID NO: 5773 - protein, 9 aa, Artificial Sequence
  source: /note="Description of Artificial Sequence: Synthetic peptide"
LLVVPPSQF

SEQ ID NO: 5774 - protein, 9 aa, Artificial Sequence
  source: /note="Description of Artificial Sequence: Synthetic peptide"
RRQNLLLVV

SEQ ID NO: 5775 - protein, 9 aa, Artificial Sequence
  source: /note="Description of Artificial Sequence: Synthetic peptide"
RQNLLLVVP

SEQ ID NO: 5776 - protein, 10 aa, Artificial Sequence
  source: /note="Description of Artificial Sequence: Synthetic peptide"
RVRRQNLLLV

SEQ ID NO: 5777 - protein, 10 aa, Artificial Sequence
  source: /note="Description of Artificial Sequence: Synthetic peptide"
LLLVVPPSQF

SEQ ID NO: 5778 - protein, 10 aa, Artificial Sequence
  source: /note="Description of Artificial Sequence: Synthetic peptide"
LVVPPSQFNF

SEQ ID NO: 5779 - protein, 10 aa, Artificial Sequence
  source: /note="Description of Artificial Sequence: Synthetic peptide"
RQNLLLVVPP

SEQ ID NO: 5780 - protein, 9 aa, Artificial Sequence
  source: /note="Description of Artificial Sequence: Synthetic peptide"
EMSFHLLNY

SEQ ID NO: 5781 - protein, 9 aa, Artificial Sequence
  source: /note="Description of Artificial Sequence: Synthetic peptide"
YLHHWNYLS

SEQ ID NO: 5782 - protein, 9 aa, Artificial Sequence
  source: /note="Description of Artificial Sequence: Synthetic peptide"
IIREMSFHL

SEQ ID NO: 5783 - protein, 9 aa, Artificial Sequence
  source: /note="Description of Artificial Sequence: Synthetic peptide"
YLSFLKGQI

SEQ ID NO: 5784 - protein, 9 aa, Artificial Sequence
  source: /note="Description of Artificial Sequence: Synthetic peptide"
LLNYRTSNI

SEQ ID NO: 5785 - protein, 9 aa, Artificial Sequence
  source: /note="Description of Artificial Sequence: Synthetic peptide"
HISKGVHRV

SEQ ID NO: 5786 - protein, 9 aa, Artificial Sequence
  source: /note="Description of Artificial Sequence: Synthetic peptide"
MSFHLLNYR

SEQ ID NO: 5787 - protein, 9 aa, Artificial Sequence
  source: /note="Description of Artificial Sequence: Synthetic peptide"
ALEIKHISK

SEQ ID NO: 5788 - protein, 9 aa, Artificial Sequence
  source: /note="Description of Artificial Sequence: Synthetic peptide"
HWNYLSFLK

SEQ ID NO: 5789 - protein, 9 aa, Artificial Sequence
  source: /note="Description of Artificial Sequence: Synthetic peptide"
QWIRLHFQK

SEQ ID NO: 5790 - protein, 9 aa, Artificial Sequence
  source: /note="Description of Artificial Sequence: Synthetic peptide"
CYLHHWNYL

SEQ ID NO: 5791 - protein, 9 aa, Artificial Sequence
  source: /note="Description of Artificial Sequence: Synthetic peptide"
LHHWNYLSF

SEQ ID NO: 5792 - protein, 9 aa, Artificial Sequence
  source: /note="Description of Artificial Sequence: Synthetic peptide"
SHQWIRLHF

SEQ ID NO: 5793 - protein, 9 aa, Artificial Sequence
  source: /note="Description of Artificial Sequence: Synthetic peptide"
WIRLHFQKA

SEQ ID NO: 5794 - protein, 9 aa, Artificial Sequence
  source: /note="Description of Artificial Sequence: Synthetic peptide"
KCYLHHWNY

SEQ ID NO: 5795 - protein, 9 aa, Artificial Sequence
  source: /note="Description of Artificial Sequence: Synthetic peptide"
RTSNISHQW

SEQ ID NO: 5796 - protein, 9 aa, Artificial Sequence
  source: /note="Description of Artificial Sequence: Synthetic peptide"
SFLKGQIIR

SEQ ID NO: 5797 - protein, 9 aa, Artificial Sequence
  source: /note="Description of Artificial Sequence: Synthetic peptide"
SNISHQWIR

SEQ ID NO: 5798 - protein, 9 aa, Artificial Sequence
  source: /note="Description of Artificial Sequence: Synthetic peptide"
EIKHISKGV

SEQ ID NO: 5799 - protein, 9 aa, Artificial Sequence
  source: /note="Description of Artificial Sequence: Synthetic peptide"
GQIIREMSF

SEQ ID NO: 5800 - protein, 9 aa, Artificial Sequence
  source: /note="Description of Artificial Sequence: Synthetic peptide"
LQRTEKKCY

SEQ ID NO: 5801 - protein, 9 aa, Artificial Sequence
  source: /note="Description of Artificial Sequence: Synthetic peptide"
HHWNYLSFL

SEQ ID NO: 5802 - protein, 9 aa, Artificial Sequence
  source: /note="Description of Artificial Sequence: Synthetic peptide"
LSFLKGQII

SEQ ID NO: 5803 - protein, 9 aa, Artificial Sequence
  source: /note="Description of Artificial Sequence: Synthetic peptide"
LKGQIIREM

SEQ ID NO: 5804 - protein, 9 aa, Artificial Sequence
  source: /note="Description of Artificial Sequence: Synthetic peptide"
REMSFHLLN

SEQ ID NO: 5805 - protein, 9 aa, Artificial Sequence
  source: /note="Description of Artificial Sequence: Synthetic peptide"
IRLHFQKAL

SEQ ID NO: 5806 - protein, 9 aa, Artificial Sequence
  source: /note="Description of Artificial Sequence: Synthetic peptide"
LHFQKALEI

SEQ ID NO: 5807 - protein, 9 aa, Artificial Sequence
  source: /note="Description of Artificial Sequence: Synthetic peptide"
FQKALEIKH

SEQ ID NO: 5808 - protein, 10 aa, Artificial Sequence
  source: /note="Description of Artificial Sequence: Synthetic peptide"
YLHHWNYLSF

SEQ ID NO: 5809 - protein, 10 aa, Artificial Sequence
  source: /note="Description of Artificial Sequence: Synthetic peptide"
HLLNYRTSNI

SEQ ID NO: 5810 - protein, 10 aa, Artificial Sequence
  source: /note="Description of Artificial Sequence: Synthetic peptide"
YLSFLKGQII

SEQ ID NO: 5811 - protein, 10 aa, Artificial Sequence
  source: /note="Description of Artificial Sequence: Synthetic peptide"
FLKGQIIREM

SEQ ID NO: 5812 - protein, 10 aa, Artificial Sequence
  source: /note="Description of Artificial Sequence: Synthetic peptide"
QIIREMSFHL

SEQ ID NO: 5813 - protein, 10 aa, Artificial Sequence
  source: /note="Description of Artificial Sequence: Synthetic peptide"
IIREMSFHLL

SEQ ID NO: 5814 - protein, 10 aa, Artificial Sequence
  source: /note="Description of Artificial Sequence: Synthetic peptide"
RLHFQKALEI

SEQ ID NO: 5815 - protein, 10 aa, Artificial Sequence
  source: /note="Description of Artificial Sequence: Synthetic peptide"
HQWIRLHFQK

SEQ ID NO: 5816 - protein, 10 aa, Artificial Sequence
  source: /note="Description of Artificial Sequence: Synthetic peptide"
KALEIKHISK

SEQ ID NO: 5817 - protein, 10 aa, Artificial Sequence
  source: /note="Description of Artificial Sequence: Synthetic peptide"
HHWNYLSFLK

SEQ ID NO: 5818 - protein, 10 aa, Artificial Sequence
  source: /note="Description of Artificial Sequence: Synthetic peptide"
LSFLKGQIIR

SEQ ID NO: 5819 - protein, 10 aa, Artificial Sequence
  source: /note="Description of Artificial Sequence: Synthetic peptide"
CYLHHWNYLS

SEQ ID NO: 5820 - protein, 10 aa, Artificial Sequence
  source: /note="Description of Artificial Sequence: Synthetic peptide"
NYLSFLKGQI

SEQ ID NO: 5821 - protein, 10 aa, Artificial Sequence
  source: /note="Description of Artificial Sequence: Synthetic peptide"
ISHQWIRLHF

SEQ ID NO: 5822 - protein, 10 aa, Artificial Sequence
  source: /note="Description of Artificial Sequence: Synthetic peptide"
KCYLHHWNYL

SEQ ID NO: 5823 - protein, 10 aa, Artificial Sequence
  source: /note="Description of Artificial Sequence: Synthetic peptide"
RTSNISHQWI

SEQ ID NO: 5824 - protein, 10 aa, Artificial Sequence
  source: /note="Description of Artificial Sequence: Synthetic peptide"
KKCYLHHWNY

SEQ ID NO: 5825 - protein, 10 aa, Artificial Sequence
  source: /note="Description of Artificial Sequence: Synthetic peptide"
REMSFHLLNY

SEQ ID NO: 5826 - protein, 10 aa, Artificial Sequence
  source: /note="Description of Artificial Sequence: Synthetic peptide"
EMSFHLLNYR

SEQ ID NO: 5827 - protein, 10 aa, Artificial Sequence
  source: /note="Description of Artificial Sequence: Synthetic peptide"
TSNISHQWIR

SEQ ID NO: 5828 - protein, 10 aa, Artificial Sequence
  source: /note="Description of Artificial Sequence: Synthetic peptide"
MSFHLLNYRT

SEQ ID NO: 5829 - protein, 10 aa, Artificial Sequence
  source: /note="Description of Artificial Sequence: Synthetic peptide"
WIRLHFQKAL

SEQ ID NO: 5830 - protein, 10 aa, Artificial Sequence
  source: /note="Description of Artificial Sequence: Synthetic peptide"
LQRTEKKCYL

SEQ ID NO: 5831 - protein, 10 aa, Artificial Sequence
  source: /note="Description of Artificial Sequence: Synthetic peptide"
LHHWNYLSFL

SEQ ID NO: 5832 - protein, 10 aa, Artificial Sequence
  source: /note="Description of Artificial Sequence: Synthetic peptide"
KGQIIREMSF

SEQ ID NO: 5833 - protein, 10 aa, Artificial Sequence
  source: /note="Description of Artificial Sequence: Synthetic peptide"
LNYRTSNISH

SEQ ID NO: 5834 - protein, 10 aa, Artificial Sequence
  source: /note="Description of Artificial Sequence: Synthetic peptide"
YRTSNISHQW

SEQ ID NO: 5835 - protein, 10 aa, Artificial Sequence
  source: /note="Description of Artificial Sequence: Synthetic peptide"
FQKALEIKHI

SEQ ID NO: 5836 - protein, 10 aa, Artificial Sequence
  source: /note="Description of Artificial Sequence: Synthetic peptide"
LEIKHISKGV

SEQ ID NO: 5837 - protein, 10 aa, Artificial Sequence
  source: /note="Description of Artificial Sequence: Synthetic peptide"
KHISKGVHRV

SEQ ID NO: 5838 - protein, 10 aa, Artificial Sequence
  source: /note="Description of Artificial Sequence: Synthetic peptide"
TEKKCYLHHW

SEQ ID NO: 5839 - protein, 9 aa, Artificial Sequence
  source: /note="Description of Artificial Sequence: Synthetic peptide"
AINRSIQCK

SEQ ID NO: 5840 - protein, 9 aa, Artificial Sequence
  source: /note="Description of Artificial Sequence: Synthetic peptide"
RSIQCKVIV

SEQ ID NO: 5841 - protein, 10 aa, Artificial Sequence
  source: /note="Description of Artificial Sequence: Synthetic peptide"
AINRSIQCKV

SEQ ID NO: 5842 - protein, 10 aa, Artificial Sequence
  source: /note="Description of Artificial Sequence: Synthetic peptide"
AAINRSIQCK

SEQ ID NO: 5843 - protein, 10 aa, Artificial Sequence
  source: /note="Description of Artificial Sequence: Synthetic peptide"
YIGESENSEI

SEQ ID NO: 5844 - protein, 9 aa, Artificial Sequence
  source: /note="Description of Artificial Sequence: Synthetic peptide"
KIAFGFFLR

SEQ ID NO: 5845 - protein, 9 aa, Artificial Sequence
  source: /note="Description of Artificial Sequence: Synthetic peptide"
AFGFFLRLL

SEQ ID NO: 5846 - protein, 9 aa, Artificial Sequence
  source: /note="Description of Artificial Sequence: Synthetic peptide"
SPNKIAFGF

SEQ ID NO: 5847 - protein, 9 aa, Artificial Sequence
  source: /note="Description of Artificial Sequence: Synthetic peptide"
KKSPNKIAF

SEQ ID NO: 5848 - protein, 9 aa, Artificial Sequence
  source: /note="Description of Artificial Sequence: Synthetic peptide"
NKIAFGFFL

SEQ ID NO: 5849 - protein, 9 aa, Artificial Sequence
  source: /note="Description of Artificial Sequence: Synthetic peptide"
IAFGFFLRL

SEQ ID NO: 5850 - protein, 10 aa, Artificial Sequence
  source: /note="Description of Artificial Sequence: Synthetic peptide"
KIAFGFFLRL

SEQ ID NO: 5851 - protein, 10 aa, Artificial Sequence
  source: /note="Description of Artificial Sequence: Synthetic peptide"
KSPNKIAFGF

SEQ ID NO: 5852 - protein, 10 aa, Artificial Sequence
  source: /note="Description of Artificial Sequence: Synthetic peptide"
NKIAFGFFLR

SEQ ID NO: 5853 - protein, 10 aa, Artificial Sequence
  source: /note="Description of Artificial Sequence: Synthetic peptide"
SPNKIAFGFF

SEQ ID NO: 5854 - protein, 10 aa, Artificial Sequence
  source: /note="Description of Artificial Sequence: Synthetic peptide"
TKKSPNKIAF

SEQ ID NO: 5855 - protein, 10 aa, Artificial Sequence
  source: /note="Description of Artificial Sequence: Synthetic peptide"
IAFGFFLRLL

SEQ ID NO: 5856 - protein, 9 aa, Artificial Sequence
  source: /note="Description of Artificial Sequence: Synthetic peptide"
YLVCFITPV

SEQ ID NO: 5857 - protein, 9 aa, Artificial Sequence
  source: /note="Description of Artificial Sequence: Synthetic peptide"
LVCFITPVV

SEQ ID NO: 5858 - protein, 9 aa, Artificial Sequence
  source: /note="Description of Artificial Sequence: Synthetic peptide"
FITPVVALL

SEQ ID NO: 5859 - protein, 9 aa, Artificial Sequence
  source: /note="Description of Artificial Sequence: Synthetic peptide"
CFITPVVAL

SEQ ID NO: 5860 - protein, 10 aa, Artificial Sequence
  source: /note="Description of Artificial Sequence: Synthetic peptide"
YLVCFITPVV

SEQ ID NO: 5861 - protein, 10 aa, Artificial Sequence
  source: /note="Description of Artificial Sequence: Synthetic peptide"
FYLVCFITPV

SEQ ID NO: 5862 - protein, 10 aa, Artificial Sequence
  source: /note="Description of Artificial Sequence: Synthetic peptide"
CFITPVVALL

SEQ ID NO: 5863 - protein, 10 aa, Artificial Sequence
  source: /note="Description of Artificial Sequence: Synthetic peptide"
ITPVVALLPR

SEQ ID NO: 5864 - protein, 10 aa, Artificial Sequence
  source: /note="Description of Artificial Sequence: Synthetic peptide"
NPTFYLVCFI

SEQ ID NO: 5865 - protein, 9 aa, Artificial Sequence
  source: /note="Description of Artificial Sequence: Synthetic peptide"
SGPRYKHSK

SEQ ID NO: 5866 - protein, 9 aa, Artificial Sequence
  source: /note="Description of Artificial Sequence: Synthetic peptide"
RYKHSKLER

SEQ ID NO: 5867 - protein, 9 aa, Artificial Sequence
  source: /note="Description of Artificial Sequence: Synthetic peptide"
GPRYKHSKL

SEQ ID NO: 5868 - protein, 10 aa, Artificial Sequence
  source: /note="Description of Artificial Sequence: Synthetic peptide"
NSGPRYKHSK

SEQ ID NO: 5869 - protein, 9 aa, Artificial Sequence
  source: /note="Description of Artificial Sequence: Synthetic peptide"
IMNRKPCHK

SEQ ID NO: 5870 - protein, 10 aa, Artificial Sequence
  source: /note="Description of Artificial Sequence: Synthetic peptide"
MNRKPCHKNK

SEQ ID NO: 5871 - protein, 10 aa, Artificial Sequence
  source: /note="Description of Artificial Sequence: Synthetic peptide"
DIMNRKPCHK

SEQ ID NO: 5872 - protein, 9 aa, Artificial Sequence
  source: /note="Description of Artificial Sequence: Synthetic peptide"
CVNDAPALK

SEQ ID NO: 5873 - protein, 9 aa, Artificial Sequence
  source: /note="Description of Artificial Sequence: Synthetic peptide"
ITAMTGDCV

SEQ ID NO: 5874 - protein, 10 aa, Artificial Sequence
  source: /note="Description of Artificial Sequence: Synthetic peptide"
AMTGDCVNDA

SEQ ID NO: 5875 - protein, 10 aa, Artificial Sequence
  source: /note="Description of Artificial Sequence: Synthetic peptide"
CVNDAPALKK

SEQ ID NO: 5876 - protein, 10 aa, Artificial Sequence
  source: /note="Description of Artificial Sequence: Synthetic peptide"
EITAMTGDCV

SEQ ID NO: 5877 - protein, 9 aa, Artificial Sequence
  source: /note="Description of Artificial Sequence: Synthetic peptide"
HQWLALLPL

SEQ ID NO: 5878 - protein, 9 aa, Artificial Sequence
  source: /note="Description of Artificial Sequence: Synthetic peptide"
GSSCLVVPV

SEQ ID NO: 5879 - protein, 9 aa, Artificial Sequence
  source: /note="Description of Artificial Sequence: Synthetic peptide"
RGLCGCSHR

SEQ ID NO: 5880 - protein, 9 aa, Artificial Sequence
  source: /note="Description of Artificial Sequence: Synthetic peptide"
ALLPLHGNR

SEQ ID NO: 5881 - protein, 9 aa, Artificial Sequence
  source: /note="Description of Artificial Sequence: Synthetic peptide"
SSCLVVPVR

SEQ ID NO: 5882 - protein, 9 aa, Artificial Sequence
  source: /note="Description of Artificial Sequence: Synthetic peptide"
APHQWLALL

SEQ ID NO: 5883 - protein, 9 aa, Artificial Sequence
  source: /note="Description of Artificial Sequence: Synthetic peptide"
LPLHGNRGL

SEQ ID NO: 5884 - protein, 9 aa, Artificial Sequence
  source: /note="Description of Artificial Sequence: Synthetic peptide"
CSHRGSSCL

SEQ ID NO: 5885 - protein, 9 aa, Artificial Sequence
  source: /note="Description of Artificial Sequence: Synthetic peptide"
EPQGAPHQW

SEQ ID NO: 5886 - protein, 10 aa, Artificial Sequence
  source: /note="Description of Artificial Sequence: Synthetic peptide"
LLPLHGNRGL

SEQ ID NO: 5887 - protein, 10 aa, Artificial Sequence
  source: /note="Description of Artificial Sequence: Synthetic peptide"
GSSCLVVPVR

SEQ ID NO: 5888 - protein, 10 aa, Artificial Sequence
  source: /note="Description of Artificial Sequence: Synthetic peptide"
CSHRGSSCLV

SEQ ID NO: 5889 - protein, 10 aa, Artificial Sequence
  source: /note="Description of Artificial Sequence: Synthetic peptide"
LALLPLHGNR

SEQ ID NO: 5890 - protein, 10 aa, Artificial Sequence
  source: /note="Description of Artificial Sequence: Synthetic peptide"
HQWLALLPLH

SEQ ID NO: 5891 - protein, 10 aa, Artificial Sequence
  source: /note="Description of Artificial Sequence: Synthetic peptide"
SHRGSSCLVV

SEQ ID NO: 5892 - protein, 10 aa, Artificial Sequence
  source: /note="Description of Artificial Sequence: Synthetic peptide"
RGSSCLVVPV

SEQ ID NO: 5893 - protein, 9 aa, Artificial Sequence
  source: /note="Description of Artificial Sequence: Synthetic peptide"
KQFRGLQCH

SEQ ID NO: 5894 - protein, 9 aa, Artificial Sequence
  source: /note="Description of Artificial Sequence: Synthetic peptide"
CHIEQEQKF

SEQ ID NO: 5895 - protein, 10 aa, Artificial Sequence
  source: /note="Description of Artificial Sequence: Synthetic peptide"
KQFRGLQCHI

SEQ ID NO: 5896 - protein, 9 aa, Artificial Sequence
  source: /note="Description of Artificial Sequence: Synthetic peptide"
IMSAIKEGK

SEQ ID NO: 5897 - protein, 9 aa, Artificial Sequence
  source: /note="Description of Artificial Sequence: Synthetic peptide"
AIKEGKGIY

SEQ ID NO: 5898 - protein, 10 aa, Artificial Sequence
  source: /note="Description of Artificial Sequence: Synthetic peptide"
TIMSAIKEGK

SEQ ID NO: 5899 - protein, 10 aa, Artificial Sequence
  source: /note="Description of Artificial Sequence: Synthetic peptide"
SAIKEGKGIY

SEQ ID NO: 5900 - protein, 10 aa, Artificial Sequence
  source: /note="Description of Artificial Sequence: Synthetic peptide"
DFQTIMSAIK

SEQ ID NO: 5901 - protein, 10 aa, Artificial Sequence
  source: /note="Description of Artificial Sequence: Synthetic peptide"
KEGKGIYNNI

SEQ ID NO: 5902 - protein, 9 aa, Artificial Sequence
  source: /note="Description of Artificial Sequence: Synthetic peptide"
SLFSQETPV

SEQ ID NO: 5903 - protein, 9 aa, Artificial Sequence
  source: /note="Description of Artificial Sequence: Synthetic peptide"
FSQETPVVL

SEQ ID NO: 5904 - protein, 9 aa, Artificial Sequence
  source: /note="Description of Artificial Sequence: Synthetic peptide"
QETPVVLQL

SEQ ID NO: 5905 - protein, 10 aa, Artificial Sequence
  source: /note="Description of Artificial Sequence: Synthetic peptide"
SLFSQETPVV

SEQ ID NO: 5906 - protein, 10 aa, Artificial Sequence
  source: /note="Description of Artificial Sequence: Synthetic peptide"
HSLFSQETPV

SEQ ID NO: 5907 - protein, 10 aa, Artificial Sequence
  source: /note="Description of Artificial Sequence: Synthetic peptide"
LFSQETPVVL

SEQ ID NO: 5908 - protein, 10 aa, Artificial Sequence
  source: /note="Description of Artificial Sequence: Synthetic peptide"
SQETPVVLQL

SEQ ID NO: 5909 - protein, 10 aa, Artificial Sequence
  source: /note="Description of Artificial Sequence: Synthetic peptide"
QETPVVLQLA

SEQ ID NO: 5910 - protein, 9 aa, Artificial Sequence
  source: /note="Description of Artificial Sequence: Synthetic peptide"
SFERLLWQI

SEQ ID NO: 5911 - protein, 9 aa, Artificial Sequence
  source: /note="Description of Artificial Sequence: Synthetic peptide"
WQICRGNVY

SEQ ID NO: 5912 - protein, 9 aa, Artificial Sequence
  source: /note="Description of Artificial Sequence: Synthetic peptide"
FERLLWQIC

SEQ ID NO: 5913 - protein, 10 aa, Artificial Sequence
  source: /note="Description of Artificial Sequence: Synthetic peptide"
LLWQICRGNV

SEQ ID NO: 5914 - protein, 10 aa, Artificial Sequence
  source: /note="Description of Artificial Sequence: Synthetic peptide"
WQICRGNVYL

SEQ ID NO: 5915 - protein, 10 aa, Artificial Sequence
  source: /note="Description of Artificial Sequence: Synthetic peptide"
QICRGNVYLK

SEQ ID NO: 5916 - protein, 10 aa, Artificial Sequence
  source: /note="Description of Artificial Sequence: Synthetic peptide"
LWQICRGNVY

SEQ ID NO: 5917 - protein, 10 aa, Artificial Sequence
  source: /note="Description of Artificial Sequence: Synthetic peptide"
ASFERLLWQI

SEQ ID NO: 5918 - protein, 9 aa, Artificial Sequence
  source: /note="Description of Artificial Sequence: Synthetic peptide"
VLDAPFPCV

SEQ ID NO: 5919 - protein, 9 aa, Artificial Sequence
  source: /note="Description of Artificial Sequence: Synthetic peptide"
GQRVLDAPF

SEQ ID NO: 5920 - protein, 10 aa, Artificial Sequence
  source: /note="Description of Artificial Sequence: Synthetic peptide"
RVLDAPFPCV

SEQ ID NO: 5921 - protein, 10 aa, Artificial Sequence
  source: /note="Description of Artificial Sequence: Synthetic peptide"
TGQRVLDAPF

SEQ ID NO: 5922 - protein, 9 aa, Artificial Sequence
  source: /note="Description of Artificial Sequence: Synthetic peptide"
IYPPSTCSL

SEQ ID NO: 5923 - protein, 9 aa, Artificial Sequence
  source: /note="Description of Artificial Sequence: Synthetic peptide"
RQIYPPSTC

SEQ ID NO: 5924 - protein, 10 aa, Artificial Sequence
  source: /note="Description of Artificial Sequence: Synthetic peptide"
QIYPPSTCSL

SEQ ID NO: 5925 - protein, 10 aa, Artificial Sequence
  source: /note="Description of Artificial Sequence: Synthetic peptide"
RQIYPPSTCS

SEQ ID NO: 5926 - protein, 9 aa, Artificial Sequence
  source: /note="Description of Artificial Sequence: Synthetic peptide"
KERERVRAR

SEQ ID NO: 5927 - protein, 9 aa, Artificial Sequence
  source: /note="Description of Artificial Sequence: Synthetic peptide"
RERVRARVR

SEQ ID NO: 5928 - protein, 9 aa, Artificial Sequence
  source: /note="Description of Artificial Sequence: Synthetic peptide"
RVRARVRAP

SEQ ID NO: 5929 - protein, 9 aa, Artificial Sequence
  source: /note="Description of Artificial Sequence: Synthetic peptide"
RARVRAPCC

SEQ ID NO: 5930 - protein, 9 aa, Artificial Sequence
  source: /note="Description of Artificial Sequence: Synthetic peptide"
RVRAPCCAG

SEQ ID NO: 5931 - protein, 9 aa, Artificial Sequence
  source: /note="Description of Artificial Sequence: Synthetic peptide"
RAPCCAGSR

SEQ ID NO: 5932 - protein, 10 aa, Artificial Sequence
  source: /note="Description of Artificial Sequence: Synthetic peptide"
RVRARVRAPC

SEQ ID NO: 5933 - protein, 10 aa, Artificial Sequence
  source: /note="Description of Artificial Sequence: Synthetic peptide"
RARVRAPCCA

SEQ ID NO: 5934 - protein, 10 aa, Artificial Sequence
  source: /note="Description of Artificial Sequence: Synthetic peptide"
RVRAPCCAGS

SEQ ID NO: 5935 - protein, 10 aa, Artificial Sequence
  source: /note="Description of Artificial Sequence: Synthetic peptide"
KERERVRARV

SEQ ID NO: 5936 - protein, 10 aa, Artificial Sequence
  source: /note="Description of Artificial Sequence: Synthetic peptide"
RERVRARVRA

SEQ ID NO: 5937 - protein, 9 aa, Artificial Sequence
  source: /note="Description of Artificial Sequence: Synthetic peptide"
HSNCCDGGY

SEQ ID NO: 5938 - protein, 9 aa, Artificial Sequence
  source: /note="Description of Artificial Sequence: Synthetic peptide"
FQSLYHSSV

SEQ ID NO: 5939 - protein, 9 aa, Artificial Sequence
  source: /note="Description of Artificial Sequence: Synthetic peptide"
SLYHSSVYC

SEQ ID NO: 5940 - protein, 9 aa, Artificial Sequence
  source: /note="Description of Artificial Sequence: Synthetic peptide"
LYHSSVYCM

SEQ ID NO: 5941 - protein, 9 aa, Artificial Sequence
  source: /note="Description of Artificial Sequence: Synthetic peptide"
IIRFAFQSL

SEQ ID NO: 5942 - protein, 9 aa, Artificial Sequence
  source: /note="Description of Artificial Sequence: Synthetic peptide"
RFAFQSLYH

SEQ ID NO: 5943 - protein, 9 aa, Artificial Sequence
  source: /note="Description of Artificial Sequence: Synthetic peptide"
GGYRSRCSK

SEQ ID NO: 5944 - protein, 9 aa, Artificial Sequence
  source: /note="Description of Artificial Sequence: Synthetic peptide"
RSRCSKWHT

SEQ ID NO: 5945 - protein, 9 aa, Artificial Sequence
  source: /note="Description of Artificial Sequence: Synthetic peptide"
RCSKWHTNK

SEQ ID NO: 5946 - protein, 9 aa, Artificial Sequence
  source: /note="Description of Artificial Sequence: Synthetic peptide"
CSKWHTNKR

SEQ ID NO: 5947 - protein, 9 aa, Artificial Sequence
  source: /note="Description of Artificial Sequence: Synthetic peptide"
KWHTNKRWR

SEQ ID NO: 5948 - protein, 9 aa, Artificial Sequence
  source: /note="Description of Artificial Sequence: Synthetic peptide"
HTNKRWRAI

SEQ ID NO: 5949 - protein, 9 aa, Artificial Sequence
  source: /note="Description of Artificial Sequence: Synthetic peptide"
RWRAIGDGS

SEQ ID NO: 5950 - protein, 9 aa, Artificial Sequence
  source: /note="Description of Artificial Sequence: Synthetic peptide"
IRFAFQSLY

SEQ ID NO: 5951 - protein, 9 aa, Artificial Sequence
  source: /note="Description of Artificial Sequence: Synthetic peptide"
QSLYHSSVY

SEQ ID NO: 5952 - protein, 9 aa, Artificial Sequence
  source: /note="Description of Artificial Sequence: Synthetic peptide"
SSVYCMSLF

SEQ ID NO: 5953 - protein, 9 aa, Artificial Sequence
  source: /note="Description of Artificial Sequence: Synthetic peptide"
FAFQSLYHS

SEQ ID NO: 5954 - protein, 9 aa, Artificial Sequence
  source: /note="Description of Artificial Sequence: Synthetic peptide"
HSSVYCMSL

SEQ ID NO: 5955 - protein, 9 aa, Artificial Sequence
  source: /note="Description of Artificial Sequence: Synthetic peptide"
MSLFTGTGH

SEQ ID NO: 5956 - protein, 9 aa, Artificial Sequence
  source: /note="Description of Artificial Sequence: Synthetic peptide"
SKWHTNKRW

SEQ ID NO: 5957 - protein, 10 aa, Artificial Sequence
  source: /note="Description of Artificial Sequence: Synthetic peptide"
SLYHSSVYCM

SEQ ID NO: 5958 - protein, 10 aa, Artificial Sequence
  source: /note="Description of Artificial Sequence: Synthetic peptide"
TIIRFAFQSL

SEQ ID NO: 5959 - protein, 10 aa, Artificial Sequence
  source: /note="Description of Artificial Sequence: Synthetic peptide"
HSNCCDGGYR

SEQ ID NO: 5960 - protein, 10 aa, Artificial Sequence
  source: /note="Description of Artificial Sequence: Synthetic peptide"
IIRFAFQSLY

SEQ ID NO: 5961 - protein, 10 aa, Artificial Sequence
  source: /note="Description of Artificial Sequence: Synthetic peptide"
RSRCSKWHTN

SEQ ID NO: 5962 - protein, 10 aa, Artificial Sequence
  source: /note="Description of Artificial Sequence: Synthetic peptide"
KWHTNKRWRA

SEQ ID NO: 5963 - protein, 10 aa, Artificial Sequence
  source: /note="Description of Artificial Sequence: Synthetic peptide"
HTNKRWRAIG

SEQ ID NO: 5964 - protein, 10 aa, Artificial Sequence
  source: /note="Description of Artificial Sequence: Synthetic peptide"
FQSLYHSSVY

SEQ ID NO: 5965 - protein, 10 aa, Artificial Sequence
  source: /note="Description of Artificial Sequence: Synthetic peptide"
HSSVYCMSLF

SEQ ID NO: 5966 - protein, 10 aa, Artificial Sequence
  source: /note="Description of Artificial Sequence: Synthetic peptide"
GHSNCCDGGY

SEQ ID NO: 5967 - protein, 10 aa, Artificial Sequence
  source: /note="Description of Artificial Sequence: Synthetic peptide"
ETIIRFAFQS

SEQ ID NO: 5968 - protein, 10 aa, Artificial Sequence
  source: /note="Description of Artificial Sequence: Synthetic peptide"
FAFQSLYHSS

SEQ ID NO: 5969 - protein, 10 aa, Artificial Sequence
  source: /note="Description of Artificial Sequence: Synthetic peptide"
YHSSVYCMSL

SEQ ID NO: 5970 - protein, 10 aa, Artificial Sequence
  source: /note="Description of Artificial Sequence: Synthetic peptide"
GGYRSRCSKW

SEQ ID NO: 5971 - protein, 9 aa, Artificial Sequence
  source: /note="Description of Artificial Sequence: Synthetic peptide"
LVGQDQSSM

SEQ ID NO: 5972 - protein, 9 aa, Artificial Sequence
  source: /note="Description of Artificial Sequence: Synthetic peptide"
GQDQSSMQL

SEQ ID NO: 5973 - protein, 10 aa, Artificial Sequence
  source: /note="Description of Artificial Sequence: Synthetic peptide"
TLVGQDQSSM

SEQ ID NO: 5974 - protein, 9 aa, Artificial Sequence
  source: /note="Description of Artificial Sequence: Synthetic peptide"
NTSNPQSKI

SEQ ID NO: 5975 - protein, 9 aa, Artificial Sequence
  source: /note="Description of Artificial Sequence: Synthetic peptide"
NPQSKIGLF

SEQ ID NO: 5976 - protein, 10 aa, Artificial Sequence
  source: /note="Description of Artificial Sequence: Synthetic peptide"
VMNTSNPQSK

SEQ ID NO: 5977 - protein, 10 aa, Artificial Sequence
  source: /note="Description of Artificial Sequence: Synthetic peptide"
RPGADRHGRY

SEQ ID NO: 5978 - protein, 9 aa, Artificial Sequence
  source: /note="Description of Artificial Sequence: Synthetic peptide"
AKKEISQLF

SEQ ID NO: 5979 - protein, 9 aa, Artificial Sequence
  source: /note="Description of Artificial Sequence: Synthetic peptide"
KKEISQLFM

SEQ ID NO: 5980 - protein, 9 aa, Artificial Sequence
  source: /note="Description of Artificial Sequence: Synthetic peptide"
KEISQLFMT

SEQ ID NO: 5981 - protein, 10 aa, Artificial Sequence
  source: /note="Description of Artificial Sequence: Synthetic peptide"
SAKKEISQLF

SEQ ID NO: 5982 - protein, 10 aa, Artificial Sequence
  source: /note="Description of Artificial Sequence: Synthetic peptide"
AKKEISQLFM

SEQ ID NO: 5983 - protein, 10 aa, Artificial Sequence
  source: /note="Description of Artificial Sequence: Synthetic peptide"
KEISQLFMTH

SEQ ID NO: 5984 - protein, 9 aa, Artificial Sequence
  source: /note="Description of Artificial Sequence: Synthetic peptide"
SIYAQLVAA

SEQ ID NO: 5985 - protein, 9 aa, Artificial Sequence
  source: /note="Description of Artificial Sequence: Synthetic peptide"
QLVAAFSGL

SEQ ID NO: 5986 - protein, 9 aa, Artificial Sequence
  source: /note="Description of Artificial Sequence: Synthetic peptide"
IYAQLVAAF

SEQ ID NO: 5987 - protein, 9 aa, Artificial Sequence
  source: /note="Description of Artificial Sequence: Synthetic peptide"
AQLVAAFSG

SEQ ID NO: 5988 - protein, 10 aa, Artificial Sequence
  source: /note="Description of Artificial Sequence: Synthetic peptide"
AQLVAAFSGL

SEQ ID NO: 5989 - protein, 10 aa, Artificial Sequence
  source: /note="Description of Artificial Sequence: Synthetic peptide"
QLVAAFSGLI

SEQ ID NO: 5990 - protein, 10 aa, Artificial Sequence
  source: /note="Description of Artificial Sequence: Synthetic peptide"
SIYAQLVAAF

SEQ ID NO: 5991 - protein, 10 aa, Artificial Sequence
  source: /note="Description of Artificial Sequence: Synthetic peptide"
DSIYAQLVAA

SEQ ID NO: 5992 - protein, 9 aa, Artificial Sequence
  source: /note="Description of Artificial Sequence: Synthetic peptide"
FSCFLSFLL

SEQ ID NO: 5993 - protein, 9 aa, Artificial Sequence
  source: /note="Description of Artificial Sequence: Synthetic peptide"
FLSFLLVAA

SEQ ID NO: 5994 - protein, 9 aa, Artificial Sequence
  source: /note="Description of Artificial Sequence: Synthetic peptide"
FFSCFLSFL

SEQ ID NO: 5995 - protein, 9 aa, Artificial Sequence
  source: /note="Description of Artificial Sequence: Synthetic peptide"
LSFLLVAAV

SEQ ID NO: 5996 - protein, 9 aa, Artificial Sequence
  source: /note="Description of Artificial Sequence: Synthetic peptide"
TFFSCFLSF

SEQ ID NO: 5997 - protein, 9 aa, Artificial Sequence
  source: /note="Description of Artificial Sequence: Synthetic peptide"
FLLVAAVVW

SEQ ID NO: 5998 - protein, 10 aa, Artificial Sequence
  source: /note="Description of Artificial Sequence: Synthetic peptide"
FSCFLSFLLV

SEQ ID NO: 5999 - protein, 10 aa, Artificial Sequence
  source: /note="Description of Artificial Sequence: Synthetic peptide"
FFSCFLSFLL

SEQ ID NO: 6000 - protein, 10 aa, Artificial Sequence
  source: /note="Description of Artificial Sequence: Synthetic peptide"
FLSFLLVAAV

SEQ ID NO: 6001 - protein, 10 aa, Artificial Sequence
  source: /note="Description of Artificial Sequence: Synthetic peptide"
VTFFSCFLSF

SEQ ID NO: 6002 - protein, 10 aa, Artificial Sequence
  source: /note="Description of Artificial Sequence: Synthetic peptide"
TFFSCFLSFL

SEQ ID NO: 6003 - protein, 10 aa, Artificial Sequence
  source: /note="Description of Artificial Sequence: Synthetic peptide"
SFLLVAAVVW

SEQ ID NO: 6004 - protein, 10 aa, Artificial Sequence
  source: /note="Description of Artificial Sequence: Synthetic peptide"
LSFLLVAAVV

SEQ ID NO: 6005 - protein, 10 aa, Artificial Sequence
  source: /note="Description of Artificial Sequence: Synthetic peptide"
YTKKKKKGKR

SEQ ID NO: 6006 - protein, 9 aa, Artificial Sequence
  source: /note="Description of Artificial Sequence: Synthetic peptide"
HQHQQQQQH

SEQ ID NO: 6007 - protein, 10 aa, Artificial Sequence
  source: /note="Description of Artificial Sequence: Synthetic peptide"
HQQQQQQQQH

SEQ ID NO: 6008 - protein, 9 aa, Artificial Sequence
  source: /note="Description of Artificial Sequence: Synthetic peptide"
HPWITANLS

SEQ ID NO: 6009 - protein, 10 aa, Artificial Sequence
  source: /note="Description of Artificial Sequence: Synthetic peptide"
LSKPSNCQNK

SEQ ID NO: 6010 - protein, 10 aa, Artificial Sequence
  source: /note="Description of Artificial Sequence: Synthetic peptide"
LEHPWITANL

SEQ ID NO: 6011 - protein, 9 aa, Artificial Sequence
  source: /note="Description of Artificial Sequence: Synthetic peptide"
SQDIHFWIW

SEQ ID NO: 6012 - protein, 10 aa, Artificial Sequence
  source: /note="Description of Artificial Sequence: Synthetic peptide"
SQDIHFWIWK

SEQ ID NO: 6013 - protein, 10 aa, Artificial Sequence
  source: /note="Description of Artificial Sequence: Synthetic peptide"
LSQDIHFWIW

SEQ ID NO: 6014 - protein, 9 aa, Artificial Sequence
  source: /note="Description of Artificial Sequence: Synthetic peptide"
VWKGKGSHK

SEQ ID NO: 6015 - protein, 10 aa, Artificial Sequence
  source: /note="Description of Artificial Sequence: Synthetic peptide"
YVWKGKGSHK

SEQ ID NO: 6016 - protein, 9 aa, Artificial Sequence
  source: /note="Description of Artificial Sequence: Synthetic peptide"
KGCQVELSY

SEQ ID NO: 6017 - protein, 9 aa, Artificial Sequence
  source: /note="Description of Artificial Sequence: Synthetic peptide"
HKKGCQVEL

SEQ ID NO: 6018 - protein, 9 aa, Artificial Sequence
  source: /note="Description of Artificial Sequence: Synthetic peptide"
CQVELSYPP

SEQ ID NO: 6019 - protein, 9 aa, Artificial Sequence
  source: /note="Description of Artificial Sequence: Synthetic peptide"
VELSYPPLI

SEQ ID NO: 6020 - protein, 10 aa, Artificial Sequence
  source: /note="Description of Artificial Sequence: Synthetic peptide"
CQVELSYPPL

SEQ ID NO: 6021 - protein, 10 aa, Artificial Sequence
  source: /note="Description of Artificial Sequence: Synthetic peptide"
KKGCQVELSY

SEQ ID NO: 6022 - protein, 9 aa, Artificial Sequence
  source: /note="Description of Artificial Sequence: Synthetic peptide"
KARRGGGWR

SEQ ID NO: 6023 - protein, 9 aa, Artificial Sequence
  source: /note="Description of Artificial Sequence: Synthetic peptide"
RTAHRGGRI

SEQ ID NO: 6024 - protein, 9 aa, Artificial Sequence
  source: /note="Description of Artificial Sequence: Synthetic peptide"
RPPGARTAH

SEQ ID NO: 6025 - protein, 9 aa, Artificial Sequence
  source: /note="Description of Artificial Sequence: Synthetic peptide"
GRISPQEGL

SEQ ID NO: 6026 - protein, 10 aa, Artificial Sequence
  source: /note="Description of Artificial Sequence: Synthetic peptide"
KARRGGGWRP

SEQ ID NO: 6027 - protein, 10 aa, Artificial Sequence
  source: /note="Description of Artificial Sequence: Synthetic peptide"
GWRPPGARTA

SEQ ID NO: 6028 - protein, 10 aa, Artificial Sequence
  source: /note="Description of Artificial Sequence: Synthetic peptide"
GARTAHRGGR

SEQ ID NO: 6029 - protein, 10 aa, Artificial Sequence
  source: /note="Description of Artificial Sequence: Synthetic peptide"
MEKARRGGGW

SEQ ID NO: 6030 - protein, 9 aa, Artificial Sequence
  source: /note="Description of Artificial Sequence: Synthetic peptide"
WIYMFLVAI

SEQ ID NO: 6031 - protein, 9 aa, Artificial Sequence
  source: /note="Description of Artificial Sequence: Synthetic peptide"
YMFLVAISF

SEQ ID NO: 6032 - protein, 9 aa, Artificial Sequence
  source: /note="Description of Artificial Sequence: Synthetic peptide"
FLVAISFKT

SEQ ID NO: 6033 - protein, 9 aa, Artificial Sequence
  source: /note="Description of Artificial Sequence: Synthetic peptide"
LVAISFKTV

SEQ ID NO: 6034 - protein, 9 aa, Artificial Sequence
  source: /note="Description of Artificial Sequence: Synthetic peptide"
TVFKASHAA

SEQ ID NO: 6035 - protein, 9 aa, Artificial Sequence
  source: /note="Description of Artificial Sequence: Synthetic peptide"
MFLVAISFK

SEQ ID NO: 6036 - protein, 9 aa, Artificial Sequence
  source: /note="Description of Artificial Sequence: Synthetic peptide"
AISFKTVFK

SEQ ID NO: 6037 - protein, 9 aa, Artificial Sequence
  source: /note="Description of Artificial Sequence: Synthetic peptide"
IYMFLVAIS

SEQ ID NO: 6038 - protein, 9 aa, Artificial Sequence
  source: /note="Description of Artificial Sequence: Synthetic peptide"
KTVFKASHA

SEQ ID NO: 6039 - protein, 9 aa, Artificial Sequence
  source: /note="Description of Artificial Sequence: Synthetic peptide"
VFKASHAAK

SEQ ID NO: 6040 - protein, 9 aa, Artificial Sequence
  source: /note="Description of Artificial Sequence: Synthetic peptide"
VAISFKTVF

SEQ ID NO: 6041 - protein, 9 aa, Artificial Sequence
  source: /note="Description of Artificial Sequence: Synthetic peptide"
ISFKTVFKA

SEQ ID NO: 6042 - protein, 9 aa, Artificial Sequence
  source: /note="Description of Artificial Sequence: Synthetic peptide"
FKTVFKASH

SEQ ID NO: 6043 - protein, 9 aa, Artificial Sequence
  source: /note="Description of Artificial Sequence: Synthetic peptide"
NPWIYMFLV

SEQ ID NO: 6044 - protein, 10 aa, Artificial Sequence
  source: /note="Description of Artificial Sequence: Synthetic peptide"
FLVAISFKTV

SEQ ID NO: 6045 - protein, 10 aa, Artificial Sequence
  source: /note="Description of Artificial Sequence: Synthetic peptide"
AISFKTVFKA

SEQ ID NO: 6046 - protein, 10 aa, Artificial Sequence
  source: /note="Description of Artificial Sequence: Synthetic peptide"
YMFLVAISFK

SEQ ID NO: 6047 - protein, 10 aa, Artificial Sequence
  source: /note="Description of Artificial Sequence: Synthetic peptide"
VAISFKTVFK

SEQ ID NO: 6048 - protein, 10 aa, Artificial Sequence
  source: /note="Description of Artificial Sequence: Synthetic peptide"
TVFKASHAAK

SEQ ID NO: 6049 - protein, 10 aa, Artificial Sequence
  source: /note="Description of Artificial Sequence: Synthetic peptide"
PWIYMFLVAI

SEQ ID NO: 6050 - protein, 10 aa, Artificial Sequence
  source: /note="Description of Artificial Sequence: Synthetic peptide"
IYMFLVAISF

SEQ ID NO: 6051 - protein, 10 aa, Artificial Sequence
  source: /note="Description of Artificial Sequence: Synthetic peptide"
SFKTVFKASH

SEQ ID NO: 6052 - protein, 10 aa, Artificial Sequence
  source: /note="Description of Artificial Sequence: Synthetic peptide"
KTVFKASHAA

SEQ ID NO: 6053 - protein, 10 aa, Artificial Sequence
  source: /note="Description of Artificial Sequence: Synthetic peptide"
LVAISFKTVF

SEQ ID NO: 6054 - protein, 10 aa, Artificial Sequence
  source: /note="Description of Artificial Sequence: Synthetic peptide"
NPWIYMFLVA

SEQ ID NO: 6055 - protein, 9 aa, Artificial Sequence
  source: /note="Description of Artificial Sequence: Synthetic peptide"
RVLATVLVL

SEQ ID NO: 6056 - protein, 9 aa, Artificial Sequence
  source: /note="Description of Artificial Sequence: Synthetic peptide"
ELAKVEIRV

SEQ ID NO: 6057 - protein, 9 aa, Artificial Sequence
  source: /note="Description of Artificial Sequence: Synthetic peptide"
EIRVLATVL

SEQ ID NO: 6058 - protein, 9 aa, Artificial Sequence
  source: /note="Description of Artificial Sequence: Synthetic peptide"
VEIRVLATV

SEQ ID NO: 6059 - protein, 10 aa, Artificial Sequence
  source: /note="Description of Artificial Sequence: Synthetic peptide"
RVLATVLVLA

SEQ ID NO: 6060 - protein, 10 aa, Artificial Sequence
  source: /note="Description of Artificial Sequence: Synthetic peptide"
KVEIRVLATV

SEQ ID NO: 6061 - protein, 10 aa, Artificial Sequence
  source: /note="Description of Artificial Sequence: Synthetic peptide"
EIRVLATVLV

SEQ ID NO: 6062 - protein, 10 aa, Artificial Sequence
  source: /note="Description of Artificial Sequence: Synthetic peptide"
AKVEIRVLAT

SEQ ID NO: 6063 - protein, 10 aa, Artificial Sequence
  source: /note="Description of Artificial Sequence: Synthetic peptide"
VEIRVLATVL

SEQ ID NO: 6064 - protein, 10 aa, Artificial Sequence
  source: /note="Description of Artificial Sequence: Synthetic peptide"
IRVLATVLVL

SEQ ID NO: 6065 - protein, 10 aa, Artificial Sequence
  source: /note="Description of Artificial Sequence: Synthetic peptide"
EELAKVEIRV

SEQ ID NO: 6066 - protein, 9 aa, Artificial Sequence
  source: /note="Description of Artificial Sequence: Synthetic peptide"
HMQDKLLEV

SEQ ID NO: 6067 - protein, 9 aa, Artificial Sequence
  source: /note="Description of Artificial Sequence: Synthetic peptide"
AVIEHMQDK

SEQ ID NO: 6068 - protein, 9 aa, Artificial Sequence
  source: /note="Description of Artificial Sequence: Synthetic peptide"
IEHMQDKLL

SEQ ID NO: 6069 - protein, 10 aa, Artificial Sequence
  source: /note="Description of Artificial Sequence: Synthetic peptide"
AVIEHMQDKL

SEQ ID NO: 6070 - protein, 9 aa, Artificial Sequence
  source: /note="Description of Artificial Sequence: Synthetic peptide"
HVRHHPVRR

SEQ ID NO: 6071 - protein, 9 aa, Artificial Sequence
  source: /note="Description of Artificial Sequence: Synthetic peptide"
RHHPVRRNK

SEQ ID NO: 6072 - protein, 9 aa, Artificial Sequence
  source: /note="Description of Artificial Sequence: Synthetic peptide"
RLVDHVRHH

SEQ ID NO: 6073 - protein, 10 aa, Artificial Sequence
  source: /note="Description of Artificial Sequence: Synthetic peptide"
LVDHVRHHPV

SEQ ID NO: 6074 - protein, 10 aa, Artificial Sequence
  source: /note="Description of Artificial Sequence: Synthetic peptide"
HVRHHPVRRN

SEQ ID NO: 6075 - protein, 10 aa, Artificial Sequence
  source: /note="Description of Artificial Sequence: Synthetic peptide"
RHHPVRRNKF

SEQ ID NO: 6076 - protein, 9 aa, Artificial Sequence
  source: /note="Description of Artificial Sequence: Synthetic peptide"
HLSTAGTPA

SEQ ID NO: 6077 - protein, 9 aa, Artificial Sequence
  source: /note="Description of Artificial Sequence: Synthetic peptide"
RASRHHLST

SEQ ID NO: 6078 - protein, 9 aa, Artificial Sequence
  source: /note="Description of Artificial Sequence: Synthetic peptide"
ASRHHLSTA

SEQ ID NO: 6079 - protein, 9 aa, Artificial Sequence
  source: /note="Description of Artificial Sequence: Synthetic peptide"
PTCSPRTLR

SEQ ID NO: 6080 - protein, 9 aa, Artificial Sequence
  source: /note="Description of Artificial Sequence: Synthetic peptide"
TPAPPPVPT

SEQ ID NO: 6081 - protein, 9 aa, Artificial Sequence
  source: /note="Description of Artificial Sequence: Synthetic peptide"
VPTCSPRTL

SEQ ID NO: 6082 - protein, 10 aa, Artificial Sequence
  source: /note="Description of Artificial Sequence: Synthetic peptide"
RASRHHLSTA

SEQ ID NO: 6083 - protein, 10 aa, Artificial Sequence
  source: /note="Description of Artificial Sequence: Synthetic peptide"
ASRHHLSTAG

SEQ ID NO: 6084 - protein, 10 aa, Artificial Sequence
  source: /note="Description of Artificial Sequence: Synthetic peptide"
HHLSTAGTPA

SEQ ID NO: 6085 - protein, 9 aa, Artificial Sequence
  source: /note="Description of Artificial Sequence: Synthetic peptide"
HLWGGQQRA

SEQ ID NO: 6086 - protein, 9 aa, Artificial Sequence
  source: /note="Description of Artificial Sequence: Synthetic peptide"
GQQRAPPHH

SEQ ID NO: 6087 - protein, 9 aa, Artificial Sequence
  source: /note="Description of Artificial Sequence: Synthetic peptide"
HLWGATAGT

SEQ ID NO: 6088 - protein, 9 aa, Artificial Sequence
  source: /note="Description of Artificial Sequence: Synthetic peptide"
ASRHHLWGA

SEQ ID NO: 6089 - protein, 9 aa, Artificial Sequence
  source: /note="Description of Artificial Sequence: Synthetic peptide"
PTCSPRTLR

SEQ ID NO: 6090 - protein, 9 aa, Artificial Sequence
  source: /note="Description of Artificial Sequence: Synthetic peptide"
TPAPPPVPT

SEQ ID NO: 6091 - protein, 9 aa, Artificial Sequence
  source: /note="Description of Artificial Sequence: Synthetic peptide"
VPTCSPRTL

SEQ ID NO: 6092 - protein, 9 aa, Artificial Sequence
  source: /note="Description of Artificial Sequence: Synthetic peptide"
RHHLWGATA

SEQ ID NO: 6093 - protein, 9 aa, Artificial Sequence
  source: /note="Description of Artificial Sequence: Synthetic peptide"
WGATAGTPA

SEQ ID NO: 6094 - protein, 10 aa, Artificial Sequence
  source: /note="Description of Artificial Sequence: Synthetic peptide"
RASRHHLWGA

SEQ ID NO: 6095 - protein, 10 aa, Artificial Sequence
  source: /note="Description of Artificial Sequence: Synthetic peptide"
ASRHHLWGAT

SEQ ID NO: 6096 - protein, 10 aa, Artificial Sequence
  source: /note="Description of Artificial Sequence: Synthetic peptide"
RHHLWGATAG

SEQ ID NO: 6097 - protein, 9 aa, Artificial Sequence
  source: /note="Description of Artificial Sequence: Synthetic peptide"
VSRSVALAV

SEQ ID NO: 6098 - protein, 10 aa, Artificial Sequence
  source: /note="Description of Artificial Sequence: Synthetic peptide"
VSRSVALAVL

SEQ ID NO: 6099 - protein, 9 aa, Artificial Sequence
  source: /note="Description of Artificial Sequence: Synthetic peptide"
LLSFWPGGY

SEQ ID NO: 6100 - protein, 9 aa, Artificial Sequence
  source: /note="Description of Artificial Sequence: Synthetic peptide"
LLCVWVSSI

SEQ ID NO: 6101 - protein, 9 aa, Artificial Sequence
  source: /note="Description of Artificial Sequence: Synthetic peptide"
LTSSSREWK

SEQ ID NO: 6102 - protein, 9 aa, Artificial Sequence
  source: /note="Description of Artificial Sequence: Synthetic peptide"
SSSREWKVK

SEQ ID NO: 6103 - protein, 9 aa, Artificial Sequence
  source: /note="Description of Artificial Sequence: Synthetic peptide"
KFPELLCVW

SEQ ID NO: 6104 - protein, 9 aa, Artificial Sequence
  source: /note="Description of Artificial Sequence: Synthetic peptide"
KVKFPELLC

SEQ ID NO: 6105 - protein, 9 aa, Artificial Sequence
  source: /note="Description of Artificial Sequence: Synthetic peptide"
FWPGGYPAY

SEQ ID NO: 6106 - protein, 9 aa, Artificial Sequence
  source: /note="Description of Artificial Sequence: Synthetic peptide"
TSSSREWKV

SEQ ID NO: 6107 - protein, 9 aa, Artificial Sequence
  source: /note="Description of Artificial Sequence: Synthetic peptide"
EWKVKFPEL

SEQ ID NO: 6108 - protein, 9 aa, Artificial Sequence
  source: /note="Description of Artificial Sequence: Synthetic peptide"
LAVLALLSF

SEQ ID NO: 6109 - protein, 9 aa, Artificial Sequence
  source: /note="Description of Artificial Sequence: Synthetic peptide"
SFWPGGYPA

SEQ ID NO: 6110 - protein, 9 aa, Artificial Sequence
  source: /note="Description of Artificial Sequence: Synthetic peptide"
LLTSSSREW

SEQ ID NO: 6111 - protein, 9 aa, Artificial Sequence
  source: /note="Description of Artificial Sequence: Synthetic peptide"
SSREWKVKF

SEQ ID NO: 6112 - protein, 9 aa, Artificial Sequence
  source: /note="Description of Artificial Sequence: Synthetic peptide"
WKVKFPELL

SEQ ID NO: 6113 - protein, 9 aa, Artificial Sequence
  source: /note="Description of Artificial Sequence: Synthetic peptide"
VKFPELLCV

SEQ ID NO: 6114 - protein, 9 aa, Artificial Sequence
  source: /note="Description of Artificial Sequence: Synthetic peptide"
REWKVKFPE

SEQ ID NO: 6115 - protein, 9 aa, Artificial Sequence
  source: /note="Description of Artificial Sequence: Synthetic peptide"
FPELLCVWV

SEQ ID NO: 6116 - protein, 10 aa, Artificial Sequence
  source: /note="Description of Artificial Sequence: Synthetic peptide"
ELLCVWVSSI

SEQ ID NO: 6117 - protein, 10 aa, Artificial Sequence
  source: /note="Description of Artificial Sequence: Synthetic peptide"
ALLSFWPGGY

SEQ ID NO: 6118 - protein, 10 aa, Artificial Sequence
  source: /note="Description of Artificial Sequence: Synthetic peptide"
LLTSSSREWK

SEQ ID NO: 6119 - protein, 10 aa, Artificial Sequence
  source: /note="Description of Artificial Sequence: Synthetic peptide"
TSSSREWKVK

SEQ ID NO: 6120 - protein, 10 aa, Artificial Sequence
  source: /note="Description of Artificial Sequence: Synthetic peptide"
SFWPGGYPAY

SEQ ID NO: 6121 - protein, 10 aa, Artificial Sequence
  source: /note="Description of Artificial Sequence: Synthetic peptide"
KFPELLCVWV

SEQ ID NO: 6122 - protein, 10 aa, Artificial Sequence
  source: /note="Description of Artificial Sequence: Synthetic peptide"
KVKFPELLCV

SEQ ID NO: 6123 - protein, 10 aa, Artificial Sequence
  source: /note="Description of Artificial Sequence: Synthetic peptide"
DSGLLTSSSR

SEQ ID NO: 6124 - protein, 10 aa, Artificial Sequence
  source: /note="Description of Artificial Sequence: Synthetic peptide"
LLCVWVSSIR

SEQ ID NO: 6125 - protein, 10 aa, Artificial Sequence
  source: /note="Description of Artificial Sequence: Synthetic peptide"
LSFWPGGYPA

SEQ ID NO: 6126 - protein, 10 aa, Artificial Sequence
  source: /note="Description of Artificial Sequence: Synthetic peptide"
LTSSSREWKV

SEQ ID NO: 6127 - protein, 10 aa, Artificial Sequence
  source: /note="Description of Artificial Sequence: Synthetic peptide"
YPAYSKDSGL

SEQ ID NO: 6128 - protein, 10 aa, Artificial Sequence
  source: /note="Description of Artificial Sequence: Synthetic peptide"
ALAVLALLSF

SEQ ID NO: 6129 - protein, 10 aa, Artificial Sequence
  source: /note="Description of Artificial Sequence: Synthetic peptide"
LAVLALLSFW

SEQ ID NO: 6130 - protein, 10 aa, Artificial Sequence
  source: /note="Description of Artificial Sequence: Synthetic peptide"
GLLTSSSREW

SEQ ID NO: 6131 - protein, 10 aa, Artificial Sequence
  source: /note="Description of Artificial Sequence: Synthetic peptide"
SSSREWKVKF

SEQ ID NO: 6132 - protein, 10 aa, Artificial Sequence
  source: /note="Description of Artificial Sequence: Synthetic peptide"
REWKVKFPEL

SEQ ID NO: 6133 - protein, 10 aa, Artificial Sequence
  source: /note="Description of Artificial Sequence: Synthetic peptide"
VKFPELLCVW

SEQ ID NO: 6134 - protein, 9 aa, Artificial Sequence
  source: /note="Description of Artificial Sequence: Synthetic peptide"
ISRSVALAV

SEQ ID NO: 6135 - protein, 10 aa, Artificial Sequence
  source: /note="Description of Artificial Sequence: Synthetic peptide"
ISRSVALAVL

SEQ ID NO: 6136 - protein, 9 aa, Artificial Sequence
  source: /note="Description of Artificial Sequence: Synthetic peptide"
IQQDFLDTY

SEQ ID NO: 6137 - protein, 10 aa, Artificial Sequence
  source: /note="Description of Artificial Sequence: Synthetic peptide"
LYGDIIQQDF

SEQ ID NO: 6138 - protein, 10 aa, Artificial Sequence
  source: /note="Description of Artificial Sequence: Synthetic peptide"
IIQQDFLDTY

SEQ ID NO: 6139 - protein, 9 aa, Artificial Sequence
  source: /note="Description of Artificial Sequence: Synthetic peptide"
WLVVEDAPL

SEQ ID NO: 6140 - protein, 10 aa, Artificial Sequence
  source: /note="Description of Artificial Sequence: Synthetic peptide"
VEDAPLRTPL

SEQ ID NO: 6141 - protein, 9 aa, Artificial Sequence
  source: /note="Description of Artificial Sequence: Synthetic peptide"
FLASLMFFG

SEQ ID NO: 6142 - protein, 9 aa, Artificial Sequence
  source: /note="Description of Artificial Sequence: Synthetic peptide"
LMFFGNQSI

SEQ ID NO: 6143 - protein, 9 aa, Artificial Sequence
  source: /note="Description of Artificial Sequence: Synthetic peptide"
MFFGNQSII

SEQ ID NO: 6144 - protein, 9 aa, Artificial Sequence
  source: /note="Description of Artificial Sequence: Synthetic peptide"
FGNQSIITL

SEQ ID NO: 6145 - protein, 10 aa, Artificial Sequence
  source: /note="Description of Artificial Sequence: Synthetic peptide"
FLASLMFFGN

SEQ ID NO: 6146 - protein, 10 aa, Artificial Sequence
  source: /note="Description of Artificial Sequence: Synthetic peptide"
SLMFFGNQSI

SEQ ID NO: 6147 - protein, 10 aa, Artificial Sequence
  source: /note="Description of Artificial Sequence: Synthetic peptide"
LMFFGNQSII

SEQ ID NO: 6148 - protein, 10 aa, Artificial Sequence
  source: /note="Description of Artificial Sequence: Synthetic peptide"
FFGNQSIITL

SEQ ID NO: 6149 - protein, 9 aa, Artificial Sequence
  source: /note="Description of Artificial Sequence: Synthetic peptide"
PLPETSPSY

SEQ ID NO: 6150 - protein, 10 aa, Artificial Sequence
  source: /note="Description of Artificial Sequence: Synthetic peptide"
PPLPETSPSY

SEQ ID NO: 6151 - protein, 9 aa, Artificial Sequence
  source: /note="Description of Artificial Sequence: Synthetic peptide"
SQNDFQSLL

SEQ ID NO: 6152 - protein, 9 aa, Artificial Sequence
  source: /note="Description of Artificial Sequence: Synthetic peptide"
AQRIISLSQ

SEQ ID NO: 6153 - protein, 9 aa, Artificial Sequence
  source: /note="Description of Artificial Sequence: Synthetic peptide"
IISLSQNDF

SEQ ID NO: 6154 - protein, 9 aa, Artificial Sequence
  source: /note="Description of Artificial Sequence: Synthetic peptide"
LSQNDFQSL

SEQ ID NO: 6155 - protein, 10 aa, Artificial Sequence
  source: /note="Description of Artificial Sequence: Synthetic peptide"
SLSQNDFQSL

SEQ ID NO: 6156 - protein, 10 aa, Artificial Sequence
  source: /note="Description of Artificial Sequence: Synthetic peptide"
SQNDFQSLLK

SEQ ID NO: 6157 - protein, 10 aa, Artificial Sequence
  source: /note="Description of Artificial Sequence: Synthetic peptide"
RIISLSQNDF

SEQ ID NO: 6158 - protein, 10 aa, Artificial Sequence
  source: /note="Description of Artificial Sequence: Synthetic peptide"
LSQNDFQSLL

SEQ ID NO: 6159 - protein, 9 aa, Artificial Sequence
  source: /note="Description of Artificial Sequence: Synthetic peptide"
AQRGPPPSR

SEQ ID NO: 6160 - protein, 10 aa, Artificial Sequence
  source: /note="Description of Artificial Sequence: Synthetic peptide"
AQRGPPPSRR

SEQ ID NO: 6161 - protein, 10 aa, Artificial Sequence
  source: /note="Description of Artificial Sequence: Synthetic peptide"
GPPPSRRPPA

SEQ ID NO: 6162 - protein, 9 aa, Artificial Sequence
  source: /note="Description of Artificial Sequence: Synthetic peptide"
GEAGGGSTT

SEQ ID NO: 6163 - protein, 10 aa, Artificial Sequence
  source: /note="Description of Artificial Sequence: Synthetic peptide"
GEAGGGSTTT

SEQ ID NO: 6164 - protein, 9 aa, Artificial Sequence
  source: /note="Description of Artificial Sequence: Synthetic peptide"
NPMTPMTPM

SEQ ID NO: 6165 - protein, 9 aa, Artificial Sequence
  source: /note="Description of Artificial Sequence: Synthetic peptide"
GPVNPMTPM

SEQ ID NO: 6166 - protein, 9 aa, Artificial Sequence
  source: /note="Description of Artificial Sequence: Synthetic peptide"
TPMTPMTSM

SEQ ID NO: 6167 - protein, 10 aa, Artificial Sequence
  source: /note="Description of Artificial Sequence: Synthetic peptide"
MTPMTPMTSM

SEQ ID NO: 6168 - protein, 10 aa, Artificial Sequence
  source: /note="Description of Artificial Sequence: Synthetic peptide"
MTPMTSMTSM

SEQ ID NO: 6169 - protein, 10 aa, Artificial Sequence
  source: /note="Description of Artificial Sequence: Synthetic peptide"
TPMTPMTSMT

SEQ ID NO: 6170 - protein, 9 aa, Artificial Sequence
  source: /note="Description of Artificial Sequence: Synthetic peptide"
IVSNMFFAH

SEQ ID NO: 6171 - protein, 9 aa, Artificial Sequence
  source: /note="Description of Artificial Sequence: Synthetic peptide"
DIVSNMFFA

SEQ ID NO: 6172 - protein, 9 aa, Artificial Sequence
  source: /note="Description of Artificial Sequence: Synthetic peptide"
SNMFFAHQL

SEQ ID NO: 6173 - protein, 10 aa, Artificial Sequence
  source: /note="Description of Artificial Sequence: Synthetic peptide"
SNMFFAHQLI

SEQ ID NO: 6174 - protein, 10 aa, Artificial Sequence
  source: /note="Description of Artificial Sequence: Synthetic peptide"
VSNMFFAHQL

SEQ ID NO: 6175 - protein, 9 aa, Artificial Sequence
  source: /note="Description of Artificial Sequence: Synthetic peptide"
PYHDICFNL

SEQ ID NO: 6176 - protein, 9 aa, Artificial Sequence
  source: /note="Description of Artificial Sequence: Synthetic peptide"
DICFNLMAV

SEQ ID NO: 6177 - protein, 9 aa, Artificial Sequence
  source: /note="Description of Artificial Sequence: Synthetic peptide"
YHDICFNLM

SEQ ID NO: 6178 - protein, 9 aa, Artificial Sequence
  source: /note="Description of Artificial Sequence: Synthetic peptide"
GEPYHDICF

SEQ ID NO: 6179 - protein, 9 aa, Artificial Sequence
  source: /note="Description of Artificial Sequence: Synthetic peptide"
HDICFNLMA

SEQ ID NO: 6180 - protein, 10 aa, Artificial Sequence
  source: /note="Description of Artificial Sequence: Synthetic peptide"
PYHDICFNLM

SEQ ID NO: 6181 - protein, 10 aa, Artificial Sequence
  source: /note="Description of Artificial Sequence: Synthetic peptide"
DICFNLMAVV

SEQ ID NO: 6182 - protein, 10 aa, Artificial Sequence
  source: /note="Description of Artificial Sequence: Synthetic peptide"
EPYHDICFNL

SEQ ID NO: 6183 - protein, 10 aa, Artificial Sequence
  source: /note="Description of Artificial Sequence: Synthetic peptide"
HDICFNLMAV

SEQ ID NO: 6184 - protein, 9 aa, Artificial Sequence
  source: /note="Description of Artificial Sequence: Synthetic peptide"
TGSPSLPAY

SEQ ID NO: 6185 - protein, 9 aa, Artificial Sequence
  source: /note="Description of Artificial Sequence: Synthetic peptide"
LPAYPLLSV

SEQ ID NO: 6186 - protein, 9 aa, Artificial Sequence
  source: /note="Description of Artificial Sequence: Synthetic peptide"
SPSLPAYPL

SEQ ID NO: 6187 - protein, 10 aa, Artificial Sequence
  source: /note="Description of Artificial Sequence: Synthetic peptide"
CTGSPSLPAY

SEQ ID NO: 6188 - protein, 10 aa, Artificial Sequence
  source: /note="Description of Artificial Sequence: Synthetic peptide"
SLPAYPLLSV

SEQ ID NO: 6189 - protein, 10 aa, Artificial Sequence
  source: /note="Description of Artificial Sequence: Synthetic peptide"
SPSLPAYPLL

SEQ ID NO: 6190 - protein, 10 aa, Artificial Sequence
  source: /note="Description of Artificial Sequence: Synthetic peptide"
LPAYPLLSVI

SEQ ID NO: 6191 - protein, 9 aa, Artificial Sequence
  source: /note="Description of Artificial Sequence: Synthetic peptide"
RMGGGGTRA

SEQ ID NO: 6192 - protein, 9 aa, Artificial Sequence
  source: /note="Description of Artificial Sequence: Synthetic peptide"
GTRAGPGPG

SEQ ID NO: 6193 - protein, 9 aa, Artificial Sequence
  source: /note="Description of Artificial Sequence: Synthetic peptide"
RVSQAHRGR

SEQ ID NO: 6194 - protein, 9 aa, Artificial Sequence
  source: /note="Description of Artificial Sequence: Synthetic peptide"
QEAERVSQA

SEQ ID NO: 6195 - protein, 10 aa, Artificial Sequence
  source: /note="Description of Artificial Sequence: Synthetic peptide"
AGRMGGGGTR

SEQ ID NO: 6196 - protein, 10 aa, Artificial Sequence
  source: /note="Description of Artificial Sequence: Synthetic peptide"
GTRAGPGPGA

SEQ ID NO: 6197 - protein, 10 aa, Artificial Sequence
  source: /note="Description of Artificial Sequence: Synthetic peptide"
RMGGGGTRAG

SEQ ID NO: 6198 - protein, 10 aa, Artificial Sequence
  source: /note="Description of Artificial Sequence: Synthetic peptide"
HQEAERVSQA

SEQ ID NO: 6199 - protein, 10 aa, Artificial Sequence
  source: /note="Description of Artificial Sequence: Synthetic peptide"
QEAERVSQAH

SEQ ID NO: 6200 - protein, 9 aa, Artificial Sequence
  source: /note="Description of Artificial Sequence: Synthetic peptide"
RMGFLYLTV

SEQ ID NO: 6201 - protein, 9 aa, Artificial Sequence
  source: /note="Description of Artificial Sequence: Synthetic peptide"
TVYGHTWQV

SEQ ID NO: 6202 - protein, 9 aa, Artificial Sequence
  source: /note="Description of Artificial Sequence: Synthetic peptide"
YLTVYGHTW

SEQ ID NO: 6203 - protein, 9 aa, Artificial Sequence
  source: /note="Description of Artificial Sequence: Synthetic peptide"
MGFLYLTVY

SEQ ID NO: 6204 - protein, 10 aa, Artificial Sequence
  source: /note="Description of Artificial Sequence: Synthetic peptide"
FLYLTVYGHT

SEQ ID NO: 6205 - protein, 10 aa, Artificial Sequence
  source: /note="Description of Artificial Sequence: Synthetic peptide"
LTVYGHTWQV

SEQ ID NO: 6206 - protein, 10 aa, Artificial Sequence
  source: /note="Description of Artificial Sequence: Synthetic peptide"
RMGFLYLTVY

SEQ ID NO: 6207 - protein, 10 aa, Artificial Sequence
  source: /note="Description of Artificial Sequence: Synthetic peptide"
LYLTVYGHTW

SEQ ID NO: 6208 - protein, 10 aa, Artificial Sequence
  source: /note="Description of Artificial Sequence: Synthetic peptide"
KRMGFLYLTV

SEQ ID NO: 6209 - protein, 9 aa, Artificial Sequence
  source: /note="Description of Artificial Sequence: Synthetic peptide"
VLGERNFFA

SEQ ID NO: 6210 - protein, 9 aa, Artificial Sequence
  source: /note="Description of Artificial Sequence: Synthetic peptide"
FALRIMDKF

SEQ ID NO: 6211 - protein, 9 aa, Artificial Sequence
  source: /note="Description of Artificial Sequence: Synthetic peptide"
RNFFALRIM

SEQ ID NO: 6212 - protein, 10 aa, Artificial Sequence
  source: /note="Description of Artificial Sequence: Synthetic peptide"
FVLGERNFFA

SEQ ID NO: 6213 - protein, 10 aa, Artificial Sequence
  source: /note="Description of Artificial Sequence: Synthetic peptide"
VLGERNFFAL

SEQ ID NO: 6214 - protein, 10 aa, Artificial Sequence
  source: /note="Description of Artificial Sequence: Synthetic peptide"
NFFALRIMDK

SEQ ID NO: 6215 - protein, 10 aa, Artificial Sequence
  source: /note="Description of Artificial Sequence: Synthetic peptide"
FFALRIMDKF

SEQ ID NO: 6216 - protein, 10 aa, Artificial Sequence
  source: /note="Description of Artificial Sequence: Synthetic peptide"
GERNFFALRI

SEQ ID NO: 6217 - protein, 10 aa, Artificial Sequence
  source: /note="Description of Artificial Sequence: Synthetic peptide"
ERNFFALRIM

SEQ ID NO: 6218 - protein, 9 aa, Artificial Sequence
  source: /note="Description of Artificial Sequence: Synthetic peptide"
PPVRRVESL

SEQ ID NO: 6219 - protein, 10 aa, Artificial Sequence
  source: /note="Description of Artificial Sequence: Synthetic peptide"
HPPVRRVESL

SEQ ID NO: 6220 - protein, 10 aa, Artificial Sequence
  source: /note="Description of Artificial Sequence: Synthetic peptide"
RRVESLNLPL

SEQ ID NO: 6221 - protein, 9 aa, Artificial Sequence
  source: /note="Description of Artificial Sequence: Synthetic peptide"
CTFMKKFFV

SEQ ID NO: 6222 - protein, 9 aa, Artificial Sequence
  source: /note="Description of Artificial Sequence: Synthetic peptide"
AFDSCTFMK

SEQ ID NO: 6223 - protein, 9 aa, Artificial Sequence
  source: /note="Description of Artificial Sequence: Synthetic peptide"
TFMKKFFVT

SEQ ID NO: 6224 - protein, 9 aa, Artificial Sequence
  source: /note="Description of Artificial Sequence: Synthetic peptide"
AAFDSCTFM

SEQ ID NO: 6225 - protein, 9 aa, Artificial Sequence
  source: /note="Description of Artificial Sequence: Synthetic peptide"
FMKKFFVTS

SEQ ID NO: 6226 - protein, 9 aa, Artificial Sequence
  source: /note="Description of Artificial Sequence: Synthetic peptide"
MKKFFVTSC

SEQ ID NO: 6227 - protein, 10 aa, Artificial Sequence
  source: /note="Description of Artificial Sequence: Synthetic peptide"
FMKKFFVTSC

SEQ ID NO: 6228 - protein, 10 aa, Artificial Sequence
  source: /note="Description of Artificial Sequence: Synthetic peptide"
AAFDSCTFMK

SEQ ID NO: 6229 - protein, 10 aa, Artificial Sequence
  source: /note="Description of Artificial Sequence: Synthetic peptide"
AFDSCTFMKK

SEQ ID NO: 6230 - protein, 10 aa, Artificial Sequence
  source: /note="Description of Artificial Sequence: Synthetic peptide"
MKKFFVTSCY

SEQ ID NO: 6231 - protein, 10 aa, Artificial Sequence
  source: /note="Description of Artificial Sequence: Synthetic peptide"
IAAFDSCTFM

SEQ ID NO: 6232 - protein, 10 aa, Artificial Sequence
  source: /note="Description of Artificial Sequence: Synthetic peptide"
FDSCTFMKKF

SEQ ID NO: 6233 - protein, 9 aa, Artificial Sequence
  source: /note="Description of Artificial Sequence: Synthetic peptide"
SSSSFHLWM

SEQ ID NO: 6234 - protein, 9 aa, Artificial Sequence
  source: /note="Description of Artificial Sequence: Synthetic peptide"
RSHPPGSSS

SEQ ID NO: 6235 - protein, 9 aa, Artificial Sequence
  source: /note="Description of Artificial Sequence: Synthetic peptide"
HPPGSSSSF

SEQ ID NO: 6236 - protein, 9 aa, Artificial Sequence
  source: /note="Description of Artificial Sequence: Synthetic peptide"
SSQGPRRSL

SEQ ID NO: 6237 - protein, 9 aa, Artificial Sequence
  source: /note="Description of Artificial Sequence: Synthetic peptide"
GSSSSFHLW

SEQ ID NO: 6238 - protein, 9 aa, Artificial Sequence
  source: /note="Description of Artificial Sequence: Synthetic peptide"
FHLWMTSPS

SEQ ID NO: 6239 - protein, 9 aa, Artificial Sequence
  source: /note="Description of Artificial Sequence: Synthetic peptide"
WMTSPSSQG

SEQ ID NO: 6240 - protein, 10 aa, Artificial Sequence
  source: /note="Description of Artificial Sequence: Synthetic peptide"
MTSPSSQGPR

SEQ ID NO: 6241 - protein, 10 aa, Artificial Sequence
  source: /note="Description of Artificial Sequence: Synthetic peptide"
RGLARSHPPG

SEQ ID NO: 6242 - protein, 10 aa, Artificial Sequence
  source: /note="Description of Artificial Sequence: Synthetic peptide"
RSHPPGSSSS

SEQ ID NO: 6243 - protein, 10 aa, Artificial Sequence
  source: /note="Description of Artificial Sequence: Synthetic peptide"
SHPPGSSSSF

SEQ ID NO: 6244 - protein, 10 aa, Artificial Sequence
  source: /note="Description of Artificial Sequence: Synthetic peptide"
GSSSSFHLWM

SEQ ID NO: 6245 - protein, 10 aa, Artificial Sequence
  source: /note="Description of Artificial Sequence: Synthetic peptide"
FHLWMTSPSS

SEQ ID NO: 6246 - protein, 9 aa, Artificial Sequence
  source: /note="Description of Artificial Sequence: Synthetic peptide"
SLCVGLGIK

SEQ ID NO: 6247 - protein, 9 aa, Artificial Sequence
  source: /note="Description of Artificial Sequence: Synthetic peptide"
CVGLGIKEK

SEQ ID NO: 6248 - protein, 9 aa, Artificial Sequence
  source: /note="Description of Artificial Sequence: Synthetic peptide"
KQRAIYLRR

SEQ ID NO: 6249 - protein, 9 aa, Artificial Sequence
  source: /note="Description of Artificial Sequence: Synthetic peptide"
IYLRREGGR

SEQ ID NO: 6250 - protein, 9 aa, Artificial Sequence
  source: /note="Description of Artificial Sequence: Synthetic peptide"
APQKQRAIY

SEQ ID NO: 6251 - protein, 10 aa, Artificial Sequence
  source: /note="Description of Artificial Sequence: Synthetic peptide"
KVSLCVGLGI

SEQ ID NO: 6252 - protein, 10 aa, Artificial Sequence
  source: /note="Description of Artificial Sequence: Synthetic peptide"
VSLCVGLGIK

SEQ ID NO: 6253 - protein, 10 aa, Artificial Sequence
  source: /note="Description of Artificial Sequence: Synthetic peptide"
GIKEKNAPQK

SEQ ID NO: 6254 - protein, 10 aa, Artificial Sequence
  source: /note="Description of Artificial Sequence: Synthetic peptide"
KQRAIYLRRE

SEQ ID NO: 6255 - protein, 10 aa, Artificial Sequence
  source: /note="Description of Artificial Sequence: Synthetic peptide"
AIYLRREGGR

SEQ ID NO: 6256 - protein, 10 aa, Artificial Sequence
  source: /note="Description of Artificial Sequence: Synthetic peptide"
APQKQRAIYL

SEQ ID NO: 6257 - protein, 9 aa, Artificial Sequence
  source: /note="Description of Artificial Sequence: Synthetic peptide"
HLAEAKGHR

SEQ ID NO: 6258 - protein, 9 aa, Artificial Sequence
  source: /note="Description of Artificial Sequence: Synthetic peptide"
AEAKGHRDT

SEQ ID NO: 6259 - protein, 9 aa, Artificial Sequence
  source: /note="Description of Artificial Sequence: Synthetic peptide"
LVDSIALWM

SEQ ID NO: 6260 - protein, 9 aa, Artificial Sequence
  source: /note="Description of Artificial Sequence: Synthetic peptide"
SIALWMTEY

SEQ ID NO: 6261 - protein, 9 aa, Artificial Sequence
  source: /note="Description of Artificial Sequence: Synthetic peptide"
EMSPLVDSI

SEQ ID NO: 6262 - protein, 9 aa, Artificial Sequence
  source: /note="Description of Artificial Sequence: Synthetic peptide"
MSPLVDSIA

SEQ ID NO: 6263 - protein, 9 aa, Artificial Sequence
  source: /note="Description of Artificial Sequence: Synthetic peptide"
SPLVDSIAL

SEQ ID NO: 6264 - protein, 9 aa, Artificial Sequence
  source: /note="Description of Artificial Sequence: Synthetic peptide"
REMSPLVDS

SEQ ID NO: 6265 - protein, 10 aa, Artificial Sequence
  source: /note="Description of Artificial Sequence: Synthetic peptide"
DSIALWMTEY

SEQ ID NO: 6266 - protein, 10 aa, Artificial Sequence
  source: /note="Description of Artificial Sequence: Synthetic peptide"
SIALWMTEYL

SEQ ID NO: 6267 - protein, 10 aa, Artificial Sequence
  source: /note="Description of Artificial Sequence: Synthetic peptide"
MSPLVDSIAL

SEQ ID NO: 6268 - protein, 10 aa, Artificial Sequence
  source: /note="Description of Artificial Sequence: Synthetic peptide"
REMSPLVDSI

SEQ ID NO: 6269 - protein, 10 aa, Artificial Sequence
  source: /note="Description of Artificial Sequence: Synthetic peptide"
SPLVDSIALW

SEQ ID NO: 6270 - protein, 9 aa, Artificial Sequence
  source: /note="Description of Artificial Sequence: Synthetic peptide"
VMKYIQYKL

SEQ ID NO: 6271 - protein, 9 aa, Artificial Sequence
  source: /note="Description of Artificial Sequence: Synthetic peptide"
IVMKYIQYK

SEQ ID NO: 6272 - protein, 9 aa, Artificial Sequence
  source: /note="Description of Artificial Sequence: Synthetic peptide"
YIQYKLSQR

SEQ ID NO: 6273 - protein, 9 aa, Artificial Sequence
  source: /note="Description of Artificial Sequence: Synthetic peptide"
IQYKLSQRG

SEQ ID NO: 6274 - protein, 9 aa, Artificial Sequence
  source: /note="Description of Artificial Sequence: Synthetic peptide"
REIVMKYIQ

SEQ ID NO: 6275 - protein, 10 aa, Artificial Sequence
  source: /note="Description of Artificial Sequence: Synthetic peptide"
IVMKYIQYKL

SEQ ID NO: 6276 - protein, 10 aa, Artificial Sequence
  source: /note="Description of Artificial Sequence: Synthetic peptide"
EIVMKYIQYK

SEQ ID NO: 6277 - protein, 10 aa, Artificial Sequence
  source: /note="Description of Artificial Sequence: Synthetic peptide"
IQYKLSQRGY

SEQ ID NO: 6278 - protein, 10 aa, Artificial Sequence
  source: /note="Description of Artificial Sequence: Synthetic peptide"
KYIQYKLSQR

SEQ ID NO: 6279 - protein, 10 aa, Artificial Sequence
  source: /note="Description of Artificial Sequence: Synthetic peptide"
REIVMKYIQY

SEQ ID NO: 6280 - protein, 9 aa, Artificial Sequence
  source: /note="Description of Artificial Sequence: Synthetic peptide"
YEWDARDVG

SEQ ID NO: 6281 - protein, 10 aa, Artificial Sequence
  source: /note="Description of Artificial Sequence: Synthetic peptide"
SQRGYEWDAR

SEQ ID NO: 6282 - protein, 10 aa, Artificial Sequence
  source: /note="Description of Artificial Sequence: Synthetic peptide"
YEWDARDVGA

SEQ ID NO: 6283 - protein, 9 aa, Artificial Sequence
  source: /note="Description of Artificial Sequence: Synthetic peptide"
QSSSGYFSF

SEQ ID NO: 6284 - protein, 9 aa, Artificial Sequence
  source: /note="Description of Artificial Sequence: Synthetic peptide"
LLSQSSSGY

SEQ ID NO: 6285 - protein, 9 aa, Artificial Sequence
  source: /note="Description of Artificial Sequence: Synthetic peptide"
LSQSSSGYF

SEQ ID NO: 6286 - protein, 9 aa, Artificial Sequence
  source: /note="Description of Artificial Sequence: Synthetic peptide"
SQSSSGYFS

SEQ ID NO: 6287 - protein, 10 aa, Artificial Sequence
  source: /note="Description of Artificial Sequence: Synthetic peptide"
SQSSSGYFSF

SEQ ID NO: 6288 - protein, 10 aa, Artificial Sequence
  source: /note="Description of Artificial Sequence: Synthetic peptide"
SLLSQSSSGY

SEQ ID NO: 6289 - protein, 10 aa, Artificial Sequence
  source: /note="Description of Artificial Sequence: Synthetic peptide"
LLSQSSSGYF

SEQ ID NO: 6290 - protein, 10 aa, Artificial Sequence
  source: /note="Description of Artificial Sequence: Synthetic peptide"
FMRRSSLLSQ

SEQ ID NO: 6291 - protein, 9 aa, Artificial Sequence
  source: /note="Description of Artificial Sequence: Synthetic peptide"
STAVSWCHY

SEQ ID NO: 6292 - protein, 9 aa, Artificial Sequence
  source: /note="Description of Artificial Sequence: Synthetic peptide"
TAVSWCHYY

SEQ ID NO: 6293 - protein, 9 aa, Artificial Sequence
  source: /note="Description of Artificial Sequence: Synthetic peptide"
ELDGTTFLF

SEQ ID NO: 6294 - protein, 9 aa, Artificial Sequence
  source: /note="Description of Artificial Sequence: Synthetic peptide"
LTLHCPPGV

SEQ ID NO: 6295 - protein, 9 aa, Artificial Sequence
  source: /note="Description of Artificial Sequence: Synthetic peptide"
AVSWCHYYA

SEQ ID NO: 6296 - protein, 9 aa, Artificial Sequence
  source: /note="Description of Artificial Sequence: Synthetic peptide"
SLVEGAGDV

SEQ ID NO: 6297 - protein, 9 aa, Artificial Sequence
  source: /note="Description of Artificial Sequence: Synthetic peptide"
MVILRLLTL

SEQ ID NO: 6298 - protein, 9 aa, Artificial Sequence
  source: /note="Description of Artificial Sequence: Synthetic peptide"
TMQTFCLFK

SEQ ID NO: 6299 - protein, 9 aa, Artificial Sequence
  source: /note="Description of Artificial Sequence: Synthetic peptide"
DTMQTFCLF

SEQ ID NO: 6300 - protein, 9 aa, Artificial Sequence
  source: /note="Description of Artificial Sequence: Synthetic peptide"
HYYAASGSL

SEQ ID NO: 6301 - protein, 9 aa, Artificial Sequence
  source: /note="Description of Artificial Sequence: Synthetic peptide"
YYAASGSLV

SEQ ID NO: 6302 - protein, 9 aa, Artificial Sequence
  source: /note="Description of Artificial Sequence: Synthetic peptide"
LFITTQQNF

SEQ ID NO: 6303 - protein, 9 aa, Artificial Sequence
  source: /note="Description of Artificial Sequence: Synthetic peptide"
RSRDTMQTF

SEQ ID NO: 6304 - protein, 9 aa, Artificial Sequence
  source: /note="Description of Artificial Sequence: Synthetic peptide"
LFKPTRPST

SEQ ID NO: 6305 - protein, 9 aa, Artificial Sequence
  source: /note="Description of Artificial Sequence: Synthetic peptide"
VSWCHYYAA

SEQ ID NO: 6306 - protein, 9 aa, Artificial Sequence
  source: /note="Description of Artificial Sequence: Synthetic peptide"
TFCLFKPTR

SEQ ID NO: 6307 - protein, 9 aa, Artificial Sequence
  source: /note="Description of Artificial Sequence: Synthetic peptide"
CPPGVENAL

SEQ ID NO: 6308 - protein, 9 aa, Artificial Sequence
  source: /note="Description of Artificial Sequence: Synthetic peptide"
KPTRPSTAV

SEQ ID NO: 6309 - protein, 9 aa, Artificial Sequence
  source: /note="Description of Artificial Sequence: Synthetic peptide"
RMVILRLLT

SEQ ID NO: 6310 - protein, 9 aa, Artificial Sequence
  source: /note="Description of Artificial Sequence: Synthetic peptide"
VENALTGSL

SEQ ID NO: 6311 - protein, 9 aa, Artificial Sequence
  source: /note="Description of Artificial Sequence: Synthetic peptide"
GSLRSRDTM

SEQ ID NO: 6312 - protein, 9 aa, Artificial Sequence
  source: /note="Description of Artificial Sequence: Synthetic peptide"
TELDGTTFL

SEQ ID NO: 6313 - protein, 10 aa, Artificial Sequence
  source: /note="Description of Artificial Sequence: Synthetic peptide"
STAVSWCHYY

SEQ ID NO: 6314 - protein, 10 aa, Artificial Sequence
  source: /note="Description of Artificial Sequence: Synthetic peptide"
ELDGTTFLFI

SEQ ID NO: 6315 - protein, 10 aa, Artificial Sequence
  source: /note="Description of Artificial Sequence: Synthetic peptide"
RMVILRLLTL

SEQ ID NO: 6316 - protein, 10 aa, Artificial Sequence
  source: /note="Description of Artificial Sequence: Synthetic peptide"
LLTLHCPPGV

SEQ ID NO: 6317 - protein, 10 aa, Artificial Sequence
  source: /note="Description of Artificial Sequence: Synthetic peptide"
AVSWCHYYAA

SEQ ID NO: 6318 - protein, 10 aa, Artificial Sequence
  source: /note="Description of Artificial Sequence: Synthetic peptide"
FLFITTQQNF

SEQ ID NO: 6319 - protein, 10 aa, Artificial Sequence
  source: /note="Description of Artificial Sequence: Synthetic peptide"
DTMQTFCLFK

SEQ ID NO: 6320 - protein, 10 aa, Artificial Sequence
  source: /note="Description of Artificial Sequence: Synthetic peptide"
QTFCLFKPTR

SEQ ID NO: 6321 - protein, 10 aa, Artificial Sequence
  source: /note="Description of Artificial Sequence: Synthetic peptide"
HYYAASGSLV

SEQ ID NO: 6322 - protein, 10 aa, Artificial Sequence
  source: /note="Description of Artificial Sequence: Synthetic peptide"
TELDGTTFLF

SEQ ID NO: 6323 - protein, 10 aa, Artificial Sequence
  source: /note="Description of Artificial Sequence: Synthetic peptide"
RSRDTMQTFC

SEQ ID NO: 6324 - protein, 10 aa, Artificial Sequence
  source: /note="Description of Artificial Sequence: Synthetic peptide"
LFKPTRPSTA

SEQ ID NO: 6325 - protein, 10 aa, Artificial Sequence
  source: /note="Description of Artificial Sequence: Synthetic peptide"
PSTAVSWCHY

SEQ ID NO: 6326 - protein, 10 aa, Artificial Sequence
  source: /note="Description of Artificial Sequence: Synthetic peptide"
NALTGSLRSR

SEQ ID NO: 6327 - protein, 10 aa, Artificial Sequence
  source: /note="Description of Artificial Sequence: Synthetic peptide"
TAVSWCHYYA

SEQ ID NO: 6328 - protein, 10 aa, Artificial Sequence
  source: /note="Description of Artificial Sequence: Synthetic peptide"
LRSRDTMQTF

SEQ ID NO: 6329 - protein, 10 aa, Artificial Sequence
  source: /note="Description of Artificial Sequence: Synthetic peptide"
RDTMQTFCLF

SEQ ID NO: 6330 - protein, 10 aa, Artificial Sequence
  source: /note="Description of Artificial Sequence: Synthetic peptide"
MQTFCLFKPT

SEQ ID NO: 6331 - protein, 10 aa, Artificial Sequence
  source: /note="Description of Artificial Sequence: Synthetic peptide"
CHYYAASGSL

SEQ ID NO: 6332 - protein, 9 aa, Artificial Sequence
  source: /note="Description of Artificial Sequence: Synthetic peptide"
RIYKWVPVM

SEQ ID NO: 6333 - protein, 9 aa, Artificial Sequence
  source: /note="Description of Artificial Sequence: Synthetic peptide"
KWVPVMEPK

SEQ ID NO: 6334 - protein, 10 aa, Artificial Sequence
  source: /note="Description of Artificial Sequence: Synthetic peptide"
LRIYKWVPVM

SEQ ID NO: 6335 - protein, 9 aa, Artificial Sequence
  source: /note="Description of Artificial Sequence: Synthetic peptide"
QVLCSSLSV

SEQ ID NO: 6336 - protein, 9 aa, Artificial Sequence
  source: /note="Description of Artificial Sequence: Synthetic peptide"
SPQVLCSSL

SEQ ID NO: 6337 - protein, 10 aa, Artificial Sequence
  source: /note="Description of Artificial Sequence: Synthetic peptide"
QVLCSSLSVR

SEQ ID NO: 6338 - protein, 9 aa, Artificial Sequence
  source: /note="Description of Artificial Sequence: Synthetic peptide"
LLPPPTTTA

SEQ ID NO: 6339 - protein, 9 aa, Artificial Sequence
  source: /note="Description of Artificial Sequence: Synthetic peptide"
RARDQQQPA

SEQ ID NO: 6340 - protein, 9 aa, Artificial Sequence
  source: /note="Description of Artificial Sequence: Synthetic peptide"
LSRCPEPYG

SEQ ID NO: 6341 - protein, 9 aa, Artificial Sequence
  source: /note="Description of Artificial Sequence: Synthetic peptide"
ELSRCPEPY

SEQ ID NO: 6342 - protein, 9 aa, Artificial Sequence
  source: /note="Description of Artificial Sequence: Synthetic peptide"
TTTAGLRAR

SEQ ID NO: 6343 - protein, 9 aa, Artificial Sequence
  source: /note="Description of Artificial Sequence: Synthetic peptide"
EPARPAAPV

SEQ ID NO: 6344 - protein, 10 aa, Artificial Sequence
  source: /note="Description of Artificial Sequence: Synthetic peptide"
RPLLPPPTTT

SEQ ID NO: 6345 - protein, 10 aa, Artificial Sequence
  source: /note="Description of Artificial Sequence: Synthetic peptide"
LPPPTTTAGL

SEQ ID NO: 6346 - protein, 10 aa, Artificial Sequence
  source: /note="Description of Artificial Sequence: Synthetic peptide"
QPAQPDAPEL

SEQ ID NO: 6347 - protein, 10 aa, Artificial Sequence
  source: /note="Description of Artificial Sequence: Synthetic peptide"
YGHEPARPAA

SEQ ID NO: 6348 - protein, 10 aa, Artificial Sequence
  source: /note="Description of Artificial Sequence: Synthetic peptide"
HEPARPAAPV

SEQ ID NO: 6349 - protein, 9 aa, Artificial Sequence
  source: /note="Description of Artificial Sequence: Synthetic peptide"
LVVEIVCIL

SEQ ID NO: 6350 - protein, 9 aa, Artificial Sequence
  source: /note="Description of Artificial Sequence: Synthetic peptide"
CILEIIVAI

SEQ ID NO: 6351 - protein, 9 aa, Artificial Sequence
  source: /note="Description of Artificial Sequence: Synthetic peptide"
IIVAITEII

SEQ ID NO: 6352 - protein, 9 aa, Artificial Sequence
  source: /note="Description of Artificial Sequence: Synthetic peptide"
LVPEHIQGL

SEQ ID NO: 6353 - protein, 9 aa, Artificial Sequence
  source: /note="Description of Artificial Sequence: Synthetic peptide"
HIQGLVVEI

SEQ ID NO: 6354 - protein, 9 aa, Artificial Sequence
  source: /note="Description of Artificial Sequence: Synthetic peptide"
GLVVEIVCI

SEQ ID NO: 6355 - protein, 9 aa, Artificial Sequence
  source: /note="Description of Artificial Sequence: Synthetic peptide"
EIVCILEII

SEQ ID NO: 6356 - protein, 9 aa, Artificial Sequence
  source: /note="Description of Artificial Sequence: Synthetic peptide"
EIIVAITEI

SEQ ID NO: 6357 - protein, 9 aa, Artificial Sequence
  source: /note="Description of Artificial Sequence: Synthetic peptide"
SRKKRYSST

SEQ ID NO: 6358 - protein, 9 aa, Artificial Sequence
  source: /note="Description of Artificial Sequence: Synthetic peptide"
KKRYSSTGL

SEQ ID NO: 6359 - protein, 9 aa, Artificial Sequence
  source: /note="Description of Artificial Sequence: Synthetic peptide"
KRYSSTGLV

SEQ ID NO: 6360 - protein, 9 aa, Artificial Sequence
  source: /note="Description of Artificial Sequence: Synthetic peptide"
VEIVCILEI

SEQ ID NO: 6361 - protein, 9 aa, Artificial Sequence
  source: /note="Description of Artificial Sequence: Synthetic peptide"
VPEHIQGLV

SEQ ID NO: 6362 - protein, 10 aa, Artificial Sequence
  source: /note="Description of Artificial Sequence: Synthetic peptide"
GLVPEHIQGL

SEQ ID NO: 6363 - protein, 10 aa, Artificial Sequence
  source: /note="Description of Artificial Sequence: Synthetic peptide"
LVPEHIQGLV

SEQ ID NO: 6364 - protein, 10 aa, Artificial Sequence
  source: /note="Description of Artificial Sequence: Synthetic peptide"
HIQGLVVEIV

SEQ ID NO: 6365 - protein, 10 aa, Artificial Sequence
  source: /note="Description of Artificial Sequence: Synthetic peptide"
GLVVEIVCIL

SEQ ID NO: 6366 - protein, 10 aa, Artificial Sequence
  source: /note="Description of Artificial Sequence: Synthetic peptide"
HSRKKRYSST

SEQ ID NO: 6367 - protein, 10 aa, Artificial Sequence
  source: /note="Description of Artificial Sequence: Synthetic peptide"
KKRYSSTGLV

SEQ ID NO: 6368 - protein, 10 aa, Artificial Sequence
  source: /note="Description of Artificial Sequence: Synthetic peptide"
EIVCILEIIV

SEQ ID NO: 6369 - protein, 10 aa, Artificial Sequence
  source: /note="Description of Artificial Sequence: Synthetic peptide"
EIIVAITEII

SEQ ID NO: 6370 - protein, 10 aa, Artificial Sequence
  source: /note="Description of Artificial Sequence: Synthetic peptide"
VPEHIQGLVV

SEQ ID NO: 6371 - protein, 10 aa, Artificial Sequence
  source: /note="Description of Artificial Sequence: Synthetic peptide"
RKKRYSSTGL

SEQ ID NO: 6372 - protein, 10 aa, Artificial Sequence
  source: /note="Description of Artificial Sequence: Synthetic peptide"
LEIIVAITEI

SEQ ID NO: 6373 - protein, 10 aa, Artificial Sequence
  source: /note="Description of Artificial Sequence: Synthetic peptide"
VEIVCILEII

SEQ ID NO: 6374 - protein, 9 aa, Artificial Sequence
  source: /note="Description of Artificial Sequence: Synthetic peptide"
EARRLIVSK

SEQ ID NO: 6375 - protein, 9 aa, Artificial Sequence
  source: /note="Description of Artificial Sequence: Synthetic peptide"
VSKNAGETL

SEQ ID NO: 6376 - protein, 9 aa, Artificial Sequence
  source: /note="Description of Artificial Sequence: Synthetic peptide"
SKNAGETLL

SEQ ID NO: 6377 - protein, 9 aa, Artificial Sequence
  source: /note="Description of Artificial Sequence: Synthetic peptide"
DQNKMAALR

SEQ ID NO: 6378 - protein, 9 aa, Artificial Sequence
  source: /note="Description of Artificial Sequence: Synthetic peptide"
SQSLDQNKM

SEQ ID NO: 6379 - protein, 10 aa, Artificial Sequence
  source: /note="Description of Artificial Sequence: Synthetic peptide"
SLDQNKMAAL

SEQ ID NO: 6380 - protein, 9 aa, Artificial Sequence
  source: /note="Description of Artificial Sequence: Synthetic peptide"
PMNNSKMRK

SEQ ID NO: 6381 - protein, 9 aa, Artificial Sequence
  source: /note="Description of Artificial Sequence: Synthetic peptide"
MNNSKMRKK

SEQ ID NO: 6382 - protein, 9 aa, Artificial Sequence
  source: /note="Description of Artificial Sequence: Synthetic peptide"
KMRKKRNLQ

SEQ ID NO: 6383 - protein, 9 aa, Artificial Sequence
  source: /note="Description of Artificial Sequence: Synthetic peptide"
SKMRKKRNL

SEQ ID NO: 6384 - protein, 10 aa, Artificial Sequence
  source: /note="Description of Artificial Sequence: Synthetic peptide"
KMRKKRNLQP

SEQ ID NO: 6385 - protein, 10 aa, Artificial Sequence
  source: /note="Description of Artificial Sequence: Synthetic peptide"
MNNSKMRKKR

SEQ ID NO: 6386 - protein, 10 aa, Artificial Sequence
  source: /note="Description of Artificial Sequence: Synthetic peptide"
NSKMRKKRNL

SEQ ID NO: 6387 - protein, 9 aa, Artificial Sequence
  source: /note="Description of Artificial Sequence: Synthetic peptide"
SLSGGTWPA

SEQ ID NO: 6388 - protein, 9 aa, Artificial Sequence
  source: /note="Description of Artificial Sequence: Synthetic peptide"
TMWRSTTPR

SEQ ID NO: 6389 - protein, 9 aa, Artificial Sequence
  source: /note="Description of Artificial Sequence: Synthetic peptide"
GAAVPVALR

SEQ ID NO: 6390 - protein, 9 aa, Artificial Sequence
  source: /note="Description of Artificial Sequence: Synthetic peptide"
CSSSATMWR

SEQ ID NO: 6391 - protein, 9 aa, Artificial Sequence
  source: /note="Description of Artificial Sequence: Synthetic peptide"
TSPGAAVPV

SEQ ID NO: 6392 - protein, 9 aa, Artificial Sequence
  source: /note="Description of Artificial Sequence: Synthetic peptide"
VPVALRPSA

SEQ ID NO: 6393 - protein, 9 aa, Artificial Sequence
  source: /note="Description of Artificial Sequence: Synthetic peptide"
RPSASWSRC

SEQ ID NO: 6394 - protein, 9 aa, Artificial Sequence
  source: /note="Description of Artificial Sequence: Synthetic peptide"
CTCSSSATM

SEQ ID NO: 6395 - protein, 9 aa, Artificial Sequence
  source: /note="Description of Artificial Sequence: Synthetic peptide"
DQSLSGGTW

SEQ ID NO: 6396 - protein, 9 aa, Artificial Sequence
  source: /note="Description of Artificial Sequence: Synthetic peptide"
VALRPSASW

SEQ ID NO: 6397 - protein, 9 aa, Artificial Sequence
  source: /note="Description of Artificial Sequence: Synthetic peptide"
WPAACWCSS

SEQ ID NO: 6398 - protein, 10 aa, Artificial Sequence
  source: /note="Description of Artificial Sequence: Synthetic peptide"
SLSGGTWPAA

SEQ ID NO: 6399 - protein, 10 aa, Artificial Sequence
  source: /note="Description of Artificial Sequence: Synthetic peptide"
ATWTSPGAAV

SEQ ID NO: 6400 - protein, 10 aa, Artificial Sequence
  source: /note="Description of Artificial Sequence: Synthetic peptide"
WTSPGAAVPV

SEQ ID NO: 6401 - protein, 10 aa, Artificial Sequence
  source: /note="Description of Artificial Sequence: Synthetic peptide"
ALRPSASWSR

SEQ ID NO: 6402 - protein, 10 aa, Artificial Sequence
  source: /note="Description of Artificial Sequence: Synthetic peptide"
ATMWRSTTPR

SEQ ID NO: 6403 - protein, 10 aa, Artificial Sequence
  source: /note="Description of Artificial Sequence: Synthetic peptide"
WSRCTCSSSA

SEQ ID NO: 6404 - protein, 10 aa, Artificial Sequence
  source: /note="Description of Artificial Sequence: Synthetic peptide"
SSATWTSPGA

SEQ ID NO: 6405 - protein, 10 aa, Artificial Sequence
  source: /note="Description of Artificial Sequence: Synthetic peptide"
SPGAAVPVAL

SEQ ID NO: 6406 - protein, 10 aa, Artificial Sequence
  source: /note="Description of Artificial Sequence: Synthetic peptide"
RPSASWSRCT

SEQ ID NO: 6407 - protein, 10 aa, Artificial Sequence
  source: /note="Description of Artificial Sequence: Synthetic peptide"
SSSPSSSATW

SEQ ID NO: 6408 - protein, 10 aa, Artificial Sequence
  source: /note="Description of Artificial Sequence: Synthetic peptide"
RCTCSSSATM

SEQ ID NO: 6409 - protein, 10 aa, Artificial Sequence
  source: /note="Description of Artificial Sequence: Synthetic peptide"
WPAACWCSSS

SEQ ID NO: 6410 - protein, 9 aa, Artificial Sequence
  source: /note="Description of Artificial Sequence: Synthetic peptide"
QQQEEMCHL

SEQ ID NO: 6411 - protein, 10 aa, Artificial Sequence
  source: /note="Description of Artificial Sequence: Synthetic peptide"
YQQQQEEMCH

SEQ ID NO: 6412 - protein, 10 aa, Artificial Sequence
  source: /note="Description of Artificial Sequence: Synthetic peptide"
QQQQEEMCHL

SEQ ID NO: 6413 - protein, 10 aa, Artificial Sequence
  source: /note="Description of Artificial Sequence: Synthetic peptide"
EEMCHLQQEL

SEQ ID NO: 6414 - protein, 9 aa, Artificial Sequence
  source: /note="Description of Artificial Sequence: Synthetic peptide"
KMEDIKILL

SEQ ID NO: 6415 - protein, 9 aa, Artificial Sequence
  source: /note="Description of Artificial Sequence: Synthetic peptide"
WKMEDIKIL

SEQ ID NO: 6416 - protein, 9 aa, Artificial Sequence
  source: /note="Description of Artificial Sequence: Synthetic peptide"
KILLPQPQF

SEQ ID NO: 6417 - protein, 10 aa, Artificial Sequence
  source: /note="Description of Artificial Sequence: Synthetic peptide"
LLPQPQFQCA

SEQ ID NO: 6418 - protein, 10 aa, Artificial Sequence
  source: /note="Description of Artificial Sequence: Synthetic peptide"
WKMEDIKILL

SEQ ID NO: 6419 - protein, 10 aa, Artificial Sequence
  source: /note="Description of Artificial Sequence: Synthetic peptide"
IKILLPQPQF

SEQ ID NO: 6420 - protein, 9 aa, Artificial Sequence
  source: /note="Description of Artificial Sequence: Synthetic peptide"
HLEEILLPR

SEQ ID NO: 6421 - protein, 9 aa, Artificial Sequence
  source: /note="Description of Artificial Sequence: Synthetic peptide"
LPRRKPHAA

SEQ ID NO: 6422 - protein, 9 aa, Artificial Sequence
  source: /note="Description of Artificial Sequence: Synthetic peptide"
AALQHGRAV

SEQ ID NO: 6423 - protein, 9 aa, Artificial Sequence
  source: /note="Description of Artificial Sequence: Synthetic peptide"
FPHQNATGT

SEQ ID NO: 6424 - protein, 9 aa, Artificial Sequence
  source: /note="Description of Artificial Sequence: Synthetic peptide"
LQHGRAVHH

SEQ ID NO: 6425 - protein, 9 aa, Artificial Sequence
  source: /note="Description of Artificial Sequence: Synthetic peptide"
CENFPHQNA

SEQ ID NO: 6426 - protein, 10 aa, Artificial Sequence
  source: /note="Description of Artificial Sequence: Synthetic peptide"
LLPRRKPHAA

SEQ ID NO: 6427 - protein, 10 aa, Artificial Sequence
  source: /note="Description of Artificial Sequence: Synthetic peptide"
HLEEILLPRR

SEQ ID NO: 6428 - protein, 10 aa, Artificial Sequence
  source: /note="Description of Artificial Sequence: Synthetic peptide"
HAALQHGRAV

SEQ ID NO: 6429 - protein, 10 aa, Artificial Sequence
  source: /note="Description of Artificial Sequence: Synthetic peptide"
VPSRNPPQGL

SEQ ID NO: 6430 - protein, 10 aa, Artificial Sequence
  source: /note="Description of Artificial Sequence: Synthetic peptide"
LPRRKPHAAL

SEQ ID NO: 6431 - protein, 10 aa, Artificial Sequence
  source: /note="Description of Artificial Sequence: Synthetic peptide"
AALQHGRAVH

SEQ ID NO: 6432 - protein, 10 aa, Artificial Sequence
  source: /note="Description of Artificial Sequence: Synthetic peptide"
LQHGRAVHHQ

SEQ ID NO: 6433 - protein, 10 aa, Artificial Sequence
  source: /note="Description of Artificial Sequence: Synthetic peptide"
HQGDQPDKHF

SEQ ID NO: 6434 - protein, 10 aa, Artificial Sequence
  source: /note="Description of Artificial Sequence: Synthetic peptide"
KHFTEPDPTV

SEQ ID NO: 6435 - protein, 10 aa, Artificial Sequence
  source: /note="Description of Artificial Sequence: Synthetic peptide"
CENFPHQNAT

SEQ ID NO: 6436 - protein, 9 aa, Artificial Sequence
  source: /note="Description of Artificial Sequence: Synthetic peptide"
SPQGCFEPA

SEQ ID NO: 6437 - protein, 9 aa, Artificial Sequence
  source: /note="Description of Artificial Sequence: Synthetic peptide"
SSSSPQGCF

SEQ ID NO: 6438 - protein, 10 aa, Artificial Sequence
  source: /note="Description of Artificial Sequence: Synthetic peptide"
RPASSSSSPQ

SEQ ID NO: 6439 - protein, 10 aa, Artificial Sequence
  source: /note="Description of Artificial Sequence: Synthetic peptide"
SSSSSPQGCF

SEQ ID NO: 6440 - protein, 9 aa, Artificial Sequence
  source: /note="Description of Artificial Sequence: Synthetic peptide"
RGHLRDDIK

SEQ ID NO: 6441 - protein, 9 aa, Artificial Sequence
  source: /note="Description of Artificial Sequence: Synthetic peptide"
HLRDDIKEY

SEQ ID NO: 6442 - protein, 10 aa, Artificial Sequence
  source: /note="Description of Artificial Sequence: Synthetic peptide"
HLRDDIKEYK

SEQ ID NO: 6443 - protein, 10 aa, Artificial Sequence
  source: /note="Description of Artificial Sequence: Synthetic peptide"
NVEIQRGHLR

SEQ ID NO: 6444 - protein, 10 aa, Artificial Sequence
  source: /note="Description of Artificial Sequence: Synthetic peptide"
IQRGHLRDDI

SEQ ID NO: 6445 - protein, 10 aa, Artificial Sequence
  source: /note="Description of Artificial Sequence: Synthetic peptide"
GHLRDDIKEY

SEQ ID NO: 6446 - protein, 9 aa, Artificial Sequence
  source: /note="Description of Artificial Sequence: Synthetic peptide"
KICIWDLSK

SEQ ID NO: 6447 - protein, 10 aa, Artificial Sequence
  source: /note="Description of Artificial Sequence: Synthetic peptide"
CIWDLSKLMK

SEQ ID NO: 6448 - protein, 10 aa, Artificial Sequence
  source: /note="Description of Artificial Sequence: Synthetic peptide"
LSKLMKVHLK

SEQ ID NO: 6449 - protein, 10 aa, Artificial Sequence
  source: /note="Description of Artificial Sequence: Synthetic peptide"
ICIWDLSKLM

SEQ ID NO: 6450 - protein, 9 aa, Artificial Sequence
  source: /note="Description of Artificial Sequence: Synthetic peptide"
MVIDFKQRV

SEQ ID NO: 6451 - protein, 9 aa, Artificial Sequence
  source: /note="Description of Artificial Sequence: Synthetic peptide"
MCSMVIDFK

SEQ ID NO: 6452 - protein, 9 aa, Artificial Sequence
  source: /note="Description of Artificial Sequence: Synthetic peptide"
VDRCPMCSM

SEQ ID NO: 6453 - protein, 9 aa, Artificial Sequence
  source: /note="Description of Artificial Sequence: Synthetic peptide"
PMCSMVIDF

SEQ ID NO: 6454 - protein, 10 aa, Artificial Sequence
  source: /note="Description of Artificial Sequence: Synthetic peptide"
SMVIDFKQRV

SEQ ID NO: 6455 - protein, 10 aa, Artificial Sequence
  source: /note="Description of Artificial Sequence: Synthetic peptide"
PMCSMVIDFK

SEQ ID NO: 6456 - protein, 10 aa, Artificial Sequence
  source: /note="Description of Artificial Sequence: Synthetic peptide"
CSMVIDFKQR

SEQ ID NO: 6457 - protein, 10 aa, Artificial Sequence
  source: /note="Description of Artificial Sequence: Synthetic peptide"
CPMCSMVIDF

SEQ ID NO: 6458 - protein, 10 aa, Artificial Sequence
  source: /note="Description of Artificial Sequence: Synthetic peptide"
MVIDFKQRVF

SEQ ID NO: 6459 - protein, 9 aa, Artificial Sequence
  source: /note="Description of Artificial Sequence: Synthetic peptide"
KIFQKKFGL

SEQ ID NO: 6460 - protein, 9 aa, Artificial Sequence
  source: /note="Description of Artificial Sequence: Synthetic peptide"
EMMKIFQKK

SEQ ID NO: 6461 - protein, 9 aa, Artificial Sequence
  source: /note="Description of Artificial Sequence: Synthetic peptide"
KEMMKIFQK

SEQ ID NO: 6462 - protein, 9 aa, Artificial Sequence
  source: /note="Description of Artificial Sequence: Synthetic peptide"
MMKIFQKKF

SEQ ID NO: 6463 - protein, 9 aa, Artificial Sequence
  source: /note="Description of Artificial Sequence: Synthetic peptide"
FQKKFGLHN

SEQ ID NO: 6464 - protein, 9 aa, Artificial Sequence
  source: /note="Description of Artificial Sequence: Synthetic peptide"
QKKFGLHNF

SEQ ID NO: 6465 - protein, 10 aa, Artificial Sequence
  source: /note="Description of Artificial Sequence: Synthetic peptide"
KIFQKKFGLH

SEQ ID NO: 6466 - protein, 10 aa, Artificial Sequence
  source: /note="Description of Artificial Sequence: Synthetic peptide"
EMMKIFQKKF

SEQ ID NO: 6467 - protein, 10 aa, Artificial Sequence
  source: /note="Description of Artificial Sequence: Synthetic peptide"
FQKKFGLHNF

SEQ ID NO: 6468 - protein, 10 aa, Artificial Sequence
  source: /note="Description of Artificial Sequence: Synthetic peptide"
KEMMKIFQKK

SEQ ID NO: 6469 - protein, 10 aa, Artificial Sequence
  source: /note="Description of Artificial Sequence: Synthetic peptide"
MMKIFQKKFG

SEQ ID NO: 6470 - protein, 10 aa, Artificial Sequence
  source: /note="Description of Artificial Sequence: Synthetic peptide"
MKIFQKKFGL

SEQ ID NO: 6471 - protein, 9 aa, Artificial Sequence
  source: /note="Description of Artificial Sequence: Synthetic peptide"
FLNLIGFVL

SEQ ID NO: 6472 - protein, 9 aa, Artificial Sequence
  source: /note="Description of Artificial Sequence: Synthetic peptide"
VLRRELGSI

SEQ ID NO: 6473 - protein, 9 aa, Artificial Sequence
  source: /note="Description of Artificial Sequence: Synthetic peptide"
NLIGFVLRR

SEQ ID NO: 6474 - protein, 9 aa, Artificial Sequence
  source: /note="Description of Artificial Sequence: Synthetic peptide"
IGFVLRREL

SEQ ID NO: 6475 - protein, 10 aa, Artificial Sequence
  source: /note="Description of Artificial Sequence: Synthetic peptide"
FVLRRELGSI

SEQ ID NO: 6476 - protein, 10 aa, Artificial Sequence
  source: /note="Description of Artificial Sequence: Synthetic peptide"
AFLNLIGFVL

SEQ ID NO: 6477 - protein, 10 aa, Artificial Sequence
  source: /note="Description of Artificial Sequence: Synthetic peptide"
FLNLIGFVLR

SEQ ID NO: 6478 - protein, 10 aa, Artificial Sequence
  source: /note="Description of Artificial Sequence: Synthetic peptide"
QQHHHHHHHL

SEQ ID NO: 6479 - protein, 10 aa, Artificial Sequence
  source: /note="Description of Artificial Sequence: Synthetic peptide"
QHHHHHHHLL

SEQ ID NO: 6480 - protein, 9 aa, Artificial Sequence
  source: /note="Description of Artificial Sequence: Synthetic peptide"
HWKSQTLQF

SEQ ID NO: 6481 - protein, 9 aa, Artificial Sequence
  source: /note="Description of Artificial Sequence: Synthetic peptide"
KQRKGPHWK

SEQ ID NO: 6482 - protein, 9 aa, Artificial Sequence
  source: /note="Description of Artificial Sequence: Synthetic peptide"
GPHWKSQTL

SEQ ID NO: 6483 - protein, 9 aa, Artificial Sequence
  source: /note="Description of Artificial Sequence: Synthetic peptide"
KKQRKGPHW

SEQ ID NO: 6484 - protein, 10 aa, Artificial Sequence
  source: /note="Description of Artificial Sequence: Synthetic peptide"
KKQRKGPHWK

SEQ ID NO: 6485 - protein, 10 aa, Artificial Sequence
  source: /note="Description of Artificial Sequence: Synthetic peptide"
KQRKGPHWKS

SEQ ID NO: 6486 - protein, 10 aa, Artificial Sequence
  source: /note="Description of Artificial Sequence: Synthetic peptide"
KKKQRKGPHW

SEQ ID NO: 6487 - protein, 10 aa, Artificial Sequence
  source: /note="Description of Artificial Sequence: Synthetic peptide"
PHWKSQTLQF

SEQ ID NO: 6488 - protein, 9 aa, Artificial Sequence
  source: /note="Description of Artificial Sequence: Synthetic peptide"
QEEQQQQQL

SEQ ID NO: 6489 - protein, 10 aa, Artificial Sequence
  source: /note="Description of Artificial Sequence: Synthetic peptide"
QQEEQQQQQL

SEQ ID NO: 6490 - protein, 10 aa, Artificial Sequence
  source: /note="Description of Artificial Sequence: Synthetic peptide"
QEEQQQQQLL

SEQ ID NO: 6491 - protein, 9 aa, Artificial Sequence
  source: /note="Description of Artificial Sequence: Synthetic peptide"
RWNGSPCRA

SEQ ID NO: 6492 - protein, 10 aa, Artificial Sequence
  source: /note="Description of Artificial Sequence: Synthetic peptide"
TVRWNGSPCR

SEQ ID NO: 6493 - protein, 10 aa, Artificial Sequence
  source: /note="Description of Artificial Sequence: Synthetic peptide"
NGSPCRAPHF

SEQ ID NO: 6494 - protein, 10 aa, Artificial Sequence
  source: /note="Description of Artificial Sequence: Synthetic peptide"
SPCRAPHFHI

SEQ ID NO: 6495 - protein, 9 aa, Artificial Sequence
  source: /note="Description of Artificial Sequence: Synthetic peptide"
SCLFQSDVY

SEQ ID NO: 6496 - protein, 10 aa, Artificial Sequence
  source: /note="Description of Artificial Sequence: Synthetic peptide"
GSCLFQSDVY

SEQ ID NO: 6497 - protein, 10 aa, Artificial Sequence
  source: /note="Description of Artificial Sequence: Synthetic peptide"
LPFGSCLFQS

SEQ ID NO: 6498 - protein, 9 aa, Artificial Sequence
  source: /note="Description of Artificial Sequence: Synthetic peptide"
DEMSEDDVL

SEQ ID NO: 6499 - protein, 9 aa, Artificial Sequence
  source: /note="Description of Artificial Sequence: Synthetic peptide"
YDGFRPGMY

SEQ ID NO: 6500 - protein, 9 aa, Artificial Sequence
  source: /note="Description of Artificial Sequence: Synthetic peptide"
DGFRPGMYV

SEQ ID NO: 6501 - protein, 9 aa, Artificial Sequence
  source: /note="Description of Artificial Sequence: Synthetic peptide"
VQYDGFRPG

SEQ ID NO: 6502 - protein, 10 aa, Artificial Sequence
  source: /note="Description of Artificial Sequence: Synthetic peptide"
QYDGFRPGMY

SEQ ID NO: 6503 - protein, 10 aa, Artificial Sequence
  source: /note="Description of Artificial Sequence: Synthetic peptide"
EARVQYDGFR

SEQ ID NO: 6504 - protein, 10 aa, Artificial Sequence
  source: /note="Description of Artificial Sequence: Synthetic peptide"
DGFRPGMYVR

SEQ ID NO: 6505 - protein, 10 aa, Artificial Sequence
  source: /note="Description of Artificial Sequence: Synthetic peptide"
VQYDGFRPGM

SEQ ID NO: 6506 - protein, 10 aa, Artificial Sequence
  source: /note="Description of Artificial Sequence: Synthetic peptide"
DEARVQYDGF

SEQ ID NO: 6507 - protein, 9 aa, Artificial Sequence
  source: /note="Description of Artificial Sequence: Synthetic peptide"
KTNSNKGTF

SEQ ID NO: 6508 - protein, 9 aa, Artificial Sequence
  source: /note="Description of Artificial Sequence: Synthetic peptide"
TNSNKGTFR

SEQ ID NO: 6509 - protein, 10 aa, Artificial Sequence
  source: /note="Description of Artificial Sequence: Synthetic peptide"
HLCQKTNSNK

SEQ ID NO: 6510 - protein, 10 aa, Artificial Sequence
  source: /note="Description of Artificial Sequence: Synthetic peptide"
KTNSNKGTFR

SEQ ID NO: 6511 - protein, 10 aa, Artificial Sequence
  source: /note="Description of Artificial Sequence: Synthetic peptide"
QKTNSNKGTF

SEQ ID NO: 6512 - protein, 9 aa, Artificial Sequence
  source: /note="Description of Artificial Sequence: Synthetic peptide"
LIWATSGAA

SEQ ID NO: 6513 - protein, 9 aa, Artificial Sequence
  source: /note="Description of Artificial Sequence: Synthetic peptide"
DLIWATSGA

SEQ ID NO: 6514 - protein, 10 aa, Artificial Sequence
  source: /note="Description of Artificial Sequence: Synthetic peptide"
DLIWATSGAA

SEQ ID NO: 6515 - protein, 10 aa, Artificial Sequence
  source: /note="Description of Artificial Sequence: Synthetic peptide"
WATSGAATPV

SEQ ID NO: 6516 - protein, 9 aa, Artificial Sequence
  source: /note="Description of Artificial Sequence: Synthetic peptide"
RLLTPGEMV

SEQ ID NO: 6517 - protein, 9 aa, Artificial Sequence
  source: /note="Description of Artificial Sequence: Synthetic peptide"
QPVPPFYRR

SEQ ID NO: 6518 - protein, 9 aa, Artificial Sequence
  source: /note="Description of Artificial Sequence: Synthetic peptide"
VPPFYRRLL

SEQ ID NO: 6519 - protein, 9 aa, Artificial Sequence
  source: /note="Description of Artificial Sequence: Synthetic peptide"
RRLLTPGEM

SEQ ID NO: 6520 - protein, 10 aa, Artificial Sequence
  source: /note="Description of Artificial Sequence: Synthetic peptide"
QPVPPFYRRL

SEQ ID NO: 6521 - protein, 10 aa, Artificial Sequence
  source: /note="Description of Artificial Sequence: Synthetic peptide"
YRRLLTPGEM

SEQ ID NO: 6522 - protein, 9 aa, Artificial Sequence
  source: /note="Description of Artificial Sequence: Synthetic peptide"
LDVQIKGEF

SEQ ID NO: 6523 - protein, 10 aa, Artificial Sequence
  source: /note="Description of Artificial Sequence: Synthetic peptide"
TTAETLDVQI

SEQ ID NO: 6524 - protein, 10 aa, Artificial Sequence
  source: /note="Description of Artificial Sequence: Synthetic peptide"
LDVQIKGEFY

SEQ ID NO: 6525 - protein, 9 aa, Artificial Sequence
  source: /note="Description of Artificial Sequence: Synthetic peptide"
LSATPLPHY

SEQ ID NO: 6526 - protein, 9 aa, Artificial Sequence
  source: /note="Description of Artificial Sequence: Synthetic peptide"
SATPLPHYL

SEQ ID NO: 6527 - protein, 9 aa, Artificial Sequence
  source: /note="Description of Artificial Sequence: Synthetic peptide"
GLSATPLPH

SEQ ID NO: 6528 - protein, 9 aa, Artificial Sequence
  source: /note="Description of Artificial Sequence: Synthetic peptide"
TPLPHYLAH

SEQ ID NO: 6529 - protein, 10 aa, Artificial Sequence
  source: /note="Description of Artificial Sequence: Synthetic peptide"
GLSATPLPHY

SEQ ID NO: 6530 - protein, 10 aa, Artificial Sequence
  source: /note="Description of Artificial Sequence: Synthetic peptide"
STTGLSATPL

SEQ ID NO: 6531 - protein, 10 aa, Artificial Sequence
  source: /note="Description of Artificial Sequence: Synthetic peptide"
LSATPLPHYL

SEQ ID NO: 6532 - protein, 9 aa, Artificial Sequence
  source: /note="Description of Artificial Sequence: Synthetic peptide"
SVSFGTVYK

SEQ ID NO: 6533 - protein, 9 aa, Artificial Sequence
  source: /note="Description of Artificial Sequence: Synthetic peptide"
GSVSFGTVY

SEQ ID NO: 6534 - protein, 9 aa, Artificial Sequence
  source: /note="Description of Artificial Sequence: Synthetic peptide"
GQRIGSVSF

SEQ ID NO: 6535 - protein, 10 aa, Artificial Sequence
  source: /note="Description of Artificial Sequence: Synthetic peptide"
RIGSVSFGTV

SEQ ID NO: 6536 - protein, 10 aa, Artificial Sequence
  source: /note="Description of Artificial Sequence: Synthetic peptide"
GSVSFGTVYK

SEQ ID NO: 6537 - protein, 10 aa, Artificial Sequence
  source: /note="Description of Artificial Sequence: Synthetic peptide"
VSFGTVYKGK

SEQ ID NO: 6538 - protein, 10 aa, Artificial Sequence
  source: /note="Description of Artificial Sequence: Synthetic peptide"
IGSVSFGTVY

SEQ ID NO: 6539 - protein, 10 aa, Artificial Sequence
  source: /note="Description of Artificial Sequence: Synthetic peptide"
ITVGQRIGSV

SEQ ID NO: 6540 - protein, 10 aa, Artificial Sequence
  source: /note="Description of Artificial Sequence: Synthetic peptide"
VGQRIGSVSF

SEQ ID NO: 6541 - protein, 9 aa, Artificial Sequence
  source: /note="Description of Artificial Sequence: Synthetic peptide"
GSGSFATVY

SEQ ID NO: 6542 - protein, 9 aa, Artificial Sequence
  source: /note="Description of Artificial Sequence: Synthetic peptide"
SGSFATVYK

SEQ ID NO: 6543 - protein, 9 aa, Artificial Sequence
  source: /note="Description of Artificial Sequence: Synthetic peptide"
SFATVYKGK

SEQ ID NO: 6544 - protein, 9 aa, Artificial Sequence
  source: /note="Description of Artificial Sequence: Synthetic peptide"
FATVYKGKW

SEQ ID NO: 6545 - protein, 10 aa, Artificial Sequence
  source: /note="Description of Artificial Sequence: Synthetic peptide"
RIGSGSFATV

SEQ ID NO: 6546 - protein, 10 aa, Artificial Sequence
  source: /note="Description of Artificial Sequence: Synthetic peptide"
GSGSFATVYK

SEQ ID NO: 6547 - protein, 10 aa, Artificial Sequence
  source: /note="Description of Artificial Sequence: Synthetic peptide"
GSFATVYKGK

SEQ ID NO: 6548 - protein, 10 aa, Artificial Sequence
  source: /note="Description of Artificial Sequence: Synthetic peptide"
SFATVYKGKW

SEQ ID NO: 6549 - protein, 10 aa, Artificial Sequence
  source: /note="Description of Artificial Sequence: Synthetic peptide"
GQRIGSGSFA

SEQ ID NO: 6550 - protein, 10 aa, Artificial Sequence
  source: /note="Description of Artificial Sequence: Synthetic peptide"
IGSGSFATVY

SEQ ID NO: 6551 - protein, 9 aa, Artificial Sequence
  source: /note="Description of Artificial Sequence: Synthetic peptide"
SGSFVTVYK

SEQ ID NO: 6552 - protein, 9 aa, Artificial Sequence
  source: /note="Description of Artificial Sequence: Synthetic peptide"
SFVTVYKGK

SEQ ID NO: 6553 - protein, 9 aa, Artificial Sequence
  source: /note="Description of Artificial Sequence: Synthetic peptide"
GSGSFVTVY

SEQ ID NO: 6554 - protein, 10 aa, Artificial Sequence
  source: /note="Description of Artificial Sequence: Synthetic peptide"
RIGSGSFVTV

SEQ ID NO: 6555 - protein, 10 aa, Artificial Sequence
  source: /note="Description of Artificial Sequence: Synthetic peptide"
GSGSFVTVYK

SEQ ID NO: 6556 - protein, 10 aa, Artificial Sequence
  source: /note="Description of Artificial Sequence: Synthetic peptide"
GSFVTVYKGK

SEQ ID NO: 6557 - protein, 10 aa, Artificial Sequence
  source: /note="Description of Artificial Sequence: Synthetic peptide"
SFVTVYKGKW

SEQ ID NO: 6558 - protein, 10 aa, Artificial Sequence
  source: /note="Description of Artificial Sequence: Synthetic peptide"
GQRIGSGSFV

SEQ ID NO: 6559 - protein, 10 aa, Artificial Sequence
  source: /note="Description of Artificial Sequence: Synthetic peptide"
IGSGSFVTVY

SEQ ID NO: 6560 - protein, 9 aa, Artificial Sequence
  source: /note="Description of Artificial Sequence: Synthetic peptide"
ATKKSRWSG

SEQ ID NO: 6561 - protein, 9 aa, Artificial Sequence
  source: /note="Description of Artificial Sequence: Synthetic peptide"
KKSRWSGSH

SEQ ID NO: 6562 - protein, 10 aa, Artificial Sequence
  source: /note="Description of Artificial Sequence: Synthetic peptide"
ATKKSRWSGS

SEQ ID NO: 6563 - protein, 10 aa, Artificial Sequence
  source: /note="Description of Artificial Sequence: Synthetic peptide"
DFGLATKKSR

SEQ ID NO: 6564 - protein, 10 aa, Artificial Sequence
  source: /note="Description of Artificial Sequence: Synthetic peptide"
FGLATKKSRW

SEQ ID NO: 6565 - protein, 10 aa, Artificial Sequence
  source: /note="Description of Artificial Sequence: Synthetic peptide"
DFGLATEKSR

SEQ ID NO: 6566 - protein, 10 aa, Artificial Sequence
  source: /note="Description of Artificial Sequence: Synthetic peptide"
FGLATEKSRW

SEQ ID NO: 6567 - protein, 9 aa, Artificial Sequence
  source: /note="Description of Artificial Sequence: Synthetic peptide"
VESRWSGSH

SEQ ID NO: 6568 - protein, 10 aa, Artificial Sequence
  source: /note="Description of Artificial Sequence: Synthetic peptide"
DFGLATVESR

SEQ ID NO: 6569 - protein, 10 aa, Artificial Sequence
  source: /note="Description of Artificial Sequence: Synthetic peptide"
ESRWSGSHQF

SEQ ID NO: 6570 - protein, 10 aa, Artificial Sequence
  source: /note="Description of Artificial Sequence: Synthetic peptide"
FGLATVESRW

SEQ ID NO: 6571 - protein, 9 aa, Artificial Sequence
  source: /note="Description of Artificial Sequence: Synthetic peptide"
GLATVNSRW

SEQ ID NO: 6572 - protein, 10 aa, Artificial Sequence
  source: /note="Description of Artificial Sequence: Synthetic peptide"
DFGLATVNSR

SEQ ID NO: 6573 - protein, 10 aa, Artificial Sequence
  source: /note="Description of Artificial Sequence: Synthetic peptide"
NSRWSGSHQF

SEQ ID NO: 6574 - protein, 10 aa, Artificial Sequence
  source: /note="Description of Artificial Sequence: Synthetic peptide"
FGLATVNSRW

SEQ ID NO: 6575 - protein, 9 aa, Artificial Sequence
  source: /note="Description of Artificial Sequence: Synthetic peptide"
RGRNQIEPA

SEQ ID NO: 6576 - protein, 9 aa, Artificial Sequence
  source: /note="Description of Artificial Sequence: Synthetic peptide"
ETPVRLALL

SEQ ID NO: 6577 - protein, 9 aa, Artificial Sequence
  source: /note="Description of Artificial Sequence: Synthetic peptide"
RPQDQPAAV

SEQ ID NO: 6578 - protein, 9 aa, Artificial Sequence
  source: /note="Description of Artificial Sequence: Synthetic peptide"
LPARGRNQI

SEQ ID NO: 6579 - protein, 9 aa, Artificial Sequence
  source: /note="Description of Artificial Sequence: Synthetic peptide"
AECGGEDAL

SEQ ID NO: 6580 - protein, 9 aa, Artificial Sequence
  source: /note="Description of Artificial Sequence: Synthetic peptide"
LETPVRLAL

SEQ ID NO: 6581 - protein, 9 aa, Artificial Sequence
  source: /note="Description of Artificial Sequence: Synthetic peptide"
GEDALETPV

SEQ ID NO: 6582 - protein, 10 aa, Artificial Sequence
  source: /note="Description of Artificial Sequence: Synthetic peptide"
LLPARGRNQI

SEQ ID NO: 6583 - protein, 10 aa, Artificial Sequence
  source: /note="Description of Artificial Sequence: Synthetic peptide"
PVRLALLPAR

SEQ ID NO: 6584 - protein, 10 aa, Artificial Sequence
  source: /note="Description of Artificial Sequence: Synthetic peptide"
RLALLPARGR

SEQ ID NO: 6585 - protein, 10 aa, Artificial Sequence
  source: /note="Description of Artificial Sequence: Synthetic peptide"
TPVRLALLPA

SEQ ID NO: 6586 - protein, 10 aa, Artificial Sequence
  source: /note="Description of Artificial Sequence: Synthetic peptide"
QQARPQDQPA

SEQ ID NO: 6587 - protein, 10 aa, Artificial Sequence
  source: /note="Description of Artificial Sequence: Synthetic peptide"
ALETPVRLAL

SEQ ID NO: 6588 - protein, 10 aa, Artificial Sequence
  source: /note="Description of Artificial Sequence: Synthetic peptide"
LETPVRLALL

SEQ ID NO: 6589 - protein, 9 aa, Artificial Sequence
  source: /note="Description of Artificial Sequence: Synthetic peptide"
RNWDGSLLY

SEQ ID NO: 6590 - protein, 9 aa, Artificial Sequence
  source: /note="Description of Artificial Sequence: Synthetic peptide"
KMGYLKRNW

SEQ ID NO: 6591 - protein, 9 aa, Artificial Sequence
  source: /note="Description of Artificial Sequence: Synthetic peptide"
LKRNWDGSL

SEQ ID NO: 6592 - protein, 9 aa, Artificial Sequence
  source: /note="Description of Artificial Sequence: Synthetic peptide"
KRNWDGSLL

SEQ ID NO: 6593 - protein, 9 aa, Artificial Sequence
  source: /note="Description of Artificial Sequence: Synthetic peptide"
WDGSLLYSV

SEQ ID NO: 6594 - protein, 10 aa, Artificial Sequence
  source: /note="Description of Artificial Sequence: Synthetic peptide"
YLKRNWDGSL

SEQ ID NO: 6595 - protein, 10 aa, Artificial Sequence
  source: /note="Description of Artificial Sequence: Synthetic peptide"
KRNWDGSLLY

SEQ ID NO: 6596 - protein, 10 aa, Artificial Sequence
  source: /note="Description of Artificial Sequence: Synthetic peptide"
GKMGYLKRNW

SEQ ID NO: 6597 - protein, 10 aa, Artificial Sequence
  source: /note="Description of Artificial Sequence: Synthetic peptide"
LKRNWDGSLL

SEQ ID NO: 6598 - protein, 10 aa, Artificial Sequence
  source: /note="Description of Artificial Sequence: Synthetic peptide"
WDGSLLYSVV

SEQ ID NO: 6599 - protein, 9 aa, Artificial Sequence
  source: /note="Description of Artificial Sequence: Synthetic peptide"
ILNESEARL

SEQ ID NO: 6600 - protein, 9 aa, Artificial Sequence
  source: /note="Description of Artificial Sequence: Synthetic peptide"
RLKAELWMR

SEQ ID NO: 6601 - protein, 9 aa, Artificial Sequence
  source: /note="Description of Artificial Sequence: Synthetic peptide"
SEARLKAEL

SEQ ID NO: 6602 - protein, 9 aa, Artificial Sequence
  source: /note="Description of Artificial Sequence: Synthetic peptide"
ARLKAELWM

SEQ ID NO: 6603 - protein, 9 aa, Artificial Sequence
  source: /note="Description of Artificial Sequence: Synthetic peptide"
NESEARLKA

SEQ ID NO: 6604 - protein, 10 aa, Artificial Sequence
  source: /note="Description of Artificial Sequence: Synthetic peptide"
YILNESEARL

SEQ ID NO: 6605 - protein, 10 aa, Artificial Sequence
  source: /note="Description of Artificial Sequence: Synthetic peptide"
ILNESEARLK

SEQ ID NO: 6606 - protein, 10 aa, Artificial Sequence
  source: /note="Description of Artificial Sequence: Synthetic peptide"
SEARLKAELW

SEQ ID NO: 6607 - protein, 9 aa, Artificial Sequence
  source: /note="Description of Artificial Sequence: Synthetic peptide"
ARVTQGETL

SEQ ID NO: 6608 - protein, 10 aa, Artificial Sequence
  source: /note="Description of Artificial Sequence: Synthetic peptide"
IEARVTQGET

SEQ ID NO: 6609 - protein, 9 aa, Artificial Sequence
  source: /note="Description of Artificial Sequence: Synthetic peptide"
WQGSTRASV

SEQ ID NO: 6610 - protein, 9 aa, Artificial Sequence
  source: /note="Description of Artificial Sequence: Synthetic peptide"
SGASRFAFR

SEQ ID NO: 6611 - protein, 9 aa, Artificial Sequence
  source: /note="Description of Artificial Sequence: Synthetic peptide"
ASRFAFRWQ

SEQ ID NO: 6612 - protein, 9 aa, Artificial Sequence
  source: /note="Description of Artificial Sequence: Synthetic peptide"
AFRWQGSTR

SEQ ID NO: 6613 - protein, 9 aa, Artificial Sequence
  source: /note="Description of Artificial Sequence: Synthetic peptide"
GGCSGASRF

SEQ ID NO: 6614 - protein, 9 aa, Artificial Sequence
  source: /note="Description of Artificial Sequence: Synthetic peptide"
CSGASRFAF

SEQ ID NO: 6615 - protein, 9 aa, Artificial Sequence
  source: /note="Description of Artificial Sequence: Synthetic peptide"
FAFRWQGST

SEQ ID NO: 6616 - protein, 9 aa, Artificial Sequence
  source: /note="Description of Artificial Sequence: Synthetic peptide"
FRWQGSTRA

SEQ ID NO: 6617 - protein, 9 aa, Artificial Sequence
  source: /note="Description of Artificial Sequence: Synthetic peptide"
GASRFAFRW

SEQ ID NO: 6618 - protein, 10 aa, Artificial Sequence
  source: /note="Description of Artificial Sequence: Synthetic peptide"
CSGASRFAFR

SEQ ID NO: 6619 - protein, 10 aa, Artificial Sequence
  source: /note="Description of Artificial Sequence: Synthetic peptide"
FAFRWQGSTR

SEQ ID NO: 6620 - protein, 10 aa, Artificial Sequence
  source: /note="Description of Artificial Sequence: Synthetic peptide"
ASRFAFRWQG

SEQ ID NO: 6621 - protein, 10 aa, Artificial Sequence
  source: /note="Description of Artificial Sequence: Synthetic peptide"
RFAFRWQGST

SEQ ID NO: 6622 - protein, 10 aa, Artificial Sequence
  source: /note="Description of Artificial Sequence: Synthetic peptide"
AFRWQGSTRA

SEQ ID NO: 6623 - protein, 10 aa, Artificial Sequence
  source: /note="Description of Artificial Sequence: Synthetic peptide"
RWQGSTRASV

SEQ ID NO: 6624 - protein, 10 aa, Artificial Sequence
  source: /note="Description of Artificial Sequence: Synthetic peptide"
LGGCSGASRF

SEQ ID NO: 6625 - protein, 10 aa, Artificial Sequence
  source: /note="Description of Artificial Sequence: Synthetic peptide"
GCSGASRFAF

SEQ ID NO: 6626 - protein, 10 aa, Artificial Sequence
  source: /note="Description of Artificial Sequence: Synthetic peptide"
SGASRFAFRW

SEQ ID NO: 6627 - protein, 10 aa, Artificial Sequence
  source: /note="Description of Artificial Sequence: Synthetic peptide"
FRWQGSTRAS

SEQ ID NO: 6628 - protein, 10 aa, Artificial Sequence
  source: /note="Description of Artificial Sequence: Synthetic peptide"
WQGSTRASVW

SEQ ID NO: 6629 - protein, 9 aa, Artificial Sequence
  source: /note="Description of Artificial Sequence: Synthetic peptide"
GCQSRPANK

SEQ ID NO: 6630 - protein, 10 aa, Artificial Sequence
  source: /note="Description of Artificial Sequence: Synthetic peptide"
KHKKKGCQSR

SEQ ID NO: 6631 - protein, 10 aa, Artificial Sequence
  source: /note="Description of Artificial Sequence: Synthetic peptide"
KGCQSRPANK

SEQ ID NO: 6632 - protein, 9 aa, Artificial Sequence
  source: /note="Description of Artificial Sequence: Synthetic peptide"
NYVESNWRK

SEQ ID NO: 6633 - protein, 10 aa, Artificial Sequence
  source: /note="Description of Artificial Sequence: Synthetic peptide"
ATNYVESNWR

SEQ ID NO: 6634 - protein, 10 aa, Artificial Sequence
  source: /note="Description of Artificial Sequence: Synthetic peptide"
RKQCKELVNL

SEQ ID NO: 6635 - protein, 9 aa, Artificial Sequence
  source: /note="Description of Artificial Sequence: Synthetic peptide"
RSLCRTQRK

SEQ ID NO: 6636 - protein, 10 aa, Artificial Sequence
  source: /note="Description of Artificial Sequence: Synthetic peptide"
CGRSLCRTQR

SEQ ID NO: 6637 - protein, 10 aa, Artificial Sequence
  source: /note="Description of Artificial Sequence: Synthetic peptide"
RSLCRTQRKR

SEQ ID NO: 6638 - protein, 9 aa, Artificial Sequence
  source: /note="Description of Artificial Sequence: Synthetic peptide"
CSRFGNIFP

SEQ ID NO: 6639 - protein, 9 aa, Artificial Sequence
  source: /note="Description of Artificial Sequence: Synthetic peptide"
RFGNIFPSS

SEQ ID NO: 6640 - protein, 9 aa, Artificial Sequence
  source: /note="Description of Artificial Sequence: Synthetic peptide"
GNIFPSSAY

SEQ ID NO: 6641 - protein, 9 aa, Artificial Sequence
  source: /note="Description of Artificial Sequence: Synthetic peptide"
GCSRFGNIF

SEQ ID NO: 6642 - protein, 9 aa, Artificial Sequence
  source: /note="Description of Artificial Sequence: Synthetic peptide"
SRFGNIFPS

SEQ ID NO: 6643 - protein, 10 aa, Artificial Sequence
  source: /note="Description of Artificial Sequence: Synthetic peptide"
CSRFGNIFPS

SEQ ID NO: 6644 - protein, 10 aa, Artificial Sequence
  source: /note="Description of Artificial Sequence: Synthetic peptide"
RFGNIFPSSA

SEQ ID NO: 6645 - protein, 10 aa, Artificial Sequence
  source: /note="Description of Artificial Sequence: Synthetic peptide"
FGNIFPSSAY

SEQ ID NO: 6646 - protein, 10 aa, Artificial Sequence
  source: /note="Description of Artificial Sequence: Synthetic peptide"
TGCSRFGNIF

SEQ ID NO: 6647 - protein, 9 aa, Artificial Sequence
  source: /note="Description of Artificial Sequence: Synthetic peptide"
RARWRAEGT

SEQ ID NO: 6648 - protein, 9 aa, Artificial Sequence
  source: /note="Description of Artificial Sequence: Synthetic peptide"
RWRAEGTSA

SEQ ID NO: 6649 - protein, 9 aa, Artificial Sequence
  source: /note="Description of Artificial Sequence: Synthetic peptide"
WRAEGTSAH

SEQ ID NO: 6650 - protein, 9 aa, Artificial Sequence
  source: /note="Description of Artificial Sequence: Synthetic peptide"
RAEGTSAHL

SEQ ID NO: 6651 - protein, 10 aa, Artificial Sequence
  source: /note="Description of Artificial Sequence: Synthetic peptide"
GARARWRAEG

SEQ ID NO: 6652 - protein, 10 aa, Artificial Sequence
  source: /note="Description of Artificial Sequence: Synthetic peptide"
RARWRAEGTS

SEQ ID NO: 6653 - protein, 10 aa, Artificial Sequence
  source: /note="Description of Artificial Sequence: Synthetic peptide"
RWRAEGTSAH

SEQ ID NO: 6654 - protein, 10 aa, Artificial Sequence
  source: /note="Description of Artificial Sequence: Synthetic peptide"
ARWRAEGTSA

SEQ ID NO: 6655 - protein, 10 aa, Artificial Sequence
  source: /note="Description of Artificial Sequence: Synthetic peptide"
WRAEGTSAHL

SEQ ID NO: 6656 - protein, 9 aa, Artificial Sequence
  source: /note="Description of Artificial Sequence: Synthetic peptide"
CTAHKWNGK

SEQ ID NO: 6657 - protein, 9 aa, Artificial Sequence
  source: /note="Description of Artificial Sequence: Synthetic peptide"
KTPTWSLPK

SEQ ID NO: 6658 - protein, 9 aa, Artificial Sequence
  source: /note="Description of Artificial Sequence: Synthetic peptide"
FAISCTAHK

SEQ ID NO: 6659 - protein, 9 aa, Artificial Sequence
  source: /note="Description of Artificial Sequence: Synthetic peptide"
KWNGKTPTW

SEQ ID NO: 6660 - protein, 9 aa, Artificial Sequence
  source: /note="Description of Artificial Sequence: Synthetic peptide"
RGHCTGSPR

SEQ ID NO: 6661 - protein, 9 aa, Artificial Sequence
  source: /note="Description of Artificial Sequence: Synthetic peptide"
TSRWKGPSS

SEQ ID NO: 6662 - protein, 9 aa, Artificial Sequence
  source: /note="Description of Artificial Sequence: Synthetic peptide"
WSLPKSTSR

SEQ ID NO: 6663 - protein, 9 aa, Artificial Sequence
  source: /note="Description of Artificial Sequence: Synthetic peptide"
SPRPCTPFA

SEQ ID NO: 6664 - protein, 9 aa, Artificial Sequence
  source: /note="Description of Artificial Sequence: Synthetic peptide"
NGKTPTWSL

SEQ ID NO: 6665 - protein, 9 aa, Artificial Sequence
  source: /note="Description of Artificial Sequence: Synthetic peptide"
KHHGNGTPC

SEQ ID NO: 6666 - protein, 9 aa, Artificial Sequence
  source: /note="Description of Artificial Sequence: Synthetic peptide"
GSPRPCTPF

SEQ ID NO: 6667 - protein, 9 aa, Artificial Sequence
  source: /note="Description of Artificial Sequence: Synthetic peptide"
HKWNGKTPT

SEQ ID NO: 6668 - protein, 9 aa, Artificial Sequence
  source: /note="Description of Artificial Sequence: Synthetic peptide"
TPFAISCTA

SEQ ID NO: 6669 - protein, 10 aa, Artificial Sequence
  source: /note="Description of Artificial Sequence: Synthetic peptide"
SLPKSTSRWK

SEQ ID NO: 6670 - protein, 10 aa, Artificial Sequence
  source: /note="Description of Artificial Sequence: Synthetic peptide"
RWKGPSSCCR

SEQ ID NO: 6671 - protein, 10 aa, Artificial Sequence
  source: /note="Description of Artificial Sequence: Synthetic peptide"
TWSLPKSTSR

SEQ ID NO: 6672 - protein, 10 aa, Artificial Sequence
  source: /note="Description of Artificial Sequence: Synthetic peptide"
CTPFAISCTA

SEQ ID NO: 6673 - protein, 10 aa, Artificial Sequence
  source: /note="Description of Artificial Sequence: Synthetic peptide"
SPRPCTPFAI

SEQ ID NO: 6674 - protein, 10 aa, Artificial Sequence
  source: /note="Description of Artificial Sequence: Synthetic peptide"
AKHHGNGTPC

SEQ ID NO: 6675 - protein, 10 aa, Artificial Sequence
  source: /note="Description of Artificial Sequence: Synthetic peptide"
TGSPRPCTPF

SEQ ID NO: 6676 - protein, 10 aa, Artificial Sequence
  source: /note="Description of Artificial Sequence: Synthetic peptide"
FAISCTAHKW

SEQ ID NO: 6677 - protein, 10 aa, Artificial Sequence
  source: /note="Description of Artificial Sequence: Synthetic peptide"
HKWNGKTPTW

SEQ ID NO: 6678 - protein, 10 aa, Artificial Sequence
  source: /note="Description of Artificial Sequence: Synthetic peptide"
WSLPKSTSRW

SEQ ID NO: 6679 - protein, 10 aa, Artificial Sequence
  source: /note="Description of Artificial Sequence: Synthetic peptide"
TPFAISCTAH

SEQ ID NO: 6680 - protein, 9 aa, Artificial Sequence
  source: /note="Description of Artificial Sequence: Synthetic peptide"
KLDVVAIEA

SEQ ID NO: 6681 - protein, 9 aa, Artificial Sequence
  source: /note="Description of Artificial Sequence: Synthetic peptide"
VVAIEAKFK

SEQ ID NO: 6682 - protein, 9 aa, Artificial Sequence
  source: /note="Description of Artificial Sequence: Synthetic peptide"
ASRKLDVVA

SEQ ID NO: 6683 - protein, 10 aa, Artificial Sequence
  source: /note="Description of Artificial Sequence: Synthetic peptide"
KLDVVAIEAK

SEQ ID NO: 6684 - protein, 10 aa, Artificial Sequence
  source: /note="Description of Artificial Sequence: Synthetic peptide"
ASRKLDVVAI

SEQ ID NO: 6685 - protein, 10 aa, Artificial Sequence
  source: /note="Description of Artificial Sequence: Synthetic peptide"
DVVAIEAKFK

SEQ ID NO: 6686 - protein, 10 aa, Artificial Sequence
  source: /note="Description of Artificial Sequence: Synthetic peptide"
RKLDVVAIEA

SEQ ID NO: 6687 - protein, 10 aa, Artificial Sequence
  source: /note="Description of Artificial Sequence: Synthetic peptide"
LDVVAIEAKF

SEQ ID NO: 6688 - protein, 9 aa, Artificial Sequence
  source: /note="Description of Artificial Sequence: Synthetic peptide"
VPRSCSGPA

SEQ ID NO: 6689 - protein, 10 aa, Artificial Sequence
  source: /note="Description of Artificial Sequence: Synthetic peptide"
VPRSCSGPAS

SEQ ID NO: 6690 - protein, 9 aa, Artificial Sequence
  source: /note="Description of Artificial Sequence: Synthetic peptide"
MTLDVFYEL

SEQ ID NO: 6691 - protein, 9 aa, Artificial Sequence
  source: /note="Description of Artificial Sequence: Synthetic peptide"
QVMTLDVFY

SEQ ID NO: 6692 - protein, 9 aa, Artificial Sequence
  source: /note="Description of Artificial Sequence: Synthetic peptide"
SQVMTLDVF

SEQ ID NO: 6693 - protein, 9 aa, Artificial Sequence
  source: /note="Description of Artificial Sequence: Synthetic peptide"
EEFSQVMTL

SEQ ID NO: 6694 - protein, 10 aa, Artificial Sequence
  source: /note="Description of Artificial Sequence: Synthetic peptide"
VMTLDVFYEL

SEQ ID NO: 6695 - protein, 10 aa, Artificial Sequence
  source: /note="Description of Artificial Sequence: Synthetic peptide"
TLDVFYELSK

SEQ ID NO: 6696 - protein, 10 aa, Artificial Sequence
  source: /note="Description of Artificial Sequence: Synthetic peptide"
FSQVMTLDVF

SEQ ID NO: 6697 - protein, 10 aa, Artificial Sequence
  source: /note="Description of Artificial Sequence: Synthetic peptide"
SQVMTLDVFY

SEQ ID NO: 6698 - protein, 10 aa, Artificial Sequence
  source: /note="Description of Artificial Sequence: Synthetic peptide"
MTLDVFYELS

SEQ ID NO: 6699 - protein, 10 aa, Artificial Sequence
  source: /note="Description of Artificial Sequence: Synthetic peptide"
CEEFSQVMTL

SEQ ID NO: 6700 - protein, 9 aa, Artificial Sequence
  source: /note="Description of Artificial Sequence: Synthetic peptide"
RTKGFTSER

SEQ ID NO: 6701 - protein, 9 aa, Artificial Sequence
  source: /note="Description of Artificial Sequence: Synthetic peptide"
FLRTKGFTS

SEQ ID NO: 6702 - protein, 9 aa, Artificial Sequence
  source: /note="Description of Artificial Sequence: Synthetic peptide"
SKFLRTKGF

SEQ ID NO: 6703 - protein, 9 aa, Artificial Sequence
  source: /note="Description of Artificial Sequence: Synthetic peptide"
KGFTSERQL

SEQ ID NO: 6704 - protein, 10 aa, Artificial Sequence
  source: /note="Description of Artificial Sequence: Synthetic peptide"
FLRTKGFTSE

SEQ ID NO: 6705 - protein, 10 aa, Artificial Sequence
  source: /note="Description of Artificial Sequence: Synthetic peptide"
FTSERQLQTF

SEQ ID NO: 6706 - protein, 10 aa, Artificial Sequence
  source: /note="Description of Artificial Sequence: Synthetic peptide"
ISKFLRTKGF

SEQ ID NO: 6707 - protein, 9 aa, Artificial Sequence
  source: /note="Description of Artificial Sequence: Synthetic peptide"
KLEDRKTSW

SEQ ID NO: 6708 - protein, 10 aa, Artificial Sequence
  source: /note="Description of Artificial Sequence: Synthetic peptide"
KLEDRKTSWK

SEQ ID NO: 6709 - protein, 10 aa, Artificial Sequence
  source: /note="Description of Artificial Sequence: Synthetic peptide"
TTCVKLEDRK

SEQ ID NO: 6710 - protein, 10 aa, Artificial Sequence
  source: /note="Description of Artificial Sequence: Synthetic peptide"
VKLEDRKTSW

SEQ ID NO: 6711 - protein, 9 aa, Artificial Sequence
  source: /note="Description of Artificial Sequence: Synthetic peptide"
FSLPASFLL

SEQ ID NO: 6712 - protein, 9 aa, Artificial Sequence
  source: /note="Description of Artificial Sequence: Synthetic peptide"
SLPASFLLL

SEQ ID NO: 6713 - protein, 9 aa, Artificial Sequence
  source: /note="Description of Artificial Sequence: Synthetic peptide"
SFLLLLLLL

SEQ ID NO: 6714 - protein, 9 aa, Artificial Sequence
  source: /note="Description of Artificial Sequence: Synthetic peptide"
LPASFLLLL

SEQ ID NO: 6715 - protein, 9 aa, Artificial Sequence
  source: /note="Description of Artificial Sequence: Synthetic peptide"
LHFSLPASF

SEQ ID NO: 6716 - protein, 9 aa, Artificial Sequence
  source: /note="Description of Artificial Sequence: Synthetic peptide"
ASFLLLLLL

SEQ ID NO: 6717 - protein, 10 aa, Artificial Sequence
  source: /note="Description of Artificial Sequence: Synthetic peptide"
FSLPASFLLL

SEQ ID NO: 6718 - protein, 10 aa, Artificial Sequence
  source: /note="Description of Artificial Sequence: Synthetic peptide"
SLPASFLLLL

SEQ ID NO: 6719 - protein, 10 aa, Artificial Sequence
  source: /note="Description of Artificial Sequence: Synthetic peptide"
HFSLPASFLL

SEQ ID NO: 6720 - protein, 10 aa, Artificial Sequence
  source: /note="Description of Artificial Sequence: Synthetic peptide"
SFLLLLLLLL

SEQ ID NO: 6721 - protein, 10 aa, Artificial Sequence
  source: /note="Description of Artificial Sequence: Synthetic peptide"
ALHFSLPASF

SEQ ID NO: 6722 - protein, 10 aa, Artificial Sequence
  source: /note="Description of Artificial Sequence: Synthetic peptide"
LPASFLLLLL

SEQ ID NO: 6723 - protein, 10 aa, Artificial Sequence
  source: /note="Description of Artificial Sequence: Synthetic peptide"
LHFSLPASFL

SEQ ID NO: 6724 - protein, 10 aa, Artificial Sequence
  source: /note="Description of Artificial Sequence: Synthetic peptide"
ASFLLLLLLL

SEQ ID NO: 6725 - protein, 9 aa, Artificial Sequence
  source: /note="Description of Artificial Sequence: Synthetic peptide"
ALGSNLHVK

SEQ ID NO: 6726 - protein, 9 aa, Artificial Sequence
  source: /note="Description of Artificial Sequence: Synthetic peptide"
GSNLHVKVK

SEQ ID NO: 6727 - protein, 9 aa, Artificial Sequence
  source: /note="Description of Artificial Sequence: Synthetic peptide"
NLHVKVKGY

SEQ ID NO: 6728 - protein, 10 aa, Artificial Sequence
  source: /note="Description of Artificial Sequence: Synthetic peptide"
ALGSNLHVKV

SEQ ID NO: 6729 - protein, 10 aa, Artificial Sequence
  source: /note="Description of Artificial Sequence: Synthetic peptide"
AALGSNLHVK

SEQ ID NO: 6730 - protein, 9 aa, Artificial Sequence
  source: /note="Description of Artificial Sequence: Synthetic peptide"
MASPTDMTL

SEQ ID NO: 6731 - protein, 9 aa, Artificial Sequence
  source: /note="Description of Artificial Sequence: Synthetic peptide"
WDMASPTDM

SEQ ID NO: 6732 - protein, 10 aa, Artificial Sequence
  source: /note="Description of Artificial Sequence: Synthetic peptide"
MASPTDMTLR

SEQ ID NO: 6733 - protein, 10 aa, Artificial Sequence
  source: /note="Description of Artificial Sequence: Synthetic peptide"
MTLRRVLVGH

SEQ ID NO: 6734 - protein, 10 aa, Artificial Sequence
  source: /note="Description of Artificial Sequence: Synthetic peptide"
DMASPTDMTL

SEQ ID NO: 6735 - protein, 10 aa, Artificial Sequence
  source: /note="Description of Artificial Sequence: Synthetic peptide"
SPTDMTLRRV

SEQ ID NO: 6736 - protein, 9 aa, Artificial Sequence
  source: /note="Description of Artificial Sequence: Synthetic peptide"
KNKPPDWNA

SEQ ID NO: 6737 - protein, 9 aa, Artificial Sequence
  source: /note="Description of Artificial Sequence: Synthetic peptide"
WNAPPNSFY

SEQ ID NO: 6738 - protein, 10 aa, Artificial Sequence
  source: /note="Description of Artificial Sequence: Synthetic peptide"
YLFKNKPPDW

SEQ ID NO: 6739 - protein, 10 aa, Artificial Sequence
  source: /note="Description of Artificial Sequence: Synthetic peptide"
DWNAPPNSFY

SEQ ID NO: 6740 - protein, 10 aa, Artificial Sequence
  source: /note="Description of Artificial Sequence: Synthetic peptide"
WNAPPNSFYR

SEQ ID NO: 6741 - protein, 9 aa, Artificial Sequence
  source: /note="Description of Artificial Sequence: Synthetic peptide"
KLFVRILNA

SEQ ID NO: 6742 - protein, 9 aa, Artificial Sequence
  source: /note="Description of Artificial Sequence: Synthetic peptide"
LWNKLFVRI

SEQ ID NO: 6743 - protein, 9 aa, Artificial Sequence
  source: /note="Description of Artificial Sequence: Synthetic peptide"
ELWNKLFVR

SEQ ID NO: 6744 - protein, 9 aa, Artificial Sequence
  source: /note="Description of Artificial Sequence: Synthetic peptide"
GELWNKLFV

SEQ ID NO: 6745 - protein, 9 aa, Artificial Sequence
  source: /note="Description of Artificial Sequence: Synthetic peptide"
SQQQWAPGL

SEQ ID NO: 6746 - protein, 9 aa, Artificial Sequence
  source: /note="Description of Artificial Sequence: Synthetic peptide"
HTGEGWPPR

SEQ ID NO: 6747 - protein, 9 aa, Artificial Sequence
  source: /note="Description of Artificial Sequence: Synthetic peptide"
QQQWAPGLW

SEQ ID NO: 6748 - protein, 9 aa, Artificial Sequence
  source: /note="Description of Artificial Sequence: Synthetic peptide"
QWAPGLWTT

SEQ ID NO: 6749 - protein, 9 aa, Artificial Sequence
  source: /note="Description of Artificial Sequence: Synthetic peptide"
ASRSPRTLQ

SEQ ID NO: 6750 - protein, 9 aa, Artificial Sequence
  source: /note="Description of Artificial Sequence: Synthetic peptide"
AASRSPRTL

SEQ ID NO: 6751 - protein, 9 aa, Artificial Sequence
  source: /note="Description of Artificial Sequence: Synthetic peptide"
LQPTSQQQW

SEQ ID NO: 6752 - protein, 9 aa, Artificial Sequence
  source: /note="Description of Artificial Sequence: Synthetic peptide"
QQWAPGLWT

SEQ ID NO: 6753 - protein, 10 aa, Artificial Sequence
  source: /note="Description of Artificial Sequence: Synthetic peptide"
SQQQWAPGLW

SEQ ID NO: 6754 - protein, 10 aa, Artificial Sequence
  source: /note="Description of Artificial Sequence: Synthetic peptide"
ASRSPRTLQP

SEQ ID NO: 6755 - protein, 10 aa, Artificial Sequence
  source: /note="Description of Artificial Sequence: Synthetic peptide"
TLQPTSQQQW

SEQ ID NO: 6756 - protein, 10 aa, Artificial Sequence
  source: /note="Description of Artificial Sequence: Synthetic peptide"
QQWAPGLWTT

SEQ ID NO: 6757 - protein, 9 aa, Artificial Sequence
  source: /note="Description of Artificial Sequence: Synthetic peptide"
TLAYQHLPI

SEQ ID NO: 6758 - protein, 9 aa, Artificial Sequence
  source: /note="Description of Artificial Sequence: Synthetic peptide"
HLPIRIFVA

SEQ ID NO: 6759 - protein, 9 aa, Artificial Sequence
  source: /note="Description of Artificial Sequence: Synthetic peptide"
AYQHLPIRI

SEQ ID NO: 6760 - protein, 9 aa, Artificial Sequence
  source: /note="Description of Artificial Sequence: Synthetic peptide"
LAYQHLPIR

SEQ ID NO: 6761 - protein, 9 aa, Artificial Sequence
  source: /note="Description of Artificial Sequence: Synthetic peptide"
LPIRIFVAL

SEQ ID NO: 6762 - protein, 9 aa, Artificial Sequence
  source: /note="Description of Artificial Sequence: Synthetic peptide"
YQHLPIRIF

SEQ ID NO: 6763 - protein, 10 aa, Artificial Sequence
  source: /note="Description of Artificial Sequence: Synthetic peptide"
YQHLPIRIFV

SEQ ID NO: 6764 - protein, 10 aa, Artificial Sequence
  source: /note="Description of Artificial Sequence: Synthetic peptide"
HLPIRIFVAL

SEQ ID NO: 6765 - protein, 10 aa, Artificial Sequence
  source: /note="Description of Artificial Sequence: Synthetic peptide"
AYQHLPIRIF

SEQ ID NO: 6766 - protein, 10 aa, Artificial Sequence
  source: /note="Description of Artificial Sequence: Synthetic peptide"
IRIFVALFDY

SEQ ID NO: 6767 - protein, 10 aa, Artificial Sequence
  source: /note="Description of Artificial Sequence: Synthetic peptide"
TLAYQHLPIR

SEQ ID NO: 6768 - protein, 10 aa, Artificial Sequence
  source: /note="Description of Artificial Sequence: Synthetic peptide"
ETLAYQHLPI

SEQ ID NO: 6769 - protein, 10 aa, Artificial Sequence
  source: /note="Description of Artificial Sequence: Synthetic peptide"
LPIRIFVALF

SEQ ID NO: 6770 - protein, 10 aa, Artificial Sequence
  source: /note="Description of Artificial Sequence: Synthetic peptide"
LAYQHLPIRI

SEQ ID NO: 6771 - protein, 9 aa, Artificial Sequence
  source: /note="Description of Artificial Sequence: Synthetic peptide"
QSRPTSSAA

SEQ ID NO: 6772 - protein, 9 aa, Artificial Sequence
  source: /note="Description of Artificial Sequence: Synthetic peptide"
YPQSRPTSS

SEQ ID NO: 6773 - protein, 10 aa, Artificial Sequence
  source: /note="Description of Artificial Sequence: Synthetic peptide"
YPQSRPTSSA

SEQ ID NO: 6774 - protein, 10 aa, Artificial Sequence
  source: /note="Description of Artificial Sequence: Synthetic peptide"
SSAAGPGACM

SEQ ID NO: 6775 - protein, 9 aa, Artificial Sequence
  source: /note="Description of Artificial Sequence: Synthetic peptide"
FEGCQPPTV

SEQ ID NO: 6776 - protein, 9 aa, Artificial Sequence
  source: /note="Description of Artificial Sequence: Synthetic peptide"
GDLQGLQAA

SEQ ID NO: 6777 - protein, 10 aa, Artificial Sequence
  source: /note="Description of Artificial Sequence: Synthetic peptide"
SPNSGDLQGL

SEQ ID NO: 6778 - protein, 10 aa, Artificial Sequence
  source: /note="Description of Artificial Sequence: Synthetic peptide"
GDLQGLQAAW

SEQ ID NO: 6779 - protein, 9 aa, Artificial Sequence
  source: /note="Description of Artificial Sequence: Synthetic peptide"
SALPGPWFL

SEQ ID NO: 6780 - protein, 9 aa, Artificial Sequence
  source: /note="Description of Artificial Sequence: Synthetic peptide"
ALPGPWFLA

SEQ ID NO: 6781 - protein, 9 aa, Artificial Sequence
  source: /note="Description of Artificial Sequence: Synthetic peptide"
FLASQHCPC

SEQ ID NO: 6782 - protein, 9 aa, Artificial Sequence
  source: /note="Description of Artificial Sequence: Synthetic peptide"
ALAPARCPL

SEQ ID NO: 6783 - protein, 9 aa, Artificial Sequence
  source: /note="Description of Artificial Sequence: Synthetic peptide"
TLASPGSAL

SEQ ID NO: 6784 - protein, 9 aa, Artificial Sequence
  source: /note="Description of Artificial Sequence: Synthetic peptide"
ASAPHSSPI

SEQ ID NO: 6785 - protein, 9 aa, Artificial Sequence
  source: /note="Description of Artificial Sequence: Synthetic peptide"
ATLASPGSA

SEQ ID NO: 6786 - protein, 9 aa, Artificial Sequence
  source: /note="Description of Artificial Sequence: Synthetic peptide"
HSSPIATLA

SEQ ID NO: 6787 - protein, 9 aa, Artificial Sequence
  source: /note="Description of Artificial Sequence: Synthetic peptide"
APHSSPIAT

SEQ ID NO: 6788 - protein, 9 aa, Artificial Sequence
  source: /note="Description of Artificial Sequence: Synthetic peptide"
AEWNDQTGA

SEQ ID NO: 6789 - protein, 9 aa, Artificial Sequence
  source: /note="Description of Artificial Sequence: Synthetic peptide"
RDSPASAPH

SEQ ID NO: 6790 - protein, 9 aa, Artificial Sequence
  source: /note="Description of Artificial Sequence: Synthetic peptide"
GSALPGPWF

SEQ ID NO: 6791 - protein, 9 aa, Artificial Sequence
  source: /note="Description of Artificial Sequence: Synthetic peptide"
HPQCPDAEW

SEQ ID NO: 6792 - protein, 9 aa, Artificial Sequence
  source: /note="Description of Artificial Sequence: Synthetic peptide"
LPGPWFLAS

SEQ ID NO: 6793 - protein, 9 aa, Artificial Sequence
  source: /note="Description of Artificial Sequence: Synthetic peptide"
CPDTALAPA

SEQ ID NO: 6794 - protein, 10 aa, Artificial Sequence
  source: /note="Description of Artificial Sequence: Synthetic peptide"
ASAPHSSPIA

SEQ ID NO: 6795 - protein, 10 aa, Artificial Sequence
  source: /note="Description of Artificial Sequence: Synthetic peptide"
ATLASPGSAL

SEQ ID NO: 6796 - protein, 10 aa, Artificial Sequence
  source: /note="Description of Artificial Sequence: Synthetic peptide"
SALPGPWFLA

SEQ ID NO: 6797 - protein, 10 aa, Artificial Sequence
  source: /note="Description of Artificial Sequence: Synthetic peptide"
LAPARCPLPR

SEQ ID NO: 6798 - protein, 10 aa, Artificial Sequence
  source: /note="Description of Artificial Sequence: Synthetic peptide"
APHSSPIATL

SEQ ID NO: 6799 - protein, 10 aa, Artificial Sequence
  source: /note="Description of Artificial Sequence: Synthetic peptide"
TALAPARCPL

SEQ ID NO: 6800 - protein, 10 aa, Artificial Sequence
  source: /note="Description of Artificial Sequence: Synthetic peptide"
RKHSESPPQH

SEQ ID NO: 6801 - protein, 10 aa, Artificial Sequence
  source: /note="Description of Artificial Sequence: Synthetic peptide"
AEWNDQTGAW

SEQ ID NO: 6802 - protein, 10 aa, Artificial Sequence
  source: /note="Description of Artificial Sequence: Synthetic peptide"
SQHCPCPDTA

SEQ ID NO: 6803 - protein, 10 aa, Artificial Sequence
  source: /note="Description of Artificial Sequence: Synthetic peptide"
SPIATLASPG

SEQ ID NO: 6804 - protein, 10 aa, Artificial Sequence
  source: /note="Description of Artificial Sequence: Synthetic peptide"
SPGSALPGPW

SEQ ID NO: 6805 - protein, 9 aa, Artificial Sequence
  source: /note="Description of Artificial Sequence: Synthetic peptide"
TITSWVSPV

SEQ ID NO: 6806 - protein, 9 aa, Artificial Sequence
  source: /note="Description of Artificial Sequence: Synthetic peptide"
WVSPVFDTA

SEQ ID NO: 6807 - protein, 9 aa, Artificial Sequence
  source: /note="Description of Artificial Sequence: Synthetic peptide"
ITSWVSPVF

SEQ ID NO: 6808 - protein, 9 aa, Artificial Sequence
  source: /note="Description of Artificial Sequence: Synthetic peptide"
SPVFDTAAG

SEQ ID NO: 6809 - protein, 10 aa, Artificial Sequence
  source: /note="Description of Artificial Sequence: Synthetic peptide"
STITSWVSPV

SEQ ID NO: 6810 - protein, 10 aa, Artificial Sequence
  source: /note="Description of Artificial Sequence: Synthetic peptide"
WVSPVFDTAA

SEQ ID NO: 6811 - protein, 10 aa, Artificial Sequence
  source: /note="Description of Artificial Sequence: Synthetic peptide"
VFDTAAGSLF

SEQ ID NO: 6812 - protein, 10 aa, Artificial Sequence
  source: /note="Description of Artificial Sequence: Synthetic peptide"
TITSWVSPVF

SEQ ID NO: 6813 - protein, 9 aa, Artificial Sequence
  source: /note="Description of Artificial Sequence: Synthetic peptide"
LVDNQINSY

SEQ ID NO: 6814 - protein, 9 aa, Artificial Sequence
  source: /note="Description of Artificial Sequence: Synthetic peptide"
NQINSYSGI

SEQ ID NO: 6815 - protein, 9 aa, Artificial Sequence
  source: /note="Description of Artificial Sequence: Synthetic peptide"
QINSYSGIK

SEQ ID NO: 6816 - protein, 10 aa, Artificial Sequence
  source: /note="Description of Artificial Sequence: Synthetic peptide"
GLVLLVDNQI

SEQ ID NO: 6817 - protein, 10 aa, Artificial Sequence
  source: /note="Description of Artificial Sequence: Synthetic peptide"
LLVDNQINSY

SEQ ID NO: 6818 - protein, 10 aa, Artificial Sequence
  source: /note="Description of Artificial Sequence: Synthetic peptide"
QINSYSGIKR

SEQ ID NO: 6819 - protein, 9 aa, Artificial Sequence
  source: /note="Description of Artificial Sequence: Synthetic peptide"
RCRQAAMPA

SEQ ID NO: 6820 - protein, 9 aa, Artificial Sequence
  source: /note="Description of Artificial Sequence: Synthetic peptide"
QAAMPAWGL

SEQ ID NO: 6821 - protein, 9 aa, Artificial Sequence
  source: /note="Description of Artificial Sequence: Synthetic peptide"
LERCRQAAM

SEQ ID NO: 6822 - protein, 9 aa, Artificial Sequence
  source: /note="Description of Artificial Sequence: Synthetic peptide"
CRQAAMPAW

SEQ ID NO: 6823 - protein, 9 aa, Artificial Sequence
  source: /note="Description of Artificial Sequence: Synthetic peptide"
RQAAMPAWG

SEQ ID NO: 6824 - protein, 9 aa, Artificial Sequence
  source: /note="Description of Artificial Sequence: Synthetic peptide"
EELERCRQA

SEQ ID NO: 6825 - protein, 10 aa, Artificial Sequence
  source: /note="Description of Artificial Sequence: Synthetic peptide"
RQAAMPAWGL

SEQ ID NO: 6826 - protein, 10 aa, Artificial Sequence
  source: /note="Description of Artificial Sequence: Synthetic peptide"
ELERCRQAAM

SEQ ID NO: 6827 - protein, 10 aa, Artificial Sequence
  source: /note="Description of Artificial Sequence: Synthetic peptide"
RCRQAAMPAW

SEQ ID NO: 6828 - protein, 10 aa, Artificial Sequence
  source: /note="Description of Artificial Sequence: Synthetic peptide"
EELERCRQAA

SEQ ID NO: 6829 - protein, 10 aa, Artificial Sequence
  source: /note="Description of Artificial Sequence: Synthetic peptide"
AEELERCRQA

SEQ ID NO: 6830 - protein, 9 aa, Artificial Sequence
  source: /note="Description of Artificial Sequence: Synthetic peptide"
KQERKTRAK

SEQ ID NO: 6831 - protein, 9 aa, Artificial Sequence
  source: /note="Description of Artificial Sequence: Synthetic peptide"
KTRAKETLE

SEQ ID NO: 6832 - protein, 9 aa, Artificial Sequence
  source: /note="Description of Artificial Sequence: Synthetic peptide"
RKTRAKETL

SEQ ID NO: 6833 - protein, 10 aa, Artificial Sequence
  source: /note="Description of Artificial Sequence: Synthetic peptide"
KTRAKETLEK

SEQ ID NO: 6834 - protein, 10 aa, Artificial Sequence
  source: /note="Description of Artificial Sequence: Synthetic peptide"
ERKTRAKETL

SEQ ID NO: 6835 - protein, 9 aa, Artificial Sequence
  source: /note="Description of Artificial Sequence: Synthetic peptide"
STASAATSR

SEQ ID NO: 6836 - protein, 9 aa, Artificial Sequence
  source: /note="Description of Artificial Sequence: Synthetic peptide"
STGSSTASA

SEQ ID NO: 6837 - protein, 9 aa, Artificial Sequence
  source: /note="Description of Artificial Sequence: Synthetic peptide"
ASAATSRGM

SEQ ID NO: 6838 - protein, 9 aa, Artificial Sequence
  source: /note="Description of Artificial Sequence: Synthetic peptide"
SAATSRGMW

SEQ ID NO: 6839 - protein, 9 aa, Artificial Sequence
  source: /note="Description of Artificial Sequence: Synthetic peptide"
GEPAAARGA

SEQ ID NO: 6840 - protein, 10 aa, Artificial Sequence
  source: /note="Description of Artificial Sequence: Synthetic peptide"
SSTASAATSR

SEQ ID NO: 6841 - protein, 10 aa, Artificial Sequence
  source: /note="Description of Artificial Sequence: Synthetic peptide"
AARGASTSSV

SEQ ID NO: 6842 - protein, 10 aa, Artificial Sequence
  source: /note="Description of Artificial Sequence: Synthetic peptide"
STSSVTASCA

SEQ ID NO: 6843 - protein, 10 aa, Artificial Sequence
  source: /note="Description of Artificial Sequence: Synthetic peptide"
EPAAARGAST

SEQ ID NO: 6844 - protein, 10 aa, Artificial Sequence
  source: /note="Description of Artificial Sequence: Synthetic peptide"
RGASTSSVTA

SEQ ID NO: 6845 - protein, 10 aa, Artificial Sequence
  source: /note="Description of Artificial Sequence: Synthetic peptide"
TASAATSRGM

SEQ ID NO: 6846 - protein, 10 aa, Artificial Sequence
  source: /note="Description of Artificial Sequence: Synthetic peptide"
ASAATSRGMW

SEQ ID NO: 6847 - protein, 9 aa, Artificial Sequence
  source: /note="Description of Artificial Sequence: Synthetic peptide"
KLSFNIQAL

SEQ ID NO: 6848 - protein, 9 aa, Artificial Sequence
  source: /note="Description of Artificial Sequence: Synthetic peptide"
RTKLSFNIQ

SEQ ID NO: 6849 - protein, 9 aa, Artificial Sequence
  source: /note="Description of Artificial Sequence: Synthetic peptide"
TNMRTKLSF

SEQ ID NO: 6850 - protein, 10 aa, Artificial Sequence
  source: /note="Description of Artificial Sequence: Synthetic peptide"
KLSFNIQALA

SEQ ID NO: 6851 - protein, 10 aa, Artificial Sequence
  source: /note="Description of Artificial Sequence: Synthetic peptide"
NMRTKLSFNI

SEQ ID NO: 6852 - protein, 10 aa, Artificial Sequence
  source: /note="Description of Artificial Sequence: Synthetic peptide"
LSQVTNMRTK

SEQ ID NO: 6853 - protein, 10 aa, Artificial Sequence
  source: /note="Description of Artificial Sequence: Synthetic peptide"
RTKLSFNIQA

SEQ ID NO: 6854 - protein, 10 aa, Artificial Sequence
  source: /note="Description of Artificial Sequence: Synthetic peptide"
SQVTNMRTKL

SEQ ID NO: 6855 - protein, 10 aa, Artificial Sequence
  source: /note="Description of Artificial Sequence: Synthetic peptide"
VTNMRTKLSF

SEQ ID NO: 6856 - protein, 10 aa, Artificial Sequence
  source: /note="Description of Artificial Sequence: Synthetic peptide"
TKLSFNIQAL

SEQ ID NO: 6857 - protein, 9 aa, Artificial Sequence
  source: /note="Description of Artificial Sequence: Synthetic peptide"
NLPEALEAV

SEQ ID NO: 6858 - protein, 9 aa, Artificial Sequence
  source: /note="Description of Artificial Sequence: Synthetic peptide"
IMLQLILDI

SEQ ID NO: 6859 - protein, 9 aa, Artificial Sequence
  source: /note="Description of Artificial Sequence: Synthetic peptide"
MLQLILDIA

SEQ ID NO: 6860 - protein, 9 aa, Artificial Sequence
  source: /note="Description of Artificial Sequence: Synthetic peptide"
ILDIALFGL

SEQ ID NO: 6861 - protein, 9 aa, Artificial Sequence
  source: /note="Description of Artificial Sequence: Synthetic peptide"
RIKEIMLQL

SEQ ID NO: 6862 - protein, 9 aa, Artificial Sequence
  source: /note="Description of Artificial Sequence: Synthetic peptide"
GLRQTPILK

SEQ ID NO: 6863 - protein, 9 aa, Artificial Sequence
  source: /note="Description of Artificial Sequence: Synthetic peptide"
ALFGLRTFR

SEQ ID NO: 6864 - protein, 9 aa, Artificial Sequence
  source: /note="Description of Artificial Sequence: Synthetic peptide"
KGSISIIRK

SEQ ID NO: 6865 - protein, 9 aa, Artificial Sequence
  source: /note="Description of Artificial Sequence: Synthetic peptide"
IALFGLRTF

SEQ ID NO: 6866 - protein, 9 aa, Artificial Sequence
  source: /note="Description of Artificial Sequence: Synthetic peptide"
LFGLRTFRL

SEQ ID NO: 6867 - protein, 9 aa, Artificial Sequence
  source: /note="Description of Artificial Sequence: Synthetic peptide"
IIRKQRGSM

SEQ ID NO: 6868 - protein, 9 aa, Artificial Sequence
  source: /note="Description of Artificial Sequence: Synthetic peptide"
KQRGSMGRR

SEQ ID NO: 6869 - protein, 9 aa, Artificial Sequence
  source: /note="Description of Artificial Sequence: Synthetic peptide"
RGSMGRRVA

SEQ ID NO: 6870 - protein, 9 aa, Artificial Sequence
  source: /note="Description of Artificial Sequence: Synthetic peptide"
GSMGRRVAA

SEQ ID NO: 6871 - protein, 9 aa, Artificial Sequence
  source: /note="Description of Artificial Sequence: Synthetic peptide"
MGRRVAAGL

SEQ ID NO: 6872 - protein, 9 aa, Artificial Sequence
  source: /note="Description of Artificial Sequence: Synthetic peptide"
AVKRNLRNR

SEQ ID NO: 6873 - protein, 9 aa, Artificial Sequence
  source: /note="Description of Artificial Sequence: Synthetic peptide"
KRNLRNRIK

SEQ ID NO: 6874 - protein, 9 aa, Artificial Sequence
  source: /note="Description of Artificial Sequence: Synthetic peptide"
RNRIKEIML

SEQ ID NO: 6875 - protein, 9 aa, Artificial Sequence
  source: /note="Description of Artificial Sequence: Synthetic peptide"
SISIIRKQR

SEQ ID NO: 6876 - protein, 9 aa, Artificial Sequence
  source: /note="Description of Artificial Sequence: Synthetic peptide"
TPILKRTNL

SEQ ID NO: 6877 - protein, 9 aa, Artificial Sequence
  source: /note="Description of Artificial Sequence: Synthetic peptide"
SMGRRVAAG

SEQ ID NO: 6878 - protein, 9 aa, Artificial Sequence
  source: /note="Description of Artificial Sequence: Synthetic peptide"
NLRNRIKEI

SEQ ID NO: 6879 - protein, 9 aa, Artificial Sequence
  source: /note="Description of Artificial Sequence: Synthetic peptide"
QLILDIALF

SEQ ID NO: 6880 - protein, 9 aa, Artificial Sequence
  source: /note="Description of Artificial Sequence: Synthetic peptide"
KKKKGSISI

SEQ ID NO: 6881 - protein, 9 aa, Artificial Sequence
  source: /note="Description of Artificial Sequence: Synthetic peptide"
KKKGSISII

SEQ ID NO: 6882 - protein, 9 aa, Artificial Sequence
  source: /note="Description of Artificial Sequence: Synthetic peptide"
KRTNLPEAL

SEQ ID NO: 6883 - protein, 9 aa, Artificial Sequence
  source: /note="Description of Artificial Sequence: Synthetic peptide"
LRNRIKEIM

SEQ ID NO: 6884 - protein, 9 aa, Artificial Sequence
  source: /note="Description of Artificial Sequence: Synthetic peptide"
KEIMLQLIL

SEQ ID NO: 6885 - protein, 9 aa, Artificial Sequence
  source: /note="Description of Artificial Sequence: Synthetic peptide"
LQLILDIAL

SEQ ID NO: 6886 - protein, 10 aa, Artificial Sequence
  source: /note="Description of Artificial Sequence: Synthetic peptide"
SMGRRVAAGL

SEQ ID NO: 6887 - protein, 10 aa, Artificial Sequence
  source: /note="Description of Artificial Sequence: Synthetic peptide"
IMLQLILDIA

SEQ ID NO: 6888 - protein, 10 aa, Artificial Sequence
  source: /note="Description of Artificial Sequence: Synthetic peptide"
MLQLILDIAL

SEQ ID NO: 6889 - protein, 10 aa, Artificial Sequence
  source: /note="Description of Artificial Sequence: Synthetic peptide"
LILDIALFGL

SEQ ID NO: 6890 - protein, 10 aa, Artificial Sequence
  source: /note="Description of Artificial Sequence: Synthetic peptide"
ALFGLRTFRL

SEQ ID NO: 6891 - protein, 10 aa, Artificial Sequence
  source: /note="Description of Artificial Sequence: Synthetic peptide"
ILKRTNLPEA

SEQ ID NO: 6892 - protein, 10 aa, Artificial Sequence
  source: /note="Description of Artificial Sequence: Synthetic peptide"
RIKEIMLQLI

SEQ ID NO: 6893 - protein, 10 aa, Artificial Sequence
  source: /note="Description of Artificial Sequence: Synthetic peptide"
AGLRQTPILK

SEQ ID NO: 6894 - protein, 10 aa, Artificial Sequence
  source: /note="Description of Artificial Sequence: Synthetic peptide"
IALFGLRTFR

SEQ ID NO: 6895 - protein, 10 aa, Artificial Sequence
  source: /note="Description of Artificial Sequence: Synthetic peptide"
KQRGSMGRRV

SEQ ID NO: 6896 - protein, 10 aa, Artificial Sequence
  source: /note="Description of Artificial Sequence: Synthetic peptide"
RGSMGRRVAA

SEQ ID NO: 6897 - protein, 10 aa, Artificial Sequence
  source: /note="Description of Artificial Sequence: Synthetic peptide"
MGRRVAAGLR

SEQ ID NO: 6898 - protein, 10 aa, Artificial Sequence
  source: /note="Description of Artificial Sequence: Synthetic peptide"
GLRQTPILKR

SEQ ID NO: 6899 - protein, 10 aa, Artificial Sequence
  source: /note="Description of Artificial Sequence: Synthetic peptide"
RTNLPEALEA

SEQ ID NO: 6900 - protein, 10 aa, Artificial Sequence
  source: /note="Description of Artificial Sequence: Synthetic peptide"
AVKRNLRNRI

SEQ ID NO: 6901 - protein, 10 aa, Artificial Sequence
  source: /note="Description of Artificial Sequence: Synthetic peptide"
EAVKRNLRNR

SEQ ID NO: 6902 - protein, 10 aa, Artificial Sequence
  source: /note="Description of Artificial Sequence: Synthetic peptide"
EIMLQLILDI

SEQ ID NO: 6903 - protein, 10 aa, Artificial Sequence
  source: /note="Description of Artificial Sequence: Synthetic peptide"
SIIRKQRGSM

SEQ ID NO: 6904 - protein, 10 aa, Artificial Sequence
  source: /note="Description of Artificial Sequence: Synthetic peptide"
NLRNRIKEIM

SEQ ID NO: 6905 - protein, 10 aa, Artificial Sequence
  source: /note="Description of Artificial Sequence: Synthetic peptide"
LQLILDIALF

SEQ ID NO: 6906 - protein, 10 aa, Artificial Sequence
  source: /note="Description of Artificial Sequence: Synthetic peptide"
DIALFGLRTF

SEQ ID NO: 6907 - protein, 10 aa, Artificial Sequence
  source: /note="Description of Artificial Sequence: Synthetic peptide"
KKKKGSISII

SEQ ID NO: 6908 - protein, 10 aa, Artificial Sequence
  source: /note="Description of Artificial Sequence: Synthetic peptide"
RRVAAGLRQT

SEQ ID NO: 6909 - protein, 10 aa, Artificial Sequence
  source: /note="Description of Artificial Sequence: Synthetic peptide"
VAAGLRQTPI

SEQ ID NO: 6910 - protein, 10 aa, Artificial Sequence
  source: /note="Description of Artificial Sequence: Synthetic peptide"
LKRTNLPEAL

SEQ ID NO: 6911 - protein, 10 aa, Artificial Sequence
  source: /note="Description of Artificial Sequence: Synthetic peptide"
IKEIMLQLIL

SEQ ID NO: 6912 - protein, 10 aa, Artificial Sequence
  source: /note="Description of Artificial Sequence: Synthetic peptide"
RSETDTNSEK

SEQ ID NO: 6913 - protein, 9 aa, Artificial Sequence
  source: /note="Description of Artificial Sequence: Synthetic peptide"
IIKRHPPQI

SEQ ID NO: 6914 - protein, 9 aa, Artificial Sequence
  source: /note="Description of Artificial Sequence: Synthetic peptide"
IKRHPPQIL

SEQ ID NO: 6915 - protein, 10 aa, Artificial Sequence
  source: /note="Description of Artificial Sequence: Synthetic peptide"
SIIKRHPPQI

SEQ ID NO: 6916 - protein, 10 aa, Artificial Sequence
  source: /note="Description of Artificial Sequence: Synthetic peptide"
IIKRHPPQIL

SEQ ID NO: 6917 - protein, 10 aa, Artificial Sequence
  source: /note="Description of Artificial Sequence: Synthetic peptide"
KRHPPQILQK

SEQ ID NO: 6918 - protein, 9 aa, Artificial Sequence
  source: /note="Description of Artificial Sequence: Synthetic peptide"
EIMDSGLDK

SEQ ID NO: 6919 - protein, 9 aa, Artificial Sequence
  source: /note="Description of Artificial Sequence: Synthetic peptide"
IMDSGLDKF

SEQ ID NO: 6920 - protein, 10 aa, Artificial Sequence
  source: /note="Description of Artificial Sequence: Synthetic peptide"
EIMDSGLDKF

SEQ ID NO: 6921 - protein, 10 aa, Artificial Sequence
  source: /note="Description of Artificial Sequence: Synthetic peptide"
SEVEIMDSGL

SEQ ID NO: 6922 - protein, 9 aa, Artificial Sequence
  source: /note="Description of Artificial Sequence: Synthetic peptide"
EGSWIPQAR

SEQ ID NO: 6923 - protein, 9 aa, Artificial Sequence
  source: /note="Description of Artificial Sequence: Synthetic peptide"
SWIPQARAL

SEQ ID NO: 6924 - protein, 9 aa, Artificial Sequence
  source: /note="Description of Artificial Sequence: Synthetic peptide"
AEGSWIPQA

SEQ ID NO: 6925 - protein, 10 aa, Artificial Sequence
  source: /note="Description of Artificial Sequence: Synthetic peptide"
SWIPQARALL

SEQ ID NO: 6926 - protein, 10 aa, Artificial Sequence
  source: /note="Description of Artificial Sequence: Synthetic peptide"
GSWIPQARAL

SEQ ID NO: 6927 - protein, 9 aa, Artificial Sequence
  source: /note="Description of Artificial Sequence: Synthetic peptide"
KLDLSHNQL

SEQ ID NO: 6928 - protein, 10 aa, Artificial Sequence
  source: /note="Description of Artificial Sequence: Synthetic peptide"
QLSDVGGEHL

SEQ ID NO: 6929 - protein, 10 aa, Artificial Sequence
  source: /note="Description of Artificial Sequence: Synthetic peptide"
KKLDLSHNQL

SEQ ID NO: 6930 - protein, 9 aa, Artificial Sequence
  source: /note="Description of Artificial Sequence: Synthetic peptide"
SPVSCNHQI

SEQ ID NO: 6931 - protein, 10 aa, Artificial Sequence
  source: /note="Description of Artificial Sequence: Synthetic peptide"
CQRHEETSPV

SEQ ID NO: 6932 - protein, 10 aa, Artificial Sequence
  source: /note="Description of Artificial Sequence: Synthetic peptide"
SPVSCNHQIM

SEQ ID NO: 6933 - protein, 9 aa, Artificial Sequence
  source: /note="Description of Artificial Sequence: Synthetic peptide"
PYPFPPTQI

SEQ ID NO: 6934 - protein, 9 aa, Artificial Sequence
  source: /note="Description of Artificial Sequence: Synthetic peptide"
MAPYPFPPT

SEQ ID NO: 6935 - protein, 10 aa, Artificial Sequence
  source: /note="Description of Artificial Sequence: Synthetic peptide"
SMAPYPFPPT

SEQ ID NO: 6936 - protein, 10 aa, Artificial Sequence
  source: /note="Description of Artificial Sequence: Synthetic peptide"
APYPFPPTQI

SEQ ID NO: 6937 - protein, 9 aa, Artificial Sequence
  source: /note="Description of Artificial Sequence: Synthetic peptide"
NSVIGAAPL

SEQ ID NO: 6938 - protein, 9 aa, Artificial Sequence
  source: /note="Description of Artificial Sequence: Synthetic peptide"
KGGSYNSVI

SEQ ID NO: 6939 - protein, 10 aa, Artificial Sequence
  source: /note="Description of Artificial Sequence: Synthetic peptide"
GSYNSVIGAA

SEQ ID NO: 6940 - protein, 10 aa, Artificial Sequence
  source: /note="Description of Artificial Sequence: Synthetic peptide"
YNSVIGAAPL

SEQ ID NO: 6941 - protein, 9 aa, Artificial Sequence
  source: /note="Description of Artificial Sequence: Synthetic peptide"
SLPAQSFRA

SEQ ID NO: 6942 - protein, 9 aa, Artificial Sequence
  source: /note="Description of Artificial Sequence: Synthetic peptide"
TSLPAQSFR

SEQ ID NO: 6943 - protein, 9 aa, Artificial Sequence
  source: /note="Description of Artificial Sequence: Synthetic peptide"
QSFRAPATA

SEQ ID NO: 6944 - protein, 9 aa, Artificial Sequence
  source: /note="Description of Artificial Sequence: Synthetic peptide"
LPAQSFRAP

SEQ ID NO: 6945 - protein, 9 aa, Artificial Sequence
  source: /note="Description of Artificial Sequence: Synthetic peptide"
STSLPAQSF

SEQ ID NO: 6946 - protein, 9 aa, Artificial Sequence
  source: /note="Description of Artificial Sequence: Synthetic peptide"
AQSFRAPAT

SEQ ID NO: 6947 - protein, 10 aa, Artificial Sequence
  source: /note="Description of Artificial Sequence: Synthetic peptide"
STSLPAQSFR

SEQ ID NO: 6948 - protein, 10 aa, Artificial Sequence
  source: /note="Description of Artificial Sequence: Synthetic peptide"
SFRAPATASN

SEQ ID NO: 6949 - protein, 10 aa, Artificial Sequence
  source: /note="Description of Artificial Sequence: Synthetic peptide"
LPAQSFRAPA

SEQ ID NO: 6950 - protein, 10 aa, Artificial Sequence
  source: /note="Description of Artificial Sequence: Synthetic peptide"
GSTSLPAQSF

SEQ ID NO: 6951 - protein, 10 aa, Artificial Sequence
  source: /note="Description of Artificial Sequence: Synthetic peptide"
AQSFRAPATA

SEQ ID NO: 6952 - protein, 9 aa, Artificial Sequence
  source: /note="Description of Artificial Sequence: Synthetic peptide"
WQQKSDSSF

SEQ ID NO: 6953 - protein, 10 aa, Artificial Sequence
  source: /note="Description of Artificial Sequence: Synthetic peptide"
TLGATDWQQK

SEQ ID NO: 6954 - protein, 10 aa, Artificial Sequence
  source: /note="Description of Artificial Sequence: Synthetic peptide"
WQQKSDSSFI

SEQ ID NO: 6955 - protein, 9 aa, Artificial Sequence
  source: /note="Description of Artificial Sequence: Synthetic peptide"
TWLSTECDF

SEQ ID NO: 6956 - protein, 9 aa, Artificial Sequence
  source: /note="Description of Artificial Sequence: Synthetic peptide"
DFHPLPPSY

SEQ ID NO: 6957 - protein, 9 aa, Artificial Sequence
  source: /note="Description of Artificial Sequence: Synthetic peptide"
STECDFHPL

SEQ ID NO: 6958 - protein, 10 aa, Artificial Sequence
  source: /note="Description of Artificial Sequence: Synthetic peptide"
DFHPLPPSYR

SEQ ID NO: 6959 - protein, 10 aa, Artificial Sequence
  source: /note="Description of Artificial Sequence: Synthetic peptide"
LSTECDFHPL

SEQ ID NO: 6960 - protein, 10 aa, Artificial Sequence
  source: /note="Description of Artificial Sequence: Synthetic peptide"
CDFHPLPPSY

SEQ ID NO: 6961 - protein, 9 aa, Artificial Sequence
  source: /note="Description of Artificial Sequence: Synthetic peptide"
SINFNIIKI

SEQ ID NO: 6962 - protein, 9 aa, Artificial Sequence
  source: /note="Description of Artificial Sequence: Synthetic peptide"
TSINFNIIK

SEQ ID NO: 6963 - protein, 9 aa, Artificial Sequence
  source: /note="Description of Artificial Sequence: Synthetic peptide"
ISTSINFNI

SEQ ID NO: 6964 - protein, 9 aa, Artificial Sequence
  source: /note="Description of Artificial Sequence: Synthetic peptide"
STSINFNII

SEQ ID NO: 6965 - protein, 9 aa, Artificial Sequence
  source: /note="Description of Artificial Sequence: Synthetic peptide"
EHISTSINF

SEQ ID NO: 6966 - protein, 9 aa, Artificial Sequence
  source: /note="Description of Artificial Sequence: Synthetic peptide"
INFNIIKIL

SEQ ID NO: 6967 - protein, 10 aa, Artificial Sequence
  source: /note="Description of Artificial Sequence: Synthetic peptide"
HISTSINFNI

SEQ ID NO: 6968 - protein, 10 aa, Artificial Sequence
  source: /note="Description of Artificial Sequence: Synthetic peptide"
STSINFNIIK

SEQ ID NO: 6969 - protein, 10 aa, Artificial Sequence
  source: /note="Description of Artificial Sequence: Synthetic peptide"
TSINFNIIKI

SEQ ID NO: 6970 - protein, 10 aa, Artificial Sequence
  source: /note="Description of Artificial Sequence: Synthetic peptide"
QEHISTSINF

SEQ ID NO: 6971 - protein, 10 aa, Artificial Sequence
  source: /note="Description of Artificial Sequence: Synthetic peptide"
ISTSINFNII

SEQ ID NO: 6972 - protein, 9 aa, Artificial Sequence
  source: /note="Description of Artificial Sequence: Synthetic peptide"
RQAEQGGWL

SEQ ID NO: 6973 - protein, 9 aa, Artificial Sequence
  source: /note="Description of Artificial Sequence: Synthetic peptide"
VACPVSCPV

SEQ ID NO: 6974 - protein, 10 aa, Artificial Sequence
  source: /note="Description of Artificial Sequence: Synthetic peptide"
PVACPVSCPV

SEQ ID NO: 6975 - protein, 10 aa, Artificial Sequence
  source: /note="Description of Artificial Sequence: Synthetic peptide"
CPVSCPVGSM

SEQ ID NO: 6976 - protein, 9 aa, Artificial Sequence
  source: /note="Description of Artificial Sequence: Synthetic peptide"
REPEAWGPY

SEQ ID NO: 6977 - protein, 9 aa, Artificial Sequence
  source: /note="Description of Artificial Sequence: Synthetic peptide"
RTIREPEAW

SEQ ID NO: 6978 - protein, 10 aa, Artificial Sequence
  source: /note="Description of Artificial Sequence: Synthetic peptide"
EAWGPYRRHR

SEQ ID NO: 6979 - protein, 10 aa, Artificial Sequence
  source: /note="Description of Artificial Sequence: Synthetic peptide"
IREPEAWGPY

SEQ ID NO: 6980 - protein, 9 aa, Artificial Sequence
  source: /note="Description of Artificial Sequence: Synthetic peptide"
IVYERIFSM

SEQ ID NO: 6981 - protein, 9 aa, Artificial Sequence
  source: /note="Description of Artificial Sequence: Synthetic peptide"
TFGKIVYER

SEQ ID NO: 6982 - protein, 9 aa, Artificial Sequence
  source: /note="Description of Artificial Sequence: Synthetic peptide"
DILDTFGKI

SEQ ID NO: 6983 - protein, 9 aa, Artificial Sequence
  source: /note="Description of Artificial Sequence: Synthetic peptide"
LDTFGKIVY

SEQ ID NO: 6984 - protein, 9 aa, Artificial Sequence
  source: /note="Description of Artificial Sequence: Synthetic peptide"
GKIVYERIF

SEQ ID NO: 6985 - protein, 10 aa, Artificial Sequence
  source: /note="Description of Artificial Sequence: Synthetic peptide"
ILDTFGKIVY

SEQ ID NO: 6986 - protein, 10 aa, Artificial Sequence
  source: /note="Description of Artificial Sequence: Synthetic peptide"
TFGKIVYERI

SEQ ID NO: 6987 - protein, 10 aa, Artificial Sequence
  source: /note="Description of Artificial Sequence: Synthetic peptide"
KIVYERIFSM

SEQ ID NO: 6988 - protein, 10 aa, Artificial Sequence
  source: /note="Description of Artificial Sequence: Synthetic peptide"
DTFGKIVYER

SEQ ID NO: 6989 - protein, 10 aa, Artificial Sequence
  source: /note="Description of Artificial Sequence: Synthetic peptide"
FGKIVYERIF

SEQ ID NO: 6990 - protein, 9 aa, Artificial Sequence
  source: /note="Description of Artificial Sequence: Synthetic peptide"
MCVSSSSSH

SEQ ID NO: 6991 - protein, 10 aa, Artificial Sequence
  source: /note="Description of Artificial Sequence: Synthetic peptide"
QMCVSSSSSH

SEQ ID NO: 6992 - protein, 9 aa, Artificial Sequence
  source: /note="Description of Artificial Sequence: Synthetic peptide"
KIINQILIL

SEQ ID NO: 6993 - protein, 9 aa, Artificial Sequence
  source: /note="Description of Artificial Sequence: Synthetic peptide"
NRKIINQIL

SEQ ID NO: 6994 - protein, 9 aa, Artificial Sequence
  source: /note="Description of Artificial Sequence: Synthetic peptide"
RKIINQILI

SEQ ID NO: 6995 - protein, 10 aa, Artificial Sequence
  source: /note="Description of Artificial Sequence: Synthetic peptide"
EINRKIINQI

SEQ ID NO: 6996 - protein, 10 aa, Artificial Sequence
  source: /note="Description of Artificial Sequence: Synthetic peptide"
RKIINQILIL

SEQ ID NO: 6997 - protein, 9 aa, Artificial Sequence
  source: /note="Description of Artificial Sequence: Synthetic peptide"
SLGPGPGEV

SEQ ID NO: 6998 - protein, 9 aa, Artificial Sequence
  source: /note="Description of Artificial Sequence: Synthetic peptide"
VAARSPVLR

SEQ ID NO: 6999 - protein, 9 aa, Artificial Sequence
  source: /note="Description of Artificial Sequence: Synthetic peptide"
EVAARSPVL

SEQ ID NO: 7000 - protein, 9 aa, Artificial Sequence
  source: /note="Description of Artificial Sequence: Synthetic peptide"
GEVAARSPV

SEQ ID NO: 7001 - protein, 10 aa, Artificial Sequence
  source: /note="Description of Artificial Sequence: Synthetic peptide"
EVAARSPVLR

SEQ ID NO: 7002 - protein, 10 aa, Artificial Sequence
  source: /note="Description of Artificial Sequence: Synthetic peptide"
GEVAARSPVL

SEQ ID NO: 7003 - protein, 9 aa, Artificial Sequence
  source: /note="Description of Artificial Sequence: Synthetic peptide"
GVRASLWAA

SEQ ID NO: 7004 - protein, 9 aa, Artificial Sequence
  source: /note="Description of Artificial Sequence: Synthetic peptide"
RASLWAALL

SEQ ID NO: 7005 - protein, 9 aa, Artificial Sequence
  source: /note="Description of Artificial Sequence: Synthetic peptide"
VRASLWAAL

SEQ ID NO: 7006 - protein, 10 aa, Artificial Sequence
  source: /note="Description of Artificial Sequence: Synthetic peptide"
GVRASLWAAL

SEQ ID NO: 7007 - protein, 10 aa, Artificial Sequence
  source: /note="Description of Artificial Sequence: Synthetic peptide"
GWNGVRASLW

SEQ ID NO: 7008 - protein, 10 aa, Artificial Sequence
  source: /note="Description of Artificial Sequence: Synthetic peptide"
RASLWAALLL

SEQ ID NO: 7009 - protein, 10 aa, Artificial Sequence
  source: /note="Description of Artificial Sequence: Synthetic peptide"
GGWNGVRASL

SEQ ID NO: 7010 - protein, 10 aa, Artificial Sequence
  source: /note="Description of Artificial Sequence: Synthetic peptide"
VRASLWAALL

SEQ ID NO: 7011 - protein, 9 aa, Artificial Sequence
  source: /note="Description of Artificial Sequence: Synthetic peptide"
CAVPTWASV

SEQ ID NO: 7012 - protein, 9 aa, Artificial Sequence
  source: /note="Description of Artificial Sequence: Synthetic peptide"
REENKVCAV

SEQ ID NO: 7013 - protein, 9 aa, Artificial Sequence
  source: /note="Description of Artificial Sequence: Synthetic peptide"
NKVCAVPTW

SEQ ID NO: 7014 - protein, 10 aa, Artificial Sequence
  source: /note="Description of Artificial Sequence: Synthetic peptide"
EENKVCAVPT

SEQ ID NO: 7015 - protein, 9 aa, Artificial Sequence
  source: /note="Description of Artificial Sequence: Synthetic peptide"
CVSRQACRY

SEQ ID NO: 7016 - protein, 9 aa, Artificial Sequence
  source: /note="Description of Artificial Sequence: Synthetic peptide"
LQRFTFPSV

SEQ ID NO: 7017 - protein, 9 aa, Artificial Sequence
  source: /note="Description of Artificial Sequence: Synthetic peptide"
SSASTCVSR

SEQ ID NO: 7018 - protein, 9 aa, Artificial Sequence
  source: /note="Description of Artificial Sequence: Synthetic peptide"
SQPLQRFTF

SEQ ID NO: 7019 - protein, 9 aa, Artificial Sequence
  source: /note="Description of Artificial Sequence: Synthetic peptide"
TFPSVTPGM

SEQ ID NO: 7020 - protein, 9 aa, Artificial Sequence
  source: /note="Description of Artificial Sequence: Synthetic peptide"
RQACRYPSS

SEQ ID NO: 7021 - protein, 9 aa, Artificial Sequence
  source: /note="Description of Artificial Sequence: Synthetic peptide"
CTSSASTCV

SEQ ID NO: 7022 - protein, 9 aa, Artificial Sequence
  source: /note="Description of Artificial Sequence: Synthetic peptide"
FTFPSVTPG

SEQ ID NO: 7023 - protein, 9 aa, Artificial Sequence
  source: /note="Description of Artificial Sequence: Synthetic peptide"
VPPPCTSSA

SEQ ID NO: 7024 - protein, 9 aa, Artificial Sequence
  source: /note="Description of Artificial Sequence: Synthetic peptide"
CRYPSSQPL

SEQ ID NO: 7025 - protein, 9 aa, Artificial Sequence
  source: /note="Description of Artificial Sequence: Synthetic peptide"
GEVVPPPCT

SEQ ID NO: 7026 - protein, 10 aa, Artificial Sequence
  source: /note="Description of Artificial Sequence: Synthetic peptide"
PLQRFTFPSV

SEQ ID NO: 7027 - protein, 10 aa, Artificial Sequence
  source: /note="Description of Artificial Sequence: Synthetic peptide"
FTFPSVTPGM

SEQ ID NO: 7028 - protein, 10 aa, Artificial Sequence
  source: /note="Description of Artificial Sequence: Synthetic peptide"
TSSASTCVSR

SEQ ID NO: 7029 - protein, 10 aa, Artificial Sequence
  source: /note="Description of Artificial Sequence: Synthetic peptide"
STCVSRQACR

SEQ ID NO: 7030 - protein, 10 aa, Artificial Sequence
  source: /note="Description of Artificial Sequence: Synthetic peptide"
SSQPLQRFTF

SEQ ID NO: 7031 - protein, 10 aa, Artificial Sequence
  source: /note="Description of Artificial Sequence: Synthetic peptide"
YPSSQPLQRF

SEQ ID NO: 7032 - protein, 10 aa, Artificial Sequence
  source: /note="Description of Artificial Sequence: Synthetic peptide"
FPSVTPGMQA

SEQ ID NO: 7033 - protein, 10 aa, Artificial Sequence
  source: /note="Description of Artificial Sequence: Synthetic peptide"
RQACRYPSSQ

SEQ ID NO: 7034 - protein, 10 aa, Artificial Sequence
  source: /note="Description of Artificial Sequence: Synthetic peptide"
LQRFTFPSVT

SEQ ID NO: 7035 - protein, 9 aa, Artificial Sequence
  source: /note="Description of Artificial Sequence: Synthetic peptide"
NYILNTDSL

SEQ ID NO: 7036 - protein, 9 aa, Artificial Sequence
  source: /note="Description of Artificial Sequence: Synthetic peptide"
SEWKDTNYI

SEQ ID NO: 7037 - protein, 9 aa, Artificial Sequence
  source: /note="Description of Artificial Sequence: Synthetic peptide"
ILNTDSLDW

SEQ ID NO: 7038 - protein, 10 aa, Artificial Sequence
  source: /note="Description of Artificial Sequence: Synthetic peptide"
ILNTDSLDWA

SEQ ID NO: 7039 - protein, 10 aa, Artificial Sequence
  source: /note="Description of Artificial Sequence: Synthetic peptide"
SEWKDTNYIL

SEQ ID NO: 7040 - protein, 10 aa, Artificial Sequence
  source: /note="Description of Artificial Sequence: Synthetic peptide"
YILNTDSLDW

SEQ ID NO: 7041 - protein, 9 aa, Artificial Sequence
  source: /note="Description of Artificial Sequence: Synthetic peptide"
ALSIESVGL

SEQ ID NO: 7042 - protein, 9 aa, Artificial Sequence
  source: /note="Description of Artificial Sequence: Synthetic peptide"
IESVGLLPF

SEQ ID NO: 7043 - protein, 9 aa, Artificial Sequence
  source: /note="Description of Artificial Sequence: Synthetic peptide"
LSIESVGLL

SEQ ID NO: 7044 - protein, 10 aa, Artificial Sequence
  source: /note="Description of Artificial Sequence: Synthetic peptide"
ALSIESVGLL

SEQ ID NO: 7045 - protein, 10 aa, Artificial Sequence
  source: /note="Description of Artificial Sequence: Synthetic peptide"
EALSIESVGL

SEQ ID NO: 7046 - protein, 10 aa, Artificial Sequence
  source: /note="Description of Artificial Sequence: Synthetic peptide"
SIESVGLLPF

SEQ ID NO: 7047 - protein, 10 aa, Artificial Sequence
  source: /note="Description of Artificial Sequence: Synthetic peptide"
QSHPPPRLLA

SEQ ID NO: 7048 - protein, 10 aa, Artificial Sequence
  source: /note="Description of Artificial Sequence: Synthetic peptide"
VEQSHPPPRL

SEQ ID NO: 7049 - protein, 9 aa, Artificial Sequence
  source: /note="Description of Artificial Sequence: Synthetic peptide"
TSSSWSLLI

SEQ ID NO: 7050 - protein, 9 aa, Artificial Sequence
  source: /note="Description of Artificial Sequence: Synthetic peptide"
ILMTTSKYT

SEQ ID NO: 7051 - protein, 9 aa, Artificial Sequence
  source: /note="Description of Artificial Sequence: Synthetic peptide"
SMPTGRTLA

SEQ ID NO: 7052 - protein, 9 aa, Artificial Sequence
  source: /note="Description of Artificial Sequence: Synthetic peptide"
QMSRGTAGA

SEQ ID NO: 7053 - protein, 9 aa, Artificial Sequence
  source: /note="Description of Artificial Sequence: Synthetic peptide"
LLILMTTSK

SEQ ID NO: 7054 - protein, 9 aa, Artificial Sequence
  source: /note="Description of Artificial Sequence: Synthetic peptide"
TLASSVGSK

SEQ ID NO: 7055 - protein, 9 aa, Artificial Sequence
  source: /note="Description of Artificial Sequence: Synthetic peptide"
YTAPMTSYR

SEQ ID NO: 7056 - protein, 9 aa, Artificial Sequence
  source: /note="Description of Artificial Sequence: Synthetic peptide"
RSSSAPSPR

SEQ ID NO: 7057 - protein, 9 aa, Artificial Sequence
  source: /note="Description of Artificial Sequence: Synthetic peptide"
RSYPLTCAA

SEQ ID NO: 7058 - protein, 9 aa, Artificial Sequence
  source: /note="Description of Artificial Sequence: Synthetic peptide"
TTSKYTAPM

SEQ ID NO: 7059 - protein, 9 aa, Artificial Sequence
  source: /note="Description of Artificial Sequence: Synthetic peptide"
MTSYRSMPT

SEQ ID NO: 7060 - protein, 9 aa, Artificial Sequence
  source: /note="Description of Artificial Sequence: Synthetic peptide"
SYRSMPTGR

SEQ ID NO: 7061 - protein, 9 aa, Artificial Sequence
  source: /note="Description of Artificial Sequence: Synthetic peptide"
RSMPTGRTL

SEQ ID NO: 7062 - protein, 9 aa, Artificial Sequence
  source: /note="Description of Artificial Sequence: Synthetic peptide"
RTLASSVGS

SEQ ID NO: 7063 - protein, 9 aa, Artificial Sequence
  source: /note="Description of Artificial Sequence: Synthetic peptide"
SSQMSRGTA

SEQ ID NO: 7064 - protein, 9 aa, Artificial Sequence
  source: /note="Description of Artificial Sequence: Synthetic peptide"
AGSCATPPR

SEQ ID NO: 7065 - protein, 9 aa, Artificial Sequence
  source: /note="Description of Artificial Sequence: Synthetic peptide"
ATPPRSSSA

SEQ ID NO: 7066 - protein, 9 aa, Artificial Sequence
  source: /note="Description of Artificial Sequence: Synthetic peptide"
LILMTTSKY

SEQ ID NO: 7067 - protein, 9 aa, Artificial Sequence
  source: /note="Description of Artificial Sequence: Synthetic peptide"
KYTAPMTSY

SEQ ID NO: 7068 - protein, 9 aa, Artificial Sequence
  source: /note="Description of Artificial Sequence: Synthetic peptide"
TTASGWSGA

SEQ ID NO: 7069 - protein, 9 aa, Artificial Sequence
  source: /note="Description of Artificial Sequence: Synthetic peptide"
CTSSSWSLL

SEQ ID NO: 7070 - protein, 9 aa, Artificial Sequence
  source: /note="Description of Artificial Sequence: Synthetic peptide"
STPAAMLWI

SEQ ID NO: 7071 - protein, 9 aa, Artificial Sequence
  source: /note="Description of Artificial Sequence: Synthetic peptide"
YPRSYPLTC

SEQ ID NO: 7072 - protein, 9 aa, Artificial Sequence
  source: /note="Description of Artificial Sequence: Synthetic peptide"
APMTSYRSM

SEQ ID NO: 7073 - protein, 9 aa, Artificial Sequence
  source: /note="Description of Artificial Sequence: Synthetic peptide"
MPTGRTLAS

SEQ ID NO: 7074 - protein, 9 aa, Artificial Sequence
  source: /note="Description of Artificial Sequence: Synthetic peptide"
LEYPRSYPL

SEQ ID NO: 7075 - protein, 9 aa, Artificial Sequence
  source: /note="Description of Artificial Sequence: Synthetic peptide"
CAATTASGW

SEQ ID NO: 7076 - protein, 9 aa, Artificial Sequence
  source: /note="Description of Artificial Sequence: Synthetic peptide"
SSSWSLLIL

SEQ ID NO: 7077 - protein, 9 aa, Artificial Sequence
  source: /note="Description of Artificial Sequence: Synthetic peptide"
SSWSLLILM

SEQ ID NO: 7078 - protein, 9 aa, Artificial Sequence
  source: /note="Description of Artificial Sequence: Synthetic peptide"
LMTTSKYTA

SEQ ID NO: 7079 - protein, 9 aa, Artificial Sequence
  source: /note="Description of Artificial Sequence: Synthetic peptide"
SKYTAPMTS

SEQ ID NO: 7080 - protein, 9 aa, Artificial Sequence
  source: /note="Description of Artificial Sequence: Synthetic peptide"
LWICCSSQM

SEQ ID NO: 7081 - protein, 9 aa, Artificial Sequence
  source: /note="Description of Artificial Sequence: Synthetic peptide"
SQMSRGTAG

SEQ ID NO: 7082 - protein, 9 aa, Artificial Sequence
  source: /note="Description of Artificial Sequence: Synthetic peptide"
YPLTCAATT

SEQ ID NO: 7083 - protein, 9 aa, Artificial Sequence
  source: /note="Description of Artificial Sequence: Synthetic peptide"
PPTSTPAAM

SEQ ID NO: 7084 - protein, 9 aa, Artificial Sequence
  source: /note="Description of Artificial Sequence: Synthetic peptide"
TSTPAAMLW

SEQ ID NO: 7085 - protein, 9 aa, Artificial Sequence
  source: /note="Description of Artificial Sequence: Synthetic peptide"
TPAAMLWIC

SEQ ID NO: 7086 - protein, 10 aa, Artificial Sequence
  source: /note="Description of Artificial Sequence: Synthetic peptide"
CTSSSWSLLI

SEQ ID NO: 7087 - protein, 10 aa, Artificial Sequence
  source: /note="Description of Artificial Sequence: Synthetic peptide"
SLEYPRSYPL

SEQ ID NO: 7088 - protein, 10 aa, Artificial Sequence
  source: /note="Description of Artificial Sequence: Synthetic peptide"
ILMTTSKYTA

SEQ ID NO: 7089 - protein, 10 aa, Artificial Sequence
  source: /note="Description of Artificial Sequence: Synthetic peptide"
MLWICCSSQM

SEQ ID NO: 7090 - protein, 10 aa, Artificial Sequence
  source: /note="Description of Artificial Sequence: Synthetic peptide"
SQMSRGTAGA

SEQ ID NO: 7091 - protein, 10 aa, Artificial Sequence
  source: /note="Description of Artificial Sequence: Synthetic peptide"
SLLILMTTSK

SEQ ID NO: 7092 - protein, 10 aa, Artificial Sequence
  source: /note="Description of Artificial Sequence: Synthetic peptide"
RTLASSVGSK

SEQ ID NO: 7093 - protein, 10 aa, Artificial Sequence
  source: /note="Description of Artificial Sequence: Synthetic peptide"
TSYRSMPTGR

SEQ ID NO: 7094 - protein, 10 aa, Artificial Sequence
  source: /note="Description of Artificial Sequence: Synthetic peptide"
RSYPLTCAAT

SEQ ID NO: 7095 - protein, 10 aa, Artificial Sequence
  source: /note="Description of Artificial Sequence: Synthetic peptide"
MTTSKYTAPM

SEQ ID NO: 7096 - protein, 10 aa, Artificial Sequence
  source: /note="Description of Artificial Sequence: Synthetic peptide"
KYTAPMTSYR

SEQ ID NO: 7097 - protein, 10 aa, Artificial Sequence
  source: /note="Description of Artificial Sequence: Synthetic peptide"
RSMPTGRTLA

SEQ ID NO: 7098 - protein, 10 aa, Artificial Sequence
  source: /note="Description of Artificial Sequence: Synthetic peptide"
LLILMTTSKY

SEQ ID NO: 7099 - protein, 10 aa, Artificial Sequence
  source: /note="Description of Artificial Sequence: Synthetic peptide"
SKYTAPMTSY

SEQ ID NO: 7100 - protein, 10 aa, Artificial Sequence
  source: /note="Description of Artificial Sequence: Synthetic peptide"
WICCSSQMSR

SEQ ID NO: 7101 - protein, 10 aa, Artificial Sequence
  source: /note="Description of Artificial Sequence: Synthetic peptide"
TTASGWSGAS

SEQ ID NO: 7102 - protein, 10 aa, Artificial Sequence
  source: /note="Description of Artificial Sequence: Synthetic peptide"
YTAPMTSYRS

SEQ ID NO: 7103 - protein, 10 aa, Artificial Sequence
  source: /note="Description of Artificial Sequence: Synthetic peptide"
YPRSYPLTCA

SEQ ID NO: 7104 - protein, 10 aa, Artificial Sequence
  source: /note="Description of Artificial Sequence: Synthetic peptide"
YPLTCAATTA

SEQ ID NO: 7105 - protein, 10 aa, Artificial Sequence
  source: /note="Description of Artificial Sequence: Synthetic peptide"
SPCTSSSWSL

SEQ ID NO: 7106 - protein, 10 aa, Artificial Sequence
  source: /note="Description of Artificial Sequence: Synthetic peptide"
MPTGRTLASS

SEQ ID NO: 7107 - protein, 10 aa, Artificial Sequence
  source: /note="Description of Artificial Sequence: Synthetic peptide"
GPPTSTPAAM

SEQ ID NO: 7108 - protein, 10 aa, Artificial Sequence
  source: /note="Description of Artificial Sequence: Synthetic peptide"
LEYPRSYPLT

SEQ ID NO: 7109 - protein, 10 aa, Artificial Sequence
  source: /note="Description of Artificial Sequence: Synthetic peptide"
GASPCTSSSW

SEQ ID NO: 7110 - protein, 10 aa, Artificial Sequence
  source: /note="Description of Artificial Sequence: Synthetic peptide"
TSSSWSLLIL

SEQ ID NO: 7111 - protein, 10 aa, Artificial Sequence
  source: /note="Description of Artificial Sequence: Synthetic peptide"
SSSWSLLILM

SEQ ID NO: 7112 - protein, 10 aa, Artificial Sequence
  source: /note="Description of Artificial Sequence: Synthetic peptide"
YRSMPTGRTL

SEQ ID NO: 7113 - protein, 10 aa, Artificial Sequence
  source: /note="Description of Artificial Sequence: Synthetic peptide"
SKGPPTSTPA

SEQ ID NO: 7114 - protein, 9 aa, Artificial Sequence
  source: /note="Description of Artificial Sequence: Synthetic peptide"
AAACWATSV

SEQ ID NO: 7115 - protein, 9 aa, Artificial Sequence
  source: /note="Description of Artificial Sequence: Synthetic peptide"
ELQHSIPWA

SEQ ID NO: 7116 - protein, 9 aa, Artificial Sequence
  source: /note="Description of Artificial Sequence: Synthetic peptide"
IMRPSTAAA

SEQ ID NO: 7117 - protein, 9 aa, Artificial Sequence
  source: /note="Description of Artificial Sequence: Synthetic peptide"
ATSVGLAWR

SEQ ID NO: 7118 - protein, 9 aa, Artificial Sequence
  source: /note="Description of Artificial Sequence: Synthetic peptide"
SSRSVCPIM

SEQ ID NO: 7119 - protein, 9 aa, Artificial Sequence
  source: /note="Description of Artificial Sequence: Synthetic peptide"
IPWAPTSSR

SEQ ID NO: 7120 - protein, 9 aa, Artificial Sequence
  source: /note="Description of Artificial Sequence: Synthetic peptide"
STAAACWAT

SEQ ID NO: 7121 - protein, 9 aa, Artificial Sequence
  source: /note="Description of Artificial Sequence: Synthetic peptide"
APTSSRSVC

SEQ ID NO: 7122 - protein, 9 aa, Artificial Sequence
  source: /note="Description of Artificial Sequence: Synthetic peptide"
CPIMRPSTA

SEQ ID NO: 7123 - protein, 9 aa, Artificial Sequence
  source: /note="Description of Artificial Sequence: Synthetic peptide"
LELQHSIPW

SEQ ID NO: 7124 - protein, 9 aa, Artificial Sequence
  source: /note="Description of Artificial Sequence: Synthetic peptide"
LQHSIPWAP

SEQ ID NO: 7125 - protein, 9 aa, Artificial Sequence
  source: /note="Description of Artificial Sequence: Synthetic peptide"
WATSVGLAW

SEQ ID NO: 7126 - protein, 9 aa, Artificial Sequence
  source: /note="Description of Artificial Sequence: Synthetic peptide"
RPSTAAACW

SEQ ID NO: 7127 - protein, 9 aa, Artificial Sequence
  source: /note="Description of Artificial Sequence: Synthetic peptide"
TSVGLAWRW

SEQ ID NO: 7128 - protein, 10 aa, Artificial Sequence
  source: /note="Description of Artificial Sequence: Synthetic peptide"
TAAACWATSV

SEQ ID NO: 7129 - protein, 10 aa, Artificial Sequence
  source: /note="Description of Artificial Sequence: Synthetic peptide"
CWATSVGLAW

SEQ ID NO: 7130 - protein, 10 aa, Artificial Sequence
  source: /note="Description of Artificial Sequence: Synthetic peptide"
SSRSVCPIMR

SEQ ID NO: 7131 - protein, 10 aa, Artificial Sequence
  source: /note="Description of Artificial Sequence: Synthetic peptide"
IMRPSTAAAC

SEQ ID NO: 7132 - protein, 10 aa, Artificial Sequence
  source: /note="Description of Artificial Sequence: Synthetic peptide"
SIPWAPTSSR

SEQ ID NO: 7133 - protein, 10 aa, Artificial Sequence
  source: /note="Description of Artificial Sequence: Synthetic peptide"
WATSVGLAWR

SEQ ID NO: 7134 - protein, 10 aa, Artificial Sequence
  source: /note="Description of Artificial Sequence: Synthetic peptide"
STAAACWATS

SEQ ID NO: 7135 - protein, 10 aa, Artificial Sequence
  source: /note="Description of Artificial Sequence: Synthetic peptide"
CPIMRPSTAA

SEQ ID NO: 7136 - protein, 10 aa, Artificial Sequence
  source: /note="Description of Artificial Sequence: Synthetic peptide"
RPSTAAACWA

SEQ ID NO: 7137 - protein, 10 aa, Artificial Sequence
  source: /note="Description of Artificial Sequence: Synthetic peptide"
LLELQHSIPW

SEQ ID NO: 7138 - protein, 10 aa, Artificial Sequence
  source: /note="Description of Artificial Sequence: Synthetic peptide"
LELQHSIPWA

SEQ ID NO: 7139 - protein, 10 aa, Artificial Sequence
  source: /note="Description of Artificial Sequence: Synthetic peptide"
LQHSIPWAPT

SEQ ID NO: 7140 - protein, 10 aa, Artificial Sequence
  source: /note="Description of Artificial Sequence: Synthetic peptide"
TSSRSVCPIM

SEQ ID NO: 7141 - protein, 10 aa, Artificial Sequence
  source: /note="Description of Artificial Sequence: Synthetic peptide"
AACWATSVGL

SEQ ID NO: 7142 - protein, 9 aa, Artificial Sequence
  source: /note="Description of Artificial Sequence: Synthetic peptide"
GEWELCRAA

SEQ ID NO: 7143 - protein, 9 aa, Artificial Sequence
  source: /note="Description of Artificial Sequence: Synthetic peptide"
CRAAPGPAY

SEQ ID NO: 7144 - protein, 9 aa, Artificial Sequence
  source: /note="Description of Artificial Sequence: Synthetic peptide"
WELCRAAPG

SEQ ID NO: 7145 - protein, 10 aa, Artificial Sequence
  source: /note="Description of Artificial Sequence: Synthetic peptide"
LCRAAPGPAY

SEQ ID NO: 7146 - protein, 10 aa, Artificial Sequence
  source: /note="Description of Artificial Sequence: Synthetic peptide"
WELCRAAPGP

SEQ ID NO: 7147 - protein, 10 aa, Artificial Sequence
  source: /note="Description of Artificial Sequence: Synthetic peptide"
GEWELCRAAP

SEQ ID NO: 7148 - protein, 9 aa, Artificial Sequence
  source: /note="Description of Artificial Sequence: Synthetic peptide"
LEPLGSSTL

SEQ ID NO: 7149 - protein, 10 aa, Artificial Sequence
  source: /note="Description of Artificial Sequence: Synthetic peptide"
ALEPLGSSTL

SEQ ID NO: 7150 - protein, 9 aa, Artificial Sequence
  source: /note="Description of Artificial Sequence: Synthetic peptide"
IAEGLSEKY

SEQ ID NO: 7151 - protein, 10 aa, Artificial Sequence
  source: /note="Description of Artificial Sequence: Synthetic peptide"
GLSEKYGKHV

SEQ ID NO: 7152 - protein, 10 aa, Artificial Sequence
  source: /note="Description of Artificial Sequence: Synthetic peptide"
YGKHVSAEEK

SEQ ID NO: 7153 - protein, 10 aa, Artificial Sequence
  source: /note="Description of Artificial Sequence: Synthetic peptide"
EIAEGLSEKY

SEQ ID NO: 7154 - protein, 10 aa, Artificial Sequence
  source: /note="Description of Artificial Sequence: Synthetic peptide"
SEKYGKHVSA

SEQ ID NO: 7155 - protein, 9 aa, Artificial Sequence
  source: /note="Description of Artificial Sequence: Synthetic peptide"
EEGSESQEA

SEQ ID NO: 7156 - protein, 10 aa, Artificial Sequence
  source: /note="Description of Artificial Sequence: Synthetic peptide"
QEEGSESQEA

SEQ ID NO: 7157 - protein, 10 aa, Artificial Sequence
  source: /note="Description of Artificial Sequence: Synthetic peptide"
EEGSESQEAA

SEQ ID NO: 7158 - protein, 9 aa, Artificial Sequence
  source: /note="Description of Artificial Sequence: Synthetic peptide"
NLSISSEIV

SEQ ID NO: 7159 - protein, 9 aa, Artificial Sequence
  source: /note="Description of Artificial Sequence: Synthetic peptide"
RTQNDFANL

SEQ ID NO: 7160 - protein, 10 aa, Artificial Sequence
  source: /note="Description of Artificial Sequence: Synthetic peptide"
FANLSISSEI

SEQ ID NO: 7161 - protein, 10 aa, Artificial Sequence
  source: /note="Description of Artificial Sequence: Synthetic peptide"
RFRTQNDFAN

SEQ ID NO: 7162 - protein, 10 aa, Artificial Sequence
  source: /note="Description of Artificial Sequence: Synthetic peptide"
FRTQNDFANL

SEQ ID NO: 7163 - protein, 10 aa, Artificial Sequence
  source: /note="Description of Artificial Sequence: Synthetic peptide"
TQNDFANLSI

SEQ ID NO: 7164 - protein, 9 aa, Artificial Sequence
  source: /note="Description of Artificial Sequence: Synthetic peptide"
MLLEPALLY

SEQ ID NO: 7165 - protein, 9 aa, Artificial Sequence
  source: /note="Description of Artificial Sequence: Synthetic peptide"
NMLLEPALL

SEQ ID NO: 7166 - protein, 9 aa, Artificial Sequence
  source: /note="Description of Artificial Sequence: Synthetic peptide"
LLEPALLYL

SEQ ID NO: 7167 - protein, 10 aa, Artificial Sequence
  source: /note="Description of Artificial Sequence: Synthetic peptide"
MLLEPALLYL

SEQ ID NO: 7168 - protein, 10 aa, Artificial Sequence
  source: /note="Description of Artificial Sequence: Synthetic peptide"
LLEPALLYLK

SEQ ID NO: 7169 - protein, 10 aa, Artificial Sequence
  source: /note="Description of Artificial Sequence: Synthetic peptide"
NMLLEPALLY

SEQ ID NO: 7170 - protein, 10 aa, Artificial Sequence
  source: /note="Description of Artificial Sequence: Synthetic peptide"
EPALLYLKEL

SEQ ID NO: 7171 - protein, 10 aa, Artificial Sequence
  source: /note="Description of Artificial Sequence: Synthetic peptide"
LLCGDPQDKV

SEQ ID NO: 7172 - protein, 9 aa, Artificial Sequence
  source: /note="Description of Artificial Sequence: Synthetic peptide"
HSMPLYPPT

SEQ ID NO: 7173 - protein, 9 aa, Artificial Sequence
  source: /note="Description of Artificial Sequence: Synthetic peptide"
SSTPRFCCV

SEQ ID NO: 7174 - protein, 9 aa, Artificial Sequence
  source: /note="Description of Artificial Sequence: Synthetic peptide"
RFCCVTTWR

SEQ ID NO: 7175 - protein, 9 aa, Artificial Sequence
  source: /note="Description of Artificial Sequence: Synthetic peptide"
RKRSSSWAT

SEQ ID NO: 7176 - protein, 9 aa, Artificial Sequence
  source: /note="Description of Artificial Sequence: Synthetic peptide"
KRSSSWATL

SEQ ID NO: 7177 - protein, 9 aa, Artificial Sequence
  source: /note="Description of Artificial Sequence: Synthetic peptide"
MPLYPPTTS

SEQ ID NO: 7178 - protein, 10 aa, Artificial Sequence
  source: /note="Description of Artificial Sequence: Synthetic peptide"
RFCCVTTWRK

SEQ ID NO: 7179 - protein, 10 aa, Artificial Sequence
  source: /note="Description of Artificial Sequence: Synthetic peptide"
TWRKRSSSWA

SEQ ID NO: 7180 - protein, 10 aa, Artificial Sequence
  source: /note="Description of Artificial Sequence: Synthetic peptide"
RKRSSSWATL

SEQ ID NO: 7181 - protein, 10 aa, Artificial Sequence
  source: /note="Description of Artificial Sequence: Synthetic peptide"
RSSSWATLPG

SEQ ID NO: 7182 - protein, 10 aa, Artificial Sequence
  source: /note="Description of Artificial Sequence: Synthetic peptide"
TSSTPRFCCV

SEQ ID NO: 7183 - protein, 10 aa, Artificial Sequence
  source: /note="Description of Artificial Sequence: Synthetic peptide"
MPLYPPTTSS

SEQ ID NO: 7184 - protein, 10 aa, Artificial Sequence
  source: /note="Description of Artificial Sequence: Synthetic peptide"
HSMPLYPPTT

SEQ ID NO: 7185 - protein, 10 aa, Artificial Sequence
  source: /note="Description of Artificial Sequence: Synthetic peptide"
TTWRKRSSSW

SEQ ID NO: 7186 - protein, 10 aa, Artificial Sequence
  source: /note="Description of Artificial Sequence: Synthetic peptide"
TPRFCCVTTW

SEQ ID NO: 7187 - protein, 9 aa, Artificial Sequence
  source: /note="Description of Artificial Sequence: Synthetic peptide"
TYFQIHINK

SEQ ID NO: 7188 - protein, 9 aa, Artificial Sequence
  source: /note="Description of Artificial Sequence: Synthetic peptide"
FQIHINKYK

SEQ ID NO: 7189 - protein, 9 aa, Artificial Sequence
  source: /note="Description of Artificial Sequence: Synthetic peptide"
YFQIHINKY

SEQ ID NO: 7190 - protein, 9 aa, Artificial Sequence
  source: /note="Description of Artificial Sequence: Synthetic peptide"
AKNGTYFQI

SEQ ID NO: 7191 - protein, 10 aa, Artificial Sequence
  source: /note="Description of Artificial Sequence: Synthetic peptide"
GTYFQIHINK

SEQ ID NO: 7192 - protein, 10 aa, Artificial Sequence
  source: /note="Description of Artificial Sequence: Synthetic peptide"
TYFQIHINKY

SEQ ID NO: 7193 - protein, 10 aa, Artificial Sequence
  source: /note="Description of Artificial Sequence: Synthetic peptide"
SAKNGTYFQI

SEQ ID NO: 7194 - protein, 10 aa, Artificial Sequence
  source: /note="Description of Artificial Sequence: Synthetic peptide"
YFQIHINKYK

SEQ ID NO: 7195 - protein, 10 aa, Artificial Sequence
  source: /note="Description of Artificial Sequence: Synthetic peptide"
FQIHINKYKM

SEQ ID NO: 7196 - protein, 10 aa, Artificial Sequence
  source: /note="Description of Artificial Sequence: Synthetic peptide"
AKNGTYFQIH

SEQ ID NO: 7197 - protein, 9 aa, Artificial Sequence
  source: /note="Description of Artificial Sequence: Synthetic peptide"
APTSPLNPA

SEQ ID NO: 7198 - protein, 10 aa, Artificial Sequence
  source: /note="Description of Artificial Sequence: Synthetic peptide"
LPASAPTSPL

SEQ ID NO: 7199 - protein, 10 aa, Artificial Sequence
  source: /note="Description of Artificial Sequence: Synthetic peptide"
SPLNPATRPA

SEQ ID NO: 7200 - protein, 9 aa, Artificial Sequence
  source: /note="Description of Artificial Sequence: Synthetic peptide"
LQFVQQAGV

SEQ ID NO: 7201 - protein, 9 aa, Artificial Sequence
  source: /note="Description of Artificial Sequence: Synthetic peptide"
MQFILLQEI

SEQ ID NO: 7202 - protein, 9 aa, Artificial Sequence
  source: /note="Description of Artificial Sequence: Synthetic peptide"
LLQEILPPL

SEQ ID NO: 7203 - protein, 9 aa, Artificial Sequence
  source: /note="Description of Artificial Sequence: Synthetic peptide"
RLGEKESSI

SEQ ID NO: 7204 - protein, 9 aa, Artificial Sequence
  source: /note="Description of Artificial Sequence: Synthetic peptide"
ALQPRGAGV

SEQ ID NO: 7205 - protein, 9 aa, Artificial Sequence
  source: /note="Description of Artificial Sequence: Synthetic peptide"
GQIPGPRLV

SEQ ID NO: 7206 - protein, 9 aa, Artificial Sequence
  source: /note="Description of Artificial Sequence: Synthetic peptide"
TLHRAPGPA

SEQ ID NO: 7207 - protein, 9 aa, Artificial Sequence
  source: /note="Description of Artificial Sequence: Synthetic peptide"
GLVSGPLGA

SEQ ID NO: 7208 - protein, 9 aa, Artificial Sequence
  source: /note="Description of Artificial Sequence: Synthetic peptide"
LVSGPLGAA

SEQ ID NO: 7209 - protein, 9 aa, Artificial Sequence
  source: /note="Description of Artificial Sequence: Synthetic peptide"
ATGPGSCSK

SEQ ID NO: 7210 - protein, 9 aa, Artificial Sequence
  source: /note="Description of Artificial Sequence: Synthetic peptide"
RSSGGTLHR

SEQ ID NO: 7211 - protein, 9 aa, Artificial Sequence
  source: /note="Description of Artificial Sequence: Synthetic peptide"
VVQRQMPDK

SEQ ID NO: 7212 - protein, 9 aa, Artificial Sequence
  source: /note="Description of Artificial Sequence: Synthetic peptide"
GQKPPQHPV

SEQ ID NO: 7213 - protein, 9 aa, Artificial Sequence
  source: /note="Description of Artificial Sequence: Synthetic peptide"
HLRQGQIPG

SEQ ID NO: 7214 - protein, 9 aa, Artificial Sequence
  source: /note="Description of Artificial Sequence: Synthetic peptide"
GNSARLGEK

SEQ ID NO: 7215 - protein, 9 aa, Artificial Sequence
  source: /note="Description of Artificial Sequence: Synthetic peptide"
KTQPGTRPG

SEQ ID NO: 7216 - protein, 9 aa, Artificial Sequence
  source: /note="Description of Artificial Sequence: Synthetic peptide"
GTRPGPPTC

SEQ ID NO: 7217 - protein, 9 aa, Artificial Sequence
  source: /note="Description of Artificial Sequence: Synthetic peptide"
CFSSGNSAR

SEQ ID NO: 7218 - protein, 9 aa, Artificial Sequence
  source: /note="Description of Artificial Sequence: Synthetic peptide"
FSSGNSARL

SEQ ID NO: 7219 - protein, 9 aa, Artificial Sequence
  source: /note="Description of Artificial Sequence: Synthetic peptide"
DAAELGAAM

SEQ ID NO: 7220 - protein, 9 aa, Artificial Sequence
  source: /note="Description of Artificial Sequence: Synthetic peptide"
GPRLVLQFV

SEQ ID NO: 7221 - protein, 9 aa, Artificial Sequence
  source: /note="Description of Artificial Sequence: Synthetic peptide"
GARSSGGTL

SEQ ID NO: 7222 - protein, 9 aa, Artificial Sequence
  source: /note="Description of Artificial Sequence: Synthetic peptide"
GPACARDAA

SEQ ID NO: 7223 - protein, 9 aa, Artificial Sequence
  source: /note="Description of Artificial Sequence: Synthetic peptide"
MPGLVSGPL

SEQ ID NO: 7224 - protein, 9 aa, Artificial Sequence
  source: /note="Description of Artificial Sequence: Synthetic peptide"
QPRGAGVQL

SEQ ID NO: 7225 - protein, 9 aa, Artificial Sequence
  source: /note="Description of Artificial Sequence: Synthetic peptide"
SLHLRQGQI

SEQ ID NO: 7226 - protein, 9 aa, Artificial Sequence
  source: /note="Description of Artificial Sequence: Synthetic peptide"
GKLCHEGSL

SEQ ID NO: 7227 - protein, 9 aa, Artificial Sequence
  source: /note="Description of Artificial Sequence: Synthetic peptide"
LCHEGSLHL

SEQ ID NO: 7228 - protein, 9 aa, Artificial Sequence
  source: /note="Description of Artificial Sequence: Synthetic peptide"
GVCGPGMQF

SEQ ID NO: 7229 - protein, 9 aa, Artificial Sequence
  source: /note="Description of Artificial Sequence: Synthetic peptide"
GEHQCFSSG

SEQ ID NO: 7230 - protein, 9 aa, Artificial Sequence
  source: /note="Description of Artificial Sequence: Synthetic peptide"
KEDPQPARF

SEQ ID NO: 7231 - protein, 9 aa, Artificial Sequence
  source: /note="Description of Artificial Sequence: Synthetic peptide"
ARFSDVSAT

SEQ ID NO: 7232 - protein, 9 aa, Artificial Sequence
  source: /note="Description of Artificial Sequence: Synthetic peptide"
LHRAPGPAC

SEQ ID NO: 7233 - protein, 9 aa, Artificial Sequence
  source: /note="Description of Artificial Sequence: Synthetic peptide"
VSGPLGAAL

SEQ ID NO: 7234 - protein, 9 aa, Artificial Sequence
  source: /note="Description of Artificial Sequence: Synthetic peptide"
SKRVVQRQM

SEQ ID NO: 7235 - protein, 9 aa, Artificial Sequence
  source: /note="Description of Artificial Sequence: Synthetic peptide"
RQMPDKTQP

SEQ ID NO: 7236 - protein, 9 aa, Artificial Sequence
  source: /note="Description of Artificial Sequence: Synthetic peptide"
AELGAAMPG

SEQ ID NO: 7237 - protein, 10 aa, Artificial Sequence
  source: /note="Description of Artificial Sequence: Synthetic peptide"
KLCHEGSLHL

SEQ ID NO: 7238 - protein, 10 aa, Artificial Sequence
  source: /note="Description of Artificial Sequence: Synthetic peptide"
VLQFVQQAGV

SEQ ID NO: 7239 - protein, 10 aa, Artificial Sequence
  source: /note="Description of Artificial Sequence: Synthetic peptide"
GMQFILLQEI

SEQ ID NO: 7240 - protein, 10 aa, Artificial Sequence
  source: /note="Description of Artificial Sequence: Synthetic peptide"
MQFILLQEIL

SEQ ID NO: 7241 - protein, 10 aa, Artificial Sequence
  source: /note="Description of Artificial Sequence: Synthetic peptide"
ILLQEILPPL

SEQ ID NO: 7242 - protein, 10 aa, Artificial Sequence
  source: /note="Description of Artificial Sequence: Synthetic peptide"
LLQEILPPLC

SEQ ID NO: 7243 - protein, 10 aa, Artificial Sequence
  source: /note="Description of Artificial Sequence: Synthetic peptide"
AMPGLVSGPL

SEQ ID NO: 7244 - protein, 10 aa, Artificial Sequence
  source: /note="Description of Artificial Sequence: Synthetic peptide"
RLVLQFVQQA

SEQ ID NO: 7245 - protein, 10 aa, Artificial Sequence
  source: /note="Description of Artificial Sequence: Synthetic peptide"
ELGAAMPGLV

SEQ ID NO: 7246 - protein, 10 aa, Artificial Sequence
  source: /note="Description of Artificial Sequence: Synthetic peptide"
GLVSGPLGAA

SEQ ID NO: 7247 - protein, 10 aa, Artificial Sequence
  source: /note="Description of Artificial Sequence: Synthetic peptide"
LVSGPLGAAL

SEQ ID NO: 7248 - protein, 10 aa, Artificial Sequence
  source: /note="Description of Artificial Sequence: Synthetic peptide"
RLGEKESSIK

SEQ ID NO: 7249 - protein, 10 aa, Artificial Sequence
  source: /note="Description of Artificial Sequence: Synthetic peptide"
RVVQRQMPDK

SEQ ID NO: 7250 - protein, 10 aa, Artificial Sequence
  source: /note="Description of Artificial Sequence: Synthetic peptide"
AATGPGSCSK

SEQ ID NO: 7251 - protein, 10 aa, Artificial Sequence
  source: /note="Description of Artificial Sequence: Synthetic peptide"
SGNSARLGEK

SEQ ID NO: 7252 - protein, 10 aa, Artificial Sequence
  source: /note="Description of Artificial Sequence: Synthetic peptide"
SIKEDPQPAR

SEQ ID NO: 7253 - protein, 10 aa, Artificial Sequence
  source: /note="Description of Artificial Sequence: Synthetic peptide"
RSSGGTLHRA

SEQ ID NO: 7254 - protein, 10 aa, Artificial Sequence
  source: /note="Description of Artificial Sequence: Synthetic peptide"
GTLHRAPGPA

SEQ ID NO: 7255 - protein, 10 aa, Artificial Sequence
  source: /note="Description of Artificial Sequence: Synthetic peptide"
IPGPRLVLQF

SEQ ID NO: 7256 - protein, 10 aa, Artificial Sequence
  source: /note="Description of Artificial Sequence: Synthetic peptide"
QQAGVCGPGM

SEQ ID NO: 7257 - protein, 10 aa, Artificial Sequence
  source: /note="Description of Artificial Sequence: Synthetic peptide"
RQGQIPGPRL

SEQ ID NO: 7258 - protein, 10 aa, Artificial Sequence
  source: /note="Description of Artificial Sequence: Synthetic peptide"
GQIPGPRLVL

SEQ ID NO: 7259 - protein, 10 aa, Artificial Sequence
  source: /note="Description of Artificial Sequence: Synthetic peptide"
LQFVQQAGVC

SEQ ID NO: 7260 - protein, 10 aa, Artificial Sequence
  source: /note="Description of Artificial Sequence: Synthetic peptide"
AGVCGPGMQF

SEQ ID NO: 7261 - protein, 10 aa, Artificial Sequence
  source: /note="Description of Artificial Sequence: Synthetic peptide"
HQCFSSGNSA

SEQ ID NO: 7262 - protein, 10 aa, Artificial Sequence
  source: /note="Description of Artificial Sequence: Synthetic peptide"
IKEDPQPARF

SEQ ID NO: 7263 - protein, 10 aa, Artificial Sequence
  source: /note="Description of Artificial Sequence: Synthetic peptide"
RDAAELGAAM

SEQ ID NO: 7264 - protein, 10 aa, Artificial Sequence
  source: /note="Description of Artificial Sequence: Synthetic peptide"
AELGAAMPGL

SEQ ID NO: 7265 - protein, 10 aa, Artificial Sequence
  source: /note="Description of Artificial Sequence: Synthetic peptide"
LQPRGAGVQL

SEQ ID NO: 7266 - protein, 10 aa, Artificial Sequence
  source: /note="Description of Artificial Sequence: Synthetic peptide"
VQLGAATGPG

SEQ ID NO: 7267 - protein, 10 aa, Artificial Sequence
  source: /note="Description of Artificial Sequence: Synthetic peptide"
CSKRVVQRQM

SEQ ID NO: 7268 - protein, 10 aa, Artificial Sequence
  source: /note="Description of Artificial Sequence: Synthetic peptide"
RQMPDKTQPG

SEQ ID NO: 7269 - protein, 10 aa, Artificial Sequence
  source: /note="Description of Artificial Sequence: Synthetic peptide"
GEHQCFSSGN

SEQ ID NO: 7270 - protein, 9 aa, Artificial Sequence
  source: /note="Description of Artificial Sequence: Synthetic peptide"
WPRGEDAPC

SEQ ID NO: 7271 - protein, 9 aa, Artificial Sequence
  source: /note="Description of Artificial Sequence: Synthetic peptide"
GEDAPCYES

SEQ ID NO: 7272 - protein, 10 aa, Artificial Sequence
  source: /note="Description of Artificial Sequence: Synthetic peptide"
WPRGEDAPCY

SEQ ID NO: 7273 - protein, 9 aa, Artificial Sequence
  source: /note="Description of Artificial Sequence: Synthetic peptide"
YSTFSAPLK

SEQ ID NO: 7274 - protein, 9 aa, Artificial Sequence
  source: /note="Description of Artificial Sequence: Synthetic peptide"
STFSAPLKK

SEQ ID NO: 7275 - protein, 9 aa, Artificial Sequence
  source: /note="Description of Artificial Sequence: Synthetic peptide"
PLKKANRKK

SEQ ID NO: 7276 - protein, 9 aa, Artificial Sequence
  source: /note="Description of Artificial Sequence: Synthetic peptide"
SAPLKKANR

SEQ ID NO: 7277 - protein, 10 aa, Artificial Sequence
  source: /note="Description of Artificial Sequence: Synthetic peptide"
TYSTFSAPLK

SEQ ID NO: 7278 - protein, 10 aa, Artificial Sequence
  source: /note="Description of Artificial Sequence: Synthetic peptide"
YSTFSAPLKK

SEQ ID NO: 7279 - protein, 10 aa, Artificial Sequence
  source: /note="Description of Artificial Sequence: Synthetic peptide"
STFSAPLKKA

SEQ ID NO: 7280 - protein, 10 aa, Artificial Sequence
  source: /note="Description of Artificial Sequence: Synthetic peptide"
SAPLKKANRK

SEQ ID NO: 7281 - protein, 10 aa, Artificial Sequence
  source: /note="Description of Artificial Sequence: Synthetic peptide"
FSAPLKKANR

SEQ ID NO: 7282 - protein, 9 aa, Artificial Sequence
  source: /note="Description of Artificial Sequence: Synthetic peptide"
RYRTGHRLL

SEQ ID NO: 7283 - protein, 9 aa, Artificial Sequence
  source: /note="Description of Artificial Sequence: Synthetic peptide"
RTGHRLLAF

SEQ ID NO: 7284 - protein, 9 aa, Artificial Sequence
  source: /note="Description of Artificial Sequence: Synthetic peptide"
HRLLAFPQL

SEQ ID NO: 7285 - protein, 10 aa, Artificial Sequence
  source: /note="Description of Artificial Sequence: Synthetic peptide"
RYRTGHRLLA

SEQ ID NO: 7286 - protein, 10 aa, Artificial Sequence
  source: /note="Description of Artificial Sequence: Synthetic peptide"
LPRYRTGHRL

SEQ ID NO: 7287 - protein, 10 aa, Artificial Sequence
  source: /note="Description of Artificial Sequence: Synthetic peptide"
YRTGHRLLAF

SEQ ID NO: 7288 - protein, 10 aa, Artificial Sequence
  source: /note="Description of Artificial Sequence: Synthetic peptide"
GHRLLAFPQL

SEQ ID NO: 7289 - protein, 10 aa, Artificial Sequence
  source: /note="Description of Artificial Sequence: Synthetic peptide"
HRLLAFPQLL

SEQ ID NO: 7290 - protein, 9 aa, Artificial Sequence
  source: /note="Description of Artificial Sequence: Synthetic peptide"
SSSSEESPK

SEQ ID NO: 7291 - protein, 10 aa, Artificial Sequence
  source: /note="Description of Artificial Sequence: Synthetic peptide"
SSSSEESPKK

SEQ ID NO: 7292 - protein, 10 aa, Artificial Sequence
  source: /note="Description of Artificial Sequence: Synthetic peptide"
SQLGQNSSSS

SEQ ID NO: 7293 - protein, 9 aa, Artificial Sequence
  source: /note="Description of Artificial Sequence: Synthetic peptide"
YPSVGGAPR

SEQ ID NO: 7294 - protein, 10 aa, Artificial Sequence
  source: /note="Description of Artificial Sequence: Synthetic peptide"
SYPSVGGAPR

SEQ ID NO: 7295 - protein, 9 aa, Artificial Sequence
  source: /note="Description of Artificial Sequence: Synthetic peptide"
TVTIPPSPR

SEQ ID NO: 7296 - protein, 9 aa, Artificial Sequence
  source: /note="Description of Artificial Sequence: Synthetic peptide"
IPPSPRCPF

SEQ ID NO: 7297 - protein, 10 aa, Artificial Sequence
  source: /note="Description of Artificial Sequence: Synthetic peptide"
QTVTIPPSPR

SEQ ID NO: 7298 - protein, 10 aa, Artificial Sequence
  source: /note="Description of Artificial Sequence: Synthetic peptide"
SPRCPFHMSS

SEQ ID NO: 7299 - protein, 10 aa, Artificial Sequence
  source: /note="Description of Artificial Sequence: Synthetic peptide"
HQQTVTIPPS

SEQ ID NO: 7300 - protein, 9 aa, Artificial Sequence
  source: /note="Description of Artificial Sequence: Synthetic peptide"
VTLALQQQR

SEQ ID NO: 7301 - protein, 9 aa, Artificial Sequence
  source: /note="Description of Artificial Sequence: Synthetic peptide"
QQRNLHEHK

SEQ ID NO: 7302 - protein, 9 aa, Artificial Sequence
  source: /note="Description of Artificial Sequence: Synthetic peptide"
KQVTLALQQ

SEQ ID NO: 7303 - protein, 9 aa, Artificial Sequence
  source: /note="Description of Artificial Sequence: Synthetic peptide"
QQQRNLHEH

SEQ ID NO: 7304 - protein, 10 aa, Artificial Sequence
  source: /note="Description of Artificial Sequence: Synthetic peptide"
QVTLALQQQR

SEQ ID NO: 7305 - protein, 10 aa, Artificial Sequence
  source: /note="Description of Artificial Sequence: Synthetic peptide"
KQVTLALQQQ

SEQ ID NO: 7306 - protein, 10 aa, Artificial Sequence
  source: /note="Description of Artificial Sequence: Synthetic peptide"
LQQQRNLHEH

SEQ ID NO: 7307 - protein, 10 aa, Artificial Sequence
  source: /note="Description of Artificial Sequence: Synthetic peptide"
QQRNLHEHKV

SEQ ID NO: 7308 - protein, 9 aa, Artificial Sequence
  source: /note="Description of Artificial Sequence: Synthetic peptide"
LYNHQQLGR

SEQ ID NO: 7309 - protein, 9 aa, Artificial Sequence
  source: /note="Description of Artificial Sequence: Synthetic peptide"
QQLGRGSPC

SEQ ID NO: 7310 - protein, 10 aa, Artificial Sequence
  source: /note="Description of Artificial Sequence: Synthetic peptide"
TLYNHQQLGR

SEQ ID NO: 7311 - protein, 10 aa, Artificial Sequence
  source: /note="Description of Artificial Sequence: Synthetic peptide"
HQQLGRGSPC

SEQ ID NO: 7312 - protein, 10 aa, Artificial Sequence
  source: /note="Description of Artificial Sequence: Synthetic peptide"
QQLGRGSPCI

SEQ ID NO: 7313 - protein, 10 aa, Artificial Sequence
  source: /note="Description of Artificial Sequence: Synthetic peptide"
CLKDELSHQL

SEQ ID NO: 7314 - protein, 10 aa, Artificial Sequence
  source: /note="Description of Artificial Sequence: Synthetic peptide"
KELDCLKDEL

SEQ ID NO: 7315 - protein, 10 aa, Artificial Sequence
  source: /note="Description of Artificial Sequence: Synthetic peptide"
LPLRKELDCL

SEQ ID NO: 7316 - protein, 9 aa, Artificial Sequence
  source: /note="Description of Artificial Sequence: Synthetic peptide"
VQIESGSSV

SEQ ID NO: 7317 - protein, 9 aa, Artificial Sequence
  source: /note="Description of Artificial Sequence: Synthetic peptide"
IESGSSVPS

SEQ ID NO: 7318 - protein, 10 aa, Artificial Sequence
  source: /note="Description of Artificial Sequence: Synthetic peptide"
SVQIESGSSV

SEQ ID NO: 7319 - protein, 10 aa, Artificial Sequence
  source: /note="Description of Artificial Sequence: Synthetic peptide"
VQIESGSSVP

SEQ ID NO: 7320 - protein, 9 aa, Artificial Sequence
  source: /note="Description of Artificial Sequence: Synthetic peptide"
TFADVVWLV

SEQ ID NO: 7321 - protein, 9 aa, Artificial Sequence
  source: /note="Description of Artificial Sequence: Synthetic peptide"
WLVSNASML

SEQ ID NO: 7322 - protein, 9 aa, Artificial Sequence
  source: /note="Description of Artificial Sequence: Synthetic peptide"
HTFADVVWL

SEQ ID NO: 7323 - protein, 9 aa, Artificial Sequence
  source: /note="Description of Artificial Sequence: Synthetic peptide"
DVVWLVSNA

SEQ ID NO: 7324 - protein, 9 aa, Artificial Sequence
  source: /note="Description of Artificial Sequence: Synthetic peptide"
VWLVSNASM

SEQ ID NO: 7325 - protein, 10 aa, Artificial Sequence
  source: /note="Description of Artificial Sequence: Synthetic peptide"
HTFADVVWLV

SEQ ID NO: 7326 - protein, 10 aa, Artificial Sequence
  source: /note="Description of Artificial Sequence: Synthetic peptide"
WLVSNASMLV

SEQ ID NO: 7327 - protein, 10 aa, Artificial Sequence
  source: /note="Description of Artificial Sequence: Synthetic peptide"
VWLVSNASML

SEQ ID NO: 7328 - protein, 10 aa, Artificial Sequence
  source: /note="Description of Artificial Sequence: Synthetic peptide"
VVWLVSNASM

SEQ ID NO: 7329 - protein, 9 aa, Artificial Sequence
  source: /note="Description of Artificial Sequence: Synthetic peptide"
QTIEELAGK

SEQ ID NO: 7330 - protein, 9 aa, Artificial Sequence
  source: /note="Description of Artificial Sequence: Synthetic peptide"
IDHTSIQTI

SEQ ID NO: 7331 - protein, 9 aa, Artificial Sequence
  source: /note="Description of Artificial Sequence: Synthetic peptide"
TSIQTIEEL

SEQ ID NO: 7332 - protein, 10 aa, Artificial Sequence
  source: /note="Description of Artificial Sequence: Synthetic peptide"
MIDHTSIQTI

SEQ ID NO: 7333 - protein, 10 aa, Artificial Sequence
  source: /note="Description of Artificial Sequence: Synthetic peptide"
HTSIQTIEEL

SEQ ID NO: 7334 - protein, 10 aa, Artificial Sequence
  source: /note="Description of Artificial Sequence: Synthetic peptide"
QTIEELAGKI

SEQ ID NO: 7335 - protein, 9 aa, Artificial Sequence
  source: /note="Description of Artificial Sequence: Synthetic peptide"
AAALPASER

SEQ ID NO: 7336 - protein, 10 aa, Artificial Sequence
  source: /note="Description of Artificial Sequence: Synthetic peptide"
SAAALPASER

SEQ ID NO: 7337 - protein, 10 aa, Artificial Sequence
  source: /note="Description of Artificial Sequence: Synthetic peptide"
AALPASERGW

SEQ ID NO: 7338 - protein, 9 aa, Artificial Sequence
  source: /note="Description of Artificial Sequence: Synthetic peptide"
VQVETAREG

SEQ ID NO: 7339 - protein, 9 aa, Artificial Sequence
  source: /note="Description of Artificial Sequence: Synthetic peptide"
EVNINGESR

SEQ ID NO: 7340 - protein, 9 aa, Artificial Sequence
  source: /note="Description of Artificial Sequence: Synthetic peptide"
FISRYQIQV

SEQ ID NO: 7341 - protein, 10 aa, Artificial Sequence
  source: /note="Description of Artificial Sequence: Synthetic peptide"
ISRYQIQVGK

SEQ ID NO: 7342 - protein, 10 aa, Artificial Sequence
  source: /note="Description of Artificial Sequence: Synthetic peptide"
KPNFISRYQI

SEQ ID NO: 7343 - protein, 10 aa, Artificial Sequence
  source: /note="Description of Artificial Sequence: Synthetic peptide"
YQIQVGKNEP

SEQ ID NO: 7344 - protein, 9 aa, Artificial Sequence
  source: /note="Description of Artificial Sequence: Synthetic peptide"
SLGPLRAAA

SEQ ID NO: 7345 - protein, 9 aa, Artificial Sequence
  source: /note="Description of Artificial Sequence: Synthetic peptide"
GPLRAAAGF

SEQ ID NO: 7346 - protein, 10 aa, Artificial Sequence
  source: /note="Description of Artificial Sequence: Synthetic peptide"
RAAAGFVQTA

SEQ ID NO: 7347 - protein, 10 aa, Artificial Sequence
  source: /note="Description of Artificial Sequence: Synthetic peptide"
ESLGPLRAAA

SEQ ID NO: 7348 - protein, 10 aa, Artificial Sequence
  source: /note="Description of Artificial Sequence: Synthetic peptide"
DESLGPLRAA

SEQ ID NO: 7349 - protein, 9 aa, Artificial Sequence
  source: /note="Description of Artificial Sequence: Synthetic peptide"
KLQVSRHTK

SEQ ID NO: 7350 - protein, 9 aa, Artificial Sequence
  source: /note="Description of Artificial Sequence: Synthetic peptide"
VSRHTKFGY

SEQ ID NO: 7351 - protein, 9 aa, Artificial Sequence
  source: /note="Description of Artificial Sequence: Synthetic peptide"
HTKFGYGVL

SEQ ID NO: 7352 - protein, 9 aa, Artificial Sequence
  source: /note="Description of Artificial Sequence: Synthetic peptide"
LQVSRHTKF

SEQ ID NO: 7353 - protein, 9 aa, Artificial Sequence
  source: /note="Description of Artificial Sequence: Synthetic peptide"
RHTKFGYGV

SEQ ID NO: 7354 - protein, 9 aa, Artificial Sequence
  source: /note="Description of Artificial Sequence: Synthetic peptide"
TKFGYGVLV

SEQ ID NO: 7355 - protein, 10 aa, Artificial Sequence
  source: /note="Description of Artificial Sequence: Synthetic peptide"
KLQVSRHTKF

SEQ ID NO: 7356 - protein, 10 aa, Artificial Sequence
  source: /note="Description of Artificial Sequence: Synthetic peptide"
KKLQVSRHTK

SEQ ID NO: 7357 - protein, 10 aa, Artificial Sequence
  source: /note="Description of Artificial Sequence: Synthetic peptide"
VSRHTKFGYG

SEQ ID NO: 7358 - protein, 10 aa, Artificial Sequence
  source: /note="Description of Artificial Sequence: Synthetic peptide"
HTKFGYGVLV

SEQ ID NO: 7359 - protein, 10 aa, Artificial Sequence
  source: /note="Description of Artificial Sequence: Synthetic peptide"
QVSRHTKFGY

SEQ ID NO: 7360 - protein, 10 aa, Artificial Sequence
  source: /note="Description of Artificial Sequence: Synthetic peptide"
RHTKFGYGVL

SEQ ID NO: 7361 - protein, 10 aa, Artificial Sequence
  source: /note="Description of Artificial Sequence: Synthetic peptide"
TKFGYGVLVT

SEQ ID NO: 7362 - protein, 9 aa, Artificial Sequence
  source: /note="Description of Artificial Sequence: Synthetic peptide"
AVSSPYSCV

SEQ ID NO: 7363 - protein, 9 aa, Artificial Sequence
  source: /note="Description of Artificial Sequence: Synthetic peptide"
EPQRPPPAV

SEQ ID NO: 7364 - protein, 9 aa, Artificial Sequence
  source: /note="Description of Artificial Sequence: Synthetic peptide"
PPPAVSSPY

SEQ ID NO: 7365 - protein, 10 aa, Artificial Sequence
  source: /note="Description of Artificial Sequence: Synthetic peptide"
RPPPAVSSPY

SEQ ID NO: 7366 - protein, 10 aa, Artificial Sequence
  source: /note="Description of Artificial Sequence: Synthetic peptide"
EMKNASCVQK

SEQ ID NO: 7367 - protein, 10 aa, Artificial Sequence
  source: /note="Description of Artificial Sequence: Synthetic peptide"
SPEMKNASCV

SEQ ID NO: 7368 - protein, 9 aa, Artificial Sequence
  source: /note="Description of Artificial Sequence: Synthetic peptide"
SQRPGVPAL

SEQ ID NO: 7369 - protein, 9 aa, Artificial Sequence
  source: /note="Description of Artificial Sequence: Synthetic peptide"
AGALRRRRK

SEQ ID NO: 7370 - protein, 9 aa, Artificial Sequence
  source: /note="Description of Artificial Sequence: Synthetic peptide"
GALRRRRKR

SEQ ID NO: 7371 - protein, 9 aa, Artificial Sequence
  source: /note="Description of Artificial Sequence: Synthetic peptide"
ALRRRRKRM

SEQ ID NO: 7372 - protein, 9 aa, Artificial Sequence
  source: /note="Description of Artificial Sequence: Synthetic peptide"
RPGVPALPV

SEQ ID NO: 7373 - protein, 10 aa, Artificial Sequence
  source: /note="Description of Artificial Sequence: Synthetic peptide"
GLSPSQRPGV

SEQ ID NO: 7374 - protein, 10 aa, Artificial Sequence
  source: /note="Description of Artificial Sequence: Synthetic peptide"
VAGALRRRRK

SEQ ID NO: 7375 - protein, 10 aa, Artificial Sequence
  source: /note="Description of Artificial Sequence: Synthetic peptide"
SPSQRPGVPA

SEQ ID NO: 7376 - protein, 10 aa, Artificial Sequence
  source: /note="Description of Artificial Sequence: Synthetic peptide"
RPGVPALPVA

SEQ ID NO: 7377 - protein, 10 aa, Artificial Sequence
  source: /note="Description of Artificial Sequence: Synthetic peptide"
VPALPVAGAL

SEQ ID NO: 7378 - protein, 10 aa, Artificial Sequence
  source: /note="Description of Artificial Sequence: Synthetic peptide"
ALRRRRKRMC

SEQ ID NO: 7379 - protein, 10 aa, Artificial Sequence
  source: /note="Description of Artificial Sequence: Synthetic peptide"
SQRPGVPALP

SEQ ID NO: 7380 - protein, 9 aa, Artificial Sequence
  source: /note="Description of Artificial Sequence: Synthetic peptide"
RLSKGFQLL

SEQ ID NO: 7381 - protein, 9 aa, Artificial Sequence
  source: /note="Description of Artificial Sequence: Synthetic peptide"
VMAGSVPSA

SEQ ID NO: 7382 - protein, 9 aa, Artificial Sequence
  source: /note="Description of Artificial Sequence: Synthetic peptide"
NLLWREMSI

SEQ ID NO: 7383 - protein, 9 aa, Artificial Sequence
  source: /note="Description of Artificial Sequence: Synthetic peptide"
CLRPHRVQL

SEQ ID NO: 7384 - protein, 9 aa, Artificial Sequence
  source: /note="Description of Artificial Sequence: Synthetic peptide"
EMSIFLPGI

SEQ ID NO: 7385 - protein, 9 aa, Artificial Sequence
  source: /note="Description of Artificial Sequence: Synthetic peptide"
LSKGFQLLR

SEQ ID NO: 7386 - protein, 9 aa, Artificial Sequence
  source: /note="Description of Artificial Sequence: Synthetic peptide"
MSIFLPGIF

SEQ ID NO: 7387 - protein, 9 aa, Artificial Sequence
  source: /note="Description of Artificial Sequence: Synthetic peptide"
RPHRVQLLR

SEQ ID NO: 7388 - protein, 9 aa, Artificial Sequence
  source: /note="Description of Artificial Sequence: Synthetic peptide"
RVQLLRRWG

SEQ ID NO: 7389 - protein, 9 aa, Artificial Sequence
  source: /note="Description of Artificial Sequence: Synthetic peptide"
RWWGPGSPA

SEQ ID NO: 7390 - protein, 9 aa, Artificial Sequence
  source: /note="Description of Artificial Sequence: Synthetic peptide"
LWREMSIFL

SEQ ID NO: 7391 - protein, 9 aa, Artificial Sequence
  source: /note="Description of Artificial Sequence: Synthetic peptide"
TVMAGSVPS

SEQ ID NO: 7392 - protein, 9 aa, Artificial Sequence
  source: /note="Description of Artificial Sequence: Synthetic peptide"
APEPRKGPF

SEQ ID NO: 7393 - protein, 9 aa, Artificial Sequence
  source: /note="Description of Artificial Sequence: Synthetic peptide"
WPVTAVTVM

SEQ ID NO: 7394 - protein, 9 aa, Artificial Sequence
  source: /note="Description of Artificial Sequence: Synthetic peptide"
GPSSPRNLL

SEQ ID NO: 7395 - protein, 9 aa, Artificial Sequence
  source: /note="Description of Artificial Sequence: Synthetic peptide"
LLWREMSIF

SEQ ID NO: 7396 - protein, 9 aa, Artificial Sequence
  source: /note="Description of Artificial Sequence: Synthetic peptide"
RRWGPGSPA

SEQ ID NO: 7397 - protein, 9 aa, Artificial Sequence
  source: /note="Description of Artificial Sequence: Synthetic peptide"
QRLSKGFQL

SEQ ID NO: 7398 - protein, 9 aa, Artificial Sequence
  source: /note="Description of Artificial Sequence: Synthetic peptide"
SKGFQLLRW

SEQ ID NO: 7399 - protein, 9 aa, Artificial Sequence
  source: /note="Description of Artificial Sequence: Synthetic peptide"
KGFQLLRWW

SEQ ID NO: 7400 - protein, 9 aa, Artificial Sequence
  source: /note="Description of Artificial Sequence: Synthetic peptide"
LESPGPLAL

SEQ ID NO: 7401 - protein, 9 aa, Artificial Sequence
  source: /note="Description of Artificial Sequence: Synthetic peptide"
REMSIFLPG

SEQ ID NO: 7402 - protein, 9 aa, Artificial Sequence
  source: /note="Description of Artificial Sequence: Synthetic peptide"
DPPWPVTAV

SEQ ID NO: 7403 - protein, 10 aa, Artificial Sequence
  source: /note="Description of Artificial Sequence: Synthetic peptide"
TVMAGSVPSA

SEQ ID NO: 7404 - protein, 10 aa, Artificial Sequence
  source: /note="Description of Artificial Sequence: Synthetic peptide"
LLWREMSIFL

SEQ ID NO: 7405 - protein, 10 aa, Artificial Sequence
  source: /note="Description of Artificial Sequence: Synthetic peptide"
FSAGRGRCPV

SEQ ID NO: 7406 - protein, 10 aa, Artificial Sequence
  source: /note="Description of Artificial Sequence: Synthetic peptide"
CLRPHRVQLL

SEQ ID NO: 7407 - protein, 10 aa, Artificial Sequence
  source: /note="Description of Artificial Sequence: Synthetic peptide"
RLSKGFQLLR

SEQ ID NO: 7408 - protein, 10 aa, Artificial Sequence
  source: /note="Description of Artificial Sequence: Synthetic peptide"
REMSIFLPGI

SEQ ID NO: 7409 - protein, 10 aa, Artificial Sequence
  source: /note="Description of Artificial Sequence: Synthetic peptide"
RGRCPVQGCL

SEQ ID NO: 7410 - protein, 10 aa, Artificial Sequence
  source: /note="Description of Artificial Sequence: Synthetic peptide"
RPHRVQLLRR

SEQ ID NO: 7411 - protein, 10 aa, Artificial Sequence
  source: /note="Description of Artificial Sequence: Synthetic peptide"
GSPAGQRLSK

SEQ ID NO: 7412 - protein, 10 aa, Artificial Sequence
  source: /note="Description of Artificial Sequence: Synthetic peptide"
CSPSGFSAGR

SEQ ID NO: 7413 - protein, 10 aa, Artificial Sequence
  source: /note="Description of Artificial Sequence: Synthetic peptide"
LALEGPSSPR

SEQ ID NO: 7414 - protein, 10 aa, Artificial Sequence
  source: /note="Description of Artificial Sequence: Synthetic peptide"
FPPPDPPWPV

SEQ ID NO: 7415 - protein, 10 aa, Artificial Sequence
  source: /note="Description of Artificial Sequence: Synthetic peptide"
TAVTVMAGSV

SEQ ID NO: 7416 - protein, 10 aa, Artificial Sequence
  source: /note="Description of Artificial Sequence: Synthetic peptide"
GPGSPAGQRL

SEQ ID NO: 7417 - protein, 10 aa, Artificial Sequence
  source: /note="Description of Artificial Sequence: Synthetic peptide"
VPSAQSVDAL

SEQ ID NO: 7418 - protein, 10 aa, Artificial Sequence
  source: /note="Description of Artificial Sequence: Synthetic peptide"
SPRNLLWREM

SEQ ID NO: 7419 - protein, 10 aa, Artificial Sequence
  source: /note="Description of Artificial Sequence: Synthetic peptide"
EMSIFLPGIF

SEQ ID NO: 7420 - protein, 10 aa, Artificial Sequence
  source: /note="Description of Artificial Sequence: Synthetic peptide"
RCCSCSPSGF

SEQ ID NO: 7421 - protein, 10 aa, Artificial Sequence
  source: /note="Description of Artificial Sequence: Synthetic peptide"
LRRWGPGSPA

SEQ ID NO: 7422 - protein, 10 aa, Artificial Sequence
  source: /note="Description of Artificial Sequence: Synthetic peptide"
RRWGPGSPAG

SEQ ID NO: 7423 - protein, 10 aa, Artificial Sequence
  source: /note="Description of Artificial Sequence: Synthetic peptide"
GQRLSKGFQL

SEQ ID NO: 7424 - protein, 10 aa, Artificial Sequence
  source: /note="Description of Artificial Sequence: Synthetic peptide"
QRLSKGFQLL

SEQ ID NO: 7425 - protein, 10 aa, Artificial Sequence
  source: /note="Description of Artificial Sequence: Synthetic peptide"
LSKGFQLLRW

SEQ ID NO: 7426 - protein, 10 aa, Artificial Sequence
  source: /note="Description of Artificial Sequence: Synthetic peptide"
FQLLRWWGPG

SEQ ID NO: 7427 - protein, 10 aa, Artificial Sequence
  source: /note="Description of Artificial Sequence: Synthetic peptide"
LRWWGPGSPA

SEQ ID NO: 7428 - protein, 10 aa, Artificial Sequence
  source: /note="Description of Artificial Sequence: Synthetic peptide"
ALESPGPLAL

SEQ ID NO: 7429 - protein, 10 aa, Artificial Sequence
  source: /note="Description of Artificial Sequence: Synthetic peptide"
LEGPSSPRNL

SEQ ID NO: 7430 - protein, 10 aa, Artificial Sequence
  source: /note="Description of Artificial Sequence: Synthetic peptide"
RNLLWREMSI

SEQ ID NO: 7431 - protein, 10 aa, Artificial Sequence
  source: /note="Description of Artificial Sequence: Synthetic peptide"
NLLWREMSIF

SEQ ID NO: 7432 - protein, 10 aa, Artificial Sequence
  source: /note="Description of Artificial Sequence: Synthetic peptide"
CPVQGCLRPH

SEQ ID NO: 7433 - protein, 10 aa, Artificial Sequence
  source: /note="Description of Artificial Sequence: Synthetic peptide"
WPVTAVTVMA

SEQ ID NO: 7434 - protein, 10 aa, Artificial Sequence
  source: /note="Description of Artificial Sequence: Synthetic peptide"
PPWPVTAVTV

SEQ ID NO: 7435 - protein, 10 aa, Artificial Sequence
  source: /note="Description of Artificial Sequence: Synthetic peptide"
GPFPPPDPPW

SEQ ID NO: 7436 - protein, 10 aa, Artificial Sequence
  source: /note="Description of Artificial Sequence: Synthetic peptide"
GPSSPRNLLW

SEQ ID NO: 7437 - protein, 9 aa, Artificial Sequence
  source: /note="Description of Artificial Sequence: Synthetic peptide"
HVPVKRSKK

SEQ ID NO: 7438 - protein, 9 aa, Artificial Sequence
  source: /note="Description of Artificial Sequence: Synthetic peptide"
KKAVDAPPA

SEQ ID NO: 7439 - protein, 10 aa, Artificial Sequence
  source: /note="Description of Artificial Sequence: Synthetic peptide"
YYHVPVKRSK

SEQ ID NO: 7440 - protein, 10 aa, Artificial Sequence
  source: /note="Description of Artificial Sequence: Synthetic peptide"
RSKKAVDAPP

SEQ ID NO: 7441 - protein, 10 aa, Artificial Sequence
  source: /note="Description of Artificial Sequence: Synthetic peptide"
VPVKRSKKAV

SEQ ID NO: 7442 - protein, 9 aa, Artificial Sequence
  source: /note="Description of Artificial Sequence: Synthetic peptide"
RLNAGLGPW

SEQ ID NO: 7443 - protein, 10 aa, Artificial Sequence
  source: /note="Description of Artificial Sequence: Synthetic peptide"
RLNAGLGPWL

SEQ ID NO: 7444 - protein, 9 aa, Artificial Sequence
  source: /note="Description of Artificial Sequence: Synthetic peptide"
LLKTVKPLV

SEQ ID NO: 7445 - protein, 9 aa, Artificial Sequence
  source: /note="Description of Artificial Sequence: Synthetic peptide"
KTVKPLVWK

SEQ ID NO: 7446 - protein, 9 aa, Artificial Sequence
  source: /note="Description of Artificial Sequence: Synthetic peptide"
HLLKTVKPL

SEQ ID NO: 7447 - protein, 9 aa, Artificial Sequence
  source: /note="Description of Artificial Sequence: Synthetic peptide"
LKTVKPLVW

SEQ ID NO: 7448 - protein, 10 aa, Artificial Sequence
  source: /note="Description of Artificial Sequence: Synthetic peptide"
HLLKTVKPLV

SEQ ID NO: 7449 - protein, 10 aa, Artificial Sequence
  source: /note="Description of Artificial Sequence: Synthetic peptide"
LVWKPGDWSR

SEQ ID NO: 7450 - protein, 10 aa, Artificial Sequence
  source: /note="Description of Artificial Sequence: Synthetic peptide"
SHLLKTVKPL

SEQ ID NO: 7451 - protein, 10 aa, Artificial Sequence
  source: /note="Description of Artificial Sequence: Synthetic peptide"
LLKTVKPLVW

SEQ ID NO: 7452 - protein, 9 aa, Artificial Sequence
  source: /note="Description of Artificial Sequence: Synthetic peptide"
EEAGATTEA

SEQ ID NO: 7453 - protein, 10 aa, Artificial Sequence
  source: /note="Description of Artificial Sequence: Synthetic peptide"
TEEAGATTEA

SEQ ID NO: 7454 - protein, 9 aa, Artificial Sequence
  source: /note="Description of Artificial Sequence: Synthetic peptide"
LALKEDLLY

SEQ ID NO: 7455 - protein, 9 aa, Artificial Sequence
  source: /note="Description of Artificial Sequence: Synthetic peptide"
ALKEDLLYL

SEQ ID NO: 7456 - protein, 9 aa, Artificial Sequence
  source: /note="Description of Artificial Sequence: Synthetic peptide"
SLQCQSLAL

SEQ ID NO: 7457 - protein, 9 aa, Artificial Sequence
  source: /note="Description of Artificial Sequence: Synthetic peptide"
KLALKEDLL

SEQ ID NO: 7458 - protein, 9 aa, Artificial Sequence
  source: /note="Description of Artificial Sequence: Synthetic peptide"
QLLCQNPEK

SEQ ID NO: 7459 - protein, 9 aa, Artificial Sequence
  source: /note="Description of Artificial Sequence: Synthetic peptide"
MPPPANPQL

SEQ ID NO: 7460 - protein, 9 aa, Artificial Sequence
  source: /note="Description of Artificial Sequence: Synthetic peptide"
ERNLRPLSL

SEQ ID NO: 7461 - protein, 9 aa, Artificial Sequence
  source: /note="Description of Artificial Sequence: Synthetic peptide"
YLRTSGEPW

SEQ ID NO: 7462 - protein, 9 aa, Artificial Sequence
  source: /note="Description of Artificial Sequence: Synthetic peptide"
CQNPEKLAL

SEQ ID NO: 7463 - protein, 9 aa, Artificial Sequence
  source: /note="Description of Artificial Sequence: Synthetic peptide"
FEPPMPPPA

SEQ ID NO: 7464 - protein, 10 aa, Artificial Sequence
  source: /note="Description of Artificial Sequence: Synthetic peptide"
QLLCQNPEKL

SEQ ID NO: 7465 - protein, 10 aa, Artificial Sequence
  source: /note="Description of Artificial Sequence: Synthetic peptide"
KLALKEDLLY

SEQ ID NO: 7466 - protein, 10 aa, Artificial Sequence
  source: /note="Description of Artificial Sequence: Synthetic peptide"
CQNPEKLALK

SEQ ID NO: 7467 - protein, 10 aa, Artificial Sequence
  source: /note="Description of Artificial Sequence: Synthetic peptide"
LYLRTSGEPW

SEQ ID NO: 7468 - protein, 10 aa, Artificial Sequence
  source: /note="Description of Artificial Sequence: Synthetic peptide"
ALKEDLLYLR

SEQ ID NO: 7469 - protein, 10 aa, Artificial Sequence
  source: /note="Description of Artificial Sequence: Synthetic peptide"
MPPPANPQLL

SEQ ID NO: 7470 - protein, 10 aa, Artificial Sequence
  source: /note="Description of Artificial Sequence: Synthetic peptide"
RPLSLQCQSL

SEQ ID NO: 7471 - protein, 10 aa, Artificial Sequence
  source: /note="Description of Artificial Sequence: Synthetic peptide"
LALKEDLLYL

SEQ ID NO: 7472 - protein, 10 aa, Artificial Sequence
  source: /note="Description of Artificial Sequence: Synthetic peptide"
TERNLRPLSL

SEQ ID NO: 7473 - protein, 10 aa, Artificial Sequence
  source: /note="Description of Artificial Sequence: Synthetic peptide"
LSLQCQSLAL

SEQ ID NO: 7474 - protein, 10 aa, Artificial Sequence
  source: /note="Description of Artificial Sequence: Synthetic peptide"
GEPWDTERNL

SEQ ID NO: 7475 - protein, 9 aa, Artificial Sequence
  source: /note="Description of Artificial Sequence: Synthetic peptide"
ESLWICAMR

SEQ ID NO: 7476 - protein, 9 aa, Artificial Sequence
  source: /note="Description of Artificial Sequence: Synthetic peptide"
NQSAESLWI

SEQ ID NO: 7477 - protein, 9 aa, Artificial Sequence
  source: /note="Description of Artificial Sequence: Synthetic peptide"
AESLWICAM

SEQ ID NO: 7478 - protein, 10 aa, Artificial Sequence
  source: /note="Description of Artificial Sequence: Synthetic peptide"
QSAESLWICA

SEQ ID NO: 7479 - protein, 10 aa, Artificial Sequence
  source: /note="Description of Artificial Sequence: Synthetic peptide"
CLNQSAESLW

SEQ ID NO: 7480 - protein, 10 aa, Artificial Sequence
  source: /note="Description of Artificial Sequence: Synthetic peptide"
SAESLWICAM

SEQ ID NO: 7481 - protein, 9 aa, Artificial Sequence
  source: /note="Description of Artificial Sequence: Synthetic peptide"
RLSGRLMLM

SEQ ID NO: 7482 - protein, 9 aa, Artificial Sequence
  source: /note="Description of Artificial Sequence: Synthetic peptide"
LMLMETAQL

SEQ ID NO: 7483 - protein, 9 aa, Artificial Sequence
  source: /note="Description of Artificial Sequence: Synthetic peptide"
MLMETAQLT

SEQ ID NO: 7484 - protein, 9 aa, Artificial Sequence
  source: /note="Description of Artificial Sequence: Synthetic peptide"
RLTPGRSLR

SEQ ID NO: 7485 - protein, 9 aa, Artificial Sequence
  source: /note="Description of Artificial Sequence: Synthetic peptide"
RSLRLSGRL

SEQ ID NO: 7486 - protein, 9 aa, Artificial Sequence
  source: /note="Description of Artificial Sequence: Synthetic peptide"
SLRLSGRLM

SEQ ID NO: 7487 - protein, 9 aa, Artificial Sequence
  source: /note="Description of Artificial Sequence: Synthetic peptide"
ERLTPGRSL

SEQ ID NO: 7488 - protein, 9 aa, Artificial Sequence
  source: /note="Description of Artificial Sequence: Synthetic peptide"
LRLSGRLML

SEQ ID NO: 7489 - protein, 9 aa, Artificial Sequence
  source: /note="Description of Artificial Sequence: Synthetic peptide"
LMETAQLTL

SEQ ID NO: 7490 - protein, 10 aa, Artificial Sequence
  source: /note="Description of Artificial Sequence: Synthetic peptide"
RLMLMETAQL

SEQ ID NO: 7491 - protein, 10 aa, Artificial Sequence
  source: /note="Description of Artificial Sequence: Synthetic peptide"
MLMETAQLTL

SEQ ID NO: 7492 - protein, 10 aa, Artificial Sequence
  source: /note="Description of Artificial Sequence: Synthetic peptide"
RLTPGRSLRL

SEQ ID NO: 7493 - protein, 10 aa, Artificial Sequence
  source: /note="Description of Artificial Sequence: Synthetic peptide"
LMETAQLTLK

SEQ ID NO: 7494 - protein, 10 aa, Artificial Sequence
  source: /note="Description of Artificial Sequence: Synthetic peptide"
RSLRLSGRLM

SEQ ID NO: 7495 - protein, 10 aa, Artificial Sequence
  source: /note="Description of Artificial Sequence: Synthetic peptide"
SLRLSGRLML

SEQ ID NO: 7496 - protein, 10 aa, Artificial Sequence
  source: /note="Description of Artificial Sequence: Synthetic peptide"
SGRLMLMETA

SEQ ID NO: 7497 - protein, 10 aa, Artificial Sequence
  source: /note="Description of Artificial Sequence: Synthetic peptide"
ETAQLTLKSL

SEQ ID NO: 7498 - protein, 10 aa, Artificial Sequence
  source: /note="Description of Artificial Sequence: Synthetic peptide"
GERLTPGRSL

SEQ ID NO: 7499 - protein, 10 aa, Artificial Sequence
  source: /note="Description of Artificial Sequence: Synthetic peptide"
LRLSGRLMLM

SEQ ID NO: 7500 - protein, 9 aa, Artificial Sequence
  source: /note="Description of Artificial Sequence: Synthetic peptide"
AVANPGLIY

SEQ ID NO: 7501 - protein, 9 aa, Artificial Sequence
  source: /note="Description of Artificial Sequence: Synthetic peptide"
LIYLTGPYL

SEQ ID NO: 7502 - protein, 9 aa, Artificial Sequence
  source: /note="Description of Artificial Sequence: Synthetic peptide"
YLTGPYLDV

SEQ ID NO: 7503 - protein, 9 aa, Artificial Sequence
  source: /note="Description of Artificial Sequence: Synthetic peptide"
GLIYLTGPY

SEQ ID NO: 7504 - protein, 9 aa, Artificial Sequence
  source: /note="Description of Artificial Sequence: Synthetic peptide"
VANPGLIYL

SEQ ID NO: 7505 - protein, 10 aa, Artificial Sequence
  source: /note="Description of Artificial Sequence: Synthetic peptide"
AVANPGLIYL

SEQ ID NO: 7506 - protein, 10 aa, Artificial Sequence
  source: /note="Description of Artificial Sequence: Synthetic peptide"
GLIYLTGPYL

SEQ ID NO: 7507 - protein, 10 aa, Artificial Sequence
  source: /note="Description of Artificial Sequence: Synthetic peptide"
IYLTGPYLDV

SEQ ID NO: 7508 - protein, 10 aa, Artificial Sequence
  source: /note="Description of Artificial Sequence: Synthetic peptide"
HAVANPGLIY

SEQ ID NO: 7509 - protein, 9 aa, Artificial Sequence
  source: /note="Description of Artificial Sequence: Synthetic peptide"
LMGEDWNEV

SEQ ID NO: 7510 - protein, 9 aa, Artificial Sequence
  source: /note="Description of Artificial Sequence: Synthetic peptide"
IMTVFQILM

SEQ ID NO: 7511 - protein, 9 aa, Artificial Sequence
  source: /note="Description of Artificial Sequence: Synthetic peptide"
FQILMGEDW

SEQ ID NO: 7512 - protein, 9 aa, Artificial Sequence
  source: /note="Description of Artificial Sequence: Synthetic peptide"
MGEDWNEVM

SEQ ID NO: 7513 - protein, 10 aa, Artificial Sequence
  source: /note="Description of Artificial Sequence: Synthetic peptide"
MGEDWNEVMY

SEQ ID NO: 7514 - protein, 10 aa, Artificial Sequence
  source: /note="Description of Artificial Sequence: Synthetic peptide"
ILMGEDWNEV

SEQ ID NO: 7515 - protein, 10 aa, Artificial Sequence
  source: /note="Description of Artificial Sequence: Synthetic peptide"
LMGEDWNEVM

SEQ ID NO: 7516 - protein, 10 aa, Artificial Sequence
  source: /note="Description of Artificial Sequence: Synthetic peptide"
VFQILMGEDW

SEQ ID NO: 7517 - protein, 10 aa, Artificial Sequence
  source: /note="Description of Artificial Sequence: Synthetic peptide"
AIMTVFQILM

SEQ ID NO: 7518 - protein, 9 aa, Artificial Sequence
  source: /note="Description of Artificial Sequence: Synthetic peptide"
PAKYVWEQR

SEQ ID NO: 7519 - protein, 9 aa, Artificial Sequence
  source: /note="Description of Artificial Sequence: Synthetic peptide"
NQKPAKYVW

SEQ ID NO: 7520 - protein, 10 aa, Artificial Sequence
  source: /note="Description of Artificial Sequence: Synthetic peptide"
YVWEQRTSEM

SEQ ID NO: 7521 - protein, 10 aa, Artificial Sequence
  source: /note="Description of Artificial Sequence: Synthetic peptide"
QQKNQKPAKY

SEQ ID NO: 7522 - protein, 9 aa, Artificial Sequence
  source: /note="Description of Artificial Sequence: Synthetic peptide"
ILTGEDWNL

SEQ ID NO: 7523 - protein, 9 aa, Artificial Sequence
  source: /note="Description of Artificial Sequence: Synthetic peptide"
LTGEDWNLV

SEQ ID NO: 7524 - protein, 9 aa, Artificial Sequence
  source: /note="Description of Artificial Sequence: Synthetic peptide"
GEDWNLVMY

SEQ ID NO: 7525 - protein, 9 aa, Artificial Sequence
  source: /note="Description of Artificial Sequence: Synthetic peptide"
NLVMYDGIM

SEQ ID NO: 7526 - protein, 10 aa, Artificial Sequence
  source: /note="Description of Artificial Sequence: Synthetic peptide"
TGEDWNLVMY

SEQ ID NO: 7527 - protein, 10 aa, Artificial Sequence
  source: /note="Description of Artificial Sequence: Synthetic peptide"
ILTGEDWNLV

SEQ ID NO: 7528 - protein, 10 aa, Artificial Sequence
  source: /note="Description of Artificial Sequence: Synthetic peptide"
LVMYDGIMAY

SEQ ID NO: 7529 - protein, 10 aa, Artificial Sequence
  source: /note="Description of Artificial Sequence: Synthetic peptide"
LTGEDWNLVM

SEQ ID NO: 7530 - protein, 9 aa, Artificial Sequence
  source: /note="Description of Artificial Sequence: Synthetic peptide"
SPVVLERIW

SEQ ID NO: 7531 - protein, 10 aa, Artificial Sequence
  source: /note="Description of Artificial Sequence: Synthetic peptide"
DVDSPVVLER

SEQ ID NO: 7532 - protein, 10 aa, Artificial Sequence
  source: /note="Description of Artificial Sequence: Synthetic peptide"
LERIWQNSDF

SEQ ID NO: 7533 - protein, 9 aa, Artificial Sequence
  source: /note="Description of Artificial Sequence: Synthetic peptide"
RENCNKIIM

SEQ ID NO: 7534 - protein, 10 aa, Artificial Sequence
  source: /note="Description of Artificial Sequence: Synthetic peptide"
RENCNKIIML

SEQ ID NO: 7535 - protein, 9 aa, Artificial Sequence
  source: /note="Description of Artificial Sequence: Synthetic peptide"
KLFTKGIGM

SEQ ID NO: 7536 - protein, 9 aa, Artificial Sequence
  source: /note="Description of Artificial Sequence: Synthetic peptide"
REHLDKLFT

SEQ ID NO: 7537 - protein, 10 aa, Artificial Sequence
  source: /note="Description of Artificial Sequence: Synthetic peptide"
KLFTKGIGML

SEQ ID NO: 7538 - protein, 10 aa, Artificial Sequence
  source: /note="Description of Artificial Sequence: Synthetic peptide"
RHRESRHHSR

SEQ ID NO: 7539 - protein, 10 aa, Artificial Sequence
  source: /note="Description of Artificial Sequence: Synthetic peptide"
RESRHHSRDV

SEQ ID NO: 7540 - protein, 9 aa, Artificial Sequence
  source: /note="Description of Artificial Sequence: Synthetic peptide"
RSRHNIILS

SEQ ID NO: 7541 - protein, 9 aa, Artificial Sequence
  source: /note="Description of Artificial Sequence: Synthetic peptide"
FHRSRHNII

SEQ ID NO: 7542 - protein, 9 aa, Artificial Sequence
  source: /note="Description of Artificial Sequence: Synthetic peptide"
HRSRHNIIL

SEQ ID NO: 7543 - protein, 9 aa, Artificial Sequence
  source: /note="Description of Artificial Sequence: Synthetic peptide"
SRHNIILSA

SEQ ID NO: 7544 - protein, 10 aa, Artificial Sequence
  source: /note="Description of Artificial Sequence: Synthetic peptide"
RSRHNIILSA

SEQ ID NO: 7545 - protein, 10 aa, Artificial Sequence
  source: /note="Description of Artificial Sequence: Synthetic peptide"
EFHRSRHNII

SEQ ID NO: 7546 - protein, 10 aa, Artificial Sequence
  source: /note="Description of Artificial Sequence: Synthetic peptide"
FHRSRHNIIL

SEQ ID NO: 7547 - protein, 10 aa, Artificial Sequence
  source: /note="Description of Artificial Sequence: Synthetic peptide"
SEFHRSRHNI

SEQ ID NO: 7548 - protein, 9 aa, Artificial Sequence
  source: /note="Description of Artificial Sequence: Synthetic peptide"
ILSVGIFFV

SEQ ID NO: 7549 - protein, 9 aa, Artificial Sequence
  source: /note="Description of Artificial Sequence: Synthetic peptide"
VILSVGIFF

SEQ ID NO: 7550 - protein, 9 aa, Artificial Sequence
  source: /note="Description of Artificial Sequence: Synthetic peptide"
NVILSVGIF

SEQ ID NO: 7551 - protein, 9 aa, Artificial Sequence
  source: /note="Description of Artificial Sequence: Synthetic peptide"
SRHNVILSV

SEQ ID NO: 7552 - protein, 10 aa, Artificial Sequence
  source: /note="Description of Artificial Sequence: Synthetic peptide"
VILSVGIFFV

SEQ ID NO: 7553 - protein, 10 aa, Artificial Sequence
  source: /note="Description of Artificial Sequence: Synthetic peptide"
RSRHNVILSV

SEQ ID NO: 7554 - protein, 10 aa, Artificial Sequence
  source: /note="Description of Artificial Sequence: Synthetic peptide"
LSVGIFFVSA

SEQ ID NO: 7555 - protein, 10 aa, Artificial Sequence
  source: /note="Description of Artificial Sequence: Synthetic peptide"
NVILSVGIFF

SEQ ID NO: 7556 - protein, 10 aa, Artificial Sequence
  source: /note="Description of Artificial Sequence: Synthetic peptide"
RHNVILSVGI

SEQ ID NO: 7557 - protein, 10 aa, Artificial Sequence
  source: /note="Description of Artificial Sequence: Synthetic peptide"
HNVILSVGIF

SEQ ID NO: 7558 - protein, 9 aa, Artificial Sequence
  source: /note="Description of Artificial Sequence: Synthetic peptide"
RYRFWRRSS

SEQ ID NO: 7559 - protein, 9 aa, Artificial Sequence
  source: /note="Description of Artificial Sequence: Synthetic peptide"
RFWRRSSSR

SEQ ID NO: 7560 - protein, 9 aa, Artificial Sequence
  source: /note="Description of Artificial Sequence: Synthetic peptide"
PPYRYRFWR

SEQ ID NO: 7561 - protein, 9 aa, Artificial Sequence
  source: /note="Description of Artificial Sequence: Synthetic peptide"
PYRYRFWRR

SEQ ID NO: 7562 - protein, 9 aa, Artificial Sequence
  source: /note="Description of Artificial Sequence: Synthetic peptide"
YRFWRRSSS

SEQ ID NO: 7563 - protein, 9 aa, Artificial Sequence
  source: /note="Description of Artificial Sequence: Synthetic peptide"
LPPYRYRFW

SEQ ID NO: 7564 - protein, 10 aa, Artificial Sequence
  source: /note="Description of Artificial Sequence: Synthetic peptide"
RLPPYRYRFW

SEQ ID NO: 7565 - protein, 10 aa, Artificial Sequence
  source: /note="Description of Artificial Sequence: Synthetic peptide"
RYRFWRRSSS

SEQ ID NO: 7566 - protein, 10 aa, Artificial Sequence
  source: /note="Description of Artificial Sequence: Synthetic peptide"
RFWRRSSSRS

SEQ ID NO: 7567 - protein, 10 aa, Artificial Sequence
  source: /note="Description of Artificial Sequence: Synthetic peptide"
LPPYRYRFWR

SEQ ID NO: 7568 - protein, 10 aa, Artificial Sequence
  source: /note="Description of Artificial Sequence: Synthetic peptide"
PPYRYRFWRR

SEQ ID NO: 7569 - protein, 10 aa, Artificial Sequence
  source: /note="Description of Artificial Sequence: Synthetic peptide"
YRYRFWRRSS

SEQ ID NO: 7570 - protein, 9 aa, Artificial Sequence
  source: /note="Description of Artificial Sequence: Synthetic peptide"
FILNNIRHI

SEQ ID NO: 7571 - protein, 9 aa, Artificial Sequence
  source: /note="Description of Artificial Sequence: Synthetic peptide"
NIRHIRPHR

SEQ ID NO: 7572 - protein, 9 aa, Artificial Sequence
  source: /note="Description of Artificial Sequence: Synthetic peptide"
ILNNIRHIR

SEQ ID NO: 7573 - protein, 9 aa, Artificial Sequence
  source: /note="Description of Artificial Sequence: Synthetic peptide"
RHIRPHRTI

SEQ ID NO: 7574 - protein, 10 aa, Artificial Sequence
  source: /note="Description of Artificial Sequence: Synthetic peptide"
GFILNNIRHI

SEQ ID NO: 7575 - protein, 10 aa, Artificial Sequence
  source: /note="Description of Artificial Sequence: Synthetic peptide"
FIGFILNNIR

SEQ ID NO: 7576 - protein, 10 aa, Artificial Sequence
  source: /note="Description of Artificial Sequence: Synthetic peptide"
FILNNIRHIR

SEQ ID NO: 7577 - protein, 10 aa, Artificial Sequence
  source: /note="Description of Artificial Sequence: Synthetic peptide"
NNIRHIRPHR

SEQ ID NO: 7578 - protein, 10 aa, Artificial Sequence
  source: /note="Description of Artificial Sequence: Synthetic peptide"
RHIRPHRTIL

SEQ ID NO: 7579 - protein, 9 aa, Artificial Sequence
  source: /note="Description of Artificial Sequence: Synthetic peptide"
LLGGVCVGA

SEQ ID NO: 7580 - protein, 9 aa, Artificial Sequence
  source: /note="Description of Artificial Sequence: Synthetic peptide"
CVGASRVYK

SEQ ID NO: 7581 - protein, 9 aa, Artificial Sequence
  source: /note="Description of Artificial Sequence: Synthetic peptide"
GASRVYKSK

SEQ ID NO: 7582 - protein, 9 aa, Artificial Sequence
  source: /note="Description of Artificial Sequence: Synthetic peptide"
VCVGASRVY

SEQ ID NO: 7583 - protein, 10 aa, Artificial Sequence
  source: /note="Description of Artificial Sequence: Synthetic peptide"
LLLGGVCVGA

SEQ ID NO: 7584 - protein, 10 aa, Artificial Sequence
  source: /note="Description of Artificial Sequence: Synthetic peptide"
VGASRVYKSK

SEQ ID NO: 7585 - protein, 10 aa, Artificial Sequence
  source: /note="Description of Artificial Sequence: Synthetic peptide"
GVCVGASRVY

SEQ ID NO: 7586 - protein, 9 aa, Artificial Sequence
  source: /note="Description of Artificial Sequence: Synthetic peptide"
LEVEEWSDM

SEQ ID NO: 7587 - protein, 9 aa, Artificial Sequence
  source: /note="Description of Artificial Sequence: Synthetic peptide"
TELKGKLEV

SEQ ID NO: 7588 - protein, 10 aa, Artificial Sequence
  source: /note="Description of Artificial Sequence: Synthetic peptide"
LEVEEWSDMY

SEQ ID NO: 7589 - protein, 9 aa, Artificial Sequence
  source: /note="Description of Artificial Sequence: Synthetic peptide"
LNDFLSTDY

SEQ ID NO: 7590 - protein, 9 aa, Artificial Sequence
  source: /note="Description of Artificial Sequence: Synthetic peptide"
FLSTDYNLC

SEQ ID NO: 7591 - protein, 9 aa, Artificial Sequence
  source: /note="Description of Artificial Sequence: Synthetic peptide"
DFLSTDYNL

SEQ ID NO: 7592 - protein, 10 aa, Artificial Sequence
  source: /note="Description of Artificial Sequence: Synthetic peptide"
LLNDFLSTDY

SEQ ID NO: 7593 - protein, 10 aa, Artificial Sequence
  source: /note="Description of Artificial Sequence: Synthetic peptide"
STDYNLCNGK

SEQ ID NO: 7594 - protein, 10 aa, Artificial Sequence
  source: /note="Description of Artificial Sequence: Synthetic peptide"
FQLLNDFLST

SEQ ID NO: 7595 - protein, 10 aa, Artificial Sequence
  source: /note="Description of Artificial Sequence: Synthetic peptide"
NDFLSTDYNL

SEQ ID NO: 7596 - protein, 9 aa, Artificial Sequence
  source: /note="Description of Artificial Sequence: Synthetic peptide"
KLDTLQTFI

SEQ ID NO: 7597 - protein, 9 aa, Artificial Sequence
  source: /note="Description of Artificial Sequence: Synthetic peptide"
WKLDTLQTF

SEQ ID NO: 7598 - protein, 10 aa, Artificial Sequence
  source: /note="Description of Artificial Sequence: Synthetic peptide"
KLDTLQTFIR

SEQ ID NO: 7599 - protein, 10 aa, Artificial Sequence
  source: /note="Description of Artificial Sequence: Synthetic peptide"
FWKLDTLQTF

SEQ ID NO: 7600 - protein, 10 aa, Artificial Sequence
  source: /note="Description of Artificial Sequence: Synthetic peptide"
WKLDTLQTFI

SEQ ID NO: 7601 - protein, 9 aa, Artificial Sequence
  source: /note="Description of Artificial Sequence: Synthetic peptide"
NSDNFGEKM

SEQ ID NO: 7602 - protein, 9 aa, Artificial Sequence
  source: /note="Description of Artificial Sequence: Synthetic peptide"
GMMSNSDNF

SEQ ID NO: 7603 - protein, 9 aa, Artificial Sequence
  source: /note="Description of Artificial Sequence: Synthetic peptide"
SNSDNFGEK

SEQ ID NO: 7604 - protein, 10 aa, Artificial Sequence
  source: /note="Description of Artificial Sequence: Synthetic peptide"
MSNSDNFGEK

SEQ ID NO: 7605 - protein, 10 aa, Artificial Sequence
  source: /note="Description of Artificial Sequence: Synthetic peptide"
SGMMSNSDNF

SEQ ID NO: 7606 - protein, 9 aa, Artificial Sequence
  source: /note="Description of Artificial Sequence: Synthetic peptide"
KLYCKDLEI

SEQ ID NO: 7607 - protein, 10 aa, Artificial Sequence
  source: /note="Description of Artificial Sequence: Synthetic peptide"
KLYCKDLEIV

SEQ ID NO: 7608 - protein, 10 aa, Artificial Sequence
  source: /note="Description of Artificial Sequence: Synthetic peptide"
LYCKDLEIVL

SEQ ID NO: 7609 - protein, 9 aa, Artificial Sequence
  source: /note="Description of Artificial Sequence: Synthetic peptide"
AQKTACNTA

SEQ ID NO: 7610 - protein, 10 aa, Artificial Sequence
  source: /note="Description of Artificial Sequence: Synthetic peptide"
KTACNTATCV

SEQ ID NO: 7611 - protein, 10 aa, Artificial Sequence
  source: /note="Description of Artificial Sequence: Synthetic peptide"
AQKTACNTAT

SEQ ID NO: 7612 - protein, 9 aa, Artificial Sequence
  source: /note="Description of Artificial Sequence: Synthetic peptide"
AAKERQRIK

SEQ ID NO: 7613 - protein, 9 aa, Artificial Sequence
  source: /note="Description of Artificial Sequence: Synthetic peptide"
RAAKERQRI

SEQ ID NO: 7614 - protein, 10 aa, Artificial Sequence
  source: /note="Description of Artificial Sequence: Synthetic peptide"
RAAKERQRIK

SEQ ID NO: 7615 - protein, 9 aa, Artificial Sequence
  source: /note="Description of Artificial Sequence: Synthetic peptide"
KQNRQTCIR

SEQ ID NO: 7616 - protein, 9 aa, Artificial Sequence
  source: /note="Description of Artificial Sequence: Synthetic peptide"
QNRQTCIRK

SEQ ID NO: 7617 - protein, 9 aa, Artificial Sequence
  source: /note="Description of Artificial Sequence: Synthetic peptide"
CIRKSLICA

SEQ ID NO: 7618 - protein, 9 aa, Artificial Sequence
  source: /note="Description of Artificial Sequence: Synthetic peptide"
RQTCIRKSL

SEQ ID NO: 7619 - protein, 9 aa, Artificial Sequence
  source: /note="Description of Artificial Sequence: Synthetic peptide"
IRKSLICAF

SEQ ID NO: 7620 - protein, 10 aa, Artificial Sequence
  source: /note="Description of Artificial Sequence: Synthetic peptide"
KQNRQTCIRK

SEQ ID NO: 7621 - protein, 10 aa, Artificial Sequence
  source: /note="Description of Artificial Sequence: Synthetic peptide"
SQKQNRQTCI

SEQ ID NO: 7622 - protein, 10 aa, Artificial Sequence
  source: /note="Description of Artificial Sequence: Synthetic peptide"
CIRKSLICAF

SEQ ID NO: 7623 - protein, 10 aa, Artificial Sequence
  source: /note="Description of Artificial Sequence: Synthetic peptide"
RQTCIRKSLI

SEQ ID NO: 7624 - protein, 9 aa, Artificial Sequence
  source: /note="Description of Artificial Sequence: Synthetic peptide"
AVLHCHQMV

SEQ ID NO: 7625 - protein, 9 aa, Artificial Sequence
  source: /note="Description of Artificial Sequence: Synthetic peptide"
VLHCHQMVV

SEQ ID NO: 7626 - protein, 9 aa, Artificial Sequence
  source: /note="Description of Artificial Sequence: Synthetic peptide"
MVVVHRDLK

SEQ ID NO: 7627 - protein, 10 aa, Artificial Sequence
  source: /note="Description of Artificial Sequence: Synthetic peptide"
AVLHCHQMVV

SEQ ID NO: 7628 - protein, 10 aa, Artificial Sequence
  source: /note="Description of Artificial Sequence: Synthetic peptide"
VLHCHQMVVV

SEQ ID NO: 7629 - protein, 10 aa, Artificial Sequence
  source: /note="Description of Artificial Sequence: Synthetic peptide"
QMVVVHRDLK

SEQ ID NO: 7630 - protein, 10 aa, Artificial Sequence
  source: /note="Description of Artificial Sequence: Synthetic peptide"
EAVLHCHQMV

SEQ ID NO: 7631 - protein, 10 aa, Artificial Sequence
  source: /note="Description of Artificial Sequence: Synthetic peptide"
HQMVVVHRDL

SEQ ID NO: 7632 - protein, 9 aa, Artificial Sequence
  source: /note="Description of Artificial Sequence: Synthetic peptide"
VPANTFCST

SEQ ID NO: 7633 - protein, 9 aa, Artificial Sequence
  source: /note="Description of Artificial Sequence: Synthetic peptide"
QACVPANTF

SEQ ID NO: 7634 - protein, 9 aa, Artificial Sequence
  source: /note="Description of Artificial Sequence: Synthetic peptide"
KKNQACVPA

SEQ ID NO: 7635 - protein, 10 aa, Artificial Sequence
  source: /note="Description of Artificial Sequence: Synthetic peptide"
WPEKKNQACV

SEQ ID NO: 7636 - protein, 10 aa, Artificial Sequence
  source: /note="Description of Artificial Sequence: Synthetic peptide"
NQACVPANTF

SEQ ID NO: 7637 - protein, 9 aa, Artificial Sequence
  source: /note="Description of Artificial Sequence: Synthetic peptide"
LLLYITLRV

SEQ ID NO: 7638 - protein, 9 aa, Artificial Sequence
  source: /note="Description of Artificial Sequence: Synthetic peptide"
LLYITLRVV

SEQ ID NO: 7639 - protein, 9 aa, Artificial Sequence
  source: /note="Description of Artificial Sequence: Synthetic peptide"
RVVKWIPAL

SEQ ID NO: 7640 - protein, 9 aa, Artificial Sequence
  source: /note="Description of Artificial Sequence: Synthetic peptide"
GLRPSQHLL

SEQ ID NO: 7641 - protein, 9 aa, Artificial Sequence
  source: /note="Description of Artificial Sequence: Synthetic peptide"
VVKWIPALA

SEQ ID NO: 7642 - protein, 9 aa, Artificial Sequence
  source: /note="Description of Artificial Sequence: Synthetic peptide"
SAWPAPSAK

SEQ ID NO: 7643 - protein, 9 aa, Artificial Sequence
  source: /note="Description of Artificial Sequence: Synthetic peptide"
HLLLYITLR

SEQ ID NO: 7644 - protein, 9 aa, Artificial Sequence
  source: /note="Description of Artificial Sequence: Synthetic peptide"
KWIPALATA

SEQ ID NO: 7645 - protein, 9 aa, Artificial Sequence
  source: /note="Description of Artificial Sequence: Synthetic peptide"
LYITLRVVK

SEQ ID NO: 7646 - protein, 9 aa, Artificial Sequence
  source: /note="Description of Artificial Sequence: Synthetic peptide"
ASAWPAPSA

SEQ ID NO: 7647 - protein, 9 aa, Artificial Sequence
  source: /note="Description of Artificial Sequence: Synthetic peptide"
SAKTVWHPT

SEQ ID NO: 7648 - protein, 9 aa, Artificial Sequence
  source: /note="Description of Artificial Sequence: Synthetic peptide"
KTVWHPTLL

SEQ ID NO: 7649 - protein, 9 aa, Artificial Sequence
  source: /note="Description of Artificial Sequence: Synthetic peptide"
RPSQHLLLY

SEQ ID NO: 7650 - protein, 9 aa, Artificial Sequence
  source: /note="Description of Artificial Sequence: Synthetic peptide"
LATASAWPA

SEQ ID NO: 7651 - protein, 9 aa, Artificial Sequence
  source: /note="Description of Artificial Sequence: Synthetic peptide"
TVWHPTLLI

SEQ ID NO: 7652 - protein, 9 aa, Artificial Sequence
  source: /note="Description of Artificial Sequence: Synthetic peptide"
IPALATASA

SEQ ID NO: 7653 - protein, 9 aa, Artificial Sequence
  source: /note="Description of Artificial Sequence: Synthetic peptide"
WPAPSAKTV

SEQ ID NO: 7654 - protein, 9 aa, Artificial Sequence
  source: /note="Description of Artificial Sequence: Synthetic peptide"
SQHLLLYIT

SEQ ID NO: 7655 - protein, 9 aa, Artificial Sequence
  source: /note="Description of Artificial Sequence: Synthetic peptide"
VKWIPALAT

SEQ ID NO: 7656 - protein, 9 aa, Artificial Sequence
  source: /note="Description of Artificial Sequence: Synthetic peptide"
AKTVWHPTL

SEQ ID NO: 7657 - protein, 10 aa, Artificial Sequence
  source: /note="Description of Artificial Sequence: Synthetic peptide"
HLLLYITLRV

SEQ ID NO: 7658 - protein, 10 aa, Artificial Sequence
  source: /note="Description of Artificial Sequence: Synthetic peptide"
LLLYITLRVV

SEQ ID NO: 7659 - protein, 10 aa, Artificial Sequence
  source: /note="Description of Artificial Sequence: Synthetic peptide"
ALATASAWPA

SEQ ID NO: 7660 - protein, 10 aa, Artificial Sequence
  source: /note="Description of Artificial Sequence: Synthetic peptide"
GLRPSQHLLL

SEQ ID NO: 7661 - protein, 10 aa, Artificial Sequence
  source: /note="Description of Artificial Sequence: Synthetic peptide"
YITLRVVKWI

SEQ ID NO: 7662 - protein, 10 aa, Artificial Sequence
  source: /note="Description of Artificial Sequence: Synthetic peptide"
RVVKWIPALA

SEQ ID NO: 7663 - protein, 10 aa, Artificial Sequence
  source: /note="Description of Artificial Sequence: Synthetic peptide"
WIPALATASA

SEQ ID NO: 7664 - protein, 10 aa, Artificial Sequence
  source: /note="Description of Artificial Sequence: Synthetic peptide"
LLYITLRVVK

SEQ ID NO: 7665 - protein, 10 aa, Artificial Sequence
  source: /note="Description of Artificial Sequence: Synthetic peptide"
ASAWPAPSAK

SEQ ID NO: 7666 - protein, 10 aa, Artificial Sequence
  source: /note="Description of Artificial Sequence: Synthetic peptide"
LYITLRVVKW

SEQ ID NO: 7667 - protein, 10 aa, Artificial Sequence
  source: /note="Description of Artificial Sequence: Synthetic peptide"
TLRVVKWIPA

SEQ ID NO: 7668 - protein, 10 aa, Artificial Sequence
  source: /note="Description of Artificial Sequence: Synthetic peptide"
SAKTVWHPTL

SEQ ID NO: 7669 - protein, 10 aa, Artificial Sequence
  source: /note="Description of Artificial Sequence: Synthetic peptide"
KTVWHPTLLI

SEQ ID NO: 7670 - protein, 10 aa, Artificial Sequence
  source: /note="Description of Artificial Sequence: Synthetic peptide"
LRPSQHLLLY

SEQ ID NO: 7671 - protein, 10 aa, Artificial Sequence
  source: /note="Description of Artificial Sequence: Synthetic peptide"
TASAWPAPSA

SEQ ID NO: 7672 - protein, 10 aa, Artificial Sequence
  source: /note="Description of Artificial Sequence: Synthetic peptide"
KPGLRPSQHL

SEQ ID NO: 7673 - protein, 10 aa, Artificial Sequence
  source: /note="Description of Artificial Sequence: Synthetic peptide"
RPSQHLLLYI

SEQ ID NO: 7674 - protein, 10 aa, Artificial Sequence
  source: /note="Description of Artificial Sequence: Synthetic peptide"
IPALATASAW

SEQ ID NO: 7675 - protein, 10 aa, Artificial Sequence
  source: /note="Description of Artificial Sequence: Synthetic peptide"
WPAPSAKTVW

SEQ ID NO: 7676 - protein, 10 aa, Artificial Sequence
  source: /note="Description of Artificial Sequence: Synthetic peptide"
SQHLLLYITL

SEQ ID NO: 7677 - protein, 10 aa, Artificial Sequence
  source: /note="Description of Artificial Sequence: Synthetic peptide"
LRVVKWIPAL

SEQ ID NO: 7678 - protein, 10 aa, Artificial Sequence
  source: /note="Description of Artificial Sequence: Synthetic peptide"
VKWIPALATA

SEQ ID NO: 7679 - protein, 10 aa, Artificial Sequence
  source: /note="Description of Artificial Sequence: Synthetic peptide"
AKTVWHPTLL

SEQ ID NO: 7680 - protein, 9 aa, Artificial Sequence
  source: /note="Description of Artificial Sequence: Synthetic peptide"
YLKRGYLTL

SEQ ID NO: 7681 - protein, 9 aa, Artificial Sequence
  source: /note="Description of Artificial Sequence: Synthetic peptide"
NTWFSYLKR

SEQ ID NO: 7682 - protein, 9 aa, Artificial Sequence
  source: /note="Description of Artificial Sequence: Synthetic peptide"
SYLKRGYLT

SEQ ID NO: 7683 - protein, 9 aa, Artificial Sequence
  source: /note="Description of Artificial Sequence: Synthetic peptide"
WFSYLKRGY

SEQ ID NO: 7684 - protein, 9 aa, Artificial Sequence
  source: /note="Description of Artificial Sequence: Synthetic peptide"
FSYLKRGYL

SEQ ID NO: 7685 - protein, 10 aa, Artificial Sequence
  source: /note="Description of Artificial Sequence: Synthetic peptide"
YLKRGYLTLS

SEQ ID NO: 7686 - protein, 10 aa, Artificial Sequence
  source: /note="Description of Artificial Sequence: Synthetic peptide"
SYLKRGYLTL

SEQ ID NO: 7687 - protein, 10 aa, Artificial Sequence
  source: /note="Description of Artificial Sequence: Synthetic peptide"
TWFSYLKRGY

SEQ ID NO: 7688 - protein, 10 aa, Artificial Sequence
  source: /note="Description of Artificial Sequence: Synthetic peptide"
ENTWFSYLKR

SEQ ID NO: 7689 - protein, 9 aa, Artificial Sequence
  source: /note="Description of Artificial Sequence: Synthetic peptide"
GLLGFPVLT

SEQ ID NO: 7690 - protein, 9 aa, Artificial Sequence
  source: /note="Description of Artificial Sequence: Synthetic peptide"
WVRAKGLLG

SEQ ID NO: 7691 - protein, 9 aa, Artificial Sequence
  source: /note="Description of Artificial Sequence: Synthetic peptide"
VRAKGLLGF

SEQ ID NO: 7692 - protein, 9 aa, Artificial Sequence
  source: /note="Description of Artificial Sequence: Synthetic peptide"
AKGLLGFPV

SEQ ID NO: 7693 - protein, 9 aa, Artificial Sequence
  source: /note="Description of Artificial Sequence: Synthetic peptide"
KGLLGFPVL

SEQ ID NO: 7694 - protein, 10 aa, Artificial Sequence
  source: /note="Description of Artificial Sequence: Synthetic peptide"
GLLGFPVLTL

SEQ ID NO: 7695 - protein, 10 aa, Artificial Sequence
  source: /note="Description of Artificial Sequence: Synthetic peptide"
RAKGLLGFPV

SEQ ID NO: 7696 - protein, 10 aa, Artificial Sequence
  source: /note="Description of Artificial Sequence: Synthetic peptide"
WVRAKGLLGF

SEQ ID NO: 7697 - protein, 10 aa, Artificial Sequence
  source: /note="Description of Artificial Sequence: Synthetic peptide"
RPWVRAKGLL

SEQ ID NO: 7698 - protein, 10 aa, Artificial Sequence
  source: /note="Description of Artificial Sequence: Synthetic peptide"
AKGLLGFPVL

SEQ ID NO: 7699 - protein, 9 aa, Artificial Sequence
  source: /note="Description of Artificial Sequence: Synthetic peptide"
SLGFKLTSV

SEQ ID NO: 7700 - protein, 9 aa, Artificial Sequence
  source: /note="Description of Artificial Sequence: Synthetic peptide"
VSQASLGFK

SEQ ID NO: 7701 - protein, 9 aa, Artificial Sequence
  source: /note="Description of Artificial Sequence: Synthetic peptide"
GFKLTSVEK

SEQ ID NO: 7702 - protein, 9 aa, Artificial Sequence
  source: /note="Description of Artificial Sequence: Synthetic peptide"
SQASLGFKL

SEQ ID NO: 7703 - protein, 10 aa, Artificial Sequence
  source: /note="Description of Artificial Sequence: Synthetic peptide"
QVSQASLGFK

SEQ ID NO: 7704 - protein, 10 aa, Artificial Sequence
  source: /note="Description of Artificial Sequence: Synthetic peptide"
LGFKLTSVEK

SEQ ID NO: 7705 - protein, 10 aa, Artificial Sequence
  source: /note="Description of Artificial Sequence: Synthetic peptide"
KLTSVEKSLR

SEQ ID NO: 7706 - protein, 10 aa, Artificial Sequence
  source: /note="Description of Artificial Sequence: Synthetic peptide"
SQASLGFKLT

SEQ ID NO: 7707 - protein, 10 aa, Artificial Sequence
  source: /note="Description of Artificial Sequence: Synthetic peptide"
FKLTSVEKSL

SEQ ID NO: 7708 - protein, 9 aa, Artificial Sequence
  source: /note="Description of Artificial Sequence: Synthetic peptide"
EMRIEMVQR

SEQ ID NO: 7709 - protein, 9 aa, Artificial Sequence
  source: /note="Description of Artificial Sequence: Synthetic peptide"
DEMRIEMVQ

SEQ ID NO: 7710 - protein, 9 aa, Artificial Sequence
  source: /note="Description of Artificial Sequence: Synthetic peptide"
IEMVQREAC

SEQ ID NO: 7711 - protein, 10 aa, Artificial Sequence
  source: /note="Description of Artificial Sequence: Synthetic peptide"
MRIEMVQREA

SEQ ID NO: 7712 - protein, 10 aa, Artificial Sequence
  source: /note="Description of Artificial Sequence: Synthetic peptide"
IEMVQREACI

SEQ ID NO: 7713 - protein, 10 aa, Artificial Sequence
  source: /note="Description of Artificial Sequence: Synthetic peptide"
VQREACIVNL

SEQ ID NO: 7714 - protein, 9 aa, Artificial Sequence
  source: /note="Description of Artificial Sequence: Synthetic peptide"
SSSSSHQSK

SEQ ID NO: 7715 - protein, 9 aa, Artificial Sequence
  source: /note="Description of Artificial Sequence: Synthetic peptide"
HQSKGLDAY

SEQ ID NO: 7716 - protein, 10 aa, Artificial Sequence
  source: /note="Description of Artificial Sequence: Synthetic peptide"
HSSSSSHQSK

SEQ ID NO: 7717 - protein, 10 aa, Artificial Sequence
  source: /note="Description of Artificial Sequence: Synthetic peptide"
SHQSKGLDAY

SEQ ID NO: 7718 - protein, 9 aa, Artificial Sequence
  source: /note="Description of Artificial Sequence: Synthetic peptide"
FLDSLEFYY

SEQ ID NO: 7719 - protein, 9 aa, Artificial Sequence
  source: /note="Description of Artificial Sequence: Synthetic peptide"
GYVVFLDSL

SEQ ID NO: 7720 - protein, 9 aa, Artificial Sequence
  source: /note="Description of Artificial Sequence: Synthetic peptide"
VVFLDSLEF

SEQ ID NO: 7721 - protein, 9 aa, Artificial Sequence
  source: /note="Description of Artificial Sequence: Synthetic peptide"
VFLDSLEFY

SEQ ID NO: 7722 - protein, 10 aa, Artificial Sequence
  source: /note="Description of Artificial Sequence: Synthetic peptide"
FLDSLEFYYP

SEQ ID NO: 7723 - protein, 10 aa, Artificial Sequence
  source: /note="Description of Artificial Sequence: Synthetic peptide"
VVFLDSLEFY

SEQ ID NO: 7724 - protein, 10 aa, Artificial Sequence
  source: /note="Description of Artificial Sequence: Synthetic peptide"
YVVFLDSLEF

SEQ ID NO: 7725 - protein, 10 aa, Artificial Sequence
  source: /note="Description of Artificial Sequence: Synthetic peptide"
RGYVVFLDSL

SEQ ID NO: 7726 - protein, 10 aa, Artificial Sequence
  source: /note="Description of Artificial Sequence: Synthetic peptide"
VFLDSLEFYY

SEQ ID NO: 7727 - protein, 10 aa, Artificial Sequence
  source: /note="Description of Artificial Sequence: Synthetic peptide"
DSLEFYYPEL

SEQ ID NO: 7728 - protein, 9 aa, Artificial Sequence
  source: /note="Description of Artificial Sequence: Synthetic peptide"
LMKSNIYPI

SEQ ID NO: 7729 - protein, 9 aa, Artificial Sequence
  source: /note="Description of Artificial Sequence: Synthetic peptide"
RDLMKSNIY

SEQ ID NO: 7730 - protein, 9 aa, Artificial Sequence
  source: /note="Description of Artificial Sequence: Synthetic peptide"
MKSNIYPIV

SEQ ID NO: 7731 - protein, 10 aa, Artificial Sequence
  source: /note="Description of Artificial Sequence: Synthetic peptide"
DLMKSNIYPI

SEQ ID NO: 7732 - protein, 10 aa, Artificial Sequence
  source: /note="Description of Artificial Sequence: Synthetic peptide"
LMKSNIYPIV

SEQ ID NO: 7733 - protein, 10 aa, Artificial Sequence
  source: /note="Description of Artificial Sequence: Synthetic peptide"
GIGCTRDLMK

SEQ ID NO: 7734 - protein, 10 aa, Artificial Sequence
  source: /note="Description of Artificial Sequence: Synthetic peptide"
CTRDLMKSNI

SEQ ID NO: 7735 - protein, 10 aa, Artificial Sequence
  source: /note="Description of Artificial Sequence: Synthetic peptide"
MKSNIYPIVL

SEQ ID NO: 7736 - protein, 9 aa, Artificial Sequence
  source: /note="Description of Artificial Sequence: Synthetic peptide"
ILSFFVAQA

SEQ ID NO: 7737 - protein, 9 aa, Artificial Sequence
  source: /note="Description of Artificial Sequence: Synthetic peptide"
FVAQAGARK

SEQ ID NO: 7738 - protein, 9 aa, Artificial Sequence
  source: /note="Description of Artificial Sequence: Synthetic peptide"
SFFVAQAGA

SEQ ID NO: 7739 - protein, 9 aa, Artificial Sequence
  source: /note="Description of Artificial Sequence: Synthetic peptide"
FFVAQAGAR

SEQ ID NO: 7740 - protein, 9 aa, Artificial Sequence
  source: /note="Description of Artificial Sequence: Synthetic peptide"
LSFFVAQAG

SEQ ID NO: 7741 - protein, 10 aa, Artificial Sequence
  source: /note="Description of Artificial Sequence: Synthetic peptide"
GILSFFVAQA

SEQ ID NO: 7742 - protein, 10 aa, Artificial Sequence
  source: /note="Description of Artificial Sequence: Synthetic peptide"
FVAQAGARKI

SEQ ID NO: 7743 - protein, 10 aa, Artificial Sequence
  source: /note="Description of Artificial Sequence: Synthetic peptide"
SFFVAQAGAR

SEQ ID NO: 7744 - protein, 10 aa, Artificial Sequence
  source: /note="Description of Artificial Sequence: Synthetic peptide"
VAQAGARKIY

SEQ ID NO: 7745 - protein, 10 aa, Artificial Sequence
  source: /note="Description of Artificial Sequence: Synthetic peptide"
CGSGILSFFV

SEQ ID NO: 7746 - protein, 10 aa, Artificial Sequence
  source: /note="Description of Artificial Sequence: Synthetic peptide"
LSFFVAQAGA

SEQ ID NO: 7747 - protein, 9 aa, Artificial Sequence
  source: /note="Description of Artificial Sequence: Synthetic peptide"
RLEIQQIEK

SEQ ID NO: 7748 - protein, 9 aa, Artificial Sequence
  source: /note="Description of Artificial Sequence: Synthetic peptide"
MERLEIQQI

SEQ ID NO: 7749 - protein, 9 aa, Artificial Sequence
  source: /note="Description of Artificial Sequence: Synthetic peptide"
GLYPPLVSM

SEQ ID NO: 7750 - protein, 9 aa, Artificial Sequence
  source: /note="Description of Artificial Sequence: Synthetic peptide"
NPGLYPPLV

SEQ ID NO: 7751 - protein, 10 aa, Artificial Sequence
  source: /note="Description of Artificial Sequence: Synthetic peptide"
GLYPPLVSMS

SEQ ID NO: 7752 - protein, 10 aa, Artificial Sequence
  source: /note="Description of Artificial Sequence: Synthetic peptide"
LPNPGLYPPL

SEQ ID NO: 7753 - protein, 9 aa, Artificial Sequence
  source: /note="Description of Artificial Sequence: Synthetic peptide"
YAPGALPPL

SEQ ID NO: 7754 - protein, 9 aa, Artificial Sequence
  source: /note="Description of Artificial Sequence: Synthetic peptide"
LPPLPPPHL

SEQ ID NO: 7755 - protein, 10 aa, Artificial Sequence
  source: /note="Description of Artificial Sequence: Synthetic peptide"
ALPPLPPPHL

SEQ ID NO: 7756 - protein, 10 aa, Artificial Sequence
  source: /note="Description of Artificial Sequence: Synthetic peptide"
PYAPGALPPL

SEQ ID NO: 7757 - protein, 10 aa, Artificial Sequence
  source: /note="Description of Artificial Sequence: Synthetic peptide"
LPPLPPPHLY

SEQ ID NO: 7758 - protein, 9 aa, Artificial Sequence
  source: /note="Description of Artificial Sequence: Synthetic peptide"
NTQAPLQVY

SEQ ID NO: 7759 - protein, 9 aa, Artificial Sequence
  source: /note="Description of Artificial Sequence: Synthetic peptide"
LYPNTQAPL

SEQ ID NO: 7760 - protein, 9 aa, Artificial Sequence
  source: /note="Description of Artificial Sequence: Synthetic peptide"
LQVYGGVTY

SEQ ID NO: 7761 - protein, 9 aa, Artificial Sequence
  source: /note="Description of Artificial Sequence: Synthetic peptide"
APLQVYGGV

SEQ ID NO: 7762 - protein, 10 aa, Artificial Sequence
  source: /note="Description of Artificial Sequence: Synthetic peptide"
HLYPNTQAPL

SEQ ID NO: 7763 - protein, 10 aa, Artificial Sequence
  source: /note="Description of Artificial Sequence: Synthetic peptide"
LQVYGGVTYY

SEQ ID NO: 7764 - protein, 10 aa, Artificial Sequence
  source: /note="Description of Artificial Sequence: Synthetic peptide"
QAPLQVYGGV

SEQ ID NO: 7765 - protein, 10 aa, Artificial Sequence
  source: /note="Description of Artificial Sequence: Synthetic peptide"
YPNTQAPLQV

SEQ ID NO: 7766 - protein, 9 aa, Artificial Sequence
  source: /note="Description of Artificial Sequence: Synthetic peptide"
KFRQELIAL

SEQ ID NO: 7767 - protein, 9 aa, Artificial Sequence
  source: /note="Description of Artificial Sequence: Synthetic peptide"
APKFRQELI

SEQ ID NO: 7768 - protein, 9 aa, Artificial Sequence
  source: /note="Description of Artificial Sequence: Synthetic peptide"
REDEQAPKF

SEQ ID NO: 7769 - protein, 9 aa, Artificial Sequence
  source: /note="Description of Artificial Sequence: Synthetic peptide"
FRQELIALY

SEQ ID NO: 7770 - protein, 10 aa, Artificial Sequence
  source: /note="Description of Artificial Sequence: Synthetic peptide"
KFRQELIALY

SEQ ID NO: 7771 - protein, 10 aa, Artificial Sequence
  source: /note="Description of Artificial Sequence: Synthetic peptide"
EQAPKFRQEL

SEQ ID NO: 7772 - protein, 9 aa, Artificial Sequence
  source: /note="Description of Artificial Sequence: Synthetic peptide"
DSSSYHPFK

SEQ ID NO: 7773 - protein, 9 aa, Artificial Sequence
  source: /note="Description of Artificial Sequence: Synthetic peptide"
INQNIRFQK

SEQ ID NO: 7774 - protein, 9 aa, Artificial Sequence
  source: /note="Description of Artificial Sequence: Synthetic peptide"
AFFVDSSSY

SEQ ID NO: 7775 - protein, 9 aa, Artificial Sequence
  source: /note="Description of Artificial Sequence: Synthetic peptide"
LACIAAFFV

SEQ ID NO: 7776 - protein, 9 aa, Artificial Sequence
  source: /note="Description of Artificial Sequence: Synthetic peptide"
HPFKINQNI

SEQ ID NO: 7777 - protein, 9 aa, Artificial Sequence
  source: /note="Description of Artificial Sequence: Synthetic peptide"
VDSSSYHPF

SEQ ID NO: 7778 - protein, 9 aa, Artificial Sequence
  source: /note="Description of Artificial Sequence: Synthetic peptide"
FKINQNIRF

SEQ ID NO: 7779 - protein, 9 aa, Artificial Sequence
  source: /note="Description of Artificial Sequence: Synthetic peptide"
NQNIRFQKF

SEQ ID NO: 7780 - protein, 10 aa, Artificial Sequence
  source: /note="Description of Artificial Sequence: Synthetic peptide"
FVDSSSYHPF

SEQ ID NO: 7781 - protein, 10 aa, Artificial Sequence
  source: /note="Description of Artificial Sequence: Synthetic peptide"
RLACIAAFFV

SEQ ID NO: 7782 - protein, 10 aa, Artificial Sequence
  source: /note="Description of Artificial Sequence: Synthetic peptide"
KINQNIRFQK

SEQ ID NO: 7783 - protein, 10 aa, Artificial Sequence
  source: /note="Description of Artificial Sequence: Synthetic peptide"
INQNIRFQKF

SEQ ID NO: 7784 - protein, 10 aa, Artificial Sequence
  source: /note="Description of Artificial Sequence: Synthetic peptide"
AAFFVDSSSY

SEQ ID NO: 7785 - protein, 10 aa, Artificial Sequence
  source: /note="Description of Artificial Sequence: Synthetic peptide"
HPFKINQNIR

SEQ ID NO: 7786 - protein, 10 aa, Artificial Sequence
  source: /note="Description of Artificial Sequence: Synthetic peptide"
DSSSYHPFKI

SEQ ID NO: 7787 - protein, 10 aa, Artificial Sequence
  source: /note="Description of Artificial Sequence: Synthetic peptide"
NPWSLEEEKY

SEQ ID NO: 7788 - protein, 9 aa, Artificial Sequence
  source: /note="Description of Artificial Sequence: Synthetic peptide"
RILKLCSKV

SEQ ID NO: 7789 - protein, 9 aa, Artificial Sequence
  source: /note="Description of Artificial Sequence: Synthetic peptide"
KVSFRVDWI

SEQ ID NO: 7790 - protein, 9 aa, Artificial Sequence
  source: /note="Description of Artificial Sequence: Synthetic peptide"
KLCSKVSFR

SEQ ID NO: 7791 - protein, 9 aa, Artificial Sequence
  source: /note="Description of Artificial Sequence: Synthetic peptide"
KKKGVRILK

SEQ ID NO: 7792 - protein, 9 aa, Artificial Sequence
  source: /note="Description of Artificial Sequence: Synthetic peptide"
GKKKGVRIL

SEQ ID NO: 7793 - protein, 9 aa, Artificial Sequence
  source: /note="Description of Artificial Sequence: Synthetic peptide"
KKGVRILKL

SEQ ID NO: 7794 - protein, 9 aa, Artificial Sequence
  source: /note="Description of Artificial Sequence: Synthetic peptide"
LKLCSKVSF

SEQ ID NO: 7795 - protein, 9 aa, Artificial Sequence
  source: /note="Description of Artificial Sequence: Synthetic peptide"
SKVSFRVDW

SEQ ID NO: 7796 - protein, 10 aa, Artificial Sequence
  source: /note="Description of Artificial Sequence: Synthetic peptide"
KLCSKVSFRV

SEQ ID NO: 7797 - protein, 10 aa, Artificial Sequence
  source: /note="Description of Artificial Sequence: Synthetic peptide"
GVRILKLCSK

SEQ ID NO: 7798 - protein, 10 aa, Artificial Sequence
  source: /note="Description of Artificial Sequence: Synthetic peptide"
SGKKKGVRIL

SEQ ID NO: 7799 - protein, 10 aa, Artificial Sequence
  source: /note="Description of Artificial Sequence: Synthetic peptide"
ILKLCSKVSF

SEQ ID NO: 7800 - protein, 10 aa, Artificial Sequence
  source: /note="Description of Artificial Sequence: Synthetic peptide"
KKKGVRILKL

SEQ ID NO: 7801 - protein, 10 aa, Artificial Sequence
  source: /note="Description of Artificial Sequence: Synthetic peptide"
SKVSFRVDWI

SEQ ID NO: 7802 - protein, 9 aa, Artificial Sequence
  source: /note="Description of Artificial Sequence: Synthetic peptide"
LLIDGAILF

SEQ ID NO: 7803 - protein, 9 aa, Artificial Sequence
  source: /note="Description of Artificial Sequence: Synthetic peptide"
LIDGAILFV

SEQ ID NO: 7804 - protein, 9 aa, Artificial Sequence
  source: /note="Description of Artificial Sequence: Synthetic peptide"
ILFVLFCFV

SEQ ID NO: 7805 - protein, 9 aa, Artificial Sequence
  source: /note="Description of Artificial Sequence: Synthetic peptide"
FVLFCFVFL

SEQ ID NO: 7806 - protein, 9 aa, Artificial Sequence
  source: /note="Description of Artificial Sequence: Synthetic peptide"
TLRKNLSSL

SEQ ID NO: 7807 - protein, 9 aa, Artificial Sequence
  source: /note="Description of Artificial Sequence: Synthetic peptide"
FVFLRQNLA

SEQ ID NO: 7808 - protein, 9 aa, Artificial Sequence
  source: /note="Description of Artificial Sequence: Synthetic peptide"
VLFCFVFLR

SEQ ID NO: 7809 - protein, 9 aa, Artificial Sequence
  source: /note="Description of Artificial Sequence: Synthetic peptide"
CSGVISAHR

SEQ ID NO: 7810 - protein, 9 aa, Artificial Sequence
  source: /note="Description of Artificial Sequence: Synthetic peptide"
SGVISAHRK

SEQ ID NO: 7811 - protein, 9 aa, Artificial Sequence
  source: /note="Description of Artificial Sequence: Synthetic peptide"
RVAGTTGAR

SEQ ID NO: 7812 - protein, 9 aa, Artificial Sequence
  source: /note="Description of Artificial Sequence: Synthetic peptide"
DGAILFVLF

SEQ ID NO: 7813 - protein, 9 aa, Artificial Sequence
  source: /note="Description of Artificial Sequence: Synthetic peptide"
AILFVLFCF

SEQ ID NO: 7814 - protein, 9 aa, Artificial Sequence
  source: /note="Description of Artificial Sequence: Synthetic peptide"
LFVLFCFVF

SEQ ID NO: 7815 - protein, 9 aa, Artificial Sequence
  source: /note="Description of Artificial Sequence: Synthetic peptide"
CFVFLRQNL

SEQ ID NO: 7816 - protein, 9 aa, Artificial Sequence
  source: /note="Description of Artificial Sequence: Synthetic peptide"
VFLRQNLAL

SEQ ID NO: 7817 - protein, 9 aa, Artificial Sequence
  source: /note="Description of Artificial Sequence: Synthetic peptide"
RQNLALSPR

SEQ ID NO: 7818 - protein, 9 aa, Artificial Sequence
  source: /note="Description of Artificial Sequence: Synthetic peptide"
VISAHRKLR

SEQ ID NO: 7819 - protein, 9 aa, Artificial Sequence
  source: /note="Description of Artificial Sequence: Synthetic peptide"
KLRLPGSGH

SEQ ID NO: 7820 - protein, 9 aa, Artificial Sequence
  source: /note="Description of Artificial Sequence: Synthetic peptide"
GARHHTWLI

SEQ ID NO: 7821 - protein, 9 aa, Artificial Sequence
  source: /note="Description of Artificial Sequence: Synthetic peptide"
LPGSGHSPA

SEQ ID NO: 7822 - protein, 9 aa, Artificial Sequence
  source: /note="Description of Artificial Sequence: Synthetic peptide"
LRKNLSSLL

SEQ ID NO: 7823 - protein, 9 aa, Artificial Sequence
  source: /note="Description of Artificial Sequence: Synthetic peptide"
RKNLSSLLI

SEQ ID NO: 7824 - protein, 9 aa, Artificial Sequence
  source: /note="Description of Artificial Sequence: Synthetic peptide"
ARHHTWLIF

SEQ ID NO: 7825 - protein, 9 aa, Artificial Sequence
  source: /note="Description of Artificial Sequence: Synthetic peptide"
IDGAILFVL

SEQ ID NO: 7826 - protein, 10 aa, Artificial Sequence
  source: /note="Description of Artificial Sequence: Synthetic peptide"
FTLRKNLSSL

SEQ ID NO: 7827 - protein, 10 aa, Artificial Sequence
  source: /note="Description of Artificial Sequence: Synthetic peptide"
NLSSLLIDGA

SEQ ID NO: 7828 - protein, 10 aa, Artificial Sequence
  source: /note="Description of Artificial Sequence: Synthetic peptide"
LLIDGAILFV

SEQ ID NO: 7829 - protein, 10 aa, Artificial Sequence
  source: /note="Description of Artificial Sequence: Synthetic peptide"
LIDGAILFVL

SEQ ID NO: 7830 - protein, 10 aa, Artificial Sequence
  source: /note="Description of Artificial Sequence: Synthetic peptide"
AILFVLFCFV

SEQ ID NO: 7831 - protein, 10 aa, Artificial Sequence
  source: /note="Description of Artificial Sequence: Synthetic peptide"
FVFLRQNLAL

SEQ ID NO: 7832 - protein, 10 aa, Artificial Sequence
  source: /note="Description of Artificial Sequence: Synthetic peptide"
TLRKNLSSLL

SEQ ID NO: 7833 - protein, 10 aa, Artificial Sequence
  source: /note="Description of Artificial Sequence: Synthetic peptide"
RLECSGVISA

SEQ ID NO: 7834 - protein, 10 aa, Artificial Sequence
  source: /note="Description of Artificial Sequence: Synthetic peptide"
RLPGSGHSPA

SEQ ID NO: 7835 - protein, 10 aa, Artificial Sequence
  source: /note="Description of Artificial Sequence: Synthetic peptide"
FVLFCFVFLR

SEQ ID NO: 7836 - protein, 10 aa, Artificial Sequence
  source: /note="Description of Artificial Sequence: Synthetic peptide"
CSGVISAHRK

SEQ ID NO: 7837 - protein, 10 aa, Artificial Sequence
  source: /note="Description of Artificial Sequence: Synthetic peptide"
IDGAILFVLF

SEQ ID NO: 7838 - protein, 10 aa, Artificial Sequence
  source: /note="Description of Artificial Sequence: Synthetic peptide"
GAILFVLFCF

SEQ ID NO: 7839 - protein, 10 aa, Artificial Sequence
  source: /note="Description of Artificial Sequence: Synthetic peptide"
ILFVLFCFVF

SEQ ID NO: 7840 - protein, 10 aa, Artificial Sequence
  source: /note="Description of Artificial Sequence: Synthetic peptide"
RQNLALSPRL

SEQ ID NO: 7841 - protein, 10 aa, Artificial Sequence
  source: /note="Description of Artificial Sequence: Synthetic peptide"
KLRLPGSGHS

SEQ ID NO: 7842 - protein, 10 aa, Artificial Sequence
  source: /note="Description of Artificial Sequence: Synthetic peptide"
SGHSPASASR

SEQ ID NO: 7843 - protein, 10 aa, Artificial Sequence
  source: /note="Description of Artificial Sequence: Synthetic peptide"
ASRVAGTTGA

SEQ ID NO: 7844 - protein, 10 aa, Artificial Sequence
  source: /note="Description of Artificial Sequence: Synthetic peptide"
GARHHTWLIF

SEQ ID NO: 7845 - protein, 10 aa, Artificial Sequence
  source: /note="Description of Artificial Sequence: Synthetic peptide"
RVAGTTGARH

SEQ ID NO: 7846 - protein, 10 aa, Artificial Sequence
  source: /note="Description of Artificial Sequence: Synthetic peptide"
ECSGVISAHR

SEQ ID NO: 7847 - protein, 10 aa, Artificial Sequence
  source: /note="Description of Artificial Sequence: Synthetic peptide"
GVISAHRKLR

SEQ ID NO: 7848 - protein, 10 aa, Artificial Sequence
  source: /note="Description of Artificial Sequence: Synthetic peptide"
QPTFTLRKNL

SEQ ID NO: 7849 - protein, 10 aa, Artificial Sequence
  source: /note="Description of Artificial Sequence: Synthetic peptide"
SLLIDGAILF

SEQ ID NO: 7850 - protein, 9 aa, Artificial Sequence
  source: /note="Description of Artificial Sequence: Synthetic peptide"
MEEKVKEKA

SEQ ID NO: 7851 - protein, 9 aa, Artificial Sequence
  source: /note="Description of Artificial Sequence: Synthetic peptide"
SMSGSLETT

SEQ ID NO: 7852 - protein, 9 aa, Artificial Sequence
  source: /note="Description of Artificial Sequence: Synthetic peptide"
EVLNRRSSM

SEQ ID NO: 7853 - protein, 9 aa, Artificial Sequence
  source: /note="Description of Artificial Sequence: Synthetic peptide"
RRSSMSGSL

SEQ ID NO: 7854 - protein, 10 aa, Artificial Sequence
  source: /note="Description of Artificial Sequence: Synthetic peptide"
NRRSSMSGSL

SEQ ID NO: 7855 - protein, 10 aa, Artificial Sequence
  source: /note="Description of Artificial Sequence: Synthetic peptide"
SEVLNRRSSM

SEQ ID NO: 7856 - protein, 9 aa, Artificial Sequence
  source: /note="Description of Artificial Sequence: Synthetic peptide"
EARRRTRKF

SEQ ID NO: 7857 - protein, 10 aa, Artificial Sequence
  source: /note="Description of Artificial Sequence: Synthetic peptide"
RTRKFEDRDR

SEQ ID NO: 7858 - protein, 10 aa, Artificial Sequence
  source: /note="Description of Artificial Sequence: Synthetic peptide"
RKFEDRDRSH

SEQ ID NO: 7859 - protein, 10 aa, Artificial Sequence
  source: /note="Description of Artificial Sequence: Synthetic peptide"
EEARRRTRKF

SEQ ID NO: 7860 - protein, 9 aa, Artificial Sequence
  source: /note="Description of Artificial Sequence: Synthetic peptide"
ILCSELSSV

SEQ ID NO: 7861 - protein, 9 aa, Artificial Sequence
  source: /note="Description of Artificial Sequence: Synthetic peptide"
VLSSCVALF

SEQ ID NO: 7862 - protein, 9 aa, Artificial Sequence
  source: /note="Description of Artificial Sequence: Synthetic peptide"
CLRETYRLI

SEQ ID NO: 7863 - protein, 9 aa, Artificial Sequence
  source: /note="Description of Artificial Sequence: Synthetic peptide"
LSSCVALFK

SEQ ID NO: 7864 - protein, 9 aa, Artificial Sequence
  source: /note="Description of Artificial Sequence: Synthetic peptide"
CVALFKGAR

SEQ ID NO: 7865 - protein, 9 aa, Artificial Sequence
  source: /note="Description of Artificial Sequence: Synthetic peptide"
HICLRETYR

SEQ ID NO: 7866 - protein, 9 aa, Artificial Sequence
  source: /note="Description of Artificial Sequence: Synthetic peptide"
GAREHICLR

SEQ ID NO: 7867 - protein, 9 aa, Artificial Sequence
  source: /note="Description of Artificial Sequence: Synthetic peptide"
TYRLISTIA

SEQ ID NO: 7868 - protein, 9 aa, Artificial Sequence
  source: /note="Description of Artificial Sequence: Synthetic peptide"
ILHEKREIR

SEQ ID NO: 7869 - protein, 9 aa, Artificial Sequence
  source: /note="Description of Artificial Sequence: Synthetic peptide"
EIRCVQAVV

SEQ ID NO: 7870 - protein, 9 aa, Artificial Sequence
  source: /note="Description of Artificial Sequence: Synthetic peptide"
ELSSVHEVL

SEQ ID NO: 7871 - protein, 9 aa, Artificial Sequence
  source: /note="Description of Artificial Sequence: Synthetic peptide"
EVLSSCVAL

SEQ ID NO: 7872 - protein, 9 aa, Artificial Sequence
  source: /note="Description of Artificial Sequence: Synthetic peptide"
ETYRLISTI

SEQ ID NO: 7873 - protein, 9 aa, Artificial Sequence
  source: /note="Description of Artificial Sequence: Synthetic peptide"
REIRCVQAV

SEQ ID NO: 7874 - protein, 9 aa, Artificial Sequence
  source: /note="Description of Artificial Sequence: Synthetic peptide"
RCVQAVVIL

SEQ ID NO: 7875 - protein, 9 aa, Artificial Sequence
  source: /note="Description of Artificial Sequence: Synthetic peptide"
SELSSVHEV

SEQ ID NO: 7876 - protein, 9 aa, Artificial Sequence
  source: /note="Description of Artificial Sequence: Synthetic peptide"
HEVLSSCVA

SEQ ID NO: 7877 - protein, 9 aa, Artificial Sequence
  source: /note="Description of Artificial Sequence: Synthetic peptide"
ALFKGAREH

SEQ ID NO: 7878 - protein, 9 aa, Artificial Sequence
  source: /note="Description of Artificial Sequence: Synthetic peptide"
EHICLRETY

SEQ ID NO: 7879 - protein, 9 aa, Artificial Sequence
  source: /note="Description of Artificial Sequence: Synthetic peptide"
RETYRLIST

SEQ ID NO: 7880 - protein, 9 aa, Artificial Sequence
  source: /note="Description of Artificial Sequence: Synthetic peptide"
YRLISTIAI

SEQ ID NO: 7881 - protein, 9 aa, Artificial Sequence
  source: /note="Description of Artificial Sequence: Synthetic peptide"
REHICLRET

SEQ ID NO: 7882 - protein, 9 aa, Artificial Sequence
  source: /note="Description of Artificial Sequence: Synthetic peptide"
HEKREIRCV

SEQ ID NO: 7883 - protein, 10 aa, Artificial Sequence
  source: /note="Description of Artificial Sequence: Synthetic peptide"
VILCSELSSV

SEQ ID NO: 7884 - protein, 10 aa, Artificial Sequence
  source: /note="Description of Artificial Sequence: Synthetic peptide"
SVHEVLSSCV

SEQ ID NO: 7885 - protein, 10 aa, Artificial Sequence
  source: /note="Description of Artificial Sequence: Synthetic peptide"
ALFKGAREHI

SEQ ID NO: 7886 - protein, 10 aa, Artificial Sequence
  source: /note="Description of Artificial Sequence: Synthetic peptide"
VLSSCVALFK

SEQ ID NO: 7887 - protein, 10 aa, Artificial Sequence
  source: /note="Description of Artificial Sequence: Synthetic peptide"
TYRLISTIAI

SEQ ID NO: 7888 - protein, 10 aa, Artificial Sequence
  source: /note="Description of Artificial Sequence: Synthetic peptide"
EHICLRETYR

SEQ ID NO: 7889 - protein, 10 aa, Artificial Sequence
  source: /note="Description of Artificial Sequence: Synthetic peptide"
ETYRLISTIA

SEQ ID NO: 7890 - protein, 10 aa, Artificial Sequence
  source: /note="Description of Artificial Sequence: Synthetic peptide"
EVLSSCVALF

SEQ ID NO: 7891 - protein, 10 aa, Artificial Sequence
  source: /note="Description of Artificial Sequence: Synthetic peptide"
REIRCVQAVV

SEQ ID NO: 7892 - protein, 10 aa, Artificial Sequence
  source: /note="Description of Artificial Sequence: Synthetic peptide"
SELSSVHEVL

SEQ ID NO: 7893 - protein, 10 aa, Artificial Sequence
  source: /note="Description of Artificial Sequence: Synthetic peptide"
HEVLSSCVAL

SEQ ID NO: 7894 - protein, 10 aa, Artificial Sequence
  source: /note="Description of Artificial Sequence: Synthetic peptide"
REHICLRETY

SEQ ID NO: 7895 - protein, 10 aa, Artificial Sequence
  source: /note="Description of Artificial Sequence: Synthetic peptide"
RETYRLISTI

SEQ ID NO: 7896 - protein, 9 aa, Artificial Sequence
  source: /note="Description of Artificial Sequence: Synthetic peptide"
AMAPVGPST

SEQ ID NO: 7897 - protein, 9 aa, Artificial Sequence
  source: /note="Description of Artificial Sequence: Synthetic peptide"
ATTMSQQGK

SEQ ID NO: 7898 - protein, 9 aa, Artificial Sequence
  source: /note="Description of Artificial Sequence: Synthetic peptide"
QGKPAMAPV

SEQ ID NO: 7899 - protein, 9 aa, Artificial Sequence
  source: /note="Description of Artificial Sequence: Synthetic peptide"
APLGEWHLL

SEQ ID NO: 7900 - protein, 9 aa, Artificial Sequence
  source: /note="Description of Artificial Sequence: Synthetic peptide"
MSQQGKPAM

SEQ ID NO: 7901 - protein, 9 aa, Artificial Sequence
  source: /note="Description of Artificial Sequence: Synthetic peptide"
APVGPSTST

SEQ ID NO: 7902 - protein, 9 aa, Artificial Sequence
  source: /note="Description of Artificial Sequence: Synthetic peptide"
LLRSEATTM

SEQ ID NO: 7903 - protein, 9 aa, Artificial Sequence
  source: /note="Description of Artificial Sequence: Synthetic peptide"
GAALGEAPL

SEQ ID NO: 7904 - protein, 9 aa, Artificial Sequence
  source: /note="Description of Artificial Sequence: Synthetic peptide"
GEWHLLRSE

SEQ ID NO: 7905 - protein, 9 aa, Artificial Sequence
  source: /note="Description of Artificial Sequence: Synthetic peptide"
GPSTSTRSW

SEQ ID NO: 7906 - protein, 10 aa, Artificial Sequence
  source: /note="Description of Artificial Sequence: Synthetic peptide"
EAPLGEWHLL

SEQ ID NO: 7907 - protein, 10 aa, Artificial Sequence
  source: /note="Description of Artificial Sequence: Synthetic peptide"
TTMSQQGKPA

SEQ ID NO: 7908 - protein, 10 aa, Artificial Sequence
  source: /note="Description of Artificial Sequence: Synthetic peptide"
KPAMAPVGPS

SEQ ID NO: 7909 - protein, 10 aa, Artificial Sequence
  source: /note="Description of Artificial Sequence: Synthetic peptide"
TMSQQGKPAM

SEQ ID NO: 7910 - protein, 10 aa, Artificial Sequence
  source: /note="Description of Artificial Sequence: Synthetic peptide"
HLLRSEATTM

SEQ ID NO: 7911 - protein, 10 aa, Artificial Sequence
  source: /note="Description of Artificial Sequence: Synthetic peptide"
GEAPLGEWHL

SEQ ID NO: 7912 - protein, 10 aa, Artificial Sequence
  source: /note="Description of Artificial Sequence: Synthetic peptide"
GEWHLLRSEA

SEQ ID NO: 7913 - protein, 10 aa, Artificial Sequence
  source: /note="Description of Artificial Sequence: Synthetic peptide"
QQGKPAMAPV

SEQ ID NO: 7914 - protein, 10 aa, Artificial Sequence
  source: /note="Description of Artificial Sequence: Synthetic peptide"
AMAPVGPSTS

SEQ ID NO: 7915 - protein, 10 aa, Artificial Sequence
  source: /note="Description of Artificial Sequence: Synthetic peptide"
GELYEEWLGT

SEQ ID NO: 7916 - protein, 9 aa, Artificial Sequence
  source: /note="Description of Artificial Sequence: Synthetic peptide"
LKFPNCQCL

SEQ ID NO: 7917 - protein, 9 aa, Artificial Sequence
  source: /note="Description of Artificial Sequence: Synthetic peptide"
FPNCQCLTT

SEQ ID NO: 7918 - protein, 10 aa, Artificial Sequence
  source: /note="Description of Artificial Sequence: Synthetic peptide"
ALKFPNCQCL

SEQ ID NO: 7919 - protein, 10 aa, Artificial Sequence
  source: /note="Description of Artificial Sequence: Synthetic peptide"
CQCLTTVIDI

SEQ ID NO: 7920 - protein, 10 aa, Artificial Sequence
  source: /note="Description of Artificial Sequence: Synthetic peptide"
FPNCQCLTTV

SEQ ID NO: 7921 - protein, 10 aa, Artificial Sequence
  source: /note="Description of Artificial Sequence: Synthetic peptide"
AECALKFPNC

SEQ ID NO: 7922 - protein, 9 aa, Artificial Sequence
  source: /note="Description of Artificial Sequence: Synthetic peptide"
SQIPPSSPL

SEQ ID NO: 7923 - protein, 10 aa, Artificial Sequence
  source: /note="Description of Artificial Sequence: Synthetic peptide"
MSQIPPSSPL

SEQ ID NO: 7924 - protein, 9 aa, Artificial Sequence
  source: /note="Description of Artificial Sequence: Synthetic peptide"
LVYDICKYL

SEQ ID NO: 7925 - protein, 9 aa, Artificial Sequence
  source: /note="Description of Artificial Sequence: Synthetic peptide"
VYDICKYLW

SEQ ID NO: 7926 - protein, 9 aa, Artificial Sequence
  source: /note="Description of Artificial Sequence: Synthetic peptide"
YLWCENIGR

SEQ ID NO: 7927 - protein, 9 aa, Artificial Sequence
  source: /note="Description of Artificial Sequence: Synthetic peptide"
CKYLWCENI

SEQ ID NO: 7928 - protein, 10 aa, Artificial Sequence
  source: /note="Description of Artificial Sequence: Synthetic peptide"
LLVYDICKYL

SEQ ID NO: 7929 - protein, 10 aa, Artificial Sequence
  source: /note="Description of Artificial Sequence: Synthetic peptide"
YLWCENIGRA

SEQ ID NO: 7930 - protein, 10 aa, Artificial Sequence
  source: /note="Description of Artificial Sequence: Synthetic peptide"
LVYDICKYLW

SEQ ID NO: 7931 - protein, 9 aa, Artificial Sequence
  source: /note="Description of Artificial Sequence: Synthetic peptide"
LVSSPTFNA

SEQ ID NO: 7932 - protein, 9 aa, Artificial Sequence
  source: /note="Description of Artificial Sequence: Synthetic peptide"
GQLVSSPTF

SEQ ID NO: 7933 - protein, 9 aa, Artificial Sequence
  source: /note="Description of Artificial Sequence: Synthetic peptide"
MEVKGQLVS

SEQ ID NO: 7934 - protein, 10 aa, Artificial Sequence
  source: /note="Description of Artificial Sequence: Synthetic peptide"
QLVSSPTFNA

SEQ ID NO: 7935 - protein, 10 aa, Artificial Sequence
  source: /note="Description of Artificial Sequence: Synthetic peptide"
MEVKGQLVSS

SEQ ID NO: 7936 - protein, 10 aa, Artificial Sequence
  source: /note="Description of Artificial Sequence: Synthetic peptide"
KGQLVSSPTF

SEQ ID NO: 7937 - protein, 9 aa, Artificial Sequence
  source: /note="Description of Artificial Sequence: Synthetic peptide"
QQLQQEQLY

SEQ ID NO: 7938 - protein, 9 aa, Artificial Sequence
  source: /note="Description of Artificial Sequence: Synthetic peptide"
KQQLQQEQL

SEQ ID NO: 7939 - protein, 9 aa, Artificial Sequence
  source: /note="Description of Artificial Sequence: Synthetic peptide"
QEQLYLESL

SEQ ID NO: 7940 - protein, 10 aa, Artificial Sequence
  source: /note="Description of Artificial Sequence: Synthetic peptide"
QLYLESLIQA

SEQ ID NO: 7941 - protein, 10 aa, Artificial Sequence
  source: /note="Description of Artificial Sequence: Synthetic peptide"
KQQLQQEQLY

SEQ ID NO: 7942 - protein, 10 aa, Artificial Sequence
  source: /note="Description of Artificial Sequence: Synthetic peptide"
LYLESLIQAR

SEQ ID NO: 7943 - protein, 10 aa, Artificial Sequence
  source: /note="Description of Artificial Sequence: Synthetic peptide"
RKQQLQQEQL

SEQ ID NO: 7944 - protein, 10 aa, Artificial Sequence
  source: /note="Description of Artificial Sequence: Synthetic peptide"
QQLQQEQLYL

SEQ ID NO: 7945 - protein, 10 aa, Artificial Sequence
  source: /note="Description of Artificial Sequence: Synthetic peptide"
QQEQLYLESL

SEQ ID NO: 7946 - protein, 10 aa, Artificial Sequence
  source: /note="Description of Artificial Sequence: Synthetic peptide"
QEQLYLESLI

SEQ ID NO: 7947 - protein, 9 aa, Artificial Sequence
  source: /note="Description of Artificial Sequence: Synthetic peptide"
CIPLPVSNI

SEQ ID NO: 7948 - protein, 9 aa, Artificial Sequence
  source: /note="Description of Artificial Sequence: Synthetic peptide"
VSKRVCIPL

SEQ ID NO: 7949 - protein, 9 aa, Artificial Sequence
  source: /note="Description of Artificial Sequence: Synthetic peptide"
KRVCIPLPV

SEQ ID NO: 7950 - protein, 9 aa, Artificial Sequence
  source: /note="Description of Artificial Sequence: Synthetic peptide"
NEVSKRVCI

SEQ ID NO: 7951 - protein, 10 aa, Artificial Sequence
  source: /note="Description of Artificial Sequence: Synthetic peptide"
EVSKRVCIPL

SEQ ID NO: 7952 - protein, 10 aa, Artificial Sequence
  source: /note="Description of Artificial Sequence: Synthetic peptide"
SKRVCIPLPV

SEQ ID NO: 7953 - protein, 9 aa, Artificial Sequence
  source: /note="Description of Artificial Sequence: Synthetic peptide"
GKRKVPENF

SEQ ID NO: 7954 - protein, 9 aa, Artificial Sequence
  source: /note="Description of Artificial Sequence: Synthetic peptide"
RKVPENFFI

SEQ ID NO: 7955 - protein, 10 aa, Artificial Sequence
  source: /note="Description of Artificial Sequence: Synthetic peptide"
WVLVLSGKRK

SEQ ID NO: 7956 - protein, 10 aa, Artificial Sequence
  source: /note="Description of Artificial Sequence: Synthetic peptide"
KRKVPENFFI

SEQ ID NO: 7957 - protein, 10 aa, Artificial Sequence
  source: /note="Description of Artificial Sequence: Synthetic peptide"
GKRKVPENFF

SEQ ID NO: 7958 - protein, 9 aa, Artificial Sequence
  source: /note="Description of Artificial Sequence: Synthetic peptide"
KTLQADFNK

SEQ ID NO: 7959 - protein, 9 aa, Artificial Sequence
  source: /note="Description of Artificial Sequence: Synthetic peptide"
ISRIKTLQA

SEQ ID NO: 7960 - protein, 9 aa, Artificial Sequence
  source: /note="Description of Artificial Sequence: Synthetic peptide"
RIKTLQADF

SEQ ID NO: 7961 - protein, 9 aa, Artificial Sequence
  source: /note="Description of Artificial Sequence: Synthetic peptide"
SEISRIKTL

SEQ ID NO: 7962 - protein, 10 aa, Artificial Sequence
  source: /note="Description of Artificial Sequence: Synthetic peptide"
LQADFNKTEL

SEQ ID NO: 7963 - protein, 10 aa, Artificial Sequence
  source: /note="Description of Artificial Sequence: Synthetic peptide"
RIKTLQADFN

SEQ ID NO: 7964 - protein, 10 aa, Artificial Sequence
  source: /note="Description of Artificial Sequence: Synthetic peptide"
EISRIKTLQA

SEQ ID NO: 7965 - protein, 10 aa, Artificial Sequence
  source: /note="Description of Artificial Sequence: Synthetic peptide"
SRIKTLQADF

SEQ ID NO: 7966 - protein, 9 aa, Artificial Sequence
  source: /note="Description of Artificial Sequence: Synthetic peptide"
KIKNTGPRK

SEQ ID NO: 7967 - protein, 9 aa, Artificial Sequence
  source: /note="Description of Artificial Sequence: Synthetic peptide"
KNRSGKKWK

SEQ ID NO: 7968 - protein, 9 aa, Artificial Sequence
  source: /note="Description of Artificial Sequence: Synthetic peptide"
RKNRSGKKW

SEQ ID NO: 7969 - protein, 9 aa, Artificial Sequence
  source: /note="Description of Artificial Sequence: Synthetic peptide"
LSRDQHVLH

SEQ ID NO: 7970 - protein, 10 aa, Artificial Sequence
  source: /note="Description of Artificial Sequence: Synthetic peptide"
LSRDQHVLHK

SEQ ID NO: 7971 - protein, 9 aa, Artificial Sequence
  source: /note="Description of Artificial Sequence: Synthetic peptide"
KHKQLIEKK

SEQ ID NO: 7972 - protein, 9 aa, Artificial Sequence
  source: /note="Description of Artificial Sequence: Synthetic peptide"
KQLIEKKEM

SEQ ID NO: 7973 - protein, 10 aa, Artificial Sequence
  source: /note="Description of Artificial Sequence: Synthetic peptide"
QLIEKKEMEI

SEQ ID NO: 7974 - protein, 10 aa, Artificial Sequence
  source: /note="Description of Artificial Sequence: Synthetic peptide"
HKQLIEKKEM

SEQ ID NO: 7975 - protein, 9 aa, Artificial Sequence
  source: /note="Description of Artificial Sequence: Synthetic peptide"
LTPPWIFEA

SEQ ID NO: 7976 - protein, 9 aa, Artificial Sequence
  source: /note="Description of Artificial Sequence: Synthetic peptide"
RQFGLTPPW

SEQ ID NO: 7977 - protein, 9 aa, Artificial Sequence
  source: /note="Description of Artificial Sequence: Synthetic peptide"
QFGLTPPWI

SEQ ID NO: 7978 - protein, 9 aa, Artificial Sequence
  source: /note="Description of Artificial Sequence: Synthetic peptide"
FGLTPPWIF

SEQ ID NO: 7979 - protein, 10 aa, Artificial Sequence
  source: /note="Description of Artificial Sequence: Synthetic peptide"
RQFGLTPPWI

SEQ ID NO: 7980 - protein, 10 aa, Artificial Sequence
  source: /note="Description of Artificial Sequence: Synthetic peptide"
GLTPPWIFEA

SEQ ID NO: 7981 - protein, 10 aa, Artificial Sequence
  source: /note="Description of Artificial Sequence: Synthetic peptide"
QFGLTPPWIF

SEQ ID NO: 7982 - protein, 10 aa, Artificial Sequence
  source: /note="Description of Artificial Sequence: Synthetic peptide"
QRQFGLTPPW

SEQ ID NO: 7983 - protein, 9 aa, Artificial Sequence
  source: /note="Description of Artificial Sequence: Synthetic peptide"
QRQFGLTPL

SEQ ID NO: 7984 - protein, 9 aa, Artificial Sequence
  source: /note="Description of Artificial Sequence: Synthetic peptide"
RQFGLTPLD

SEQ ID NO: 7985 - protein, 10 aa, Artificial Sequence
  source: /note="Description of Artificial Sequence: Synthetic peptide"
RQFGLTPLDL

SEQ ID NO: 7986 - protein, 10 aa, Artificial Sequence
  source: /note="Description of Artificial Sequence: Synthetic peptide"
QQRQFGLTPL

SEQ ID NO: 7987 - protein, 9 aa, Artificial Sequence
  source: /note="Description of Artificial Sequence: Synthetic peptide"
TLCSGSCPK

SEQ ID NO: 7988 - protein, 10 aa, Artificial Sequence
  source: /note="Description of Artificial Sequence: Synthetic peptide"
TLCSGSCPKA

SEQ ID NO: 7989 - protein, 10 aa, Artificial Sequence
  source: /note="Description of Artificial Sequence: Synthetic peptide"
LTLCSGSCPK

SEQ ID NO: 7990 - protein, 10 aa, Artificial Sequence
  source: /note="Description of Artificial Sequence: Synthetic peptide"
GSCPKASSLR

SEQ ID NO: 7991 - protein, 9 aa, Artificial Sequence
  source: /note="Description of Artificial Sequence: Synthetic peptide"
YMEDKMLPK

SEQ ID NO: 7992 - protein, 9 aa, Artificial Sequence
  source: /note="Description of Artificial Sequence: Synthetic peptide"
GLRIYMEDK

SEQ ID NO: 7993 - protein, 9 aa, Artificial Sequence
  source: /note="Description of Artificial Sequence: Synthetic peptide"
EEKGGLRIY

SEQ ID NO: 7994 - protein, 9 aa, Artificial Sequence
  source: /note="Description of Artificial Sequence: Synthetic peptide"
LRIYMEDKM

SEQ ID NO: 7995 - protein, 9 aa, Artificial Sequence
  source: /note="Description of Artificial Sequence: Synthetic peptide"
RIYMEDKML

SEQ ID NO: 7996 - protein, 10 aa, Artificial Sequence
  source: /note="Description of Artificial Sequence: Synthetic peptide"
IYMEDKMLPK

SEQ ID NO: 7997 - protein, 10 aa, Artificial Sequence
  source: /note="Description of Artificial Sequence: Synthetic peptide"
GEEKGGLRIY

SEQ ID NO: 7998 - protein, 10 aa, Artificial Sequence
  source: /note="Description of Artificial Sequence: Synthetic peptide"
EEKGGLRIYM

SEQ ID NO: 7999 - protein, 9 aa, Artificial Sequence
  source: /note="Description of Artificial Sequence: Synthetic peptide"
AIRLIRFGK

SEQ ID NO: 8000 - protein, 9 aa, Artificial Sequence
  source: /note="Description of Artificial Sequence: Synthetic peptide"
RLIRFGKKK

SEQ ID NO: 8001 - protein, 9 aa, Artificial Sequence
  source: /note="Description of Artificial Sequence: Synthetic peptide"
ELEAIRLIR

SEQ ID NO: 8002 - protein, 9 aa, Artificial Sequence
  source: /note="Description of Artificial Sequence: Synthetic peptide"
LEAIRLIRF

SEQ ID NO: 8003 - protein, 9 aa, Artificial Sequence
  source: /note="Description of Artificial Sequence: Synthetic peptide"
EELEAIRLI

SEQ ID NO: 8004 - protein, 9 aa, Artificial Sequence
  source: /note="Description of Artificial Sequence: Synthetic peptide"
AEELEAIRL

SEQ ID NO: 8005 - protein, 10 aa, Artificial Sequence
  source: /note="Description of Artificial Sequence: Synthetic peptide"
AIRLIRFGKK

SEQ ID NO: 8006 - protein, 10 aa, Artificial Sequence
  source: /note="Description of Artificial Sequence: Synthetic peptide"
EAIRLIRFGK

SEQ ID NO: 8007 - protein, 10 aa, Artificial Sequence
  source: /note="Description of Artificial Sequence: Synthetic peptide"
EELEAIRLIR

SEQ ID NO: 8008 - protein, 10 aa, Artificial Sequence
  source: /note="Description of Artificial Sequence: Synthetic peptide"
AEELEAIRLI

SEQ ID NO: 8009 - protein, 9 aa, Artificial Sequence
  source: /note="Description of Artificial Sequence: Synthetic peptide"
ILDAQILEK

SEQ ID NO: 8010 - protein, 9 aa, Artificial Sequence
  source: /note="Description of Artificial Sequence: Synthetic peptide"
LNAKCHAIL

SEQ ID NO: 8011 - protein, 9 aa, Artificial Sequence
  source: /note="Description of Artificial Sequence: Synthetic peptide"
HAILDAQIL

SEQ ID NO: 8012 - protein, 10 aa, Artificial Sequence
  source: /note="Description of Artificial Sequence: Synthetic peptide"
ILNAKCHAIL

SEQ ID NO: 8013 - protein, 10 aa, Artificial Sequence
  source: /note="Description of Artificial Sequence: Synthetic peptide"
AILDAQILEK

SEQ ID NO: 8014 - protein, 9 aa, Artificial Sequence
  source: /note="Description of Artificial Sequence: Synthetic peptide"
LEQEKEQML

SEQ ID NO: 8015 - protein, 10 aa, Artificial Sequence
  source: /note="Description of Artificial Sequence: Synthetic peptide"
EERSLLAEQL

SEQ ID NO: 8016 - protein, 9 aa, Artificial Sequence
  source: /note="Description of Artificial Sequence: Synthetic peptide"
IFEARQGEF

SEQ ID NO: 8017 - protein, 9 aa, Artificial Sequence
  source: /note="Description of Artificial Sequence: Synthetic peptide"
EMKKIFEAR

SEQ ID NO: 8018 - protein, 9 aa, Artificial Sequence
  source: /note="Description of Artificial Sequence: Synthetic peptide"
AILEMKKIF

SEQ ID NO: 8019 - protein, 9 aa, Artificial Sequence
  source: /note="Description of Artificial Sequence: Synthetic peptide"
LEMKKIFEA

SEQ ID NO: 8020 - protein, 10 aa, Artificial Sequence
  source: /note="Description of Artificial Sequence: Synthetic peptide"
KIFEARQGEF

SEQ ID NO: 8021 - protein, 10 aa, Artificial Sequence
  source: /note="Description of Artificial Sequence: Synthetic peptide"
QAILEMKKIF

SEQ ID NO: 8022 - protein, 9 aa, Artificial Sequence
  source: /note="Description of Artificial Sequence: Synthetic peptide"
KLADLSLCI

SEQ ID NO: 8023 - protein, 10 aa, Artificial Sequence
  source: /note="Description of Artificial Sequence: Synthetic peptide"
ADLSLCIQQI

SEQ ID NO: 8024 - protein, 9 aa, Artificial Sequence
  source: /note="Description of Artificial Sequence: Synthetic peptide"
PTMRVTNHK

SEQ ID NO: 8025 - protein, 9 aa, Artificial Sequence
  source: /note="Description of Artificial Sequence: Synthetic peptide"
RVTNHKPSR

SEQ ID NO: 8026 - protein, 9 aa, Artificial Sequence
  source: /note="Description of Artificial Sequence: Synthetic peptide"
VTNHKPSRR

SEQ ID NO: 8027 - protein, 10 aa, Artificial Sequence
  source: /note="Description of Artificial Sequence: Synthetic peptide"
RVTNHKPSRR

SEQ ID NO: 8028 - protein, 9 aa, Artificial Sequence
  source: /note="Description of Artificial Sequence: Synthetic peptide"
NISSMTISI

SEQ ID NO: 8029 - protein, 9 aa, Artificial Sequence
  source: /note="Description of Artificial Sequence: Synthetic peptide"
TISIQNTWK

SEQ ID NO: 8030 - protein, 9 aa, Artificial Sequence
  source: /note="Description of Artificial Sequence: Synthetic peptide"
MTISIQNTW

SEQ ID NO: 8031 - protein, 9 aa, Artificial Sequence
  source: /note="Description of Artificial Sequence: Synthetic peptide"
YQDNISSMT

SEQ ID NO: 8032 - protein, 10 aa, Artificial Sequence
  source: /note="Description of Artificial Sequence: Synthetic peptide"
YQDNISSMTI

SEQ ID NO: 8033 - protein, 10 aa, Artificial Sequence
  source: /note="Description of Artificial Sequence: Synthetic peptide"
MTISIQNTWK

SEQ ID NO: 8034 - protein, 10 aa, Artificial Sequence
  source: /note="Description of Artificial Sequence: Synthetic peptide"
SMTISIQNTW

SEQ ID NO: 8035 - protein, 9 aa, Artificial Sequence
  source: /note="Description of Artificial Sequence: Synthetic peptide"
ILRDRQALF

SEQ ID NO: 8036 - protein, 9 aa, Artificial Sequence
  source: /note="Description of Artificial Sequence: Synthetic peptide"
DISSPKILR

SEQ ID NO: 8037 - protein, 9 aa, Artificial Sequence
  source: /note="Description of Artificial Sequence: Synthetic peptide"
RDISSPKIL

SEQ ID NO: 8038 - protein, 9 aa, Artificial Sequence
  source: /note="Description of Artificial Sequence: Synthetic peptide"
KILRDRQAL

SEQ ID NO: 8039 - protein, 10 aa, Artificial Sequence
  source: /note="Description of Artificial Sequence: Synthetic peptide"
GTRDISSPKI

SEQ ID NO: 8040 - protein, 10 aa, Artificial Sequence
  source: /note="Description of Artificial Sequence: Synthetic peptide"
KILRDRQALF

SEQ ID NO: 8041 - protein, 10 aa, Artificial Sequence
  source: /note="Description of Artificial Sequence: Synthetic peptide"
RENRKLKKNI

SEQ ID NO: 8042 - protein, 9 aa, Artificial Sequence
  source: /note="Description of Artificial Sequence: Synthetic peptide"
LQSPAPPQL

SEQ ID NO: 8043 - protein, 10 aa, Artificial Sequence
  source: /note="Description of Artificial Sequence: Synthetic peptide"
TLQSPAPPQL

SEQ ID NO: 8044 - protein, 9 aa, Artificial Sequence
  source: /note="Description of Artificial Sequence: Synthetic peptide"
YMQKTRPPR

SEQ ID NO: 8045 - protein, 9 aa, Artificial Sequence
  source: /note="Description of Artificial Sequence: Synthetic peptide"
MQKTRPPRK

SEQ ID NO: 8046 - protein, 9 aa, Artificial Sequence
  source: /note="Description of Artificial Sequence: Synthetic peptide"
YEDSDGCYM

SEQ ID NO: 8047 - protein, 10 aa, Artificial Sequence
  source: /note="Description of Artificial Sequence: Synthetic peptide"
YMQKTRPPRK

SEQ ID NO: 8048 - protein, 10 aa, Artificial Sequence
  source: /note="Description of Artificial Sequence: Synthetic peptide"
MQKTRPPRKL

SEQ ID NO: 8049 - protein, 10 aa, Artificial Sequence
  source: /note="Description of Artificial Sequence: Synthetic peptide"
CYMQKTRPPR

SEQ ID NO: 8050 - protein, 9 aa, Artificial Sequence
  source: /note="Description of Artificial Sequence: Synthetic peptide"
FIPGVVMAM

SEQ ID NO: 8051 - protein, 9 aa, Artificial Sequence
  source: /note="Description of Artificial Sequence: Synthetic peptide"
VVMAMAYGL

SEQ ID NO: 8052 - protein, 9 aa, Artificial Sequence
  source: /note="Description of Artificial Sequence: Synthetic peptide"
VMAMAYGLI

SEQ ID NO: 8053 - protein, 9 aa, Artificial Sequence
  source: /note="Description of Artificial Sequence: Synthetic peptide"
AMAYGLISR

SEQ ID NO: 8054 - protein, 9 aa, Artificial Sequence
  source: /note="Description of Artificial Sequence: Synthetic peptide"
MAMAYGLIS

SEQ ID NO: 8055 - protein, 10 aa, Artificial Sequence
  source: /note="Description of Artificial Sequence: Synthetic peptide"
FIPGVVMAMA

SEQ ID NO: 8056 - protein, 10 aa, Artificial Sequence
  source: /note="Description of Artificial Sequence: Synthetic peptide"
VVMAMAYGLI

SEQ ID NO: 8057 - protein, 10 aa, Artificial Sequence
  source: /note="Description of Artificial Sequence: Synthetic peptide"
MAMAYGLISR

SEQ ID NO: 8058 - protein, 10 aa, Artificial Sequence
  source: /note="Description of Artificial Sequence: Synthetic peptide"
FFIPGVVMAM

SEQ ID NO: 8059 - protein, 10 aa, Artificial Sequence
  source: /note="Description of Artificial Sequence: Synthetic peptide"
MAYGLISREL

SEQ ID NO: 8060 - protein, 10 aa, Artificial Sequence
  source: /note="Description of Artificial Sequence: Synthetic peptide"
IPGVVMAMAY

SEQ ID NO: 8061 - protein, 9 aa, Artificial Sequence
  source: /note="Description of Artificial Sequence: Synthetic peptide"
VLFEDMITL

SEQ ID NO: 8062 - protein, 9 aa, Artificial Sequence
  source: /note="Description of Artificial Sequence: Synthetic peptide"
SSHFPYIQY

SEQ ID NO: 8063 - protein, 9 aa, Artificial Sequence
  source: /note="Description of Artificial Sequence: Synthetic peptide"
HFPYIQYQF

SEQ ID NO: 8064 - protein, 9 aa, Artificial Sequence
  source: /note="Description of Artificial Sequence: Synthetic peptide"
IQYQFWKNF

SEQ ID NO: 8065 - protein, 9 aa, Artificial Sequence
  source: /note="Description of Artificial Sequence: Synthetic peptide"
FPYIQYQFW

SEQ ID NO: 8066 - protein, 10 aa, Artificial Sequence
  source: /note="Description of Artificial Sequence: Synthetic peptide"
CSSHFPYIQY

SEQ ID NO: 8067 - protein, 10 aa, Artificial Sequence
  source: /note="Description of Artificial Sequence: Synthetic peptide"
YTCSSHFPYI

SEQ ID NO: 8068 - protein, 10 aa, Artificial Sequence
  source: /note="Description of Artificial Sequence: Synthetic peptide"
SHFPYIQYQF

SEQ ID NO: 8069 - protein, 10 aa, Artificial Sequence
  source: /note="Description of Artificial Sequence: Synthetic peptide"
HFPYIQYQFW

SEQ ID NO: 8070 - protein, 10 aa, Artificial Sequence
  source: /note="Description of Artificial Sequence: Synthetic peptide"
YIQYQFWKNF

SEQ ID NO: 8071 - protein, 9 aa, Artificial Sequence
  source: /note="Description of Artificial Sequence: Synthetic peptide"
FINRMDESL

SEQ ID NO: 8072 - protein, 9 aa, Artificial Sequence
  source: /note="Description of Artificial Sequence: Synthetic peptide"
RMDESLNIV

SEQ ID NO: 8073 - protein, 9 aa, Artificial Sequence
  source: /note="Description of Artificial Sequence: Synthetic peptide"
DESLNIVKY

SEQ ID NO: 8074 - protein, 10 aa, Artificial Sequence
  source: /note="Description of Artificial Sequence: Synthetic peptide"
RMDESLNIVK

SEQ ID NO: 8075 - protein, 10 aa, Artificial Sequence
  source: /note="Description of Artificial Sequence: Synthetic peptide"
SFINRMDESL

SEQ ID NO: 8076 - protein, 10 aa, Artificial Sequence
  source: /note="Description of Artificial Sequence: Synthetic peptide"
MDESLNIVKY

SEQ ID NO: 8077 - protein, 9 aa, Artificial Sequence
  source: /note="Description of Artificial Sequence: Synthetic peptide"
HIFHQLIQI

SEQ ID NO: 8078 - protein, 9 aa, Artificial Sequence
  source: /note="Description of Artificial Sequence: Synthetic peptide"
IQITHNGTI

SEQ ID NO: 8079 - protein, 10 aa, Artificial Sequence
  source: /note="Description of Artificial Sequence: Synthetic peptide"
SHIFHQLIQI

SEQ ID NO: 8080 - protein, 9 aa, Artificial Sequence
  source: /note="Description of Artificial Sequence: Synthetic peptide"
RIQPAVKYF

SEQ ID NO: 8081 - protein, 9 aa, Artificial Sequence
  source: /note="Description of Artificial Sequence: Synthetic peptide"
KYFQVNITA

SEQ ID NO: 8082 - protein, 9 aa, Artificial Sequence
  source: /note="Description of Artificial Sequence: Synthetic peptide"
AVKYFQVNI

SEQ ID NO: 8083 - protein, 9 aa, Artificial Sequence
  source: /note="Description of Artificial Sequence: Synthetic peptide"
LRIQPAVKY

SEQ ID NO: 8084 - protein, 9 aa, Artificial Sequence
  source: /note="Description of Artificial Sequence: Synthetic peptide"
QPAVKYFQV

SEQ ID NO: 8085 - protein, 10 aa, Artificial Sequence
  source: /note="Description of Artificial Sequence: Synthetic peptide"
IQPAVKYFQV

SEQ ID NO: 8086 - protein, 10 aa, Artificial Sequence
  source: /note="Description of Artificial Sequence: Synthetic peptide"
TLRIQPAVKY

SEQ ID NO: 8087 - protein, 10 aa, Artificial Sequence
  source: /note="Description of Artificial Sequence: Synthetic peptide"
LRIQPAVKYF

SEQ ID NO: 8088 - protein, 10 aa, Artificial Sequence
  source: /note="Description of Artificial Sequence: Synthetic peptide"
VKYFQVNITA

SEQ ID NO: 8089 - protein, 9 aa, Artificial Sequence
  source: /note="Description of Artificial Sequence: Synthetic peptide"
KTYIQQKTR

SEQ ID NO: 8090 - protein, 9 aa, Artificial Sequence
  source: /note="Description of Artificial Sequence: Synthetic peptide"
PSKTYIQQK

SEQ ID NO: 8091 - protein, 10 aa, Artificial Sequence
  source: /note="Description of Artificial Sequence: Synthetic peptide"
QQKTRDENIK

SEQ ID NO: 8092 - protein, 10 aa, Artificial Sequence
  source: /note="Description of Artificial Sequence: Synthetic peptide"
IQQKTRDENI

SEQ ID NO: 8093 - protein, 9 aa, Artificial Sequence
  source: /note="Description of Artificial Sequence: Synthetic peptide"
VEVNVQGAM

SEQ ID NO: 8094 - protein, 9 aa, Artificial Sequence
  source: /note="Description of Artificial Sequence: Synthetic peptide"
MGILCANGW

SEQ ID NO: 8095 - protein, 10 aa, Artificial Sequence
  source: /note="Description of Artificial Sequence: Synthetic peptide"
EVNVQGAMGI

SEQ ID NO: 8096 - protein, 10 aa, Artificial Sequence
  source: /note="Description of Artificial Sequence: Synthetic peptide"
KVEVNVQGAM

SEQ ID NO: 8097 - protein, 10 aa, Artificial Sequence
  source: /note="Description of Artificial Sequence: Synthetic peptide"
VQGAMGILCA

SEQ ID NO: 8098 - protein, 10 aa, Artificial Sequence
  source: /note="Description of Artificial Sequence: Synthetic peptide"
AMGILCANGW

SEQ ID NO: 8099 - protein, 9 aa, Artificial Sequence
  source: /note="Description of Artificial Sequence: Synthetic peptide"
LTFGGTPNL

SEQ ID NO: 8100 - protein, 9 aa, Artificial Sequence
  source: /note="Description of Artificial Sequence: Synthetic peptide"
STIFQSLTF

SEQ ID NO: 8101 - protein, 10 aa, Artificial Sequence
  source: /note="Description of Artificial Sequence: Synthetic peptide"
SLTFGGTPNL

SEQ ID NO: 8102 - protein, 10 aa, Artificial Sequence
  source: /note="Description of Artificial Sequence: Synthetic peptide"
FQSLTFGGTP

SEQ ID NO: 8103 - protein, 9 aa, Artificial Sequence
  source: /note="Description of Artificial Sequence: Synthetic peptide"
FTNSTLAQT

SEQ ID NO: 8104 - protein, 9 aa, Artificial Sequence
  source: /note="Description of Artificial Sequence: Synthetic peptide"
SSFTNSTLA

SEQ ID NO: 8105 - protein, 9 aa, Artificial Sequence
  source: /note="Description of Artificial Sequence: Synthetic peptide"
TSSFTNSTL

SEQ ID NO: 8106 - protein, 9 aa, Artificial Sequence
  source: /note="Description of Artificial Sequence: Synthetic peptide"
LAQTQGSGW

SEQ ID NO: 8107 - protein, 10 aa, Artificial Sequence
  source: /note="Description of Artificial Sequence: Synthetic peptide"
QTSSFTNSTL

SEQ ID NO: 8108 - protein, 10 aa, Artificial Sequence
  source: /note="Description of Artificial Sequence: Synthetic peptide"
TSSFTNSTLA

SEQ ID NO: 8109 - protein, 10 aa, Artificial Sequence
  source: /note="Description of Artificial Sequence: Synthetic peptide"
TLAQTQGSGW

SEQ ID NO: 8110 - protein, 9 aa, Artificial Sequence
  source: /note="Description of Artificial Sequence: Synthetic peptide"
LSDLELLFC

SEQ ID NO: 8111 - protein, 9 aa, Artificial Sequence
  source: /note="Description of Artificial Sequence: Synthetic peptide"
ELLFCFYLF

SEQ ID NO: 8112 - protein, 9 aa, Artificial Sequence
  source: /note="Description of Artificial Sequence: Synthetic peptide"
LFCFYLFGL

SEQ ID NO: 8113 - protein, 9 aa, Artificial Sequence
  source: /note="Description of Artificial Sequence: Synthetic peptide"
CFYLFGLTR

SEQ ID NO: 8114 - protein, 9 aa, Artificial Sequence
  source: /note="Description of Artificial Sequence: Synthetic peptide"
SDLELLFCF

SEQ ID NO: 8115 - protein, 9 aa, Artificial Sequence
  source: /note="Description of Artificial Sequence: Synthetic peptide"
LELLFCFYL

SEQ ID NO: 8116 - protein, 10 aa, Artificial Sequence
  source: /note="Description of Artificial Sequence: Synthetic peptide"
LSDLELLFCF

SEQ ID NO: 8117 - protein, 10 aa, Artificial Sequence
  source: /note="Description of Artificial Sequence: Synthetic peptide"
LLFCFYLFGL

SEQ ID NO: 8118 - protein, 10 aa, Artificial Sequence
  source: /note="Description of Artificial Sequence: Synthetic peptide"
SDLELLFCFY

SEQ ID NO: 8119 - protein, 10 aa, Artificial Sequence
  source: /note="Description of Artificial Sequence: Synthetic peptide"
FCFYLFGLTR

SEQ ID NO: 8120 - protein, 10 aa, Artificial Sequence
  source: /note="Description of Artificial Sequence: Synthetic peptide"
LELLFCFYLF

SEQ ID NO: 8121 - protein, 9 aa, Artificial Sequence
  source: /note="Description of Artificial Sequence: Synthetic peptide"
RLSPSAASR

SEQ ID NO: 8122 - protein, 9 aa, Artificial Sequence
  source: /note="Description of Artificial Sequence: Synthetic peptide"
ASRSRPSPI

SEQ ID NO: 8123 - protein, 9 aa, Artificial Sequence
  source: /note="Description of Artificial Sequence: Synthetic peptide"
RSRPSPIAA

SEQ ID NO: 8124 - protein, 9 aa, Artificial Sequence
  source: /note="Description of Artificial Sequence: Synthetic peptide"
AGRAPTAWR

SEQ ID NO: 8125 - protein, 9 aa, Artificial Sequence
  source: /note="Description of Artificial Sequence: Synthetic peptide"
VPQRLSPSA

SEQ ID NO: 8126 - protein, 9 aa, Artificial Sequence
  source: /note="Description of Artificial Sequence: Synthetic peptide"
SPIAAGRAP

SEQ ID NO: 8127 - protein, 9 aa, Artificial Sequence
  source: /note="Description of Artificial Sequence: Synthetic peptide"
AAGRAPTAW

SEQ ID NO: 8128 - protein, 10 aa, Artificial Sequence
  source: /note="Description of Artificial Sequence: Synthetic peptide"
AASRSRPSPI

SEQ ID NO: 8129 - protein, 10 aa, Artificial Sequence
  source: /note="Description of Artificial Sequence: Synthetic peptide"
ASRSRPSPIA

SEQ ID NO: 8130 - protein, 10 aa, Artificial Sequence
  source: /note="Description of Artificial Sequence: Synthetic peptide"
RSRPSPIAAG

SEQ ID NO: 8131 - protein, 10 aa, Artificial Sequence
  source: /note="Description of Artificial Sequence: Synthetic peptide"
AWRGWGSCRR

SEQ ID NO: 8132 - protein, 10 aa, Artificial Sequence
  source: /note="Description of Artificial Sequence: Synthetic peptide"
TAWRGWGSCR

SEQ ID NO: 8133 - protein, 10 aa, Artificial Sequence
  source: /note="Description of Artificial Sequence: Synthetic peptide"
EVPQRLSPSA

SEQ ID NO: 8134 - protein, 10 aa, Artificial Sequence
  source: /note="Description of Artificial Sequence: Synthetic peptide"
VPQRLSPSAA

SEQ ID NO: 8135 - protein, 10 aa, Artificial Sequence
  source: /note="Description of Artificial Sequence: Synthetic peptide"
RPSPIAAGRA

SEQ ID NO: 8136 - protein, 10 aa, Artificial Sequence
  source: /note="Description of Artificial Sequence: Synthetic peptide"
SPIAAGRAPT

SEQ ID NO: 8137 - protein, 10 aa, Artificial Sequence
  source: /note="Description of Artificial Sequence: Synthetic peptide"
AEVPQRLSPS

SEQ ID NO: 8138 - protein, 10 aa, Artificial Sequence
  source: /note="Description of Artificial Sequence: Synthetic peptide"
IAAGRAPTAW

SEQ ID NO: 8139 - protein, 9 aa, Artificial Sequence
  source: /note="Description of Artificial Sequence: Synthetic peptide"
KPWSHGNVS

SEQ ID NO: 8140 - protein, 10 aa, Artificial Sequence
  source: /note="Description of Artificial Sequence: Synthetic peptide"
FLKPWSHGNV

SEQ ID NO: 8141 - protein, 10 aa, Artificial Sequence
  source: /note="Description of Artificial Sequence: Synthetic peptide"
KPWSHGNVSK

SEQ ID NO: 8142 - protein, 10 aa, Artificial Sequence
  source: /note="Description of Artificial Sequence: Synthetic peptide"
HGNVSKQELK

SEQ ID NO: 8143 - protein, 9 aa, Artificial Sequence
  source: /note="Description of Artificial Sequence: Synthetic peptide"
DSITTCKEV

SEQ ID NO: 8144 - protein, 9 aa, Artificial Sequence
  source: /note="Description of Artificial Sequence: Synthetic peptide"
CLSWSSRIV

SEQ ID NO: 8145 - protein, 9 aa, Artificial Sequence
  source: /note="Description of Artificial Sequence: Synthetic peptide"
RIVAPGHAL

SEQ ID NO: 8146 - protein, 9 aa, Artificial Sequence
  source: /note="Description of Artificial Sequence: Synthetic peptide"
RTRRRWSSK

SEQ ID NO: 8147 - protein, 9 aa, Artificial Sequence
  source: /note="Description of Artificial Sequence: Synthetic peptide"
RGKNIQGGR

SEQ ID NO: 8148 - protein, 9 aa, Artificial Sequence
  source: /note="Description of Artificial Sequence: Synthetic peptide"
SSRIVAPGH

SEQ ID NO: 8149 - protein, 9 aa, Artificial Sequence
  source: /note="Description of Artificial Sequence: Synthetic peptide"
HALSCRTRR

SEQ ID NO: 8150 - protein, 9 aa, Artificial Sequence
  source: /note="Description of Artificial Sequence: Synthetic peptide"
LSWSSRIVA

SEQ ID NO: 8151 - protein, 10 aa, Artificial Sequence
  source: /note="Description of Artificial Sequence: Synthetic peptide"
SSRIVAPGHA

SEQ ID NO: 8152 - protein, 10 aa, Artificial Sequence
  source: /note="Description of Artificial Sequence: Synthetic peptide"
HALSCRTRRR

SEQ ID NO: 8153 - protein, 10 aa, Artificial Sequence
  source: /note="Description of Artificial Sequence: Synthetic peptide"
IQGGRPSPCL

SEQ ID NO: 8154 - protein, 10 aa, Artificial Sequence
  source: /note="Description of Artificial Sequence: Synthetic peptide"
GGRPSPCLSW

SEQ ID NO: 8155 - protein, 10 aa, Artificial Sequence
  source: /note="Description of Artificial Sequence: Synthetic peptide"
SRIVAPGHAL

SEQ ID NO: 8156 - protein, 10 aa, Artificial Sequence
  source: /note="Description of Artificial Sequence: Synthetic peptide"
SPCLSWSSRI

SEQ ID NO: 8157 - protein, 9 aa, Artificial Sequence
  source: /note="Description of Artificial Sequence: Synthetic peptide"
NLKWSTAVK

SEQ ID NO: 8158 - protein, 9 aa, Artificial Sequence
  source: /note="Description of Artificial Sequence: Synthetic peptide"
STAVKFCKK

SEQ ID NO: 8159 - protein, 9 aa, Artificial Sequence
  source: /note="Description of Artificial Sequence: Synthetic peptide"
WSTAVKFCK

SEQ ID NO: 8160 - protein, 9 aa, Artificial Sequence
  source: /note="Description of Artificial Sequence: Synthetic peptide"
TAVKFCKKK

SEQ ID NO: 8161 - protein, 9 aa, Artificial Sequence
  source: /note="Description of Artificial Sequence: Synthetic peptide"
LKWSTAVKF

SEQ ID NO: 8162 - protein, 10 aa, Artificial Sequence
  source: /note="Description of Artificial Sequence: Synthetic peptide"
KWSTAVKFCK

SEQ ID NO: 8163 - protein, 10 aa, Artificial Sequence
  source: /note="Description of Artificial Sequence: Synthetic peptide"
WSTAVKFCKK

SEQ ID NO: 8164 - protein, 10 aa, Artificial Sequence
  source: /note="Description of Artificial Sequence: Synthetic peptide"
STAVKFCKKK

SEQ ID NO: 8165 - protein, 10 aa, Artificial Sequence
  source: /note="Description of Artificial Sequence: Synthetic peptide"
NLKWSTAVKF

SEQ ID NO: 8166 - protein, 9 aa, Artificial Sequence
  source: /note="Description of Artificial Sequence: Synthetic peptide"
ALPDPQQPL

SEQ ID NO: 8167 - protein, 9 aa, Artificial Sequence
  source: /note="Description of Artificial Sequence: Synthetic peptide"
DPQQPLPSL

SEQ ID NO: 8168 - protein, 9 aa, Artificial Sequence
  source: /note="Description of Artificial Sequence: Synthetic peptide"
QPLPSLRPW

SEQ ID NO: 8169 - protein, 10 aa, Artificial Sequence
  source: /note="Description of Artificial Sequence: Synthetic peptide"
SALPDPQQPL

SEQ ID NO: 8170 - protein, 10 aa, Artificial Sequence
  source: /note="Description of Artificial Sequence: Synthetic peptide"
QQPLPSLRPW

SEQ ID NO: 8171 - protein, 9 aa, Artificial Sequence
  source: /note="Description of Artificial Sequence: Synthetic peptide"
EEDHTHEGL

SEQ ID NO: 8172 - protein, 10 aa, Artificial Sequence
  source: /note="Description of Artificial Sequence: Synthetic peptide"
MEEDHTHEGL

SEQ ID NO: 8173 - protein, 10 aa, Artificial Sequence
  source: /note="Description of Artificial Sequence: Synthetic peptide"
HEGLDIDQTA

SEQ ID NO: 8174 - protein, 10 aa, Artificial Sequence
  source: /note="Description of Artificial Sequence: Synthetic peptide"
MEEDHTDEGL

SEQ ID NO: 8175 - protein, 9 aa, Artificial Sequence
  source: /note="Description of Artificial Sequence: Synthetic peptide"
GMAPSSAAA

SEQ ID NO: 8176 - protein, 9 aa, Artificial Sequence
  source: /note="Description of Artificial Sequence: Synthetic peptide"
HQDCFEGGM

SEQ ID NO: 8177 - protein, 9 aa, Artificial Sequence
  source: /note="Description of Artificial Sequence: Synthetic peptide"
FEGGMAPSS

SEQ ID NO: 8178 - protein, 10 aa, Artificial Sequence
  source: /note="Description of Artificial Sequence: Synthetic peptide"
FEGGMAPSSA

SEQ ID NO: 8179 - protein, 9 aa, Artificial Sequence
  source: /note="Description of Artificial Sequence: Synthetic peptide"
FLGFVAFPA

SEQ ID NO: 8180 - protein, 9 aa, Artificial Sequence
  source: /note="Description of Artificial Sequence: Synthetic peptide"
FVAFPAIPG

SEQ ID NO: 8181 - protein, 9 aa, Artificial Sequence
  source: /note="Description of Artificial Sequence: Synthetic peptide"
LGFVAFPAI

SEQ ID NO: 8182 - protein, 10 aa, Artificial Sequence
  source: /note="Description of Artificial Sequence: Synthetic peptide"
FLGFVAFPAI

SEQ ID NO: 8183 - protein, 10 aa, Artificial Sequence
  source: /note="Description of Artificial Sequence: Synthetic peptide"
FVAFPAIPGA

SEQ ID NO: 8184 - protein, 10 aa, Artificial Sequence
  source: /note="Description of Artificial Sequence: Synthetic peptide"
KFLGFVAFPA

SEQ ID NO: 8185 - protein, 9 aa, Artificial Sequence
  source: /note="Description of Artificial Sequence: Synthetic peptide"
NMDFLTLRH

SEQ ID NO: 8186 - protein, 9 aa, Artificial Sequence
  source: /note="Description of Artificial Sequence: Synthetic peptide"
LLSGSNPPI

SEQ ID NO: 8187 - protein, 9 aa, Artificial Sequence
  source: /note="Description of Artificial Sequence: Synthetic peptide"
GMLPLEIAL

SEQ ID NO: 8188 - protein, 9 aa, Artificial Sequence
  source: /note="Description of Artificial Sequence: Synthetic peptide"
MLPLEIALT

SEQ ID NO: 8189 - protein, 9 aa, Artificial Sequence
  source: /note="Description of Artificial Sequence: Synthetic peptide"
LTISPFSTV

SEQ ID NO: 8190 - protein, 9 aa, Artificial Sequence
  source: /note="Description of Artificial Sequence: Synthetic peptide"
HLMWMNMNI

SEQ ID NO: 8191 - protein, 9 aa, Artificial Sequence
  source: /note="Description of Artificial Sequence: Synthetic peptide"
NIMSELKMV

SEQ ID NO: 8192 - protein, 9 aa, Artificial Sequence
  source: /note="Description of Artificial Sequence: Synthetic peptide"
IMSELKMVT

SEQ ID NO: 8193 - protein, 9 aa, Artificial Sequence
  source: /note="Description of Artificial Sequence: Synthetic peptide"
STVCRESER

SEQ ID NO: 8194 - protein, 9 aa, Artificial Sequence
  source: /note="Description of Artificial Sequence: Synthetic peptide"
NMNIMSELK

SEQ ID NO: 8195 - protein, 9 aa, Artificial Sequence
  source: /note="Description of Artificial Sequence: Synthetic peptide"
IFHSGMLPL

SEQ ID NO: 8196 - protein, 9 aa, Artificial Sequence
  source: /note="Description of Artificial Sequence: Synthetic peptide"
DYNMDFLTL

SEQ ID NO: 8197 - protein, 9 aa, Artificial Sequence
  source: /note="Description of Artificial Sequence: Synthetic peptide"
KMVTSTGLF

SEQ ID NO: 8198 - protein, 9 aa, Artificial Sequence
  source: /note="Description of Artificial Sequence: Synthetic peptide"
YNMDFLTLR

SEQ ID NO: 8199 - protein, 9 aa, Artificial Sequence
  source: /note="Description of Artificial Sequence: Synthetic peptide"
EIALTISPF

SEQ ID NO: 8200 - protein, 9 aa, Artificial Sequence
  source: /note="Description of Artificial Sequence: Synthetic peptide"
MNMNIMSEL

SEQ ID NO: 8201 - protein, 9 aa, Artificial Sequence
  source: /note="Description of Artificial Sequence: Synthetic peptide"
PPIFHSGML

SEQ ID NO: 8202 - protein, 9 aa, Artificial Sequence
  source: /note="Description of Artificial Sequence: Synthetic peptide"
LPLEIALTI

SEQ ID NO: 8203 - protein, 9 aa, Artificial Sequence
  source: /note="Description of Artificial Sequence: Synthetic peptide"
LMWMNMNIM

SEQ ID NO: 8204 - protein, 9 aa, Artificial Sequence
  source: /note="Description of Artificial Sequence: Synthetic peptide"
LSGSNPPIF

SEQ ID NO: 8205 - protein, 9 aa, Artificial Sequence
  source: /note="Description of Artificial Sequence: Synthetic peptide"
LEIALTISP

SEQ ID NO: 8206 - protein, 9 aa, Artificial Sequence
  source: /note="Description of Artificial Sequence: Synthetic peptide"
RESERDYNM

SEQ ID NO: 8207 - protein, 9 aa, Artificial Sequence
  source: /note="Description of Artificial Sequence: Synthetic peptide"
SERDYNMDF

SEQ ID NO: 8208 - protein, 9 aa, Artificial Sequence
  source: /note="Description of Artificial Sequence: Synthetic peptide"
MDFLTLRHL

SEQ ID NO: 8209 - protein, 9 aa, Artificial Sequence
  source: /note="Description of Artificial Sequence: Synthetic peptide"
LRHLMWMNM

SEQ ID NO: 8210 - protein, 9 aa, Artificial Sequence
  source: /note="Description of Artificial Sequence: Synthetic peptide"
MNIMSELKM

SEQ ID NO: 8211 - protein, 9 aa, Artificial Sequence
  source: /note="Description of Artificial Sequence: Synthetic peptide"
SELKMVTST

SEQ ID NO: 8212 - protein, 9 aa, Artificial Sequence
  source: /note="Description of Artificial Sequence: Synthetic peptide"
LKMVTSTGL

SEQ ID NO: 8213 - protein, 9 aa, Artificial Sequence
  source: /note="Description of Artificial Sequence: Synthetic peptide"
RDYNMDFLT

SEQ ID NO: 8214 - protein, 10 aa, Artificial Sequence
  source: /note="Description of Artificial Sequence: Synthetic peptide"
ALLSGSNPPI

SEQ ID NO: 8215 - protein, 10 aa, Artificial Sequence
  source: /note="Description of Artificial Sequence: Synthetic peptide"
MLPLEIALTI

SEQ ID NO: 8216 - protein, 10 aa, Artificial Sequence
  source: /note="Description of Artificial Sequence: Synthetic peptide"
ALTISPFSTV

SEQ ID NO: 8217 - protein, 10 aa, Artificial Sequence
  source: /note="Description of Artificial Sequence: Synthetic peptide"
NMDFLTLRHL

SEQ ID NO: 8218 - protein, 10 aa, Artificial Sequence
  source: /note="Description of Artificial Sequence: Synthetic peptide"
FLTLRHLMWM

SEQ ID NO: 8219 - protein, 10 aa, Artificial Sequence
  source: /note="Description of Artificial Sequence: Synthetic peptide"
HLMWMNMNIM

SEQ ID NO: 8220 - protein, 10 aa, Artificial Sequence
  source: /note="Description of Artificial Sequence: Synthetic peptide"
WMNMNIMSEL

SEQ ID NO: 8221 - protein, 10 aa, Artificial Sequence
  source: /note="Description of Artificial Sequence: Synthetic peptide"
TISPFSTVCR

SEQ ID NO: 8222 - protein, 10 aa, Artificial Sequence
  source: /note="Description of Artificial Sequence: Synthetic peptide"
MNMNIMSELK

SEQ ID NO: 8223 - protein, 10 aa, Artificial Sequence
  source: /note="Description of Artificial Sequence: Synthetic peptide"
DFLTLRHLMW

SEQ ID NO: 8224 - protein, 10 aa, Artificial Sequence
  source: /note="Description of Artificial Sequence: Synthetic peptide"
RHLMWMNMNI

SEQ ID NO: 8225 - protein, 10 aa, Artificial Sequence
  source: /note="Description of Artificial Sequence: Synthetic peptide"
TLRHLMWMNM

SEQ ID NO: 8226 - protein, 10 aa, Artificial Sequence
  source: /note="Description of Artificial Sequence: Synthetic peptide"
FSTVCRESER

SEQ ID NO: 8227 - protein, 10 aa, Artificial Sequence
  source: /note="Description of Artificial Sequence: Synthetic peptide"
DYNMDFLTLR

SEQ ID NO: 8228 - protein, 10 aa, Artificial Sequence
  source: /note="Description of Artificial Sequence: Synthetic peptide"
EIALTISPFS

SEQ ID NO: 8229 - protein, 10 aa, Artificial Sequence
  source: /note="Description of Artificial Sequence: Synthetic peptide"
NPPIFHSGML

SEQ ID NO: 8230 - protein, 10 aa, Artificial Sequence
  source: /note="Description of Artificial Sequence: Synthetic peptide"
ELKMVTSTGL

SEQ ID NO: 8231 - protein, 10 aa, Artificial Sequence
  source: /note="Description of Artificial Sequence: Synthetic peptide"
LLSGSNPPIF

SEQ ID NO: 8232 - protein, 10 aa, Artificial Sequence
  source: /note="Description of Artificial Sequence: Synthetic peptide"
LEIALTISPF

SEQ ID NO: 8233 - protein, 10 aa, Artificial Sequence
  source: /note="Description of Artificial Sequence: Synthetic peptide"
LKMVTSTGLF

SEQ ID NO: 8234 - protein, 10 aa, Artificial Sequence
  source: /note="Description of Artificial Sequence: Synthetic peptide"
FHSGMLPLEI

SEQ ID NO: 8235 - protein, 10 aa, Artificial Sequence
  source: /note="Description of Artificial Sequence: Synthetic peptide"
SGMLPLEIAL

SEQ ID NO: 8236 - protein, 10 aa, Artificial Sequence
  source: /note="Description of Artificial Sequence: Synthetic peptide"
SERDYNMDFL

SEQ ID NO: 8237 - protein, 10 aa, Artificial Sequence
  source: /note="Description of Artificial Sequence: Synthetic peptide"
RDYNMDFLTL

SEQ ID NO: 8238 - protein, 10 aa, Artificial Sequence
  source: /note="Description of Artificial Sequence: Synthetic peptide"
YNMDFLTLRH

SEQ ID NO: 8239 - protein, 10 aa, Artificial Sequence
  source: /note="Description of Artificial Sequence: Synthetic peptide"
MDFLTLRHLM

SEQ ID NO: 8240 - protein, 10 aa, Artificial Sequence
  source: /note="Description of Artificial Sequence: Synthetic peptide"
NMNIMSELKM

SEQ ID NO: 8241 - protein, 10 aa, Artificial Sequence
  source: /note="Description of Artificial Sequence: Synthetic peptide"
TSTGLFQENF

SEQ ID NO: 8242 - protein, 10 aa, Artificial Sequence
  source: /note="Description of Artificial Sequence: Synthetic peptide"
LPLEIALTIS

SEQ ID NO: 8243 - protein, 10 aa, Artificial Sequence
  source: /note="Description of Artificial Sequence: Synthetic peptide"
LEGDYFCQKL

SEQ ID NO: 8244 - protein, 9 aa, Artificial Sequence
  source: /note="Description of Artificial Sequence: Synthetic peptide"
KVKKSIFLA

SEQ ID NO: 8245 - protein, 9 aa, Artificial Sequence
  source: /note="Description of Artificial Sequence: Synthetic peptide"
IPDKVKKSI

SEQ ID NO: 8246 - protein, 9 aa, Artificial Sequence
  source: /note="Description of Artificial Sequence: Synthetic peptide"
AKESSGRAY

SEQ ID NO: 8247 - protein, 9 aa, Artificial Sequence
  source: /note="Description of Artificial Sequence: Synthetic peptide"
KESSGRAYV

SEQ ID NO: 8248 - protein, 10 aa, Artificial Sequence
  source: /note="Description of Artificial Sequence: Synthetic peptide"
FLAKESSGRA

SEQ ID NO: 8249 - protein, 10 aa, Artificial Sequence
  source: /note="Description of Artificial Sequence: Synthetic peptide"
KVKKSIFLAK

SEQ ID NO: 8250 - protein, 10 aa, Artificial Sequence
  source: /note="Description of Artificial Sequence: Synthetic peptide"
LAKESSGRAY

SEQ ID NO: 8251 - protein, 10 aa, Artificial Sequence
  source: /note="Description of Artificial Sequence: Synthetic peptide"
IFLAKESSGR

SEQ ID NO: 8252 - protein, 10 aa, Artificial Sequence
  source: /note="Description of Artificial Sequence: Synthetic peptide"
IPDKVKKSIF

SEQ ID NO: 8253 - protein, 9 aa, Artificial Sequence
  source: /note="Description of Artificial Sequence: Synthetic peptide"
QIQAFNHKK

SEQ ID NO: 8254 - protein, 10 aa, Artificial Sequence
  source: /note="Description of Artificial Sequence: Synthetic peptide"
AFNHKKQQQK

SEQ ID NO: 8255 - protein, 9 aa, Artificial Sequence
  source: /note="Description of Artificial Sequence: Synthetic peptide"
TLWHLQKEV

SEQ ID NO: 8256 - protein, 9 aa, Artificial Sequence
  source: /note="Description of Artificial Sequence: Synthetic peptide"
LQKEVALSV

SEQ ID NO: 8257 - protein, 9 aa, Artificial Sequence
  source: /note="Description of Artificial Sequence: Synthetic peptide"
EVALSVLSK

SEQ ID NO: 8258 - protein, 9 aa, Artificial Sequence
  source: /note="Description of Artificial Sequence: Synthetic peptide"
WHLQKEVAL

SEQ ID NO: 8259 - protein, 9 aa, Artificial Sequence
  source: /note="Description of Artificial Sequence: Synthetic peptide"
QKEVALSVL

SEQ ID NO: 8260 - protein, 9 aa, Artificial Sequence
  source: /note="Description of Artificial Sequence: Synthetic peptide"
KEVALSVLS

SEQ ID NO: 8261 - protein, 10 aa, Artificial Sequence
  source: /note="Description of Artificial Sequence: Synthetic peptide"
HLQKEVALSV

SEQ ID NO: 8262 - protein, 10 aa, Artificial Sequence
  source: /note="Description of Artificial Sequence: Synthetic peptide"
LQKEVALSVL

SEQ ID NO: 8263 - protein, 10 aa, Artificial Sequence
  source: /note="Description of Artificial Sequence: Synthetic peptide"
TTLWHLQKEV

SEQ ID NO: 8264 - protein, 10 aa, Artificial Sequence
  source: /note="Description of Artificial Sequence: Synthetic peptide"
KEVALSVLSK

SEQ ID NO: 8265 - protein, 9 aa, Artificial Sequence
  source: /note="Description of Artificial Sequence: Synthetic peptide"
MDKISPEAW

SEQ ID NO: 8266 - protein, 10 aa, Artificial Sequence
  source: /note="Description of Artificial Sequence: Synthetic peptide"
KISPEAWCAA

SEQ ID NO: 8267 - protein, 9 aa, Artificial Sequence
  source: /note="Description of Artificial Sequence: Synthetic peptide"
AMMILLLSL

SEQ ID NO: 8268 - protein, 9 aa, Artificial Sequence
  source: /note="Description of Artificial Sequence: Synthetic peptide"
MMILLLSLV

SEQ ID NO: 8269 - protein, 9 aa, Artificial Sequence
  source: /note="Description of Artificial Sequence: Synthetic peptide"
LLLSLVIQL

SEQ ID NO: 8270 - protein, 9 aa, Artificial Sequence
  source: /note="Description of Artificial Sequence: Synthetic peptide"
LLSLVIQLA

SEQ ID NO: 8271 - protein, 9 aa, Artificial Sequence
  source: /note="Description of Artificial Sequence: Synthetic peptide"
SLVIQLALL

SEQ ID NO: 8272 - protein, 9 aa, Artificial Sequence
  source: /note="Description of Artificial Sequence: Synthetic peptide"
ALLFHCWDM

SEQ ID NO: 8273 - protein, 9 aa, Artificial Sequence
  source: /note="Description of Artificial Sequence: Synthetic peptide"
CLISRKAMM

SEQ ID NO: 8274 - protein, 9 aa, Artificial Sequence
  source: /note="Description of Artificial Sequence: Synthetic peptide"
LISRKAMMI

SEQ ID NO: 8275 - protein, 9 aa, Artificial Sequence
  source: /note="Description of Artificial Sequence: Synthetic peptide"
LVECLISRK

SEQ ID NO: 8276 - protein, 9 aa, Artificial Sequence
  source: /note="Description of Artificial Sequence: Synthetic peptide"
IARQIGLPK

SEQ ID NO: 8277 - protein, 9 aa, Artificial Sequence
  source: /note="Description of Artificial Sequence: Synthetic peptide"
LVIQLALLF

SEQ ID NO: 8278 - protein, 9 aa, Artificial Sequence
  source: /note="Description of Artificial Sequence: Synthetic peptide"
LFHCWDMYI

SEQ ID NO: 8279 - protein, 9 aa, Artificial Sequence
  source: /note="Description of Artificial Sequence: Synthetic peptide"
MYIARQIGL

SEQ ID NO: 8280 - protein, 9 aa, Artificial Sequence
  source: /note="Description of Artificial Sequence: Synthetic peptide"
ISRKAMMIL

SEQ ID NO: 8281 - protein, 9 aa, Artificial Sequence
  source: /note="Description of Artificial Sequence: Synthetic peptide"
KLAEGEQSY

SEQ ID NO: 8282 - protein, 9 aa, Artificial Sequence
  source: /note="Description of Artificial Sequence: Synthetic peptide"
LLFHCWDMY

SEQ ID NO: 8283 - protein, 9 aa, Artificial Sequence
  source: /note="Description of Artificial Sequence: Synthetic peptide"
YLVECLISR

SEQ ID NO: 8284 - protein, 9 aa, Artificial Sequence
  source: /note="Description of Artificial Sequence: Synthetic peptide"
HCWDMYIAR

SEQ ID NO: 8285 - protein, 9 aa, Artificial Sequence
  source: /note="Description of Artificial Sequence: Synthetic peptide"
SRKAMMILL

SEQ ID NO: 8286 - protein, 9 aa, Artificial Sequence
  source: /note="Description of Artificial Sequence: Synthetic peptide"
RKAMMILLL

SEQ ID NO: 8287 - protein, 9 aa, Artificial Sequence
  source: /note="Description of Artificial Sequence: Synthetic peptide"
MILLLSLVI

SEQ ID NO: 8288 - protein, 9 aa, Artificial Sequence
  source: /note="Description of Artificial Sequence: Synthetic peptide"
LSLVIQLAL

SEQ ID NO: 8289 - protein, 9 aa, Artificial Sequence
  source: /note="Description of Artificial Sequence: Synthetic peptide"
DQNVTKRAL

SEQ ID NO: 8290 - protein, 9 aa, Artificial Sequence
  source: /note="Description of Artificial Sequence: Synthetic peptide"
AEGEQSYLV

SEQ ID NO: 8291 - protein, 9 aa, Artificial Sequence
  source: /note="Description of Artificial Sequence: Synthetic peptide"
GEQSYLVEC

SEQ ID NO: 8292 - protein, 9 aa, Artificial Sequence
  source: /note="Description of Artificial Sequence: Synthetic peptide"
VECLISRKA

SEQ ID NO: 8293 - protein, 9 aa, Artificial Sequence
  source: /note="Description of Artificial Sequence: Synthetic peptide"
WDMYIARQI

SEQ ID NO: 8294 - protein, 10 aa, Artificial Sequence
  source: /note="Description of Artificial Sequence: Synthetic peptide"
KLAEGEQSYL

SEQ ID NO: 8295 - protein, 10 aa, Artificial Sequence
  source: /note="Description of Artificial Sequence: Synthetic peptide"
CLISRKAMMI

SEQ ID NO: 8296 - protein, 10 aa, Artificial Sequence
  source: /note="Description of Artificial Sequence: Synthetic peptide"
KAMMILLLSL

SEQ ID NO: 8297 - protein, 10 aa, Artificial Sequence
  source: /note="Description of Artificial Sequence: Synthetic peptide"
AMMILLLSLV

SEQ ID NO: 8298 - protein, 10 aa, Artificial Sequence
  source: /note="Description of Artificial Sequence: Synthetic peptide"
MMILLLSLVI

SEQ ID NO: 8299 - protein, 10 aa, Artificial Sequence
  source: /note="Description of Artificial Sequence: Synthetic peptide"
ILLLSLVIQL

SEQ ID NO: 8300 - protein, 10 aa, Artificial Sequence
  source: /note="Description of Artificial Sequence: Synthetic peptide"
LLLSLVIQLA

SEQ ID NO: 8301 - protein, 10 aa, Artificial Sequence
  source: /note="Description of Artificial Sequence: Synthetic peptide"
LLSLVIQLAL

SEQ ID NO: 8302 - protein, 10 aa, Artificial Sequence
  source: /note="Description of Artificial Sequence: Synthetic peptide"
LLFHCWDMYI

SEQ ID NO: 8303 - protein, 10 aa, Artificial Sequence
  source: /note="Description of Artificial Sequence: Synthetic peptide"
YIARQIGLPK

SEQ ID NO: 8304 - protein, 10 aa, Artificial Sequence
  source: /note="Description of Artificial Sequence: Synthetic peptide"
YLVECLISRK

SEQ ID NO: 8305 - protein, 10 aa, Artificial Sequence
  source: /note="Description of Artificial Sequence: Synthetic peptide"
SLVIQLALLF

SEQ ID NO: 8306 - protein, 10 aa, Artificial Sequence
  source: /note="Description of Artificial Sequence: Synthetic peptide"
IQLALLFHCW

SEQ ID NO: 8307 - protein, 10 aa, Artificial Sequence
  source: /note="Description of Artificial Sequence: Synthetic peptide"
ISRKAMMILL

SEQ ID NO: 8308 - protein, 10 aa, Artificial Sequence
  source: /note="Description of Artificial Sequence: Synthetic peptide"
ALLFHCWDMY

SEQ ID NO: 8309 - protein, 10 aa, Artificial Sequence
  source: /note="Description of Artificial Sequence: Synthetic peptide"
SKLAEGEQSY

SEQ ID NO: 8310 - protein, 10 aa, Artificial Sequence
  source: /note="Description of Artificial Sequence: Synthetic peptide"
GEQSYLVECL

SEQ ID NO: 8311 - protein, 10 aa, Artificial Sequence
  source: /note="Description of Artificial Sequence: Synthetic peptide"
VECLISRKAM

SEQ ID NO: 8312 - protein, 10 aa, Artificial Sequence
  source: /note="Description of Artificial Sequence: Synthetic peptide"
SRKAMMILLL

SEQ ID NO: 8313 - protein, 10 aa, Artificial Sequence
  source: /note="Description of Artificial Sequence: Synthetic peptide"
LALLFHCWDM

SEQ ID NO: 8314 - protein, 9 aa, Artificial Sequence
  source: /note="Description of Artificial Sequence: Synthetic peptide"
VISSDTVPL

SEQ ID NO: 8315 - protein, 10 aa, Artificial Sequence
  source: /note="Description of Artificial Sequence: Synthetic peptide"
AVISSDTVPL

SEQ ID NO: 8316 - protein, 10 aa, Artificial Sequence
  source: /note="Description of Artificial Sequence: Synthetic peptide"
DSAVISSDTV

SEQ ID NO: 8317 - protein, 9 aa, Artificial Sequence
  source: /note="Description of Artificial Sequence: Synthetic peptide"
KQISYSTGV

SEQ ID NO: 8318 - protein, 9 aa, Artificial Sequence
  source: /note="Description of Artificial Sequence: Synthetic peptide"
SYSTGVCSI

SEQ ID NO: 8319 - protein, 9 aa, Artificial Sequence
  source: /note="Description of Artificial Sequence: Synthetic peptide"
KQKQISYST

SEQ ID NO: 8320 - protein, 10 aa, Artificial Sequence
  source: /note="Description of Artificial Sequence: Synthetic peptide"
KQKQISYSTG

SEQ ID NO: 8321 - protein, 10 aa, Artificial Sequence
  source: /note="Description of Artificial Sequence: Synthetic peptide"
KQISYSTGVC

SEQ ID NO: 8322 - protein, 10 aa, Artificial Sequence
  source: /note="Description of Artificial Sequence: Synthetic peptide"
ISYSTGVCSI

SEQ ID NO: 8323 - protein, 9 aa, Artificial Sequence
  source: /note="Description of Artificial Sequence: Synthetic peptide"
AIAATVGSV

SEQ ID NO: 8324 - protein, 9 aa, Artificial Sequence
  source: /note="Description of Artificial Sequence: Synthetic peptide"
FIWPSFMVM

SEQ ID NO: 8325 - protein, 9 aa, Artificial Sequence
  source: /note="Description of Artificial Sequence: Synthetic peptide"
MVMTMLRNI

SEQ ID NO: 8326 - protein, 9 aa, Artificial Sequence
  source: /note="Description of Artificial Sequence: Synthetic peptide"
TMLRNIWRA

SEQ ID NO: 8327 - protein, 9 aa, Artificial Sequence
  source: /note="Description of Artificial Sequence: Synthetic peptide"
ATVGSVTAA

SEQ ID NO: 8328 - protein, 9 aa, Artificial Sequence
  source: /note="Description of Artificial Sequence: Synthetic peptide"
TVGSVTAAV

SEQ ID NO: 8329 - protein, 9 aa, Artificial Sequence
  source: /note="Description of Artificial Sequence: Synthetic peptide"
MTMLRNIWR

SEQ ID NO: 8330 - protein, 9 aa, Artificial Sequence
  source: /note="Description of Artificial Sequence: Synthetic peptide"
SSFIWPSFM

SEQ ID NO: 8331 - protein, 9 aa, Artificial Sequence
  source: /note="Description of Artificial Sequence: Synthetic peptide"
SFMVMTMLR

SEQ ID NO: 8332 - protein, 9 aa, Artificial Sequence
  source: /note="Description of Artificial Sequence: Synthetic peptide"
SFIWPSFMV

SEQ ID NO: 8333 - protein, 9 aa, Artificial Sequence
  source: /note="Description of Artificial Sequence: Synthetic peptide"
MLRNIWRAY

SEQ ID NO: 8334 - protein, 9 aa, Artificial Sequence
  source: /note="Description of Artificial Sequence: Synthetic peptide"
LRNIWRAYK

SEQ ID NO: 8335 - protein, 9 aa, Artificial Sequence
  source: /note="Description of Artificial Sequence: Synthetic peptide"
RNIWRAYKR

SEQ ID NO: 8336 - protein, 9 aa, Artificial Sequence
  source: /note="Description of Artificial Sequence: Synthetic peptide"
CPPVVGSAI

SEQ ID NO: 8337 - protein, 9 aa, Artificial Sequence
  source: /note="Description of Artificial Sequence: Synthetic peptide"
WPSFMVMTM

SEQ ID NO: 8338 - protein, 9 aa, Artificial Sequence
  source: /note="Description of Artificial Sequence: Synthetic peptide"
AAVPQESSF

SEQ ID NO: 8339 - protein, 9 aa, Artificial Sequence
  source: /note="Description of Artificial Sequence: Synthetic peptide"
ESSFIWPSF

SEQ ID NO: 8340 - protein, 9 aa, Artificial Sequence
  source: /note="Description of Artificial Sequence: Synthetic peptide"
VMTMLRNIW

SEQ ID NO: 8341 - protein, 9 aa, Artificial Sequence
  source: /note="Description of Artificial Sequence: Synthetic peptide"
QESSFIWPS

SEQ ID NO: 8342 - protein, 9 aa, Artificial Sequence
  source: /note="Description of Artificial Sequence: Synthetic peptide"
VPQESSFIW

SEQ ID NO: 8343 - protein, 9 aa, Artificial Sequence
  source: /note="Description of Artificial Sequence: Synthetic peptide"
DPDWVCPPV

SEQ ID NO: 8344 - protein, 10 aa, Artificial Sequence
  source: /note="Description of Artificial Sequence: Synthetic peptide"
VVGSAIAATV

SEQ ID NO: 8345 - protein, 10 aa, Artificial Sequence
  source: /note="Description of Artificial Sequence: Synthetic peptide"
ATVGSVTAAV

SEQ ID NO: 8346 - protein, 10 aa, Artificial Sequence
  source: /note="Description of Artificial Sequence: Synthetic peptide"
SSFIWPSFMV

SEQ ID NO: 8347 - protein, 10 aa, Artificial Sequence
  source: /note="Description of Artificial Sequence: Synthetic peptide"
FIWPSFMVMT

SEQ ID NO: 8348 - protein, 10 aa, Artificial Sequence
  source: /note="Description of Artificial Sequence: Synthetic peptide"
FMVMTMLRNI

SEQ ID NO: 8349 - protein, 10 aa, Artificial Sequence
  source: /note="Description of Artificial Sequence: Synthetic peptide"
MTMLRNIWRA

SEQ ID NO: 8350 - protein, 10 aa, Artificial Sequence
  source: /note="Description of Artificial Sequence: Synthetic peptide"
SAIAATVGSV

SEQ ID NO: 8351 - protein, 10 aa, Artificial Sequence
  source: /note="Description of Artificial Sequence: Synthetic peptide"
MLRNIWRAYK

SEQ ID NO: 8352 - protein, 10 aa, Artificial Sequence
  source: /note="Description of Artificial Sequence: Synthetic peptide"
PSFMVMTMLR

SEQ ID NO: 8353 - protein, 10 aa, Artificial Sequence
  source: /note="Description of Artificial Sequence: Synthetic peptide"
SFIWPSFMVM

SEQ ID NO: 8354 - protein, 10 aa, Artificial Sequence
  source: /note="Description of Artificial Sequence: Synthetic peptide"
IWPSFMVMTM

SEQ ID NO: 8355 - protein, 10 aa, Artificial Sequence
  source: /note="Description of Artificial Sequence: Synthetic peptide"
MVMTMLRNIW

SEQ ID NO: 8356 - protein, 10 aa, Artificial Sequence
  source: /note="Description of Artificial Sequence: Synthetic peptide"
TMLRNIWRAY

SEQ ID NO: 8357 - protein, 10 aa, Artificial Sequence
  source: /note="Description of Artificial Sequence: Synthetic peptide"
VMTMLRNIWR

SEQ ID NO: 8358 - protein, 10 aa, Artificial Sequence
  source: /note="Description of Artificial Sequence: Synthetic peptide"
WVCPPVVGSA

SEQ ID NO: 8359 - protein, 10 aa, Artificial Sequence
  source: /note="Description of Artificial Sequence: Synthetic peptide"
ESSFIWPSFM

SEQ ID NO: 8360 - protein, 10 aa, Artificial Sequence
  source: /note="Description of Artificial Sequence: Synthetic peptide"
WPSFMVMTML

SEQ ID NO: 8361 - protein, 10 aa, Artificial Sequence
  source: /note="Description of Artificial Sequence: Synthetic peptide"
TAAVPQESSF

SEQ ID NO: 8362 - protein, 10 aa, Artificial Sequence
  source: /note="Description of Artificial Sequence: Synthetic peptide"
IAATVGSVTA

SEQ ID NO: 8363 - protein, 10 aa, Artificial Sequence
  source: /note="Description of Artificial Sequence: Synthetic peptide"
QESSFIWPSF

SEQ ID NO: 8364 - protein, 10 aa, Artificial Sequence
  source: /note="Description of Artificial Sequence: Synthetic peptide"
DPDWVCPPVV

SEQ ID NO: 8365 - protein, 10 aa, Artificial Sequence
  source: /note="Description of Artificial Sequence: Synthetic peptide"
CPPVVGSAIA

SEQ ID NO: 8366 - protein, 9 aa, Artificial Sequence
  source: /note="Description of Artificial Sequence: Synthetic peptide"
VSSNGNAVK

SEQ ID NO: 8367 - protein, 10 aa, Artificial Sequence
  source: /note="Description of Artificial Sequence: Synthetic peptide"
AVSSNGNAVK

SEQ ID NO: 8368 - protein, 10 aa, Artificial Sequence
  source: /note="Description of Artificial Sequence: Synthetic peptide"
AVKDPMEILI

SEQ ID NO: 8369 - protein, 9 aa, Artificial Sequence
  source: /note="Description of Artificial Sequence: Synthetic peptide"
TVTYQNDNK

SEQ ID NO: 8370 - protein, 9 aa, Artificial Sequence
  source: /note="Description of Artificial Sequence: Synthetic peptide"
MEILITVTY

SEQ ID NO: 8371 - protein, 9 aa, Artificial Sequence
  source: /note="Description of Artificial Sequence: Synthetic peptide"
YQNDNKPEF

SEQ ID NO: 8372 - protein, 10 aa, Artificial Sequence
  source: /note="Description of Artificial Sequence: Synthetic peptide"
ITVTYQNDNK

SEQ ID NO: 8373 - protein, 10 aa, Artificial Sequence
  source: /note="Description of Artificial Sequence: Synthetic peptide"
TYQNDNKPEF

SEQ ID NO: 8374 - protein, 9 aa, Artificial Sequence
  source: /note="Description of Artificial Sequence: Synthetic peptide"
RLYTLKVKA

SEQ ID NO: 8375 - protein, 9 aa, Artificial Sequence
  source: /note="Description of Artificial Sequence: Synthetic peptide"
KVKAENTHV

SEQ ID NO: 8376 - protein, 9 aa, Artificial Sequence
  source: /note="Description of Artificial Sequence: Synthetic peptide"
LKVKAENTH

SEQ ID NO: 8377 - protein, 10 aa, Artificial Sequence
  source: /note="Description of Artificial Sequence: Synthetic peptide"
LKVKAENTHV

SEQ ID NO: 8378 - protein, 9 aa, Artificial Sequence
  source: /note="Description of Artificial Sequence: Synthetic peptide"
TTCVAVFVR

SEQ ID NO: 8379 - protein, 9 aa, Artificial Sequence
  source: /note="Description of Artificial Sequence: Synthetic peptide"
ETTCVAVFV

SEQ ID NO: 8380 - protein, 9 aa, Artificial Sequence
  source: /note="Description of Artificial Sequence: Synthetic peptide"
KETTCVAVF

SEQ ID NO: 8381 - protein, 10 aa, Artificial Sequence
  source: /note="Description of Artificial Sequence: Synthetic peptide"
ETTCVAVFVR

SEQ ID NO: 8382 - protein, 10 aa, Artificial Sequence
  source: /note="Description of Artificial Sequence: Synthetic peptide"
TTCVAVFVRI

SEQ ID NO: 8383 - protein, 10 aa, Artificial Sequence
  source: /note="Description of Artificial Sequence: Synthetic peptide"
NPKETTCVAV

SEQ ID NO: 8384 - protein, 10 aa, Artificial Sequence
  source: /note="Description of Artificial Sequence: Synthetic peptide"
KETTCVAVFV

SEQ ID NO: 8385 - protein, 9 aa, Artificial Sequence
  source: /note="Description of Artificial Sequence: Synthetic peptide"
YPIQRSTGT

SEQ ID NO: 8386 - protein, 9 aa, Artificial Sequence
  source: /note="Description of Artificial Sequence: Synthetic peptide"
IQRSTGTLT

SEQ ID NO: 8387 - protein, 9 aa, Artificial Sequence
  source: /note="Description of Artificial Sequence: Synthetic peptide"
QRSTGTLTI

SEQ ID NO: 8388 - protein, 10 aa, Artificial Sequence
  source: /note="Description of Artificial Sequence: Synthetic peptide"
IQRSTGTLTI

SEQ ID NO: 8389 - protein, 10 aa, Artificial Sequence
  source: /note="Description of Artificial Sequence: Synthetic peptide"
YPIQRSTGTL

SEQ ID NO: 8390 - protein, 9 aa, Artificial Sequence
  source: /note="Description of Artificial Sequence: Synthetic peptide"
TLSAQAINR

SEQ ID NO: 8391 - protein, 9 aa, Artificial Sequence
  source: /note="Description of Artificial Sequence: Synthetic peptide"
FYTLSAQAI

SEQ ID NO: 8392 - protein, 9 aa, Artificial Sequence
  source: /note="Description of Artificial Sequence: Synthetic peptide"
EKAFYTLSA

SEQ ID NO: 8393 - protein, 9 aa, Artificial Sequence
  source: /note="Description of Artificial Sequence: Synthetic peptide"
KAFYTLSAQ

SEQ ID NO: 8394 - protein, 10 aa, Artificial Sequence
  source: /note="Description of Artificial Sequence: Synthetic peptide"
YTLSAQAINR

SEQ ID NO: 8395 - protein, 10 aa, Artificial Sequence
  source: /note="Description of Artificial Sequence: Synthetic peptide"
AFYTLSAQAI

SEQ ID NO: 8396 - protein, 10 aa, Artificial Sequence
  source: /note="Description of Artificial Sequence: Synthetic peptide"
KAFYTLSAQA

SEQ ID NO: 8397 - protein, 10 aa, Artificial Sequence
  source: /note="Description of Artificial Sequence: Synthetic peptide"
TLSAQAINRR

SEQ ID NO: 8398 - protein, 10 aa, Artificial Sequence
  source: /note="Description of Artificial Sequence: Synthetic peptide"
SAQAINRRTL

SEQ ID NO: 8399 - protein, 10 aa, Artificial Sequence
  source: /note="Description of Artificial Sequence: Synthetic peptide"
EEKAFYTLSA

SEQ ID NO: 8400 - protein, 10 aa, Artificial Sequence
  source: /note="Description of Artificial Sequence: Synthetic peptide"
REEKAFYTLS

SEQ ID NO: 8401 - protein, 9 aa, Artificial Sequence
  source: /note="Description of Artificial Sequence: Synthetic peptide"
TFISNGPFK

SEQ ID NO: 8402 - protein, 9 aa, Artificial Sequence
  source: /note="Description of Artificial Sequence: Synthetic peptide"
NVHIDPTFI

SEQ ID NO: 8403 - protein, 9 aa, Artificial Sequence
  source: /note="Description of Artificial Sequence: Synthetic peptide"
ANVHIDPTF

SEQ ID NO: 8404 - protein, 9 aa, Artificial Sequence
  source: /note="Description of Artificial Sequence: Synthetic peptide"
PTFISNGPF

SEQ ID NO: 8405 - protein, 10 aa, Artificial Sequence
  source: /note="Description of Artificial Sequence: Synthetic peptide"
PTFISNGPFK

SEQ ID NO: 8406 - protein, 10 aa, Artificial Sequence
  source: /note="Description of Artificial Sequence: Synthetic peptide"
EAANVHIDPT

SEQ ID NO: 8407 - protein, 10 aa, Artificial Sequence
  source: /note="Description of Artificial Sequence: Synthetic peptide"
AANVHIDPTF

SEQ ID NO: 8408 - protein, 10 aa, Artificial Sequence
  source: /note="Description of Artificial Sequence: Synthetic peptide"
DPTFISNGPF

SEQ ID NO: 8409 - protein, 9 aa, Artificial Sequence
  source: /note="Description of Artificial Sequence: Synthetic peptide"
TQAFNIGAL

SEQ ID NO: 8410 - protein, 9 aa, Artificial Sequence
  source: /note="Description of Artificial Sequence: Synthetic peptide"
QAFNIGALR

SEQ ID NO: 8411 - protein, 9 aa, Artificial Sequence
  source: /note="Description of Artificial Sequence: Synthetic peptide"
NIGALRNPK

SEQ ID NO: 8412 - protein, 9 aa, Artificial Sequence
  source: /note="Description of Artificial Sequence: Synthetic peptide"
DTQAFNIGA

SEQ ID NO: 8413 - protein, 9 aa, Artificial Sequence
  source: /note="Description of Artificial Sequence: Synthetic peptide"
EEDTQAFNI

SEQ ID NO: 8414 - protein, 10 aa, Artificial Sequence
  source: /note="Description of Artificial Sequence: Synthetic peptide"
TQAFNIGALR

SEQ ID NO: 8415 - protein, 10 aa, Artificial Sequence
  source: /note="Description of Artificial Sequence: Synthetic peptide"
DTQAFNIGAL

SEQ ID NO: 8416 - protein, 10 aa, Artificial Sequence
  source: /note="Description of Artificial Sequence: Synthetic peptide"
GEEDTQAFNI

SEQ ID NO: 8417 - protein, 10 aa, Artificial Sequence
  source: /note="Description of Artificial Sequence: Synthetic peptide"
LCLPRQRPTM

SEQ ID NO: 8418 - protein, 10 aa, Artificial Sequence
  source: /note="Description of Artificial Sequence: Synthetic peptide"
RQRPTMEDNT

SEQ ID NO: 8419 - protein, 9 aa, Artificial Sequence
  source: /note="Description of Artificial Sequence: Synthetic peptide"
FIKQRLSEA

SEQ ID NO: 8420 - protein, 9 aa, Artificial Sequence
  source: /note="Description of Artificial Sequence: Synthetic peptide"
KQRLSEADL

SEQ ID NO: 8421 - protein, 9 aa, Artificial Sequence
  source: /note="Description of Artificial Sequence: Synthetic peptide"
SEADLDPSV

SEQ ID NO: 8422 - protein, 9 aa, Artificial Sequence
  source: /note="Description of Artificial Sequence: Synthetic peptide"
STRVVYSIL

SEQ ID NO: 8423 - protein, 9 aa, Artificial Sequence
  source: /note="Description of Artificial Sequence: Synthetic peptide"
YGNSTRVVY

SEQ ID NO: 8424 - protein, 9 aa, Artificial Sequence
  source: /note="Description of Artificial Sequence: Synthetic peptide"
NSTRVVYSI

SEQ ID NO: 8425 - protein, 10 aa, Artificial Sequence
  source: /note="Description of Artificial Sequence: Synthetic peptide"
STRVVYSILQ

SEQ ID NO: 8426 - protein, 9 aa, Artificial Sequence
  source: /note="Description of Artificial Sequence: Synthetic peptide"
KIYPVNGQI

SEQ ID NO: 8427 - protein, 9 aa, Artificial Sequence
  source: /note="Description of Artificial Sequence: Synthetic peptide"
DPANWLKIY

SEQ ID NO: 8428 - protein, 9 aa, Artificial Sequence
  source: /note="Description of Artificial Sequence: Synthetic peptide"
YPVNGQITT

SEQ ID NO: 8429 - protein, 10 aa, Artificial Sequence
  source: /note="Description of Artificial Sequence: Synthetic peptide"
YPVNGQITTI

SEQ ID NO: 8430 - protein, 10 aa, Artificial Sequence
  source: /note="Description of Artificial Sequence: Synthetic peptide"
LKIYPVNGQI

SEQ ID NO: 8431 - protein, 9 aa, Artificial Sequence
  source: /note="Description of Artificial Sequence: Synthetic peptide"
SSDHGRFFY

SEQ ID NO: 8432 - protein, 9 aa, Artificial Sequence
  source: /note="Description of Artificial Sequence: Synthetic peptide"
RSSDHGRFF

SEQ ID NO: 8433 - protein, 9 aa, Artificial Sequence
  source: /note="Description of Artificial Sequence: Synthetic peptide"
HGRFFYVDI

SEQ ID NO: 8434 - protein, 10 aa, Artificial Sequence
  source: /note="Description of Artificial Sequence: Synthetic peptide"
RSSDHGRFFY

SEQ ID NO: 8435 - protein, 10 aa, Artificial Sequence
  source: /note="Description of Artificial Sequence: Synthetic peptide"
SSDHGRFFYV

SEQ ID NO: 8436 - protein, 10 aa, Artificial Sequence
  source: /note="Description of Artificial Sequence: Synthetic peptide"
IDRSSDHGRF

SEQ ID NO: 8437 - protein, 9 aa, Artificial Sequence
  source: /note="Description of Artificial Sequence: Synthetic peptide"
QYTLRVQAL

SEQ ID NO: 8438 - protein, 9 aa, Artificial Sequence
  source: /note="Description of Artificial Sequence: Synthetic peptide"
AQYTLRVQA

SEQ ID NO: 8439 - protein, 10 aa, Artificial Sequence
  source: /note="Description of Artificial Sequence: Synthetic peptide"
AQYTLRVQAL

SEQ ID NO: 8440 - protein, 10 aa, Artificial Sequence
  source: /note="Description of Artificial Sequence: Synthetic peptide"
YTLRVQALDR

SEQ ID NO: 8441 - protein, 10 aa, Artificial Sequence
  source: /note="Description of Artificial Sequence: Synthetic peptide"
RAQYTLRVQA

SEQ ID NO: 8442 - protein, 10 aa, Artificial Sequence
  source: /note="Description of Artificial Sequence: Synthetic peptide"
TLRVQALDRR

SEQ ID NO: 8443 - protein, 9 aa, Artificial Sequence
  source: /note="Description of Artificial Sequence: Synthetic peptide"
HFIISPTSI

SEQ ID NO: 8444 - protein, 9 aa, Artificial Sequence
  source: /note="Description of Artificial Sequence: Synthetic peptide"
IQGKADIRI

SEQ ID NO: 8445 - protein, 10 aa, Artificial Sequence
  source: /note="Description of Artificial Sequence: Synthetic peptide"
IISPTSIQGK

SEQ ID NO: 8446 - protein, 10 aa, Artificial Sequence
  source: /note="Description of Artificial Sequence: Synthetic peptide"
HHFIISPTSI

SEQ ID NO: 8447 - protein, 9 aa, Artificial Sequence
  source: /note="Description of Artificial Sequence: Synthetic peptide"
ATDADEGEY

SEQ ID NO: 8448 - protein, 9 aa, Artificial Sequence
  source: /note="Description of Artificial Sequence: Synthetic peptide"
EYGRVWYRI

SEQ ID NO: 8449 - protein, 9 aa, Artificial Sequence
  source: /note="Description of Artificial Sequence: Synthetic peptide"
YGRVWYRIL

SEQ ID NO: 8450 - protein, 9 aa, Artificial Sequence
  source: /note="Description of Artificial Sequence: Synthetic peptide"
DEGEYGRVW

SEQ ID NO: 8451 - protein, 10 aa, Artificial Sequence
  source: /note="Description of Artificial Sequence: Synthetic peptide"
EYGRVWYRIL

SEQ ID NO: 8452 - protein, 10 aa, Artificial Sequence
  source: /note="Description of Artificial Sequence: Synthetic peptide"
KATDADEGEY

SEQ ID NO: 8453 - protein, 10 aa, Artificial Sequence
  source: /note="Description of Artificial Sequence: Synthetic peptide"
EGEYGRVWYR

SEQ ID NO: 8454 - protein, 10 aa, Artificial Sequence
  source: /note="Description of Artificial Sequence: Synthetic peptide"
GEYGRVWYRI

SEQ ID NO: 8455 - protein, 10 aa, Artificial Sequence
  source: /note="Description of Artificial Sequence: Synthetic peptide"
DEGEYGRVWY

SEQ ID NO: 8456 - protein, 9 aa, Artificial Sequence
  source: /note="Description of Artificial Sequence: Synthetic peptide"
FQPPSQLFA

SEQ ID NO: 8457 - protein, 9 aa, Artificial Sequence
  source: /note="Description of Artificial Sequence: Synthetic peptide"
SFQPPSQLF

SEQ ID NO: 8458 - protein, 9 aa, Artificial Sequence
  source: /note="Description of Artificial Sequence: Synthetic peptide"
QLFAIDSAR

SEQ ID NO: 8459 - protein, 9 aa, Artificial Sequence
  source: /note="Description of Artificial Sequence: Synthetic peptide"
YSFQPPSQL

SEQ ID NO: 8460 - protein, 9 aa, Artificial Sequence
  source: /note="Description of Artificial Sequence: Synthetic peptide"
SQLFAIDSA

SEQ ID NO: 8461 - protein, 9 aa, Artificial Sequence
  source: /note="Description of Artificial Sequence: Synthetic peptide"
QPPSQLFAI

SEQ ID NO: 8462 - protein, 10 aa, Artificial Sequence
  source: /note="Description of Artificial Sequence: Synthetic peptide"
FQPPSQLFAI

SEQ ID NO: 8463 - protein, 10 aa, Artificial Sequence
  source: /note="Description of Artificial Sequence: Synthetic peptide"
LYSFQPPSQL

SEQ ID NO: 8464 - protein, 10 aa, Artificial Sequence
  source: /note="Description of Artificial Sequence: Synthetic peptide"
YSFQPPSQLF

SEQ ID NO: 8465 - protein, 10 aa, Artificial Sequence
  source: /note="Description of Artificial Sequence: Synthetic peptide"
SFQPPSQLFA

SEQ ID NO: 8466 - protein, 10 aa, Artificial Sequence
  source: /note="Description of Artificial Sequence: Synthetic peptide"
SQLFAIDSAR

SEQ ID NO: 8467 - protein, 9 aa, Artificial Sequence
  source: /note="Description of Artificial Sequence: Synthetic peptide"
KAKDMGGQM

SEQ ID NO: 8468 - protein, 10 aa, Artificial Sequence
  source: /note="Description of Artificial Sequence: Synthetic peptide"
REQYQVVIKA

SEQ ID NO: 8469 - protein, 10 aa, Artificial Sequence
  source: /note="Description of Artificial Sequence: Synthetic peptide"
YQVVIKAKDM

SEQ ID NO: 8470 - protein, 10 aa, Artificial Sequence
  source: /note="Description of Artificial Sequence: Synthetic peptide"
IKAKDMGGQM

SEQ ID NO: 8471 - protein, 9 aa, Artificial Sequence
  source: /note="Description of Artificial Sequence: Synthetic peptide"
KYLLVIQAK

SEQ ID NO: 8472 - protein, 9 aa, Artificial Sequence
  source: /note="Description of Artificial Sequence: Synthetic peptide"
EAKDKYLLV

SEQ ID NO: 8473 - protein, 9 aa, Artificial Sequence
  source: /note="Description of Artificial Sequence: Synthetic peptide"
REAKDKYLL

SEQ ID NO: 8474 - protein, 9 aa, Artificial Sequence
  source: /note="Description of Artificial Sequence: Synthetic peptide"
AKDKYLLVI

SEQ ID NO: 8475 - protein, 10 aa, Artificial Sequence
  source: /note="Description of Artificial Sequence: Synthetic peptide"
NMDREAKDKY

SEQ ID NO: 8476 - protein, 10 aa, Artificial Sequence
  source: /note="Description of Artificial Sequence: Synthetic peptide"
EAKDKYLLVI

SEQ ID NO: 8477 - protein, 10 aa, Artificial Sequence
  source: /note="Description of Artificial Sequence: Synthetic peptide"
REAKDKYLLV

SEQ ID NO: 8478 - protein, 9 aa, Artificial Sequence
  source: /note="Description of Artificial Sequence: Synthetic peptide"
LFFEPVPEF

SEQ ID NO: 8479 - protein, 10 aa, Artificial Sequence
  source: /note="Description of Artificial Sequence: Synthetic peptide"
KLFFEPVPEF

SEQ ID NO: 8480 - protein, 10 aa, Artificial Sequence
  source: /note="Description of Artificial Sequence: Synthetic peptide"
RGHKLFFEPV

SEQ ID NO: 8481 - protein, 9 aa, Artificial Sequence
  source: /note="Description of Artificial Sequence: Synthetic peptide"
GLHGADVVF

SEQ ID NO: 8482 - protein, 10 aa, Artificial Sequence
  source: /note="Description of Artificial Sequence: Synthetic peptide"
GGLHGADVVF

SEQ ID NO: 8483 - protein, 9 aa, Artificial Sequence
  source: /note="Description of Artificial Sequence: Synthetic peptide"
SLAIKPPQM

SEQ ID NO: 8484 - protein, 9 aa, Artificial Sequence
  source: /note="Description of Artificial Sequence: Synthetic peptide"
AIKPPQMSR

SEQ ID NO: 8485 - protein, 10 aa, Artificial Sequence
  source: /note="Description of Artificial Sequence: Synthetic peptide"
AIKPPQMSRK

SEQ ID NO: 8486 - protein, 10 aa, Artificial Sequence
  source: /note="Description of Artificial Sequence: Synthetic peptide"
LAIKPPQMSR

SEQ ID NO: 8487 - protein, 9 aa, Artificial Sequence
  source: /note="Description of Artificial Sequence: Synthetic peptide"
TLWYSPPEL

SEQ ID NO: 8488 - protein, 9 aa, Artificial Sequence
  source: /note="Description of Artificial Sequence: Synthetic peptide"
LWYSPPELL

SEQ ID NO: 8489 - protein, 9 aa, Artificial Sequence
  source: /note="Description of Artificial Sequence: Synthetic peptide"
WYSPPELLL

SEQ ID NO: 8490 - protein, 10 aa, Artificial Sequence
  source: /note="Description of Artificial Sequence: Synthetic peptide"
ITLWYSPPEL

SEQ ID NO: 8491 - protein, 10 aa, Artificial Sequence
  source: /note="Description of Artificial Sequence: Synthetic peptide"
TLWYSPPELL

SEQ ID NO: 8492 - protein, 10 aa, Artificial Sequence
  source: /note="Description of Artificial Sequence: Synthetic peptide"
LWYSPPELLL

SEQ ID NO: 8493 - protein, 9 aa, Artificial Sequence
  source: /note="Description of Artificial Sequence: Synthetic peptide"
RMCNHPPRK

SEQ ID NO: 8494 - protein, 9 aa, Artificial Sequence
  source: /note="Description of Artificial Sequence: Synthetic peptide"
RVRMCNHPP

SEQ ID NO: 8495 - protein, 10 aa, Artificial Sequence
  source: /note="Description of Artificial Sequence: Synthetic peptide"
RVRMCNHPPR

SEQ ID NO: 8496 - protein, 10 aa, Artificial Sequence
  source: /note="Description of Artificial Sequence: Synthetic peptide"
RMCNHPPRKI

SEQ ID NO: 8497 - protein, 10 aa, Artificial Sequence
  source: /note="Description of Artificial Sequence: Synthetic peptide"
RDLQSLLMEI

SEQ ID NO: 8498 - protein, 10 aa, Artificial Sequence
  source: /note="Description of Artificial Sequence: Synthetic peptide"
LQSLLMEIQA

SEQ ID NO: 8499 - protein, 10 aa, Artificial Sequence
  source: /note="Description of Artificial Sequence: Synthetic peptide"
DPFRDLQSLL

SEQ ID NO: 8500 - protein, 9 aa, Artificial Sequence
  source: /note="Description of Artificial Sequence: Synthetic peptide"
KMEQVLAQV

SEQ ID NO: 8501 - protein, 9 aa, Artificial Sequence
  source: /note="Description of Artificial Sequence: Synthetic peptide"
AAKMEQVLA

SEQ ID NO: 8502 - protein, 9 aa, Artificial Sequence
  source: /note="Description of Artificial Sequence: Synthetic peptide"
AKMEQVLAQ

SEQ ID NO: 8503 - protein, 9 aa, Artificial Sequence
  source: /note="Description of Artificial Sequence: Synthetic peptide"
MEQVLAQVK

SEQ ID NO: 8504 - protein, 10 aa, Artificial Sequence
  source: /note="Description of Artificial Sequence: Synthetic peptide"
KMEQVLAQVK

SEQ ID NO: 8505 - protein, 10 aa, Artificial Sequence
  source: /note="Description of Artificial Sequence: Synthetic peptide"
LAQVKKQRTK

SEQ ID NO: 8506 - protein, 10 aa, Artificial Sequence
  source: /note="Description of Artificial Sequence: Synthetic peptide"
QVLAQVKKQR

SEQ ID NO: 8507 - protein, 10 aa, Artificial Sequence
  source: /note="Description of Artificial Sequence: Synthetic peptide"
TPAAKMEQVL

SEQ ID NO: 8508 - protein, 10 aa, Artificial Sequence
  source: /note="Description of Artificial Sequence: Synthetic peptide"
AKMEQVLAQV

SEQ ID NO: 8509 - protein, 9 aa, Artificial Sequence
  source: /note="Description of Artificial Sequence: Synthetic peptide"
VYDAAREGF

SEQ ID NO: 8510 - protein, 9 aa, Artificial Sequence
  source: /note="Description of Artificial Sequence: Synthetic peptide"
LTRPVYDAA

SEQ ID NO: 8511 - protein, 10 aa, Artificial Sequence
  source: /note="Description of Artificial Sequence: Synthetic peptide"
TLTRPVYDAA

SEQ ID NO: 8512 - protein, 10 aa, Artificial Sequence
  source: /note="Description of Artificial Sequence: Synthetic peptide"
LTRPVYDAAR

SEQ ID NO: 8513 - protein, 10 aa, Artificial Sequence
  source: /note="Description of Artificial Sequence: Synthetic peptide"
DPATLTRPVY

SEQ ID NO: 8514 - protein, 9 aa, Artificial Sequence
  source: /note="Description of Artificial Sequence: Synthetic peptide"
RYAWGRLPV

SEQ ID NO: 8515 - protein, 9 aa, Artificial Sequence
  source: /note="Description of Artificial Sequence: Synthetic peptide"
GARLDVRYA

SEQ ID NO: 8516 - protein, 9 aa, Artificial Sequence
  source: /note="Description of Artificial Sequence: Synthetic peptide"
AGARLDVRY

SEQ ID NO: 8517 - protein, 9 aa, Artificial Sequence
  source: /note="Description of Artificial Sequence: Synthetic peptide"
ARLDVRYAW

SEQ ID NO: 8518 - protein, 10 aa, Artificial Sequence
  source: /note="Description of Artificial Sequence: Synthetic peptide"
RAGARLDVRY

SEQ ID NO: 8519 - protein, 10 aa, Artificial Sequence
  source: /note="Description of Artificial Sequence: Synthetic peptide"
RLDVRYAWGR

SEQ ID NO: 8520 - protein, 10 aa, Artificial Sequence
  source: /note="Description of Artificial Sequence: Synthetic peptide"
GARLDVRYAW

SEQ ID NO: 8521 - protein, 10 aa, Artificial Sequence
  source: /note="Description of Artificial Sequence: Synthetic peptide"
VRYAWGRLPV

SEQ ID NO: 8522 - protein, 10 aa, Artificial Sequence
  source: /note="Description of Artificial Sequence: Synthetic peptide"
YAWGRLPVDL

SEQ ID NO: 8523 - protein, 9 aa, Artificial Sequence
  source: /note="Description of Artificial Sequence: Synthetic peptide"
PLLEDAPLL

SEQ ID NO: 8524 - protein, 9 aa, Artificial Sequence
  source: /note="Description of Artificial Sequence: Synthetic peptide"
VPLLEDAPL

SEQ ID NO: 8525 - protein, 10 aa, Artificial Sequence
  source: /note="Description of Artificial Sequence: Synthetic peptide"
APLLEDTSRL

SEQ ID NO: 8526 - protein, 10 aa, Artificial Sequence
  source: /note="Description of Artificial Sequence: Synthetic peptide"
LEDVPLLEDA

SEQ ID NO: 8527 - protein, 10 aa, Artificial Sequence
  source: /note="Description of Artificial Sequence: Synthetic peptide"
VPLLEDAPLL

SEQ ID NO: 8528 - protein, 9 aa, Artificial Sequence
  source: /note="Description of Artificial Sequence: Synthetic peptide"
AQQPPGLQV

SEQ ID NO: 8529 - protein, 10 aa, Artificial Sequence
  source: /note="Description of Artificial Sequence: Synthetic peptide"
AQQPPGLQVE

SEQ ID NO: 8530 - protein, 9 aa, Artificial Sequence
  source: /note="Description of Artificial Sequence: Synthetic peptide"
HTQVIFIAK

SEQ ID NO: 8531 - protein, 9 aa, Artificial Sequence
  source: /note="Description of Artificial Sequence: Synthetic peptide"
IPQQHTQVI

SEQ ID NO: 8532 - protein, 9 aa, Artificial Sequence
  source: /note="Description of Artificial Sequence: Synthetic peptide"
PQQHTQVIF

SEQ ID NO: 8533 - protein, 9 aa, Artificial Sequence
  source: /note="Description of Artificial Sequence: Synthetic peptide"
QQHTQVIFI

SEQ ID NO: 8534 - protein, 9 aa, Artificial Sequence
  source: /note="Description of Artificial Sequence: Synthetic peptide"
TQVIFIAKI

SEQ ID NO: 8535 - protein, 10 aa, Artificial Sequence
  source: /note="Description of Artificial Sequence: Synthetic peptide"
HTQVIFIAKI

SEQ ID NO: 8536 - protein, 10 aa, Artificial Sequence
  source: /note="Description of Artificial Sequence: Synthetic peptide"
IPQQHTQVIF

SEQ ID NO: 8537 - protein, 10 aa, Artificial Sequence
  source: /note="Description of Artificial Sequence: Synthetic peptide"
QQHTQVIFIA

SEQ ID NO: 8538 - protein, 9 aa, Artificial Sequence
  source: /note="Description of Artificial Sequence: Synthetic peptide"
APAPMTPTS

SEQ ID NO: 8539 - protein, 9 aa, Artificial Sequence
  source: /note="Description of Artificial Sequence: Synthetic peptide"
LNMNGLAPA

SEQ ID NO: 8540 - protein, 9 aa, Artificial Sequence
  source: /note="Description of Artificial Sequence: Synthetic peptide"
MNGLAPAPM

SEQ ID NO: 8541 - protein, 10 aa, Artificial Sequence
  source: /note="Description of Artificial Sequence: Synthetic peptide"
ALNMNGLAPA

SEQ ID NO: 8542 - protein, 10 aa, Artificial Sequence
  source: /note="Description of Artificial Sequence: Synthetic peptide"
GLAPAPMTPT

SEQ ID NO: 8543 - protein, 10 aa, Artificial Sequence
  source: /note="Description of Artificial Sequence: Synthetic peptide"
NMNGLAPAPM

SEQ ID NO: 8544 - protein, 9 aa, Artificial Sequence
  source: /note="Description of Artificial Sequence: Synthetic peptide"
FLGAAALGL

SEQ ID NO: 8545 - protein, 9 aa, Artificial Sequence
  source: /note="Description of Artificial Sequence: Synthetic peptide"
STFLGAAAL

SEQ ID NO: 8546 - protein, 9 aa, Artificial Sequence
  source: /note="Description of Artificial Sequence: Synthetic peptide"
STTASGWRR

SEQ ID NO: 8547 - protein, 9 aa, Artificial Sequence
  source: /note="Description of Artificial Sequence: Synthetic peptide"
GLRILPPPL

SEQ ID NO: 8548 - protein, 9 aa, Artificial Sequence
  source: /note="Description of Artificial Sequence: Synthetic peptide"
PSRSTTAPV

SEQ ID NO: 8549 - protein, 9 aa, Artificial Sequence
  source: /note="Description of Artificial Sequence: Synthetic peptide"
TARRWSTTA

SEQ ID NO: 8550 - protein, 9 aa, Artificial Sequence
  source: /note="Description of Artificial Sequence: Synthetic peptide"
SGWRRWTTA

SEQ ID NO: 8551 - protein, 9 aa, Artificial Sequence
  source: /note="Description of Artificial Sequence: Synthetic peptide"
GWRRWTTAR

SEQ ID NO: 8552 - protein, 9 aa, Artificial Sequence
  source: /note="Description of Artificial Sequence: Synthetic peptide"
CVPSWTARR

SEQ ID NO: 8553 - protein, 9 aa, Artificial Sequence
  source: /note="Description of Artificial Sequence: Synthetic peptide"
DTASTFLGA

SEQ ID NO: 8554 - protein, 9 aa, Artificial Sequence
  source: /note="Description of Artificial Sequence: Synthetic peptide"
TASTFLGAA

SEQ ID NO: 8555 - protein, 9 aa, Artificial Sequence
  source: /note="Description of Artificial Sequence: Synthetic peptide"
GAAALGLRI

SEQ ID NO: 8556 - protein, 9 aa, Artificial Sequence
  source: /note="Description of Artificial Sequence: Synthetic peptide"
AAALGLRIL

SEQ ID NO: 8557 - protein, 9 aa, Artificial Sequence
  source: /note="Description of Artificial Sequence: Synthetic peptide"
VGSQCVPSW

SEQ ID NO: 8558 - protein, 9 aa, Artificial Sequence
  source: /note="Description of Artificial Sequence: Synthetic peptide"
SQCVPSWTA

SEQ ID NO: 8559 - protein, 9 aa, Artificial Sequence
  source: /note="Description of Artificial Sequence: Synthetic peptide"
RRWSTTASG

SEQ ID NO: 8560 - protein, 9 aa, Artificial Sequence
  source: /note="Description of Artificial Sequence: Synthetic peptide"
RWSTTASGW

SEQ ID NO: 8561 - protein, 9 aa, Artificial Sequence
  source: /note="Description of Artificial Sequence: Synthetic peptide"
RRWTTARPP

SEQ ID NO: 8562 - protein, 9 aa, Artificial Sequence
  source: /note="Description of Artificial Sequence: Synthetic peptide"
VPSWTARRW

SEQ ID NO: 8563 - protein, 10 aa, Artificial Sequence
  source: /note="Description of Artificial Sequence: Synthetic peptide"
ILPPPLTSPS

SEQ ID NO: 8564 - protein, 10 aa, Artificial Sequence
  source: /note="Description of Artificial Sequence: Synthetic peptide"
TFLGAAALGL

SEQ ID NO: 8565 - protein, 10 aa, Artificial Sequence
  source: /note="Description of Artificial Sequence: Synthetic peptide"
RWSTTASGWR

SEQ ID NO: 8566 - protein, 10 aa, Artificial Sequence
  source: /note="Description of Artificial Sequence: Synthetic peptide"
ASGWRRWTTA

SEQ ID NO: 8567 - protein, 10 aa, Artificial Sequence
  source: /note="Description of Artificial Sequence: Synthetic peptide"
SGWRRWTTAR

SEQ ID NO: 8568 - protein, 10 aa, Artificial Sequence
  source: /note="Description of Artificial Sequence: Synthetic peptide"
SQCVPSWTAR

SEQ ID NO: 8569 - protein, 10 aa, Artificial Sequence
  source: /note="Description of Artificial Sequence: Synthetic peptide"
DTASTFLGAA

SEQ ID NO: 8570 - protein, 10 aa, Artificial Sequence
  source: /note="Description of Artificial Sequence: Synthetic peptide"
TASTFLGAAA

SEQ ID NO: 8571 - protein, 10 aa, Artificial Sequence
  source: /note="Description of Artificial Sequence: Synthetic peptide"
TTAPVGSQCV

SEQ ID NO: 8572 - protein, 10 aa, Artificial Sequence
  source: /note="Description of Artificial Sequence: Synthetic peptide"
WTARRWSTTA

SEQ ID NO: 8573 - protein, 10 aa, Artificial Sequence
  source: /note="Description of Artificial Sequence: Synthetic peptide"
SPSRSTTAPV

SEQ ID NO: 8574 - protein, 10 aa, Artificial Sequence
  source: /note="Description of Artificial Sequence: Synthetic peptide"
ASTFLGAAAL

SEQ ID NO: 8575 - protein, 10 aa, Artificial Sequence
  source: /note="Description of Artificial Sequence: Synthetic peptide"
GAAALGLRIL

SEQ ID NO: 8576 - protein, 10 aa, Artificial Sequence
  source: /note="Description of Artificial Sequence: Synthetic peptide"
RRWSTTASGW

SEQ ID NO: 8577 - protein, 9 aa, Artificial Sequence
  source: /note="Description of Artificial Sequence: Synthetic peptide"
LPTPPPPPL

SEQ ID NO: 8578 - protein, 9 aa, Artificial Sequence
  source: /note="Description of Artificial Sequence: Synthetic peptide"
TPPPPPLLL

SEQ ID NO: 8579 - protein, 10 aa, Artificial Sequence
  source: /note="Description of Artificial Sequence: Synthetic peptide"
LPTPPPPPLL

SEQ ID NO: 8580 - protein, 10 aa, Artificial Sequence
  source: /note="Description of Artificial Sequence: Synthetic peptide"
TPPPPPLLLL

SEQ ID NO: 8581 - protein, 9 aa, Artificial Sequence
  source: /note="Description of Artificial Sequence: Synthetic peptide"
LPTPPPPPL

SEQ ID NO: 8582 - protein, 9 aa, Artificial Sequence
  source: /note="Description of Artificial Sequence: Synthetic peptide"
TPPPPPLLL

SEQ ID NO: 8583 - protein, 10 aa, Artificial Sequence
  source: /note="Description of Artificial Sequence: Synthetic peptide"
LPTPPPPPLL

SEQ ID NO: 8584 - protein, 10 aa, Artificial Sequence
  source: /note="Description of Artificial Sequence: Synthetic peptide"
TPPPPPLLLL

SEQ ID NO: 8585 - protein, 10 aa, Artificial Sequence
  source: /note="Description of Artificial Sequence: Synthetic peptide"
KEDYEREKEL

SEQ ID NO: 8586 - protein, 9 aa, Artificial Sequence
  source: /note="Description of Artificial Sequence: Synthetic peptide"
SMCKIILLV

SEQ ID NO: 8587 - protein, 9 aa, Artificial Sequence
  source: /note="Description of Artificial Sequence: Synthetic peptide"
ILLVIGEFR

SEQ ID NO: 8588 - protein, 9 aa, Artificial Sequence
  source: /note="Description of Artificial Sequence: Synthetic peptide"
IILLVIGEF

SEQ ID NO: 8589 - protein, 10 aa, Artificial Sequence
  source: /note="Description of Artificial Sequence: Synthetic peptide"
GSMCKIILLV

SEQ ID NO: 8590 - protein, 10 aa, Artificial Sequence
  source: /note="Description of Artificial Sequence: Synthetic peptide"
SMCKIILLVI

SEQ ID NO: 8591 - protein, 10 aa, Artificial Sequence
  source: /note="Description of Artificial Sequence: Synthetic peptide"
IILLVIGEFR

SEQ ID NO: 8592 - protein, 10 aa, Artificial Sequence
  source: /note="Description of Artificial Sequence: Synthetic peptide"
KIILLVIGEF

SEQ ID NO: 8593 - protein, 9 aa, Artificial Sequence
  source: /note="Description of Artificial Sequence: Synthetic peptide"
QENLKKLTL

SEQ ID NO: 8594 - protein, 10 aa, Artificial Sequence
  source: /note="Description of Artificial Sequence: Synthetic peptide"
TLIEKRLDCL

SEQ ID NO: 8595 - protein, 10 aa, Artificial Sequence
  source: /note="Description of Artificial Sequence: Synthetic peptide"
NLKKLTLIEK

SEQ ID NO: 8596 - protein, 10 aa, Artificial Sequence
  source: /note="Description of Artificial Sequence: Synthetic peptide"
CQENLKKLTL

SEQ ID NO: 8597 - protein, 10 aa, Artificial Sequence
  source: /note="Description of Artificial Sequence: Synthetic peptide"
KKLTLIEKRL

SEQ ID NO: 8598 - protein, 10 aa, Artificial Sequence
  source: /note="Description of Artificial Sequence: Synthetic peptide"
QENLKKLTLI

SEQ ID NO: 8599 - protein, 9 aa, Artificial Sequence
  source: /note="Description of Artificial Sequence: Synthetic peptide"
MLQEWLGAM

SEQ ID NO: 8600 - protein, 9 aa, Artificial Sequence
  source: /note="Description of Artificial Sequence: Synthetic peptide"
WLGAMTMLL

SEQ ID NO: 8601 - protein, 9 aa, Artificial Sequence
  source: /note="Description of Artificial Sequence: Synthetic peptide"
TMLLWSGGL

SEQ ID NO: 8602 - protein, 9 aa, Artificial Sequence
  source: /note="Description of Artificial Sequence: Synthetic peptide"
LLWSGGLRA

SEQ ID NO: 8603 - protein, 9 aa, Artificial Sequence
  source: /note="Description of Artificial Sequence: Synthetic peptide"
MLLWSGGLR

SEQ ID NO: 8604 - protein, 9 aa, Artificial Sequence
  source: /note="Description of Artificial Sequence: Synthetic peptide"
RVPSTGPKK

SEQ ID NO: 8605 - protein, 9 aa, Artificial Sequence
  source: /note="Description of Artificial Sequence: Synthetic peptide"
RASPGSTQM

SEQ ID NO: 8606 - protein, 9 aa, Artificial Sequence
  source: /note="Description of Artificial Sequence: Synthetic peptide"
STQMKRVPS

SEQ ID NO: 8607 - protein, 9 aa, Artificial Sequence
  source: /note="Description of Artificial Sequence: Synthetic peptide"
MTMLLWSGG

SEQ ID NO: 8608 - protein, 9 aa, Artificial Sequence
  source: /note="Description of Artificial Sequence: Synthetic peptide"
TQMKRVPST

SEQ ID NO: 8609 - protein, 9 aa, Artificial Sequence
  source: /note="Description of Artificial Sequence: Synthetic peptide"
LQEWLGAMT

SEQ ID NO: 8610 - protein, 9 aa, Artificial Sequence
  source: /note="Description of Artificial Sequence: Synthetic peptide"
QEWLGAMTM

SEQ ID NO: 8611 - protein, 9 aa, Artificial Sequence
  source: /note="Description of Artificial Sequence: Synthetic peptide"
LGAMTMLLW

SEQ ID NO: 8612 - protein, 10 aa, Artificial Sequence
  source: /note="Description of Artificial Sequence: Synthetic peptide"
MLQEWLGAMT

SEQ ID NO: 8613 - protein, 10 aa, Artificial Sequence
  source: /note="Description of Artificial Sequence: Synthetic peptide"
MTMLLWSGGL

SEQ ID NO: 8614 - protein, 10 aa, Artificial Sequence
  source: /note="Description of Artificial Sequence: Synthetic peptide"
MLLWSGGLRA

SEQ ID NO: 8615 - protein, 10 aa, Artificial Sequence
  source: /note="Description of Artificial Sequence: Synthetic peptide"
TMLLWSGGLR

SEQ ID NO: 8616 - protein, 10 aa, Artificial Sequence
  source: /note="Description of Artificial Sequence: Synthetic peptide"
RASPGSTQMK

SEQ ID NO: 8617 - protein, 10 aa, Artificial Sequence
  source: /note="Description of Artificial Sequence: Synthetic peptide"
EWLGAMTMLL

SEQ ID NO: 8618 - protein, 10 aa, Artificial Sequence
  source: /note="Description of Artificial Sequence: Synthetic peptide"
WLGAMTMLLW

SEQ ID NO: 8619 - protein, 10 aa, Artificial Sequence
  source: /note="Description of Artificial Sequence: Synthetic peptide"
MKRVPSTGPK

SEQ ID NO: 8620 - protein, 10 aa, Artificial Sequence
  source: /note="Description of Artificial Sequence: Synthetic peptide"
EMLQEWLGAM

SEQ ID NO: 8621 - protein, 10 aa, Artificial Sequence
  source: /note="Description of Artificial Sequence: Synthetic peptide"
LQEWLGAMTM

SEQ ID NO: 8622 - protein, 10 aa, Artificial Sequence
  source: /note="Description of Artificial Sequence: Synthetic peptide"
QEWLGAMTML

SEQ ID NO: 8623 - protein, 10 aa, Artificial Sequence
  source: /note="Description of Artificial Sequence: Synthetic peptide"
LRASPGSTQM

SEQ ID NO: 8624 - protein, 10 aa, Artificial Sequence
  source: /note="Description of Artificial Sequence: Synthetic peptide"
TQMKRVPSTG

SEQ ID NO: 8625 - protein, 10 aa, Artificial Sequence
  source: /note="Description of Artificial Sequence: Synthetic peptide"
TEMLQEWLGA

SEQ ID NO: 8626 - protein, 9 aa, Artificial Sequence
  source: /note="Description of Artificial Sequence: Synthetic peptide"
NTVLDNFFK

SEQ ID NO: 8627 - protein, 9 aa, Artificial Sequence
  source: /note="Description of Artificial Sequence: Synthetic peptide"
TVLDNFFKH

SEQ ID NO: 8628 - protein, 9 aa, Artificial Sequence
  source: /note="Description of Artificial Sequence: Synthetic peptide"
DNFFKHSTR

SEQ ID NO: 8629 - protein, 9 aa, Artificial Sequence
  source: /note="Description of Artificial Sequence: Synthetic peptide"
TPNTVLDNF

SEQ ID NO: 8630 - protein, 10 aa, Artificial Sequence
  source: /note="Description of Artificial Sequence: Synthetic peptide"
VTPNTVLDNF

SEQ ID NO: 8631 - protein, 10 aa, Artificial Sequence
  source: /note="Description of Artificial Sequence: Synthetic peptide"
TPNTVLDNFF

SEQ ID NO: 8632 - protein, 9 aa, Artificial Sequence
  source: /note="Description of Artificial Sequence: Synthetic peptide"
GFDVKKLMY

SEQ ID NO: 8633 - protein, 9 aa, Artificial Sequence
  source: /note="Description of Artificial Sequence: Synthetic peptide"
LGFDVKKLM

SEQ ID NO: 8634 - protein, 10 aa, Artificial Sequence
  source: /note="Description of Artificial Sequence: Synthetic peptide"
LGFDVKKLMY

SEQ ID NO: 8635 - protein, 10 aa, Artificial Sequence
  source: /note="Description of Artificial Sequence: Synthetic peptide"
RALGFDVKKL

SEQ ID NO: 8636 - protein, 9 aa, Artificial Sequence
  source: /note="Description of Artificial Sequence: Synthetic peptide"
VLNDNSMDM

SEQ ID NO: 8637 - protein, 9 aa, Artificial Sequence
  source: /note="Description of Artificial Sequence: Synthetic peptide"
NSMDMTEVI

SEQ ID NO: 8638 - protein, 9 aa, Artificial Sequence
  source: /note="Description of Artificial Sequence: Synthetic peptide"
MSVLNDNSM

SEQ ID NO: 8639 - protein, 10 aa, Artificial Sequence
  source: /note="Description of Artificial Sequence: Synthetic peptide"
LMSVLNDNSM

SEQ ID NO: 8640 - protein, 10 aa, Artificial Sequence
  source: /note="Description of Artificial Sequence: Synthetic peptide"
VLNDNSMDMT

SEQ ID NO: 8641 - protein, 10 aa, Artificial Sequence
  source: /note="Description of Artificial Sequence: Synthetic peptide"
MDMTEVISSL

SEQ ID NO: 8642 - protein, 9 aa, Artificial Sequence
  source: /note="Description of Artificial Sequence: Synthetic peptide"
GPKSKVPPK

SEQ ID NO: 8643 - protein, 9 aa, Artificial Sequence
  source: /note="Description of Artificial Sequence: Synthetic peptide"
KSKVPPKYT

SEQ ID NO: 8644 - protein, 10 aa, Artificial Sequence
  source: /note="Description of Artificial Sequence: Synthetic peptide"
KSKVPPKYTS

SEQ ID NO: 8645 - protein, 9 aa, Artificial Sequence
  source: /note="Description of Artificial Sequence: Synthetic peptide"
SLPHCVEST

SEQ ID NO: 8646 - protein, 9 aa, Artificial Sequence
  source: /note="Description of Artificial Sequence: Synthetic peptide"
RWQSLPHCV

SEQ ID NO: 8647 - protein, 9 aa, Artificial Sequence
  source: /note="Description of Artificial Sequence: Synthetic peptide"
LPHCVESTA

SEQ ID NO: 8648 - protein, 10 aa, Artificial Sequence
  source: /note="Description of Artificial Sequence: Synthetic peptide"
SLPHCVESTA

SEQ ID NO: 8649 - protein, 10 aa, Artificial Sequence
  source: /note="Description of Artificial Sequence: Synthetic peptide"
LPHCVESTAY

SEQ ID NO: 8650 - protein, 10 aa, Artificial Sequence
  source: /note="Description of Artificial Sequence: Synthetic peptide"
GRWQSLPHCV

SEQ ID NO: 8651 - protein, 10 aa, Artificial Sequence
  source: /note="Description of Artificial Sequence: Synthetic peptide"
WQSLPHCVES

SEQ ID NO: 8652 - protein, 9 aa, Artificial Sequence
  source: /note="Description of Artificial Sequence: Synthetic peptide"
RMALQCVQL

SEQ ID NO: 8653 - protein, 9 aa, Artificial Sequence
  source: /note="Description of Artificial Sequence: Synthetic peptide"
TVNKRVWNV

SEQ ID NO: 8654 - protein, 9 aa, Artificial Sequence
  source: /note="Description of Artificial Sequence: Synthetic peptide"
AQRMALQCV

SEQ ID NO: 8655 - protein, 9 aa, Artificial Sequence
  source: /note="Description of Artificial Sequence: Synthetic peptide"
NILTSPAIK

SEQ ID NO: 8656 - protein, 9 aa, Artificial Sequence
  source: /note="Description of Artificial Sequence: Synthetic peptide"
ASHGRDALR

SEQ ID NO: 8657 - protein, 9 aa, Artificial Sequence
  source: /note="Description of Artificial Sequence: Synthetic peptide"
RAPVFVNYR

SEQ ID NO: 8658 - protein, 9 aa, Artificial Sequence
  source: /note="Description of Artificial Sequence: Synthetic peptide"
RISAQRMAL

SEQ ID NO: 8659 - protein, 9 aa, Artificial Sequence
  source: /note="Description of Artificial Sequence: Synthetic peptide"
LRAPVFVNY

SEQ ID NO: 8660 - protein, 9 aa, Artificial Sequence
  source: /note="Description of Artificial Sequence: Synthetic peptide"
VNYRISAQR

SEQ ID NO: 8661 - protein, 9 aa, Artificial Sequence
  source: /note="Description of Artificial Sequence: Synthetic peptide"
DALRAPVFV

SEQ ID NO: 8662 - protein, 9 aa, Artificial Sequence
  source: /note="Description of Artificial Sequence: Synthetic peptide"
SPAIKSSAS

SEQ ID NO: 8663 - protein, 9 aa, Artificial Sequence
  source: /note="Description of Artificial Sequence: Synthetic peptide"
SASHGRDAL

SEQ ID NO: 8664 - protein, 9 aa, Artificial Sequence
  source: /note="Description of Artificial Sequence: Synthetic peptide"
APVFVNYRI

SEQ ID NO: 8665 - protein, 9 aa, Artificial Sequence
  source: /note="Description of Artificial Sequence: Synthetic peptide"
NVFIQGQSF

SEQ ID NO: 8666 - protein, 9 aa, Artificial Sequence
  source: /note="Description of Artificial Sequence: Synthetic peptide"
KKCLAKNIL

SEQ ID NO: 8667 - protein, 9 aa, Artificial Sequence
  source: /note="Description of Artificial Sequence: Synthetic peptide"
AKNILTSPA

SEQ ID NO: 8668 - protein, 9 aa, Artificial Sequence
  source: /note="Description of Artificial Sequence: Synthetic peptide"
KNILTSPAI

SEQ ID NO: 8669 - protein, 9 aa, Artificial Sequence
  source: /note="Description of Artificial Sequence: Synthetic peptide"
RDALRAPVF

SEQ ID NO: 8670 - protein, 9 aa, Artificial Sequence
  source: /note="Description of Artificial Sequence: Synthetic peptide"
YRISAQRMA

SEQ ID NO: 8671 - protein, 9 aa, Artificial Sequence
  source: /note="Description of Artificial Sequence: Synthetic peptide"
SQHTVNKRV

SEQ ID NO: 8672 - protein, 9 aa, Artificial Sequence
  source: /note="Description of Artificial Sequence: Synthetic peptide"
VNKRVWNVF

SEQ ID NO: 8673 - protein, 10 aa, Artificial Sequence
  source: /note="Description of Artificial Sequence: Synthetic peptide"
RMALQCVQLT

SEQ ID NO: 8674 - protein, 10 aa, Artificial Sequence
  source: /note="Description of Artificial Sequence: Synthetic peptide"
ALRAPVFVNY

SEQ ID NO: 8675 - protein, 10 aa, Artificial Sequence
  source: /note="Description of Artificial Sequence: Synthetic peptide"
FVNYRISAQR

SEQ ID NO: 8676 - protein, 10 aa, Artificial Sequence
  source: /note="Description of Artificial Sequence: Synthetic peptide"
RAPVFVNYRI

SEQ ID NO: 8677 - protein, 10 aa, Artificial Sequence
  source: /note="Description of Artificial Sequence: Synthetic peptide"
TVNKRVWNVF

SEQ ID NO: 8678 - protein, 10 aa, Artificial Sequence
  source: /note="Description of Artificial Sequence: Synthetic peptide"
LAKNILTSPA

SEQ ID NO: 8679 - protein, 10 aa, Artificial Sequence
  source: /note="Description of Artificial Sequence: Synthetic peptide"
KNILTSPAIK

SEQ ID NO: 8680 - protein, 10 aa, Artificial Sequence
  source: /note="Description of Artificial Sequence: Synthetic peptide"
AIKSSASHGR

SEQ ID NO: 8681 - protein, 10 aa, Artificial Sequence
  source: /note="Description of Artificial Sequence: Synthetic peptide"
KSSASHGRDA

SEQ ID NO: 8682 - protein, 10 aa, Artificial Sequence
  source: /note="Description of Artificial Sequence: Synthetic peptide"
HGRDALRAPV

SEQ ID NO: 8683 - protein, 10 aa, Artificial Sequence
  source: /note="Description of Artificial Sequence: Synthetic peptide"
SASHGRDALR

SEQ ID NO: 8684 - protein, 10 aa, Artificial Sequence
  source: /note="Description of Artificial Sequence: Synthetic peptide"
EASQHTVNKR

SEQ ID NO: 8685 - protein, 10 aa, Artificial Sequence
  source: /note="Description of Artificial Sequence: Synthetic peptide"
LTSPAIKSSA

SEQ ID NO: 8686 - protein, 10 aa, Artificial Sequence
  source: /note="Description of Artificial Sequence: Synthetic peptide"
LTGEASQHTV

SEQ ID NO: 8687 - protein, 10 aa, Artificial Sequence
  source: /note="Description of Artificial Sequence: Synthetic peptide"
HTVNKRVWNV

SEQ ID NO: 8688 - protein, 10 aa, Artificial Sequence
  source: /note="Description of Artificial Sequence: Synthetic peptide"
SPAIKSSASH

SEQ ID NO: 8689 - protein, 10 aa, Artificial Sequence
  source: /note="Description of Artificial Sequence: Synthetic peptide"
SSASHGRDAL

SEQ ID NO: 8690 - protein, 10 aa, Artificial Sequence
  source: /note="Description of Artificial Sequence: Synthetic peptide"
AKNILTSPAI

SEQ ID NO: 8691 - protein, 10 aa, Artificial Sequence
  source: /note="Description of Artificial Sequence: Synthetic peptide"
GRDALRAPVF

SEQ ID NO: 8692 - protein, 10 aa, Artificial Sequence
  source: /note="Description of Artificial Sequence: Synthetic peptide"
VNYRISAQRM

SEQ ID NO: 8693 - protein, 10 aa, Artificial Sequence
  source: /note="Description of Artificial Sequence: Synthetic peptide"
YRISAQRMAL

SEQ ID NO: 8694 - protein, 10 aa, Artificial Sequence
  source: /note="Description of Artificial Sequence: Synthetic peptide"
QRMALQCVQL

SEQ ID NO: 8695 - protein, 10 aa, Artificial Sequence
  source: /note="Description of Artificial Sequence: Synthetic peptide"
VQLTGEASQH

SEQ ID NO: 8696 - protein, 10 aa, Artificial Sequence
  source: /note="Description of Artificial Sequence: Synthetic peptide"
SQHTVNKRVW

SEQ ID NO: 8697 - protein, 10 aa, Artificial Sequence
  source: /note="Description of Artificial Sequence: Synthetic peptide"
WNVFIQGQSF

SEQ ID NO: 8698 - protein, 10 aa, Artificial Sequence
  source: /note="Description of Artificial Sequence: Synthetic peptide"
VEKKCLAKNI

SEQ ID NO: 8699 - protein, 9 aa, Artificial Sequence
  source: /note="Description of Artificial Sequence: Synthetic peptide"
AWASREMLR

SEQ ID NO: 8700 - protein, 9 aa, Artificial Sequence
  source: /note="Description of Artificial Sequence: Synthetic peptide"
GGAWASREM

SEQ ID NO: 8701 - protein, 9 aa, Artificial Sequence
  source: /note="Description of Artificial Sequence: Synthetic peptide"
GAWASREML

SEQ ID NO: 8702 - protein, 10 aa, Artificial Sequence
  source: /note="Description of Artificial Sequence: Synthetic peptide"
GAWASREMLR

SEQ ID NO: 8703 - protein, 10 aa, Artificial Sequence
  source: /note="Description of Artificial Sequence: Synthetic peptide"
MGGAWASREM

SEQ ID NO: 8704 - protein, 9 aa, Artificial Sequence
  source: /note="Description of Artificial Sequence: Synthetic peptide"
AFSCFHYSM

SEQ ID NO: 8705 - protein, 10 aa, Artificial Sequence
  source: /note="Description of Artificial Sequence: Synthetic peptide"
SAFSCFHYSM

SEQ ID NO: 8706 - protein, 10 aa, Artificial Sequence
  source: /note="Description of Artificial Sequence: Synthetic peptide"
CFHYSMEEIK

SEQ ID NO: 8707 - protein, 10 aa, Artificial Sequence
  source: /note="Description of Artificial Sequence: Synthetic peptide"
MEEIKGSDCV

SEQ ID NO: 8708 - protein, 9 aa, Artificial Sequence
  source: /note="Description of Artificial Sequence: Synthetic peptide"
NPDVPPPVL

SEQ ID NO: 8709 - protein, 9 aa, Artificial Sequence
  source: /note="Description of Artificial Sequence: Synthetic peptide"
KADQSESSL

SEQ ID NO: 8710 - protein, 9 aa, Artificial Sequence
  source: /note="Description of Artificial Sequence: Synthetic peptide"
VPPPVLFKA

SEQ ID NO: 8711 - protein, 10 aa, Artificial Sequence
  source: /note="Description of Artificial Sequence: Synthetic peptide"
DVPPPVLFKA

SEQ ID NO: 8712 - protein, 10 aa, Artificial Sequence
  source: /note="Description of Artificial Sequence: Synthetic peptide"
FKADQSESSL

SEQ ID NO: 8713 - protein, 10 aa, Artificial Sequence
  source: /note="Description of Artificial Sequence: Synthetic peptide"
NPDVPPPVLF

SEQ ID NO: 8714 - protein, 9 aa, Artificial Sequence
  source: /note="Description of Artificial Sequence: Synthetic peptide"
HVELSPMQK

SEQ ID NO: 8715 - protein, 9 aa, Artificial Sequence
  source: /note="Description of Artificial Sequence: Synthetic peptide"
IVHVELSPM

SEQ ID NO: 8716 - protein, 9 aa, Artificial Sequence
  source: /note="Description of Artificial Sequence: Synthetic peptide"
TELIVHVEL

SEQ ID NO: 8717 - protein, 10 aa, Artificial Sequence
  source: /note="Description of Artificial Sequence: Synthetic peptide"
HVELSPMQKK

SEQ ID NO: 8718 - protein, 10 aa, Artificial Sequence
  source: /note="Description of Artificial Sequence: Synthetic peptide"
LIVHVELSPM

SEQ ID NO: 8719 - protein, 10 aa, Artificial Sequence
  source: /note="Description of Artificial Sequence: Synthetic peptide"
MPSKTELIVH

SEQ ID NO: 8720 - protein, 10 aa, Artificial Sequence
  source: /note="Description of Artificial Sequence: Synthetic peptide"
TELIVHVELS

SEQ ID NO: 8721 - protein, 9 aa, Artificial Sequence
  source: /note="Description of Artificial Sequence: Synthetic peptide"
FSFEDNTIR

SEQ ID NO: 8722 - protein, 9 aa, Artificial Sequence
  source: /note="Description of Artificial Sequence: Synthetic peptide"
NTIRSGKKV

SEQ ID NO: 8723 - protein, 10 aa, Artificial Sequence
  source: /note="Description of Artificial Sequence: Synthetic peptide"
TIRSGKKVFR

SEQ ID NO: 8724 - protein, 10 aa, Artificial Sequence
  source: /note="Description of Artificial Sequence: Synthetic peptide"
EFSFEDNTIR

SEQ ID NO: 8725 - protein, 10 aa, Artificial Sequence
  source: /note="Description of Artificial Sequence: Synthetic peptide"
NTIRSGKKVF

SEQ ID NO: 8726 - protein, 10 aa, Artificial Sequence
  source: /note="Description of Artificial Sequence: Synthetic peptide"
NEFSFEDNTI

SEQ ID NO: 8727 - protein, 9 aa, Artificial Sequence
  source: /note="Description of Artificial Sequence: Synthetic peptide"
AGSESRDAY

SEQ ID NO: 8728 - protein, 9 aa, Artificial Sequence
  source: /note="Description of Artificial Sequence: Synthetic peptide"
SESRDAYSY

SEQ ID NO: 8729 - protein, 9 aa, Artificial Sequence
  source: /note="Description of Artificial Sequence: Synthetic peptide"
ESRDAYSYV

SEQ ID NO: 8730 - protein, 9 aa, Artificial Sequence
  source: /note="Description of Artificial Sequence: Synthetic peptide"
RDAYSYVVV

SEQ ID NO: 8731 - protein, 10 aa, Artificial Sequence
  source: /note="Description of Artificial Sequence: Synthetic peptide"
GSESRDAYSY

SEQ ID NO: 8732 - protein, 10 aa, Artificial Sequence
  source: /note="Description of Artificial Sequence: Synthetic peptide"
ESRDAYSYVV

SEQ ID NO: 8733 - protein, 10 aa, Artificial Sequence
  source: /note="Description of Artificial Sequence: Synthetic peptide"
DAYSYVVVGA

SEQ ID NO: 8734 - protein, 10 aa, Artificial Sequence
  source: /note="Description of Artificial Sequence: Synthetic peptide"
SAGSESRDAY

SEQ ID NO: 8735 - protein, 10 aa, Artificial Sequence
  source: /note="Description of Artificial Sequence: Synthetic peptide"
SESRDAYSYV

SEQ ID NO: 8736 - protein, 9 aa, Artificial Sequence
  source: /note="Description of Artificial Sequence: Synthetic peptide"
ITDFGHSEI

SEQ ID NO: 8737 - protein, 9 aa, Artificial Sequence
  source: /note="Description of Artificial Sequence: Synthetic peptide"
EILGETSLM

SEQ ID NO: 8738 - protein, 9 aa, Artificial Sequence
  source: /note="Description of Artificial Sequence: Synthetic peptide"
SEILGETSL

SEQ ID NO: 8739 - protein, 9 aa, Artificial Sequence
  source: /note="Description of Artificial Sequence: Synthetic peptide"
TDFGHSEIL

SEQ ID NO: 8740 - protein, 10 aa, Artificial Sequence
  source: /note="Description of Artificial Sequence: Synthetic peptide"
KITDFGHSEI

SEQ ID NO: 8741 - protein, 10 aa, Artificial Sequence
  source: /note="Description of Artificial Sequence: Synthetic peptide"
EILGETSLMR

SEQ ID NO: 8742 - protein, 10 aa, Artificial Sequence
  source: /note="Description of Artificial Sequence: Synthetic peptide"
SEILGETSLM

SEQ ID NO: 8743 - protein, 9 aa, Artificial Sequence
  source: /note="Description of Artificial Sequence: Synthetic peptide"
ITDFGHSEI

SEQ ID NO: 8744 - protein, 9 aa, Artificial Sequence
  source: /note="Description of Artificial Sequence: Synthetic peptide"
EILGETSLM

SEQ ID NO: 8745 - protein, 9 aa, Artificial Sequence
  source: /note="Description of Artificial Sequence: Synthetic peptide"
SEILGETSL

SEQ ID NO: 8746 - protein, 9 aa, Artificial Sequence
  source: /note="Description of Artificial Sequence: Synthetic peptide"
TDFGHSEIL

SEQ ID NO: 8747 - protein, 10 aa, Artificial Sequence
  source: /note="Description of Artificial Sequence: Synthetic peptide"
KITDFGHSEI

SEQ ID NO: 8748 - protein, 10 aa, Artificial Sequence
  source: /note="Description of Artificial Sequence: Synthetic peptide"
EILGETSLMR

SEQ ID NO: 8749 - protein, 10 aa, Artificial Sequence
  source: /note="Description of Artificial Sequence: Synthetic peptide"
SEILGETSLM

SEQ ID NO: 8750 - protein, 9 aa, Artificial Sequence
  source: /note="Description of Artificial Sequence: Synthetic peptide"
RVWHSRPLH

SEQ ID NO: 8751 - protein, 9 aa, Artificial Sequence
  source: /note="Description of Artificial Sequence: Synthetic peptide"
RVGAPSHRV

SEQ ID NO: 8752 - protein, 9 aa, Artificial Sequence
  source: /note="Description of Artificial Sequence: Synthetic peptide"
HSRPLHQGR

SEQ ID NO: 8753 - protein, 9 aa, Artificial Sequence
  source: /note="Description of Artificial Sequence: Synthetic peptide"
PSHRVWHSR

SEQ ID NO: 8754 - protein, 9 aa, Artificial Sequence
  source: /note="Description of Artificial Sequence: Synthetic peptide"
HRVWHSRPL

SEQ ID NO: 8755 - protein, 9 aa, Artificial Sequence
  source: /note="Description of Artificial Sequence: Synthetic peptide"
VGAPSHRVW

SEQ ID NO: 8756 - protein, 9 aa, Artificial Sequence
  source: /note="Description of Artificial Sequence: Synthetic peptide"
HQGRRDAGL

SEQ ID NO: 8757 - protein, 10 aa, Artificial Sequence
  source: /note="Description of Artificial Sequence: Synthetic peptide"
RVWHSRPLHQ

SEQ ID NO: 8758 - protein, 10 aa, Artificial Sequence
  source: /note="Description of Artificial Sequence: Synthetic peptide"
HSRPLHQGRR

SEQ ID NO: 8759 - protein, 10 aa, Artificial Sequence
  source: /note="Description of Artificial Sequence: Synthetic peptide"
DTRVGAPSHR

SEQ ID NO: 8760 - protein, 10 aa, Artificial Sequence
  source: /note="Description of Artificial Sequence: Synthetic peptide"
RPLHQGRRDA

SEQ ID NO: 8761 - protein, 10 aa, Artificial Sequence
  source: /note="Description of Artificial Sequence: Synthetic peptide"
SHRVWHSRPL

SEQ ID NO: 8762 - protein, 10 aa, Artificial Sequence
  source: /note="Description of Artificial Sequence: Synthetic peptide"
RVGAPSHRVW

SEQ ID NO: 8763 - protein, 10 aa, Artificial Sequence
  source: /note="Description of Artificial Sequence: Synthetic peptide"
HQGRRDAGLL

SEQ ID NO: 8764 - protein, 9 aa, Artificial Sequence
  source: /note="Description of Artificial Sequence: Synthetic peptide"
DLKHVKNVY

SEQ ID NO: 8765 - protein, 9 aa, Artificial Sequence
  source: /note="Description of Artificial Sequence: Synthetic peptide"
VKNVYSCDL

SEQ ID NO: 8766 - protein, 10 aa, Artificial Sequence
  source: /note="Description of Artificial Sequence: Synthetic peptide"
NVYSCDLTTL

SEQ ID NO: 8767 - protein, 10 aa, Artificial Sequence
  source: /note="Description of Artificial Sequence: Synthetic peptide"
HVKNVYSCDL

SEQ ID NO: 8768 - protein, 9 aa, Artificial Sequence
  source: /note="Description of Artificial Sequence: Synthetic peptide"
RPKRMICPR

SEQ ID NO: 8769 - protein, 9 aa, Artificial Sequence
  source: /note="Description of Artificial Sequence: Synthetic peptide"
APRPKRMIC

SEQ ID NO: 8770 - protein, 9 aa, Artificial Sequence
  source: /note="Description of Artificial Sequence: Synthetic peptide"
QEAPRPKRM

SEQ ID NO: 8771 - protein, 9 aa, Artificial Sequence
  source: /note="Description of Artificial Sequence: Synthetic peptide"
KRMICPREV

SEQ ID NO: 8772 - protein, 9 aa, Artificial Sequence
  source: /note="Description of Artificial Sequence: Synthetic peptide"
RMICPREVE

SEQ ID NO: 8773 - protein, 10 aa, Artificial Sequence
  source: /note="Description of Artificial Sequence: Synthetic peptide"
MICPREVENR

SEQ ID NO: 8774 - protein, 10 aa, Artificial Sequence
  source: /note="Description of Artificial Sequence: Synthetic peptide"
QQEAPRPKRM

SEQ ID NO: 8775 - protein, 9 aa, Artificial Sequence
  source: /note="Description of Artificial Sequence: Synthetic peptide"
RLLLLLLSL

SEQ ID NO: 8776 - protein, 10 aa, Artificial Sequence
  source: /note="Description of Artificial Sequence: Synthetic peptide"
RLLLLLLSLL

SEQ ID NO: 8777 - protein, 9 aa, Artificial Sequence
  source: /note="Description of Artificial Sequence: Synthetic peptide"
ATRGTQSLH

SEQ ID NO: 8778 - protein, 10 aa, Artificial Sequence
  source: /note="Description of Artificial Sequence: Synthetic peptide"
PPATRGTQSL

SEQ ID NO: 8779 - protein, 10 aa, Artificial Sequence
  source: /note="Description of Artificial Sequence: Synthetic peptide"
ESCLSQHHSR

SEQ ID NO: 8780 - protein, 10 aa, Artificial Sequence
  source: /note="Description of Artificial Sequence: Synthetic peptide"
CLSQHHSRER

SEQ ID NO: 8781 - protein, 10 aa, Artificial Sequence
  source: /note="Description of Artificial Sequence: Synthetic peptide"
SQHHSRERDH

SEQ ID NO: 8782 - protein, 10 aa, Artificial Sequence
  source: /note="Description of Artificial Sequence: Synthetic peptide"
GESCLSQHHS

SEQ ID NO: 8783 - protein, 9 aa, Artificial Sequence
  source: /note="Description of Artificial Sequence: Synthetic peptide"
TLSPQGPRI

SEQ ID NO: 8784 - protein, 9 aa, Artificial Sequence
  source: /note="Description of Artificial Sequence: Synthetic peptide"
WTLSPQGPR

SEQ ID NO: 8785 - protein, 9 aa, Artificial Sequence
  source: /note="Description of Artificial Sequence: Synthetic peptide"
SFTHCRPHW

SEQ ID NO: 8786 - protein, 9 aa, Artificial Sequence
  source: /note="Description of Artificial Sequence: Synthetic peptide"
SSFTHCRPH

SEQ ID NO: 8787 - protein, 9 aa, Artificial Sequence
  source: /note="Description of Artificial Sequence: Synthetic peptide"
RPHWTLSPQ

SEQ ID NO: 8788 - protein, 9 aa, Artificial Sequence
  source: /note="Description of Artificial Sequence: Synthetic peptide"
SPQGPRILL

SEQ ID NO: 8789 - protein, 10 aa, Artificial Sequence
  source: /note="Description of Artificial Sequence: Synthetic peptide"
FTHCRPHWTL

SEQ ID NO: 8790 - protein, 10 aa, Artificial Sequence
  source: /note="Description of Artificial Sequence: Synthetic peptide"
RSSFTHCRPH

SEQ ID NO: 8791 - protein, 10 aa, Artificial Sequence
  source: /note="Description of Artificial Sequence: Synthetic peptide"
HWTLSPQGPR

SEQ ID NO: 8792 - protein, 10 aa, Artificial Sequence
  source: /note="Description of Artificial Sequence: Synthetic peptide"
WTLSPQGPRI

SEQ ID NO: 8793 - protein, 10 aa, Artificial Sequence
  source: /note="Description of Artificial Sequence: Synthetic peptide"
SSFTHCRPHW

SEQ ID NO: 8794 - protein, 9 aa, Artificial Sequence
  source: /note="Description of Artificial Sequence: Synthetic peptide"
AQPSQAPPK

SEQ ID NO: 8795 - protein, 9 aa, Artificial Sequence
  source: /note="Description of Artificial Sequence: Synthetic peptide"
SQAPPKPGL

SEQ ID NO: 8796 - protein, 9 aa, Artificial Sequence
  source: /note="Description of Artificial Sequence: Synthetic peptide"
HQHNPTCSH

SEQ ID NO: 8797 - protein, 9 aa, Artificial Sequence
  source: /note="Description of Artificial Sequence: Synthetic peptide"
SHHSAQGPA

SEQ ID NO: 8798 - protein, 9 aa, Artificial Sequence
  source: /note="Description of Artificial Sequence: Synthetic peptide"
AQGPASPCH

SEQ ID NO: 8799 - protein, 9 aa, Artificial Sequence
  source: /note="Description of Artificial Sequence: Synthetic peptide"
NPTCSHHSA

SEQ ID NO: 8800 - protein, 10 aa, Artificial Sequence
  source: /note="Description of Artificial Sequence: Synthetic peptide"
LAQPSQAPPK

SEQ ID NO: 8801 - protein, 10 aa, Artificial Sequence
  source: /note="Description of Artificial Sequence: Synthetic peptide"
SQAPPKPGLH

SEQ ID NO: 8802 - protein, 10 aa, Artificial Sequence
  source: /note="Description of Artificial Sequence: Synthetic peptide"
HQHNPTCSHH

SEQ ID NO: 8803 - protein, 9 aa, Artificial Sequence
  source: /note="Description of Artificial Sequence: Synthetic peptide"
ALSPAPQQV

SEQ ID NO: 8804 - protein, 9 aa, Artificial Sequence
  source: /note="Description of Artificial Sequence: Synthetic peptide"
HLQPPFCPR

SEQ ID NO: 8805 - protein, 9 aa, Artificial Sequence
  source: /note="Description of Artificial Sequence: Synthetic peptide"
LWPPAQPHL

SEQ ID NO: 8806 - protein, 9 aa, Artificial Sequence
  source: /note="Description of Artificial Sequence: Synthetic peptide"
AWSTLWPPA

SEQ ID NO: 8807 - protein, 9 aa, Artificial Sequence
  source: /note="Description of Artificial Sequence: Synthetic peptide"
RARQPLPLP

SEQ ID NO: 8808 - protein, 9 aa, Artificial Sequence
  source: /note="Description of Artificial Sequence: Synthetic peptide"
LPLPPQPRL

SEQ ID NO: 8809 - protein, 9 aa, Artificial Sequence
  source: /note="Description of Artificial Sequence: Synthetic peptide"
LPPQPRLAL

SEQ ID NO: 8810 - protein, 9 aa, Artificial Sequence
  source: /note="Description of Artificial Sequence: Synthetic peptide"
QPRLALSPA

SEQ ID NO: 8811 - protein, 9 aa, Artificial Sequence
  source: /note="Description of Artificial Sequence: Synthetic peptide"
AQPHLQPPF

SEQ ID NO: 8812 - protein, 9 aa, Artificial Sequence
  source: /note="Description of Artificial Sequence: Synthetic peptide"
SQAPQAWST

SEQ ID NO: 8813 - protein, 9 aa, Artificial Sequence
  source: /note="Description of Artificial Sequence: Synthetic peptide"
TLWPPAQPH

SEQ ID NO: 8814 - protein, 9 aa, Artificial Sequence
  source: /note="Description of Artificial Sequence: Synthetic peptide"
QPSQAPQAW

SEQ ID NO: 8815 - protein, 9 aa, Artificial Sequence
  source: /note="Description of Artificial Sequence: Synthetic peptide"
APQAWSTLW

SEQ ID NO: 8816 - protein, 10 aa, Artificial Sequence
  source: /note="Description of Artificial Sequence: Synthetic peptide"
TLWPPAQPHL

SEQ ID NO: 8817 - protein, 10 aa, Artificial Sequence
  source: /note="Description of Artificial Sequence: Synthetic peptide"
SQAPQAWSTL

SEQ ID NO: 8818 - protein, 10 aa, Artificial Sequence
  source: /note="Description of Artificial Sequence: Synthetic peptide"
HLQPPFCPRA

SEQ ID NO: 8819 - protein, 10 aa, Artificial Sequence
  source: /note="Description of Artificial Sequence: Synthetic peptide"
RARQPLPLPP

SEQ ID NO: 8820 - protein, 10 aa, Artificial Sequence
  source: /note="Description of Artificial Sequence: Synthetic peptide"
CPRARQPLPL

SEQ ID NO: 8821 - protein, 10 aa, Artificial Sequence
  source: /note="Description of Artificial Sequence: Synthetic peptide"
AQPSQAPQAW

SEQ ID NO: 8822 - protein, 10 aa, Artificial Sequence
  source: /note="Description of Artificial Sequence: Synthetic peptide"
QAWSTLWPPA

SEQ ID NO: 8823 - protein, 10 aa, Artificial Sequence
  source: /note="Description of Artificial Sequence: Synthetic peptide"
LPLPPQPRLA

SEQ ID NO: 8824 - protein, 10 aa, Artificial Sequence
  source: /note="Description of Artificial Sequence: Synthetic peptide"
LALSPAPQQV

SEQ ID NO: 8825 - protein, 9 aa, Artificial Sequence
  source: /note="Description of Artificial Sequence: Synthetic peptide"
ALWLALSGK

SEQ ID NO: 8826 - protein, 9 aa, Artificial Sequence
  source: /note="Description of Artificial Sequence: Synthetic peptide"
LWLALSGKI

SEQ ID NO: 8827 - protein, 10 aa, Artificial Sequence
  source: /note="Description of Artificial Sequence: Synthetic peptide"
ALWLALSGKI

SEQ ID NO: 8828 - protein, 10 aa, Artificial Sequence
  source: /note="Description of Artificial Sequence: Synthetic peptide"
GALWLALSGK

SEQ ID NO: 8829 - protein, 10 aa, Artificial Sequence
  source: /note="Description of Artificial Sequence: Synthetic peptide"
LWLALSGKIK

SEQ ID NO: 8830 - protein, 10 aa, Artificial Sequence
  source: /note="Description of Artificial Sequence: Synthetic peptide"
KIKDKELPQY

SEQ ID NO: 8831 - protein, 9 aa, Artificial Sequence
  source: /note="Description of Artificial Sequence: Synthetic peptide"
GMYHEVKAM

SEQ ID NO: 8832 - protein, 9 aa, Artificial Sequence
  source: /note="Description of Artificial Sequence: Synthetic peptide"
MYHEVKAMR

SEQ ID NO: 8833 - protein, 10 aa, Artificial Sequence
  source: /note="Description of Artificial Sequence: Synthetic peptide"
RGAGMYHEVK

SEQ ID NO: 8834 - protein, 10 aa, Artificial Sequence
  source: /note="Description of Artificial Sequence: Synthetic peptide"
MYHEVKAMRK

SEQ ID NO: 8835 - protein, 10 aa, Artificial Sequence
  source: /note="Description of Artificial Sequence: Synthetic peptide"
GMYHEVKAMR

SEQ ID NO: 8836 - protein, 10 aa, Artificial Sequence
  source: /note="Description of Artificial Sequence: Synthetic peptide"
LPFDPRGAGM

SEQ ID NO: 8837 - protein, 10 aa, Artificial Sequence
  source: /note="Description of Artificial Sequence: Synthetic peptide"
AGMYHEVKAM

SEQ ID NO: 8838 - protein, 10 aa, Artificial Sequence
  source: /note="Description of Artificial Sequence: Synthetic peptide"
AVADQEDIFV

SEQ ID NO: 8839 - protein, 10 aa, Artificial Sequence
  source: /note="Description of Artificial Sequence: Synthetic peptide"
IAVADQEDIF

SEQ ID NO: 8840 - protein, 10 aa, Artificial Sequence
  source: /note="Description of Artificial Sequence: Synthetic peptide"
QEDIFVVGTA

SEQ ID NO: 8841 - protein, 9 aa, Artificial Sequence
  source: /note="Description of Artificial Sequence: Synthetic peptide"
SLLPAPRDV

SEQ ID NO: 8842 - protein, 9 aa, Artificial Sequence
  source: /note="Description of Artificial Sequence: Synthetic peptide"
LLSLLPAPR

SEQ ID NO: 8843 - protein, 10 aa, Artificial Sequence
  source: /note="Description of Artificial Sequence: Synthetic peptide"
CLLSLLPAPR

SEQ ID NO: 8844 - protein, 10 aa, Artificial Sequence
  source: /note="Description of Artificial Sequence: Synthetic peptide"
SLLPAPRDVL

SEQ ID NO: 8845 - protein, 10 aa, Artificial Sequence
  source: /note="Description of Artificial Sequence: Synthetic peptide"
LPAPRDVLET

SEQ ID NO: 8846 - protein, 10 aa, Artificial Sequence
  source: /note="Description of Artificial Sequence: Synthetic peptide"
LPMAVSRGPP

SEQ ID NO: 8847 - protein, 10 aa, Artificial Sequence
  source: /note="Description of Artificial Sequence: Synthetic peptide"
RVYYEADTTK

SEQ ID NO: 8848 - protein, 9 aa, Artificial Sequence
  source: /note="Description of Artificial Sequence: Synthetic peptide"
KNKKALETK

SEQ ID NO: 8849 - protein, 9 aa, Artificial Sequence
  source: /note="Description of Artificial Sequence: Synthetic peptide"
KKALETKEI

SEQ ID NO: 8850 - protein, 9 aa, Artificial Sequence
  source: /note="Description of Artificial Sequence: Synthetic peptide"
QLSPARRRR

SEQ ID NO: 8851 - protein, 9 aa, Artificial Sequence
  source: /note="Description of Artificial Sequence: Synthetic peptide"
SPARRRRQH

SEQ ID NO: 8852 - protein, 10 aa, Artificial Sequence
  source: /note="Description of Artificial Sequence: Synthetic peptide"
RRRRQHMQER

SEQ ID NO: 8853 - protein, 10 aa, Artificial Sequence
  source: /note="Description of Artificial Sequence: Synthetic peptide"
SPARRRRQHM

SEQ ID NO: 8854 - protein, 9 aa, Artificial Sequence
  source: /note="Description of Artificial Sequence: Synthetic peptide"
SGIQELKTM

SEQ ID NO: 8855 - protein, 9 aa, Artificial Sequence
  source: /note="Description of Artificial Sequence: Synthetic peptide"
QELKTMLAG

SEQ ID NO: 8856 - protein, 10 aa, Artificial Sequence
  source: /note="Description of Artificial Sequence: Synthetic peptide"
QELKTMLAGV

SEQ ID NO: 8857 - protein, 9 aa, Artificial Sequence
  source: /note="Description of Artificial Sequence: Synthetic peptide"
RSSVSTIQM

SEQ ID NO: 8858 - protein, 9 aa, Artificial Sequence
  source: /note="Description of Artificial Sequence: Synthetic peptide"
IQMEWPEPD

SEQ ID NO: 8859 - protein, 9 aa, Artificial Sequence
  source: /note="Description of Artificial Sequence: Synthetic peptide"
MEWPEPDLA

SEQ ID NO: 8860 - protein, 10 aa, Artificial Sequence
  source: /note="Description of Artificial Sequence: Synthetic peptide"
IQMEWPEPDL

SEQ ID NO: 8861 - protein, 10 aa, Artificial Sequence
  source: /note="Description of Artificial Sequence: Synthetic peptide"
RRSSVSTIQM

SEQ ID NO: 8862 - protein, 10 aa, Artificial Sequence
  source: /note="Description of Artificial Sequence: Synthetic peptide"
SSVSTIQMEW

SEQ ID NO: 8863 - protein, 10 aa, Artificial Sequence
  source: /note="Description of Artificial Sequence: Synthetic peptide"
MEWPEPDLAP

SEQ ID NO: 8864 - protein, 9 aa, Artificial Sequence
  source: /note="Description of Artificial Sequence: Synthetic peptide"
AIFIGWAGA

SEQ ID NO: 8865 - protein, 9 aa, Artificial Sequence
  source: /note="Description of Artificial Sequence: Synthetic peptide"
FIGWAGAAL

SEQ ID NO: 8866 - protein, 9 aa, Artificial Sequence
  source: /note="Description of Artificial Sequence: Synthetic peptide"
GWAGAALVI

SEQ ID NO: 8867 - protein, 10 aa, Artificial Sequence
  source: /note="Description of Artificial Sequence: Synthetic peptide"
FIGWAGAALV

SEQ ID NO: 8868 - protein, 10 aa, Artificial Sequence
  source: /note="Description of Artificial Sequence: Synthetic peptide"
AIFIGWAGAA

SEQ ID NO: 8869 - protein, 10 aa, Artificial Sequence
  source: /note="Description of Artificial Sequence: Synthetic peptide"
IFIGWAGAAL

SEQ ID NO: 8870 - protein, 10 aa, Artificial Sequence
  source: /note="Description of Artificial Sequence: Synthetic peptide"
GWAGAALVIL

SEQ ID NO: 8871 - protein, 10 aa, Artificial Sequence
  source: /note="Description of Artificial Sequence: Synthetic peptide"
IGWAGAALVI

SEQ ID NO: 8872 - protein, 9 aa, Artificial Sequence
  source: /note="Description of Artificial Sequence: Synthetic peptide"
FLEDGSVPS

SEQ ID NO: 8873 - protein, 9 aa, Artificial Sequence
  source: /note="Description of Artificial Sequence: Synthetic peptide"
DSSGRSWFL

SEQ ID NO: 8874 - protein, 10 aa, Artificial Sequence
  source: /note="Description of Artificial Sequence: Synthetic peptide"
RSWFLEDGSV

SEQ ID NO: 8875 - protein, 9 aa, Artificial Sequence
  source: /note="Description of Artificial Sequence: Synthetic peptide"
NQHCKTRNR

SEQ ID NO: 8876 - protein, 9 aa, Artificial Sequence
  source: /note="Description of Artificial Sequence: Synthetic peptide"
AAFNWNNQH

SEQ ID NO: 8877 - protein, 10 aa, Artificial Sequence
  source: /note="Description of Artificial Sequence: Synthetic peptide"
AFNWNNQHCK

SEQ ID NO: 8878 - protein, 10 aa, Artificial Sequence
  source: /note="Description of Artificial Sequence: Synthetic peptide"
NWNNQHCKTR

SEQ ID NO: 8879 - protein, 10 aa, Artificial Sequence
  source: /note="Description of Artificial Sequence: Synthetic peptide"
NQHCKTRNRY

SEQ ID NO: 8880 - protein, 9 aa, Artificial Sequence
  source: /note="Description of Artificial Sequence: Synthetic peptide"
VLNFHKSPK

SEQ ID NO: 8881 - protein, 9 aa, Artificial Sequence
  source: /note="Description of Artificial Sequence: Synthetic peptide"
RCVVLNFHK

SEQ ID NO: 8882 - protein, 9 aa, Artificial Sequence
  source: /note="Description of Artificial Sequence: Synthetic peptide"
LNFHKSPKR

SEQ ID NO: 8883 - protein, 10 aa, Artificial Sequence
  source: /note="Description of Artificial Sequence: Synthetic peptide"
VVLNFHKSPK

SEQ ID NO: 8884 - protein, 10 aa, Artificial Sequence
  source: /note="Description of Artificial Sequence: Synthetic peptide"
VLNFHKSPKR

SEQ ID NO: 8885 - protein, 10 aa, Artificial Sequence
  source: /note="Description of Artificial Sequence: Synthetic peptide"
LNFHKSPKRW

SEQ ID NO: 8886 - protein, 10 aa, Artificial Sequence
  source: /note="Description of Artificial Sequence: Synthetic peptide"
NERCVVLNFH

SEQ ID NO: 8887 - protein, 9 aa, Artificial Sequence
  source: /note="Description of Artificial Sequence: Synthetic peptide"
NLDELCAII

SEQ ID NO: 8888 - protein, 9 aa, Artificial Sequence
  source: /note="Description of Artificial Sequence: Synthetic peptide"
ELCAIINFR

SEQ ID NO: 8889 - protein, 9 aa, Artificial Sequence
  source: /note="Description of Artificial Sequence: Synthetic peptide"
DELCAIINF

SEQ ID NO: 8890 - protein, 9 aa, Artificial Sequence
  source: /note="Description of Artificial Sequence: Synthetic peptide"
GEPNNLDEL

SEQ ID NO: 8891 - protein, 10 aa, Artificial Sequence
  source: /note="Description of Artificial Sequence: Synthetic peptide"
EPQESGDGSL

SEQ ID NO: 8892 - protein, 9 aa, Artificial Sequence
  source: /note="Description of Artificial Sequence: Synthetic peptide"
KMETKPQPV

SEQ ID NO: 8893 - protein, 9 aa, Artificial Sequence
  source: /note="Description of Artificial Sequence: Synthetic peptide"
METKPQPVS

SEQ ID NO: 8894 - protein, 10 aa, Artificial Sequence
  source: /note="Description of Artificial Sequence: Synthetic peptide"
ETKPQPVSGA

SEQ ID NO: 8895 - protein, 10 aa, Artificial Sequence
  source: /note="Description of Artificial Sequence: Synthetic peptide"
KKMETKPQPV

SEQ ID NO: 8896 - protein, 9 aa, Artificial Sequence
  source: /note="Description of Artificial Sequence: Synthetic peptide"
RSLNERDYL

SEQ ID NO: 8897 - protein, 9 aa, Artificial Sequence
  source: /note="Description of Artificial Sequence: Synthetic peptide"
LDRRYVDEY

SEQ ID NO: 8898 - protein, 9 aa, Artificial Sequence
  source: /note="Description of Artificial Sequence: Synthetic peptide"
RDYLDRRYV

SEQ ID NO: 8899 - protein, 10 aa, Artificial Sequence
  source: /note="Description of Artificial Sequence: Synthetic peptide"
YLDRRYVDEY

SEQ ID NO: 8900 - protein, 10 aa, Artificial Sequence
  source: /note="Description of Artificial Sequence: Synthetic peptide"
SLNERDYLDR

SEQ ID NO: 8901 - protein, 10 aa, Artificial Sequence
  source: /note="Description of Artificial Sequence: Synthetic peptide"
NERDYLDRRY

SEQ ID NO: 8902 - protein, 9 aa, Artificial Sequence
  source: /note="Description of Artificial Sequence: Synthetic peptide"
YLGLTQASL

SEQ ID NO: 8903 - protein, 9 aa, Artificial Sequence
  source: /note="Description of Artificial Sequence: Synthetic peptide"
SLSPQQTLL

SEQ ID NO: 8904 - protein, 9 aa, Artificial Sequence
  source: /note="Description of Artificial Sequence: Synthetic peptide"
ASLSPQQTL

SEQ ID NO: 8905 - protein, 10 aa, Artificial Sequence
  source: /note="Description of Artificial Sequence: Synthetic peptide"
SYLGLTQASL

SEQ ID NO: 8906 - protein, 10 aa, Artificial Sequence
  source: /note="Description of Artificial Sequence: Synthetic peptide"
LSYLGLTQAS

SEQ ID NO: 8907 - protein, 10 aa, Artificial Sequence
  source: /note="Description of Artificial Sequence: Synthetic peptide"
ASLSPQQTLL

SEQ ID NO: 8908 - protein, 9 aa, Artificial Sequence
  source: /note="Description of Artificial Sequence: Synthetic peptide"
YLNSRQFPM

SEQ ID NO: 8909 - protein, 9 aa, Artificial Sequence
  source: /note="Description of Artificial Sequence: Synthetic peptide"
RQFPMPGIR

SEQ ID NO: 8910 - protein, 9 aa, Artificial Sequence
  source: /note="Description of Artificial Sequence: Synthetic peptide"
QFPMPGIRR

SEQ ID NO: 8911 - protein, 9 aa, Artificial Sequence
  source: /note="Description of Artificial Sequence: Synthetic peptide"
FPMPGIRRL

SEQ ID NO: 8912 - protein, 9 aa, Artificial Sequence
  source: /note="Description of Artificial Sequence: Synthetic peptide"
MPGIRRLKI

SEQ ID NO: 8913 - protein, 10 aa, Artificial Sequence
  source: /note="Description of Artificial Sequence: Synthetic peptide"
RQFPMPGIRR

SEQ ID NO: 8914 - protein, 10 aa, Artificial Sequence
  source: /note="Description of Artificial Sequence: Synthetic peptide"
SYLNSRQFPM

SEQ ID NO: 8915 - protein, 10 aa, Artificial Sequence
  source: /note="Description of Artificial Sequence: Synthetic peptide"
NSRQFPMPGI

SEQ ID NO: 8916 - protein, 9 aa, Artificial Sequence
  source: /note="Description of Artificial Sequence: Synthetic peptide"
HIRYRNWRL

SEQ ID NO: 8917 - protein, 9 aa, Artificial Sequence
  source: /note="Description of Artificial Sequence: Synthetic peptide"
RYRNWRLAS

SEQ ID NO: 8918 - protein, 9 aa, Artificial Sequence
  source: /note="Description of Artificial Sequence: Synthetic peptide"
RLASLEARR

SEQ ID NO: 8919 - protein, 9 aa, Artificial Sequence
  source: /note="Description of Artificial Sequence: Synthetic peptide"
YRNWRLASL

SEQ ID NO: 8920 - protein, 9 aa, Artificial Sequence
  source: /note="Description of Artificial Sequence: Synthetic peptide"
LASLEARRF

SEQ ID NO: 8921 - protein, 10 aa, Artificial Sequence
  source: /note="Description of Artificial Sequence: Synthetic peptide"
RYRNWRLASL

SEQ ID NO: 8922 - protein, 10 aa, Artificial Sequence
  source: /note="Description of Artificial Sequence: Synthetic peptide"
HIRYRNWRLA

SEQ ID NO: 8923 - protein, 10 aa, Artificial Sequence
  source: /note="Description of Artificial Sequence: Synthetic peptide"
RLASLEARRF

SEQ ID NO: 8924 - protein, 10 aa, Artificial Sequence
  source: /note="Description of Artificial Sequence: Synthetic peptide"
NWRLASLEAR

SEQ ID NO: 8925 - protein, 10 aa, Artificial Sequence
  source: /note="Description of Artificial Sequence: Synthetic peptide"
LASLEARRFR

SEQ ID NO: 8926 - protein, 10 aa, Artificial Sequence
  source: /note="Description of Artificial Sequence: Synthetic peptide"
HHIRYRNWRL

SEQ ID NO: 8927 - protein, 10 aa, Artificial Sequence
  source: /note="Description of Artificial Sequence: Synthetic peptide"
RNWRLASLEA

SEQ ID NO: 8928 - protein, 9 aa, Artificial Sequence
  source: /note="Description of Artificial Sequence: Synthetic peptide"
RIHERNISK

SEQ ID NO: 8929 - protein, 9 aa, Artificial Sequence
  source: /note="Description of Artificial Sequence: Synthetic peptide"
QVVPRIHER

SEQ ID NO: 8930 - protein, 9 aa, Artificial Sequence
  source: /note="Description of Artificial Sequence: Synthetic peptide"
VPRIHERNI

SEQ ID NO: 8931 - protein, 10 aa, Artificial Sequence
  source: /note="Description of Artificial Sequence: Synthetic peptide"
RNISKQDETM

SEQ ID NO: 8932 - protein, 9 aa, Artificial Sequence
  source: /note="Description of Artificial Sequence: Synthetic peptide"
TVTLGAHNK

SEQ ID NO: 8933 - protein, 10 aa, Artificial Sequence
  source: /note="Description of Artificial Sequence: Synthetic peptide"
ITVTLGAHNK

SEQ ID NO: 8934 - protein, 10 aa, Artificial Sequence
  source: /note="Description of Artificial Sequence: Synthetic peptide"
KTEEEDTWQK

SEQ ID NO: 8935 - protein, 9 aa, Artificial Sequence
  source: /note="Description of Artificial Sequence: Synthetic peptide"
HQRSSEVSK

SEQ ID NO: 8936 - protein, 9 aa, Artificial Sequence
  source: /note="Description of Artificial Sequence: Synthetic peptide"
QFGAQVHQR

SEQ ID NO: 8937 - protein, 9 aa, Artificial Sequence
  source: /note="Description of Artificial Sequence: Synthetic peptide"
KQFGAQVHQ

SEQ ID NO: 8938 - protein, 10 aa, Artificial Sequence
  source: /note="Description of Artificial Sequence: Synthetic peptide"
AQVHQRSSEV

SEQ ID NO: 8939 - protein, 10 aa, Artificial Sequence
  source: /note="Description of Artificial Sequence: Synthetic peptide"
KQFGAQVHQR

SEQ ID NO: 8940 - protein, 9 aa, Artificial Sequence
  source: /note="Description of Artificial Sequence: Synthetic peptide"
IIVAITPLL

SEQ ID NO: 8941 - protein, 9 aa, Artificial Sequence
  source: /note="Description of Artificial Sequence: Synthetic peptide"
NIIVAITPL

SEQ ID NO: 8942 - protein, 9 aa, Artificial Sequence
  source: /note="Description of Artificial Sequence: Synthetic peptide"
HENIIVAIT

SEQ ID NO: 8943 - protein, 10 aa, Artificial Sequence
  source: /note="Description of Artificial Sequence: Synthetic peptide"
NIIVAITPLL

SEQ ID NO: 8944 - protein, 9 aa, Artificial Sequence
  source: /note="Description of Artificial Sequence: Synthetic peptide"
STTSSSFAY

SEQ ID NO: 8945 - protein, 9 aa, Artificial Sequence
  source: /note="Description of Artificial Sequence: Synthetic peptide"
TSSSFAYDR

SEQ ID NO: 8946 - protein, 9 aa, Artificial Sequence
  source: /note="Description of Artificial Sequence: Synthetic peptide"
FSTTSSSFA

SEQ ID NO: 8947 - protein, 9 aa, Artificial Sequence
  source: /note="Description of Artificial Sequence: Synthetic peptide"
AENFSTTSS

SEQ ID NO: 8948 - protein, 9 aa, Artificial Sequence
  source: /note="Description of Artificial Sequence: Synthetic peptide"
NFSTTSSSF

SEQ ID NO: 8949 - protein, 10 aa, Artificial Sequence
  source: /note="Description of Artificial Sequence: Synthetic peptide"
FSTTSSSFAY

SEQ ID NO: 8950 - protein, 10 aa, Artificial Sequence
  source: /note="Description of Artificial Sequence: Synthetic peptide"
TTSSSFAYDR

SEQ ID NO: 8951 - protein, 10 aa, Artificial Sequence
  source: /note="Description of Artificial Sequence: Synthetic peptide"
ENFSTTSSSF

SEQ ID NO: 8952 - protein, 10 aa, Artificial Sequence
  source: /note="Description of Artificial Sequence: Synthetic peptide"
SSFAENFSTT

SEQ ID NO: 8953 - protein, 10 aa, Artificial Sequence
  source: /note="Description of Artificial Sequence: Synthetic peptide"
AENFSTTSSS

SEQ ID NO: 8954 - protein, 9 aa, Artificial Sequence
  source: /note="Description of Artificial Sequence: Synthetic peptide"
KLVYMGKPK

SEQ ID NO: 8955 - protein, 10 aa, Artificial Sequence
  source: /note="Description of Artificial Sequence: Synthetic peptide"
LVYMGKPKEK

SEQ ID NO: 8956 - protein, 10 aa, Artificial Sequence
  source: /note="Description of Artificial Sequence: Synthetic peptide"
MGKPKEKESF

SEQ ID NO: 8957 - protein, 9 aa, Artificial Sequence
  source: /note="Description of Artificial Sequence: Synthetic peptide"
TFARLLAEL

SEQ ID NO: 8958 - protein, 9 aa, Artificial Sequence
  source: /note="Description of Artificial Sequence: Synthetic peptide"
QLDDLQTTF

SEQ ID NO: 8959 - protein, 9 aa, Artificial Sequence
  source: /note="Description of Artificial Sequence: Synthetic peptide"
LQTTFARLL

SEQ ID NO: 8960 - protein, 10 aa, Artificial Sequence
  source: /note="Description of Artificial Sequence: Synthetic peptide"
QLDDLQTTFA

SEQ ID NO: 8961 - protein, 10 aa, Artificial Sequence
  source: /note="Description of Artificial Sequence: Synthetic peptide"
TTFARLLAEL

SEQ ID NO: 8962 - protein, 10 aa, Artificial Sequence
  source: /note="Description of Artificial Sequence: Synthetic peptide"
QQLDDLQTTF

SEQ ID NO: 8963 - protein, 10 aa, Artificial Sequence
  source: /note="Description of Artificial Sequence: Synthetic peptide"
LQTTFARLLA

SEQ ID NO: 8964 - protein, 9 aa, Artificial Sequence
  source: /note="Description of Artificial Sequence: Synthetic peptide"
SLADRCKKI

SEQ ID NO: 8965 - protein, 9 aa, Artificial Sequence
  source: /note="Description of Artificial Sequence: Synthetic peptide"
NSLADRCKK

SEQ ID NO: 8966 - protein, 9 aa, Artificial Sequence
  source: /note="Description of Artificial Sequence: Synthetic peptide"
CLKKVSKGV

SEQ ID NO: 8967 - protein, 9 aa, Artificial Sequence
  source: /note="Description of Artificial Sequence: Synthetic peptide"
KVSKGVEQF

SEQ ID NO: 8968 - protein, 10 aa, Artificial Sequence
  source: /note="Description of Artificial Sequence: Synthetic peptide"
KKVSKGVEQF

SEQ ID NO: 8969 - protein, 9 aa, Artificial Sequence
  source: /note="Description of Artificial Sequence: Synthetic peptide"
TEQYYSFFW

SEQ ID NO: 8970 - protein, 9 aa, Artificial Sequence
  source: /note="Description of Artificial Sequence: Synthetic peptide"
EWQPIQITM

SEQ ID NO: 8971 - protein, 9 aa, Artificial Sequence
  source: /note="Description of Artificial Sequence: Synthetic peptide"
TKSGEWQPI

SEQ ID NO: 8972 - protein, 9 aa, Artificial Sequence
  source: /note="Description of Artificial Sequence: Synthetic peptide"
GEWQPIQIT

SEQ ID NO: 8973 - protein, 10 aa, Artificial Sequence
  source: /note="Description of Artificial Sequence: Synthetic peptide"
WQPIQITMPF

SEQ ID NO: 8974 - protein, 10 aa, Artificial Sequence
  source: /note="Description of Artificial Sequence: Synthetic peptide"
GEWQPIQITM

SEQ ID NO: 8975 - protein, 9 aa, Artificial Sequence
  source: /note="Description of Artificial Sequence: Synthetic peptide"
LILYQWQHV

SEQ ID NO: 8976 - protein, 9 aa, Artificial Sequence
  source: /note="Description of Artificial Sequence: Synthetic peptide"
YRPLILYQW

SEQ ID NO: 8977 - protein, 9 aa, Artificial Sequence
  source: /note="Description of Artificial Sequence: Synthetic peptide"
LYQWQHVEL

SEQ ID NO: 8978 - protein, 9 aa, Artificial Sequence
  source: /note="Description of Artificial Sequence: Synthetic peptide"
RYRPLILYQ

SEQ ID NO: 8979 - protein, 9 aa, Artificial Sequence
  source: /note="Description of Artificial Sequence: Synthetic peptide"
LRYRPLILY

SEQ ID NO: 8980 - protein, 9 aa, Artificial Sequence
  source: /note="Description of Artificial Sequence: Synthetic peptide"
YQWQHVELS

SEQ ID NO: 8981 - protein, 10 aa, Artificial Sequence
  source: /note="Description of Artificial Sequence: Synthetic peptide"
ILYQWQHVEL

SEQ ID NO: 8982 - protein, 10 aa, Artificial Sequence
  source: /note="Description of Artificial Sequence: Synthetic peptide"
PLILYQWQHV

SEQ ID NO: 8983 - protein, 10 aa, Artificial Sequence
  source: /note="Description of Artificial Sequence: Synthetic peptide"
FLRYRPLILY

SEQ ID NO: 8984 - protein, 10 aa, Artificial Sequence
  source: /note="Description of Artificial Sequence: Synthetic peptide"
RYRPLILYQW

SEQ ID NO: 8985 - protein, 10 aa, Artificial Sequence
  source: /note="Description of Artificial Sequence: Synthetic peptide"
YQWQHVELSD

SEQ ID NO: 8986 - protein, 9 aa, Artificial Sequence
  source: /note="Description of Artificial Sequence: Synthetic peptide"
NSRGKNFFR

SEQ ID NO: 8987 - protein, 9 aa, Artificial Sequence
  source: /note="Description of Artificial Sequence: Synthetic peptide"
FFRGQLQVY

SEQ ID NO: 8988 - protein, 9 aa, Artificial Sequence
  source: /note="Description of Artificial Sequence: Synthetic peptide"
AENSRGKNF

SEQ ID NO: 8989 - protein, 9 aa, Artificial Sequence
  source: /note="Description of Artificial Sequence: Synthetic peptide"
GKNFFRGQL

SEQ ID NO: 8990 - protein, 10 aa, Artificial Sequence
  source: /note="Description of Artificial Sequence: Synthetic peptide"
RGKNFFRGQL

SEQ ID NO: 8991 - protein, 10 aa, Artificial Sequence
  source: /note="Description of Artificial Sequence: Synthetic peptide"
KNFFRGQLQV

SEQ ID NO: 8992 - protein, 10 aa, Artificial Sequence
  source: /note="Description of Artificial Sequence: Synthetic peptide"
NFFRGQLQVY

SEQ ID NO: 8993 - protein, 10 aa, Artificial Sequence
  source: /note="Description of Artificial Sequence: Synthetic peptide"
ENSRGKNFFR

SEQ ID NO: 8994 - protein, 10 aa, Artificial Sequence
  source: /note="Description of Artificial Sequence: Synthetic peptide"
RAENSRGKNF

SEQ ID NO: 8995 - protein, 10 aa, Artificial Sequence
  source: /note="Description of Artificial Sequence: Synthetic peptide"
AENSRGKNFF

SEQ ID NO: 8996 - protein, 9 aa, Artificial Sequence
  source: /note="Description of Artificial Sequence: Synthetic peptide"
YQCLATNNV

SEQ ID NO: 8997 - protein, 9 aa, Artificial Sequence
  source: /note="Description of Artificial Sequence: Synthetic peptide"
LATNNVGSI

SEQ ID NO: 8998 - protein, 10 aa, Artificial Sequence
  source: /note="Description of Artificial Sequence: Synthetic peptide"
CLATNNVGSI

SEQ ID NO: 8999 - protein, 10 aa, Artificial Sequence
  source: /note="Description of Artificial Sequence: Synthetic peptide"
HYQCLATNNV

SEQ ID NO: 9000 - protein, 10 aa, Artificial Sequence
  source: /note="Description of Artificial Sequence: Synthetic peptide"
YQCLATNNVG

SEQ ID NO: 9001 - protein, 10 aa, Artificial Sequence
  source: /note="Description of Artificial Sequence: Synthetic peptide"
LATNNVGSIL

SEQ ID NO: 9002 - protein, 9 aa, Artificial Sequence
  source: /note="Description of Artificial Sequence: Synthetic peptide"
QLAPMGTSL

SEQ ID NO: 9003 - protein, 9 aa, Artificial Sequence
  source: /note="Description of Artificial Sequence: Synthetic peptide"
PMGTSLQSF

SEQ ID NO: 9004 - protein, 10 aa, Artificial Sequence
  source: /note="Description of Artificial Sequence: Synthetic peptide"
APMGTSLQSF

SEQ ID NO: 9005 - protein, 10 aa, Artificial Sequence
  source: /note="Description of Artificial Sequence: Synthetic peptide"
GEDEPQLAPM

SEQ ID NO: 9006 - protein, 10 aa, Artificial Sequence
  source: /note="Description of Artificial Sequence: Synthetic peptide"
PQLAPMGTSL

SEQ ID NO: 9007 - protein, 9 aa, Artificial Sequence
  source: /note="Description of Artificial Sequence: Synthetic peptide"
FSHMLIRPV

SEQ ID NO: 9008 - protein, 9 aa, Artificial Sequence
  source: /note="Description of Artificial Sequence: Synthetic peptide"
MLIRPVPGY

SEQ ID NO: 9009 - protein, 9 aa, Artificial Sequence
  source: /note="Description of Artificial Sequence: Synthetic peptide"
REFSHMLIR

SEQ ID NO: 9010 - protein, 10 aa, Artificial Sequence
  source: /note="Description of Artificial Sequence: Synthetic peptide"
AAREFSHMLI

SEQ ID NO: 9011 - protein, 10 aa, Artificial Sequence
  source: /note="Description of Artificial Sequence: Synthetic peptide"
HMLIRPVPGY

SEQ ID NO: 9012 - protein, 10 aa, Artificial Sequence
  source: /note="Description of Artificial Sequence: Synthetic peptide"
EFSHMLIRPV

SEQ ID NO: 9013 - protein, 10 aa, Artificial Sequence
  source: /note="Description of Artificial Sequence: Synthetic peptide"
REFSHMLIRP

SEQ ID NO: 9014 - protein, 9 aa, Artificial Sequence
  source: /note="Description of Artificial Sequence: Synthetic peptide"
RLNQDLLSV

SEQ ID NO: 9015 - protein, 9 aa, Artificial Sequence
  source: /note="Description of Artificial Sequence: Synthetic peptide"
LLSVSFQFR

SEQ ID NO: 9016 - protein, 9 aa, Artificial Sequence
  source: /note="Description of Artificial Sequence: Synthetic peptide"
DLLSVSFQF

SEQ ID NO: 9017 - protein, 9 aa, Artificial Sequence
  source: /note="Description of Artificial Sequence: Synthetic peptide"
NQDLLSVSF

SEQ ID NO: 9018 - protein, 10 aa, Artificial Sequence
  source: /note="Description of Artificial Sequence: Synthetic peptide"
LLSVSFQFRT

SEQ ID NO: 9019 - protein, 10 aa, Artificial Sequence
  source: /note="Description of Artificial Sequence: Synthetic peptide"
DLLSVSFQFR

SEQ ID NO: 9020 - protein, 10 aa, Artificial Sequence
  source: /note="Description of Artificial Sequence: Synthetic peptide"
LNQDLLSVSF

SEQ ID NO: 9021 - protein, 10 aa, Artificial Sequence
  source: /note="Description of Artificial Sequence: Synthetic peptide"
QDLLSVSFQF

SEQ ID NO: 9022 - protein, 9 aa, Artificial Sequence
  source: /note="Description of Artificial Sequence: Synthetic peptide"
KSNLSQPGK

SEQ ID NO: 9023 - protein, 10 aa, Artificial Sequence
  source: /note="Description of Artificial Sequence: Synthetic peptide"
KLKSNLSQPG

SEQ ID NO: 9024 - protein, 10 aa, Artificial Sequence
  source: /note="Description of Artificial Sequence: Synthetic peptide"
KSNLSQPGKL

SEQ ID NO: 9025 - protein, 9 aa, Artificial Sequence
  source: /note="Description of Artificial Sequence: Synthetic peptide"
VLSFDSTKA

SEQ ID NO: 9026 - protein, 9 aa, Artificial Sequence
  source: /note="Description of Artificial Sequence: Synthetic peptide"
VVLSFDSTK

SEQ ID NO: 9027 - protein, 9 aa, Artificial Sequence
  source: /note="Description of Artificial Sequence: Synthetic peptide"
FYLLVVLSF

SEQ ID NO: 9028 - protein, 9 aa, Artificial Sequence
  source: /note="Description of Artificial Sequence: Synthetic peptide"
FDSTKASAL

SEQ ID NO: 9029 - protein, 10 aa, Artificial Sequence
  source: /note="Description of Artificial Sequence: Synthetic peptide"
LVVLSFDSTK

SEQ ID NO: 9030 - protein, 10 aa, Artificial Sequence
  source: /note="Description of Artificial Sequence: Synthetic peptide"
LFYLLVVLSF

SEQ ID NO: 9031 - protein, 10 aa, Artificial Sequence
  source: /note="Description of Artificial Sequence: Synthetic peptide"
LSFDSTKASA

SEQ ID NO: 9032 - protein, 9 aa, Artificial Sequence
  source: /note="Description of Artificial Sequence: Synthetic peptide"
HISVWLGKK

SEQ ID NO: 9033 - protein, 9 aa, Artificial Sequence
  source: /note="Description of Artificial Sequence: Synthetic peptide"
SVWLGKKLK

SEQ ID NO: 9034 - protein, 9 aa, Artificial Sequence
  source: /note="Description of Artificial Sequence: Synthetic peptide"
EIEHISVWL

SEQ ID NO: 9035 - protein, 9 aa, Artificial Sequence
  source: /note="Description of Artificial Sequence: Synthetic peptide"
NEIEHISVW

SEQ ID NO: 9036 - protein, 9 aa, Artificial Sequence
  source: /note="Description of Artificial Sequence: Synthetic peptide"
ISVWLGKKL

SEQ ID NO: 9037 - protein, 10 aa, Artificial Sequence
  source: /note="Description of Artificial Sequence: Synthetic peptide"
ISVWLGKKLK

SEQ ID NO: 9038 - protein, 10 aa, Artificial Sequence
  source: /note="Description of Artificial Sequence: Synthetic peptide"
NEIEHISVWL

SEQ ID NO: 9039 - protein, 9 aa, Artificial Sequence
  source: /note="Description of Artificial Sequence: Synthetic peptide"
TLSPLCSLI

SEQ ID NO: 9040 - protein, 9 aa, Artificial Sequence
  source: /note="Description of Artificial Sequence: Synthetic peptide"
SMRSRGGSL

SEQ ID NO: 9041 - protein, 9 aa, Artificial Sequence
  source: /note="Description of Artificial Sequence: Synthetic peptide"
MSPPTLSPL

SEQ ID NO: 9042 - protein, 9 aa, Artificial Sequence
  source: /note="Description of Artificial Sequence: Synthetic peptide"
RSRGGSLEM

SEQ ID NO: 9043 - protein, 9 aa, Artificial Sequence
  source: /note="Description of Artificial Sequence: Synthetic peptide"
SPLCSLIVV

SEQ ID NO: 9044 - protein, 9 aa, Artificial Sequence
  source: /note="Description of Artificial Sequence: Synthetic peptide"
SLEMSPPTL

SEQ ID NO: 9045 - protein, 9 aa, Artificial Sequence
  source: /note="Description of Artificial Sequence: Synthetic peptide"
LEMSPPTLS

SEQ ID NO: 9046 - protein, 10 aa, Artificial Sequence
  source: /note="Description of Artificial Sequence: Synthetic peptide"
TLSPLCSLIV

SEQ ID NO: 9047 - protein, 10 aa, Artificial Sequence
  source: /note="Description of Artificial Sequence: Synthetic peptide"
SLIVVILINA

SEQ ID NO: 9048 - protein, 10 aa, Artificial Sequence
  source: /note="Description of Artificial Sequence: Synthetic peptide"
EMSPPTLSPL

SEQ ID NO: 9049 - protein, 10 aa, Artificial Sequence
  source: /note="Description of Artificial Sequence: Synthetic peptide"
SSMRSRGGSL

SEQ ID NO: 9050 - protein, 10 aa, Artificial Sequence
  source: /note="Description of Artificial Sequence: Synthetic peptide"
SMRSRGGSLE

SEQ ID NO: 9051 - protein, 10 aa, Artificial Sequence
  source: /note="Description of Artificial Sequence: Synthetic peptide"
RSRGGSLEMS

SEQ ID NO: 9052 - protein, 10 aa, Artificial Sequence
  source: /note="Description of Artificial Sequence: Synthetic peptide"
SPLCSLIVVI

SEQ ID NO: 9053 - protein, 10 aa, Artificial Sequence
  source: /note="Description of Artificial Sequence: Synthetic peptide"
MRSRGGSLEM

SEQ ID NO: 9054 - protein, 10 aa, Artificial Sequence
  source: /note="Description of Artificial Sequence: Synthetic peptide"
GSLEMSPPTL

SEQ ID NO: 9055 - protein, 10 aa, Artificial Sequence
  source: /note="Description of Artificial Sequence: Synthetic peptide"
LEMSPPTLSP

SEQ ID NO: 9056 - protein, 9 aa, Artificial Sequence
  source: /note="Description of Artificial Sequence: Synthetic peptide"
IDNNSTASY

SEQ ID NO: 9057 - protein, 10 aa, Artificial Sequence
  source: /note="Description of Artificial Sequence: Synthetic peptide"
RIDNNSTASY

SEQ ID NO: 9058 - protein, 10 aa, Artificial Sequence
  source: /note="Description of Artificial Sequence: Synthetic peptide"
IDNNSTASYL

SEQ ID NO: 9059 - protein, 9 aa, Artificial Sequence
  source: /note="Description of Artificial Sequence: Synthetic peptide"
ALKAIRALM

SEQ ID NO: 9060 - protein, 9 aa, Artificial Sequence
  source: /note="Description of Artificial Sequence: Synthetic peptide"
AIRALMENA

SEQ ID NO: 9061 - protein, 9 aa, Artificial Sequence
  source: /note="Description of Artificial Sequence: Synthetic peptide"
IISALKAIR

SEQ ID NO: 9062 - protein, 9 aa, Artificial Sequence
  source: /note="Description of Artificial Sequence: Synthetic peptide"
SALKAIRAL

SEQ ID NO: 9063 - protein, 10 aa, Artificial Sequence
  source: /note="Description of Artificial Sequence: Synthetic peptide"
AIRALMENAV

SEQ ID NO: 9064 - protein, 10 aa, Artificial Sequence
  source: /note="Description of Artificial Sequence: Synthetic peptide"
SALKAIRALM

SEQ ID NO: 9065 - protein, 10 aa, Artificial Sequence
  source: /note="Description of Artificial Sequence: Synthetic peptide"
TIISALKAIR

SEQ ID NO: 9066 - protein, 10 aa, Artificial Sequence
  source: /note="Description of Artificial Sequence: Synthetic peptide"
ISALKAIRAL

SEQ ID NO: 9067 - protein, 9 aa, Artificial Sequence
  source: /note="Description of Artificial Sequence: Synthetic peptide"
FTDDPITEF

SEQ ID NO: 9068 - protein, 9 aa, Artificial Sequence
  source: /note="Description of Artificial Sequence: Synthetic peptide"
ITEFKLNAY

SEQ ID NO: 9069 - protein, 9 aa, Artificial Sequence
  source: /note="Description of Artificial Sequence: Synthetic peptide"
MVQFTDDPI

SEQ ID NO: 9070 - protein, 9 aa, Artificial Sequence
  source: /note="Description of Artificial Sequence: Synthetic peptide"
VQFTDDPIT

SEQ ID NO: 9071 - protein, 10 aa, Artificial Sequence
  source: /note="Description of Artificial Sequence: Synthetic peptide"
FTDDPITEFK

SEQ ID NO: 9072 - protein, 10 aa, Artificial Sequence
  source: /note="Description of Artificial Sequence: Synthetic peptide"
AMVQFTDDPI

SEQ ID NO: 9073 - protein, 10 aa, Artificial Sequence
  source: /note="Description of Artificial Sequence: Synthetic peptide"
ITEFKLNAYK

SEQ ID NO: 9074 - protein, 10 aa, Artificial Sequence
  source: /note="Description of Artificial Sequence: Synthetic peptide"
QFTDDPITEF

SEQ ID NO: 9075 - protein, 10 aa, Artificial Sequence
  source: /note="Description of Artificial Sequence: Synthetic peptide"
RGQAGPPGVM

SEQ ID NO: 9076 - protein, 9 aa, Artificial Sequence
  source: /note="Description of Artificial Sequence: Synthetic peptide"
DLWSTCRSR

SEQ ID NO: 9077 - protein, 9 aa, Artificial Sequence
  source: /note="Description of Artificial Sequence: Synthetic peptide"
GPRGQPGDV

SEQ ID NO: 9078 - protein, 9 aa, Artificial Sequence
  source: /note="Description of Artificial Sequence: Synthetic peptide"
KGKKGEPII

SEQ ID NO: 9079 - protein, 10 aa, Artificial Sequence
  source: /note="Description of Artificial Sequence: Synthetic peptide"
KKGEPIISTI

SEQ ID NO: 9080 - protein, 10 aa, Artificial Sequence
  source: /note="Description of Artificial Sequence: Synthetic peptide"
EPIISTIQGM

SEQ ID NO: 9081 - protein, 9 aa, Artificial Sequence
  source: /note="Description of Artificial Sequence: Synthetic peptide"
GTVGPPWPV

SEQ ID NO: 9082 - protein, 9 aa, Artificial Sequence
  source: /note="Description of Artificial Sequence: Synthetic peptide"
DPGTVGPPW

SEQ ID NO: 9083 - protein, 9 aa, Artificial Sequence
  source: /note="Description of Artificial Sequence: Synthetic peptide"
WSMGLPGPK

SEQ ID NO: 9084 - protein, 9 aa, Artificial Sequence
  source: /note="Description of Artificial Sequence: Synthetic peptide"
SIGIRGQPW

SEQ ID NO: 9085 - protein, 9 aa, Artificial Sequence
  source: /note="Description of Artificial Sequence: Synthetic peptide"
RGQPWSMGL

SEQ ID NO: 9086 - protein, 9 aa, Artificial Sequence
  source: /note="Description of Artificial Sequence: Synthetic peptide"
QPWSMGLPG

SEQ ID NO: 9087 - protein, 10 aa, Artificial Sequence
  source: /note="Description of Artificial Sequence: Synthetic peptide"
GSIGIRGQPW

SEQ ID NO: 9088 - protein, 10 aa, Artificial Sequence
  source: /note="Description of Artificial Sequence: Synthetic peptide"
IGIRGQPWSM

SEQ ID NO: 9089 - protein, 9 aa, Artificial Sequence
  source: /note="Description of Artificial Sequence: Synthetic peptide"
DSIDQCDLI

SEQ ID NO: 9090 - protein, 9 aa, Artificial Sequence
  source: /note="Description of Artificial Sequence: Synthetic peptide"
NVFFKLVDK

SEQ ID NO: 9091 - protein, 9 aa, Artificial Sequence
  source: /note="Description of Artificial Sequence: Synthetic peptide"
FASEPNNVF

SEQ ID NO: 9092 - protein, 9 aa, Artificial Sequence
  source: /note="Description of Artificial Sequence: Synthetic peptide"
ASEPNNVFF

SEQ ID NO: 9093 - protein, 9 aa, Artificial Sequence
  source: /note="Description of Artificial Sequence: Synthetic peptide"
EPNNVFFKL

SEQ ID NO: 9094 - protein, 10 aa, Artificial Sequence
  source: /note="Description of Artificial Sequence: Synthetic peptide"
YTFASEPNNV

SEQ ID NO: 9095 - protein, 10 aa, Artificial Sequence
  source: /note="Description of Artificial Sequence: Synthetic peptide"
ASEPNNVFFK

SEQ ID NO: 9096 - protein, 10 aa, Artificial Sequence
  source: /note="Description of Artificial Sequence: Synthetic peptide"
TFASEPNNVF

SEQ ID NO: 9097 - protein, 10 aa, Artificial Sequence
  source: /note="Description of Artificial Sequence: Synthetic peptide"
FASEPNNVFF

SEQ ID NO: 9098 - protein, 10 aa, Artificial Sequence
  source: /note="Description of Artificial Sequence: Synthetic peptide"
EPNNVFFKLV

SEQ ID NO: 9099 - protein, 10 aa, Artificial Sequence
  source: /note="Description of Artificial Sequence: Synthetic peptide"
SEPNNVFFKL

SEQ ID NO: 9100 - protein, 9 aa, Artificial Sequence
  source: /note="Description of Artificial Sequence: Synthetic peptide"
KMEDNGSDY

SEQ ID NO: 9101 - protein, 9 aa, Artificial Sequence
  source: /note="Description of Artificial Sequence: Synthetic peptide"
MEDNGSDYL

SEQ ID NO: 9102 - protein, 10 aa, Artificial Sequence
  source: /note="Description of Artificial Sequence: Synthetic peptide"
KMEDNGSDYL

SEQ ID NO: 9103 - protein, 10 aa, Artificial Sequence
  source: /note="Description of Artificial Sequence: Synthetic peptide"
SGRESPFVKM

SEQ ID NO: 9104 - protein, 10 aa, Artificial Sequence
  source: /note="Description of Artificial Sequence: Synthetic peptide"
VKMEDNGSDY

SEQ ID NO: 9105 - protein, 10 aa, Artificial Sequence
  source: /note="Description of Artificial Sequence: Synthetic peptide"
MEDNGSDYLV

SEQ ID NO: 9106 - protein, 9 aa, Artificial Sequence
  source: /note="Description of Artificial Sequence: Synthetic peptide"
QIDIDGFAV

SEQ ID NO: 9107 - protein, 9 aa, Artificial Sequence
  source: /note="Description of Artificial Sequence: Synthetic peptide"
GQIDIDGFA

SEQ ID NO: 9108 - protein, 9 aa, Artificial Sequence
  source: /note="Description of Artificial Sequence: Synthetic peptide"
LPIKPRGQI

SEQ ID NO: 9109 - protein, 10 aa, Artificial Sequence
  source: /note="Description of Artificial Sequence: Synthetic peptide"
GQIDIDGFAV

SEQ ID NO: 9110 - protein, 9 aa, Artificial Sequence
  source: /note="Description of Artificial Sequence: Synthetic peptide"
FQASMASTV

SEQ ID NO: 9111 - protein, 9 aa, Artificial Sequence
  source: /note="Description of Artificial Sequence: Synthetic peptide"
SMASTVTEV

SEQ ID NO: 9112 - protein, 9 aa, Artificial Sequence
  source: /note="Description of Artificial Sequence: Synthetic peptide"
ELQASLAHL

SEQ ID NO: 9113 - protein, 9 aa, Artificial Sequence
  source: /note="Description of Artificial Sequence: Synthetic peptide"
LQASLAHLA

SEQ ID NO: 9114 - protein, 9 aa, Artificial Sequence
  source: /note="Description of Artificial Sequence: Synthetic peptide"
VLRAPRAPR

SEQ ID NO: 9115 - protein, 9 aa, Artificial Sequence
  source: /note="Description of Artificial Sequence: Synthetic peptide"
ASLAHLALM

SEQ ID NO: 9116 - protein, 9 aa, Artificial Sequence
  source: /note="Description of Artificial Sequence: Synthetic peptide"
VTEVLRAPR

SEQ ID NO: 9117 - protein, 9 aa, Artificial Sequence
  source: /note="Description of Artificial Sequence: Synthetic peptide"
MASTVTEVL

SEQ ID NO: 9118 - protein, 9 aa, Artificial Sequence
  source: /note="Description of Artificial Sequence: Synthetic peptide"
ESQELQASL

SEQ ID NO: 9119 - protein, 9 aa, Artificial Sequence
  source: /note="Description of Artificial Sequence: Synthetic peptide"
GPLEFQASM

SEQ ID NO: 9120 - protein, 9 aa, Artificial Sequence
  source: /note="Description of Artificial Sequence: Synthetic peptide"
LEFQASMAS

SEQ ID NO: 9121 - protein, 9 aa, Artificial Sequence
  source: /note="Description of Artificial Sequence: Synthetic peptide"
RESQELQAS

SEQ ID NO: 9122 - protein, 9 aa, Artificial Sequence
  source: /note="Description of Artificial Sequence: Synthetic peptide"
QELQASLAH

SEQ ID NO: 9123 - protein, 9 aa, Artificial Sequence
  source: /note="Description of Artificial Sequence: Synthetic peptide"
QASLAHLAL

SEQ ID NO: 9124 - protein, 9 aa, Artificial Sequence
  source: /note="Description of Artificial Sequence: Synthetic peptide"
TEVLRAPRA

SEQ ID NO: 9125 - protein, 10 aa, Artificial Sequence
  source: /note="Description of Artificial Sequence: Synthetic peptide"
ASMASTVTEV

SEQ ID NO: 9126 - protein, 10 aa, Artificial Sequence
  source: /note="Description of Artificial Sequence: Synthetic peptide"
SMASTVTEVL

SEQ ID NO: 9127 - protein, 10 aa, Artificial Sequence
  source: /note="Description of Artificial Sequence: Synthetic peptide"
LQASLAHLAL

SEQ ID NO: 9128 - protein, 10 aa, Artificial Sequence
  source: /note="Description of Artificial Sequence: Synthetic peptide"
FQASMASTVT

SEQ ID NO: 9129 - protein, 10 aa, Artificial Sequence
  source: /note="Description of Artificial Sequence: Synthetic peptide"
VLRAPRAPRV

SEQ ID NO: 9130 - protein, 10 aa, Artificial Sequence
  source: /note="Description of Artificial Sequence: Synthetic peptide"
ELQASLAHLA

SEQ ID NO: 9131 - protein, 10 aa, Artificial Sequence
  source: /note="Description of Artificial Sequence: Synthetic peptide"
MASTVTEVLR

SEQ ID NO: 9132 - protein, 10 aa, Artificial Sequence
  source: /note="Description of Artificial Sequence: Synthetic peptide"
TVTEVLRAPR

SEQ ID NO: 9133 - protein, 10 aa, Artificial Sequence
  source: /note="Description of Artificial Sequence: Synthetic peptide"
EVLRAPRAPR

SEQ ID NO: 9134 - protein, 10 aa, Artificial Sequence
  source: /note="Description of Artificial Sequence: Synthetic peptide"
ESQELQASLA

SEQ ID NO: 9135 - protein, 10 aa, Artificial Sequence
  source: /note="Description of Artificial Sequence: Synthetic peptide"
APRAPRVLQV

SEQ ID NO: 9136 - protein, 10 aa, Artificial Sequence
  source: /note="Description of Artificial Sequence: Synthetic peptide"
LEFQASMAST

SEQ ID NO: 9137 - protein, 10 aa, Artificial Sequence
  source: /note="Description of Artificial Sequence: Synthetic peptide"
LRAPRAPRVL

SEQ ID NO: 9138 - protein, 10 aa, Artificial Sequence
  source: /note="Description of Artificial Sequence: Synthetic peptide"
LQVNRESQEL

SEQ ID NO: 9139 - protein, 10 aa, Artificial Sequence
  source: /note="Description of Artificial Sequence: Synthetic peptide"
RESQELQASL

SEQ ID NO: 9140 - protein, 10 aa, Artificial Sequence
  source: /note="Description of Artificial Sequence: Synthetic peptide"
SQELQASLAH

SEQ ID NO: 9141 - protein, 10 aa, Artificial Sequence
  source: /note="Description of Artificial Sequence: Synthetic peptide"
QELQASLAHL

SEQ ID NO: 9142 - protein, 10 aa, Artificial Sequence
  source: /note="Description of Artificial Sequence: Synthetic peptide"
QASLAHLALM

SEQ ID NO: 9143 - protein, 9 aa, Artificial Sequence
  source: /note="Description of Artificial Sequence: Synthetic peptide"
EFVCEAIQR

SEQ ID NO: 9144 - protein, 9 aa, Artificial Sequence
  source: /note="Description of Artificial Sequence: Synthetic peptide"
DVLEFVCEA

SEQ ID NO: 9145 - protein, 9 aa, Artificial Sequence
  source: /note="Description of Artificial Sequence: Synthetic peptide"
FVCEAIQRF

SEQ ID NO: 9146 - protein, 10 aa, Artificial Sequence
  source: /note="Description of Artificial Sequence: Synthetic peptide"
EFVCEAIQRF

SEQ ID NO: 9147 - protein, 10 aa, Artificial Sequence
  source: /note="Description of Artificial Sequence: Synthetic peptide"
DVLEFVCEAI

SEQ ID NO: 9148 - protein, 10 aa, Artificial Sequence
  source: /note="Description of Artificial Sequence: Synthetic peptide"
CEAIQRFDNL

SEQ ID NO: 9149 - protein, 9 aa, Artificial Sequence
  source: /note="Description of Artificial Sequence: Synthetic peptide"
RWRQLSLSA

SEQ ID NO: 9150 - protein, 9 aa, Artificial Sequence
  source: /note="Description of Artificial Sequence: Synthetic peptide"
CPEPRWRQL

SEQ ID NO: 9151 - protein, 9 aa, Artificial Sequence
  source: /note="Description of Artificial Sequence: Synthetic peptide"
EPRWRQLSL

SEQ ID NO: 9152 - protein, 9 aa, Artificial Sequence
  source: /note="Description of Artificial Sequence: Synthetic peptide"
WRQLSLSAA

SEQ ID NO: 9153 - protein, 10 aa, Artificial Sequence
  source: /note="Description of Artificial Sequence: Synthetic peptide"
RWRQLSLSAA

SEQ ID NO: 9154 - protein, 10 aa, Artificial Sequence
  source: /note="Description of Artificial Sequence: Synthetic peptide"
WRQLSLSAAA

SEQ ID NO: 9155 - protein, 10 aa, Artificial Sequence
  source: /note="Description of Artificial Sequence: Synthetic peptide"
QPPACPEPRW

SEQ ID NO: 9156 - protein, 9 aa, Artificial Sequence
  source: /note="Description of Artificial Sequence: Synthetic peptide"
QLRAETSAL

SEQ ID NO: 9157 - protein, 9 aa, Artificial Sequence
  source: /note="Description of Artificial Sequence: Synthetic peptide"
TLRDTTRLH

SEQ ID NO: 9158 - protein, 9 aa, Artificial Sequence
  source: /note="Description of Artificial Sequence: Synthetic peptide"
ETSALLTLR

SEQ ID NO: 9159 - protein, 9 aa, Artificial Sequence
  source: /note="Description of Artificial Sequence: Synthetic peptide"
LLTLRDTTR

SEQ ID NO: 9160 - protein, 9 aa, Artificial Sequence
  source: /note="Description of Artificial Sequence: Synthetic peptide"
DTTRLHGEV

SEQ ID NO: 9161 - protein, 9 aa, Artificial Sequence
  source: /note="Description of Artificial Sequence: Synthetic peptide"
LRAETSALL

SEQ ID NO: 9162 - protein, 9 aa, Artificial Sequence
  source: /note="Description of Artificial Sequence: Synthetic peptide"
AETSALLTL

SEQ ID NO: 9163 - protein, 9 aa, Artificial Sequence
  source: /note="Description of Artificial Sequence: Synthetic peptide"
SEQLRAETS

SEQ ID NO: 9164 - protein, 10 aa, Artificial Sequence
  source: /note="Description of Artificial Sequence: Synthetic peptide"
QLRAETSALL

SEQ ID NO: 9165 - protein, 10 aa, Artificial Sequence
  source: /note="Description of Artificial Sequence: Synthetic peptide"
LLTLRDTTRL

SEQ ID NO: 9166 - protein, 10 aa, Artificial Sequence
  source: /note="Description of Artificial Sequence: Synthetic peptide"
NLRMGSEQLR

SEQ ID NO: 9167 - protein, 10 aa, Artificial Sequence
  source: /note="Description of Artificial Sequence: Synthetic peptide"
SEQLRAETSA

SEQ ID NO: 9168 - protein, 10 aa, Artificial Sequence
  source: /note="Description of Artificial Sequence: Synthetic peptide"
EQLRAETSAL

SEQ ID NO: 9169 - protein, 10 aa, Artificial Sequence
  source: /note="Description of Artificial Sequence: Synthetic peptide"
RAETSALLTL

SEQ ID NO: 9170 - protein, 9 aa, Artificial Sequence
  source: /note="Description of Artificial Sequence: Synthetic peptide"
VIIGGVTRL

SEQ ID NO: 9171 - protein, 9 aa, Artificial Sequence
  source: /note="Description of Artificial Sequence: Synthetic peptide"
MAVVGVSLV

SEQ ID NO: 9172 - protein, 9 aa, Artificial Sequence
  source: /note="Description of Artificial Sequence: Synthetic peptide"
SLVSRLLGR

SEQ ID NO: 9173 - protein, 10 aa, Artificial Sequence
  source: /note="Description of Artificial Sequence: Synthetic peptide"
AVVGVSLVSR

SEQ ID NO: 9174 - protein, 10 aa, Artificial Sequence
  source: /note="Description of Artificial Sequence: Synthetic peptide"
VSLVSRLLGR

SEQ ID NO: 9175 - protein, 10 aa, Artificial Sequence
  source: /note="Description of Artificial Sequence: Synthetic peptide"
LVSRLLGRSR

SEQ ID NO: 9176 - protein, 9 aa, Artificial Sequence
  source: /note="Description of Artificial Sequence: Synthetic peptide"
IVSTSVTHL

SEQ ID NO: 9177 - protein, 9 aa, Artificial Sequence
  source: /note="Description of Artificial Sequence: Synthetic peptide"
STSVTHLVR

SEQ ID NO: 9178 - protein, 9 aa, Artificial Sequence
  source: /note="Description of Artificial Sequence: Synthetic peptide"
REKGLSSPK

SEQ ID NO: 9179 - protein, 9 aa, Artificial Sequence
  source: /note="Description of Artificial Sequence: Synthetic peptide"
VSTSVTHLV

SEQ ID NO: 9180 - protein, 9 aa, Artificial Sequence
  source: /note="Description of Artificial Sequence: Synthetic peptide"
SPKHGFGIV

SEQ ID NO: 9181 - protein, 9 aa, Artificial Sequence
  source: /note="Description of Artificial Sequence: Synthetic peptide"
GLSSPKHGF

SEQ ID NO: 9182 - protein, 10 aa, Artificial Sequence
  source: /note="Description of Artificial Sequence: Synthetic peptide"
IVSTSVTHLV

SEQ ID NO: 9183 - protein, 10 aa, Artificial Sequence
  source: /note="Description of Artificial Sequence: Synthetic peptide"
GIVSTSVTHL

SEQ ID NO: 9184 - protein, 10 aa, Artificial Sequence
  source: /note="Description of Artificial Sequence: Synthetic peptide"
VSTSVTHLVR

SEQ ID NO: 9185 - protein, 10 aa, Artificial Sequence
  source: /note="Description of Artificial Sequence: Synthetic peptide"
VTHLVRGHSV

SEQ ID NO: 9186 - protein, 10 aa, Artificial Sequence
  source: /note="Description of Artificial Sequence: Synthetic peptide"
HGFGIVSTSV

SEQ ID NO: 9187 - protein, 10 aa, Artificial Sequence
  source: /note="Description of Artificial Sequence: Synthetic peptide"
KGLSSPKHGF

SEQ ID NO: 9188 - protein, 10 aa, Artificial Sequence
  source: /note="Description of Artificial Sequence: Synthetic peptide"
FGIVSTSVTH

SEQ ID NO: 9189 - protein, 9 aa, Artificial Sequence
  source: /note="Description of Artificial Sequence: Synthetic peptide"
RAYSSFNQA

SEQ ID NO: 9190 - protein, 9 aa, Artificial Sequence
  source: /note="Description of Artificial Sequence: Synthetic peptide"
AYSSFNQAM

SEQ ID NO: 9191 - protein, 10 aa, Artificial Sequence
  source: /note="Description of Artificial Sequence: Synthetic peptide"
RAYSSFNQAM

SEQ ID NO: 9192 - protein, 9 aa, Artificial Sequence
  source: /note="Description of Artificial Sequence: Synthetic peptide"
GSHGSRLEK

SEQ ID NO: 9193 - protein, 9 aa, Artificial Sequence
  source: /note="Description of Artificial Sequence: Synthetic peptide"
EIVGSHGSR

SEQ ID NO: 9194 - protein, 9 aa, Artificial Sequence
  source: /note="Description of Artificial Sequence: Synthetic peptide"
GEIVGSHGS

SEQ ID NO: 9195 - protein, 10 aa, Artificial Sequence
  source: /note="Description of Artificial Sequence: Synthetic peptide"
VGSHGSRLEK

SEQ ID NO: 9196 - protein, 10 aa, Artificial Sequence
  source: /note="Description of Artificial Sequence: Synthetic peptide"
EIVGSHGSRL

SEQ ID NO: 9197 - protein, 9 aa, Artificial Sequence
  source: /note="Description of Artificial Sequence: Synthetic peptide"
SSKRIYAIA

SEQ ID NO: 9198 - protein, 9 aa, Artificial Sequence
  source: /note="Description of Artificial Sequence: Synthetic peptide"
SKRIYAIAK

SEQ ID NO: 9199 - protein, 9 aa, Artificial Sequence
  source: /note="Description of Artificial Sequence: Synthetic peptide"
ELSEPSSKR

SEQ ID NO: 9200 - protein, 9 aa, Artificial Sequence
  source: /note="Description of Artificial Sequence: Synthetic peptide"
SEPSSKRIY

SEQ ID NO: 9201 - protein, 10 aa, Artificial Sequence
  source: /note="Description of Artificial Sequence: Synthetic peptide"
LSEPSSKRIY

SEQ ID NO: 9202 - protein, 10 aa, Artificial Sequence
  source: /note="Description of Artificial Sequence: Synthetic peptide"
SSKRIYAIAK

SEQ ID NO: 9203 - protein, 10 aa, Artificial Sequence
  source: /note="Description of Artificial Sequence: Synthetic peptide"
EPSSKRIYAI

SEQ ID NO: 9204 - protein, 10 aa, Artificial Sequence
  source: /note="Description of Artificial Sequence: Synthetic peptide"
KRIYAIAKAI

SEQ ID NO: 9205 - protein, 9 aa, Artificial Sequence
  source: /note="Description of Artificial Sequence: Synthetic peptide"
RTQQVIGVM

SEQ ID NO: 9206 - protein, 9 aa, Artificial Sequence
  source: /note="Description of Artificial Sequence: Synthetic peptide"
NQQRTQQVI

SEQ ID NO: 9207 - protein, 10 aa, Artificial Sequence
  source: /note="Description of Artificial Sequence: Synthetic peptide"
SPNQQRTQQV

SEQ ID NO: 9208 - protein, 10 aa, Artificial Sequence
  source: /note="Description of Artificial Sequence: Synthetic peptide"
QQRTQQVIGV

SEQ ID NO: 9209 - protein, 10 aa, Artificial Sequence
  source: /note="Description of Artificial Sequence: Synthetic peptide"
QRTQQVIGVM

SEQ ID NO: 9210 - protein, 9 aa, Artificial Sequence
  source: /note="Description of Artificial Sequence: Synthetic peptide"
CLKTQSGQV

SEQ ID NO: 9211 - protein, 9 aa, Artificial Sequence
  source: /note="Description of Artificial Sequence: Synthetic peptide"
QVLRTSANV

SEQ ID NO: 9212 - protein, 9 aa, Artificial Sequence
  source: /note="Description of Artificial Sequence: Synthetic peptide"
RTSANVNHV

SEQ ID NO: 9213 - protein, 9 aa, Artificial Sequence
  source: /note="Description of Artificial Sequence: Synthetic peptide"
KTQSGQVLR

SEQ ID NO: 9214 - protein, 9 aa, Artificial Sequence
  source: /note="Description of Artificial Sequence: Synthetic peptide"
TSANVNHVV

SEQ ID NO: 9215 - protein, 9 aa, Artificial Sequence
  source: /note="Description of Artificial Sequence: Synthetic peptide"
LKTQSGQVL

SEQ ID NO: 9216 - protein, 9 aa, Artificial Sequence
  source: /note="Description of Artificial Sequence: Synthetic peptide"
SANVNHVVI

SEQ ID NO: 9217 - protein, 9 aa, Artificial Sequence
  source: /note="Description of Artificial Sequence: Synthetic peptide"
ANVNHVVIL

SEQ ID NO: 9218 - protein, 10 aa, Artificial Sequence
  source: /note="Description of Artificial Sequence: Synthetic peptide"
GQVLRTSANV

SEQ ID NO: 9219 - protein, 10 aa, Artificial Sequence
  source: /note="Description of Artificial Sequence: Synthetic peptide"
RTSANVNHVV

SEQ ID NO: 9220 - protein, 10 aa, Artificial Sequence
  source: /note="Description of Artificial Sequence: Synthetic peptide"
TSANVNHVVI

SEQ ID NO: 9221 - protein, 10 aa, Artificial Sequence
  source: /note="Description of Artificial Sequence: Synthetic peptide"
NVNHVVILQI

SEQ ID NO: 9222 - protein, 10 aa, Artificial Sequence
  source: /note="Description of Artificial Sequence: Synthetic peptide"
CLKTQSGQVL

SEQ ID NO: 9223 - protein, 10 aa, Artificial Sequence
  source: /note="Description of Artificial Sequence: Synthetic peptide"
SANVNHVVIL

SEQ ID NO: 9224 - protein, 9 aa, Artificial Sequence
  source: /note="Description of Artificial Sequence: Synthetic peptide"
WSAVPPHVK

SEQ ID NO: 9225 - protein, 9 aa, Artificial Sequence
  source: /note="Description of Artificial Sequence: Synthetic peptide"
KWSAVPPHV

SEQ ID NO: 9226 - protein, 9 aa, Artificial Sequence
  source: /note="Description of Artificial Sequence: Synthetic peptide"
HVKRHAVNL

SEQ ID NO: 9227 - protein, 9 aa, Artificial Sequence
  source: /note="Description of Artificial Sequence: Synthetic peptide"
SAVPPHVKR

SEQ ID NO: 9228 - protein, 9 aa, Artificial Sequence
  source: /note="Description of Artificial Sequence: Synthetic peptide"
PPHVKRHAV

SEQ ID NO: 9229 - protein, 9 aa, Artificial Sequence
  source: /note="Description of Artificial Sequence: Synthetic peptide"
GKWSAVPPH

SEQ ID NO: 9230 - protein, 10 aa, Artificial Sequence
  source: /note="Description of Artificial Sequence: Synthetic peptide"
SGKWSAVPPH

SEQ ID NO: 9231 - protein, 10 aa, Artificial Sequence
  source: /note="Description of Artificial Sequence: Synthetic peptide"
KWSAVPPHVK

SEQ ID NO: 9232 - protein, 10 aa, Artificial Sequence
  source: /note="Description of Artificial Sequence: Synthetic peptide"
WSAVPPHVKR

SEQ ID NO: 9233 - protein, 10 aa, Artificial Sequence
  source: /note="Description of Artificial Sequence: Synthetic peptide"
VPPHVKRHAV

SEQ ID NO: 9234 - protein, 10 aa, Artificial Sequence
  source: /note="Description of Artificial Sequence: Synthetic peptide"
GKWSAVPPHV

SEQ ID NO: 9235 - protein, 9 aa, Artificial Sequence
  source: /note="Description of Artificial Sequence: Synthetic peptide"
SIICHPHLR

SEQ ID NO: 9236 - protein, 10 aa, Artificial Sequence
  source: /note="Description of Artificial Sequence: Synthetic peptide"
SIICHPHLRL

SEQ ID NO: 9237 - protein, 10 aa, Artificial Sequence
  source: /note="Description of Artificial Sequence: Synthetic peptide"
TSIICHPHLR

SEQ ID NO: 9238 - protein, 10 aa, Artificial Sequence
  source: /note="Description of Artificial Sequence: Synthetic peptide"
MTSNGVALLT

SEQ ID NO: 9239 - protein, 10 aa, Artificial Sequence
  source: /note="Description of Artificial Sequence: Synthetic peptide"
LTSIICHPHL

SEQ ID NO: 9240 - protein, 9 aa, Artificial Sequence
  source: /note="Description of Artificial Sequence: Synthetic peptide"
NGVALLNVY

SEQ ID NO: 9241 - protein, 9 aa, Artificial Sequence
  source: /note="Description of Artificial Sequence: Synthetic peptide"
VALLNVYNM

SEQ ID NO: 9242 - protein, 10 aa, Artificial Sequence
  source: /note="Description of Artificial Sequence: Synthetic peptide"
LLNVYNMPST

SEQ ID NO: 9243 - protein, 10 aa, Artificial Sequence
  source: /note="Description of Artificial Sequence: Synthetic peptide"
VYNMPSTPSF

SEQ ID NO: 9244 - protein, 10 aa, Artificial Sequence
  source: /note="Description of Artificial Sequence: Synthetic peptide"
SNGVALLNVY

SEQ ID NO: 9245 - protein, 10 aa, Artificial Sequence
  source: /note="Description of Artificial Sequence: Synthetic peptide"
TSNGVALLNV

SEQ ID NO: 9246 - protein, 9 aa, Artificial Sequence
  source: /note="Description of Artificial Sequence: Synthetic peptide"
RGRCHMHPD

SEQ ID NO: 9247 - protein, 9 aa, Artificial Sequence
  source: /note="Description of Artificial Sequence: Synthetic peptide"
CHMHPDGRF

SEQ ID NO: 9248 - protein, 10 aa, Artificial Sequence
  source: /note="Description of Artificial Sequence: Synthetic peptide"
RGRCHMHPDG

SEQ ID NO: 9249 - protein, 10 aa, Artificial Sequence
  source: /note="Description of Artificial Sequence: Synthetic peptide"
APCARGRCHM

SEQ ID NO: 9250 - protein, 10 aa, Artificial Sequence
  source: /note="Description of Artificial Sequence: Synthetic peptide"
RCHMHPDGRF

SEQ ID NO: 9251 - protein, 10 aa, Artificial Sequence
  source: /note="Description of Artificial Sequence: Synthetic peptide"
HMHPDGRFEC

SEQ ID NO: 9252 - protein, 9 aa, Artificial Sequence
  source: /note="Description of Artificial Sequence: Synthetic peptide"
YLHSIHFFR

SEQ ID NO: 9253 - protein, 9 aa, Artificial Sequence
  source: /note="Description of Artificial Sequence: Synthetic peptide"
HSIHFFRPR

SEQ ID NO: 9254 - protein, 9 aa, Artificial Sequence
  source: /note="Description of Artificial Sequence: Synthetic peptide"
VYISYLHSI

SEQ ID NO: 9255 - protein, 9 aa, Artificial Sequence
  source: /note="Description of Artificial Sequence: Synthetic peptide"
ISYLHSIHF

SEQ ID NO: 9256 - protein, 9 aa, Artificial Sequence
  source: /note="Description of Artificial Sequence: Synthetic peptide"
SYLHSIHFF

SEQ ID NO: 9257 - protein, 9 aa, Artificial Sequence
  source: /note="Description of Artificial Sequence: Synthetic peptide"
RVYISYLHS

SEQ ID NO: 9258 - protein, 9 aa, Artificial Sequence
  source: /note="Description of Artificial Sequence: Synthetic peptide"
YISYLHSIH

SEQ ID NO: 9259 - protein, 10 aa, Artificial Sequence
  source: /note="Description of Artificial Sequence: Synthetic peptide"
RVYISYLHSI

SEQ ID NO: 9260 - protein, 10 aa, Artificial Sequence
  source: /note="Description of Artificial Sequence: Synthetic peptide"
SYLHSIHFFR

SEQ ID NO: 9261 - protein, 10 aa, Artificial Sequence
  source: /note="Description of Artificial Sequence: Synthetic peptide"
YISYLHSIHF

SEQ ID NO: 9262 - protein, 10 aa, Artificial Sequence
  source: /note="Description of Artificial Sequence: Synthetic peptide"
ISYLHSIHFF

SEQ ID NO: 9263 - protein, 9 aa, Artificial Sequence
  source: /note="Description of Artificial Sequence: Synthetic peptide"
HFFRPRCLH

SEQ ID NO: 9264 - protein, 9 aa, Artificial Sequence
  source: /note="Description of Artificial Sequence: Synthetic peptide"
HTAVYHEIL

SEQ ID NO: 9265 - protein, 9 aa, Artificial Sequence
  source: /note="Description of Artificial Sequence: Synthetic peptide"
RPRCLHTAV

SEQ ID NO: 9266 - protein, 9 aa, Artificial Sequence
  source: /note="Description of Artificial Sequence: Synthetic peptide"
FFRPRCLHT

SEQ ID NO: 9267 - protein, 10 aa, Artificial Sequence
  source: /note="Description of Artificial Sequence: Synthetic peptide"
CLHTAVYHEI

SEQ ID NO: 9268 - protein, 10 aa, Artificial Sequence
  source: /note="Description of Artificial Sequence: Synthetic peptide"
FFRPRCLHTA

SEQ ID NO: 9269 - protein, 10 aa, Artificial Sequence
  source: /note="Description of Artificial Sequence: Synthetic peptide"
RPRCLHTAVY

SEQ ID NO: 9270 - protein, 10 aa, Artificial Sequence
  source: /note="Description of Artificial Sequence: Synthetic peptide"
HTAVYHEILI

SEQ ID NO: 9271 - protein, 9 aa, Artificial Sequence
  source: /note="Description of Artificial Sequence: Synthetic peptide"
VLNILKSNL

SEQ ID NO: 9272 - protein, 9 aa, Artificial Sequence
  source: /note="Description of Artificial Sequence: Synthetic peptide"
ILKSNLQLM

SEQ ID NO: 9273 - protein, 9 aa, Artificial Sequence
  source: /note="Description of Artificial Sequence: Synthetic peptide"
NLQLMAAFI

SEQ ID NO: 9274 - protein, 9 aa, Artificial Sequence
  source: /note="Description of Artificial Sequence: Synthetic peptide"
LQLMAAFIK

SEQ ID NO: 9275 - protein, 9 aa, Artificial Sequence
  source: /note="Description of Artificial Sequence: Synthetic peptide"
KSNLQLMAA

SEQ ID NO: 9276 - protein, 9 aa, Artificial Sequence
  source: /note="Description of Artificial Sequence: Synthetic peptide"
SNLQLMAAF

SEQ ID NO: 9277 - protein, 9 aa, Artificial Sequence
  source: /note="Description of Artificial Sequence: Synthetic peptide"
LKSNLQLMA

SEQ ID NO: 9278 - protein, 10 aa, Artificial Sequence
  source: /note="Description of Artificial Sequence: Synthetic peptide"
ILKSNLQLMA

SEQ ID NO: 9279 - protein, 10 aa, Artificial Sequence
  source: /note="Description of Artificial Sequence: Synthetic peptide"
NLQLMAAFIK

SEQ ID NO: 9280 - protein, 10 aa, Artificial Sequence
  source: /note="Description of Artificial Sequence: Synthetic peptide"
KSNLQLMAAF

SEQ ID NO: 9281 - protein, 10 aa, Artificial Sequence
  source: /note="Description of Artificial Sequence: Synthetic peptide"
LKSNLQLMAA

SEQ ID NO: 9282 - protein, 9 aa, Artificial Sequence
  source: /note="Description of Artificial Sequence: Synthetic peptide"
SMWSAHLLM

SEQ ID NO: 9283 - protein, 9 aa, Artificial Sequence
  source: /note="Description of Artificial Sequence: Synthetic peptide"
HLLMCPCGV

SEQ ID NO: 9284 - protein, 9 aa, Artificial Sequence
  source: /note="Description of Artificial Sequence: Synthetic peptide"
WSARLLTHV

SEQ ID NO: 9285 - protein, 9 aa, Artificial Sequence
  source: /note="Description of Artificial Sequence: Synthetic peptide"
HVSMWSAHL

SEQ ID NO: 9286 - protein, 9 aa, Artificial Sequence
  source: /note="Description of Artificial Sequence: Synthetic peptide"
RLLTHVSMW

SEQ ID NO: 9287 - protein, 9 aa, Artificial Sequence
  source: /note="Description of Artificial Sequence: Synthetic peptide"
LTHVSMWSA

SEQ ID NO: 9288 - protein, 9 aa, Artificial Sequence
  source: /note="Description of Artificial Sequence: Synthetic peptide"
HTCQRGVPA

SEQ ID NO: 9289 - protein, 9 aa, Artificial Sequence
  source: /note="Description of Artificial Sequence: Synthetic peptide"
MWSARLLTH

SEQ ID NO: 9290 - protein, 9 aa, Artificial Sequence
  source: /note="Description of Artificial Sequence: Synthetic peptide"
TWSARLLTR

SEQ ID NO: 9291 - protein, 9 aa, Artificial Sequence
  source: /note="Description of Artificial Sequence: Synthetic peptide"
VPTCSHVPM

SEQ ID NO: 9292 - protein, 9 aa, Artificial Sequence
  source: /note="Description of Artificial Sequence: Synthetic peptide"
VPACSRAHV

SEQ ID NO: 9293 - protein, 9 aa, Artificial Sequence
  source: /note="Description of Artificial Sequence: Synthetic peptide"
VPTWSARLL

SEQ ID NO: 9294 - protein, 9 aa, Artificial Sequence
  source: /note="Description of Artificial Sequence: Synthetic peptide"
ARLLTHVSM

SEQ ID NO: 9295 - protein, 9 aa, Artificial Sequence
  source: /note="Description of Artificial Sequence: Synthetic peptide"
THVSMWSAH

SEQ ID NO: 9296 - protein, 9 aa, Artificial Sequence
  source: /note="Description of Artificial Sequence: Synthetic peptide"
VSMWSAHLL

SEQ ID NO: 9297 - protein, 9 aa, Artificial Sequence
  source: /note="Description of Artificial Sequence: Synthetic peptide"
LMCPCGVPT

SEQ ID NO: 9298 - protein, 9 aa, Artificial Sequence
  source: /note="Description of Artificial Sequence: Synthetic peptide"
SHVPMWSAT

SEQ ID NO: 9299 - protein, 10 aa, Artificial Sequence
  source: /note="Description of Artificial Sequence: Synthetic peptide"
LLTHVSMWSA

SEQ ID NO: 9300 - protein, 10 aa, Artificial Sequence
  source: /note="Description of Artificial Sequence: Synthetic peptide"
SMWSAHLLMC

SEQ ID NO: 9301 - protein, 10 aa, Artificial Sequence
  source: /note="Description of Artificial Sequence: Synthetic peptide"
LLMCPCGVPT

SEQ ID NO: 9302 - protein, 10 aa, Artificial Sequence
  source: /note="Description of Artificial Sequence: Synthetic peptide"
HVSMWSAHLL

SEQ ID NO: 9303 - protein, 10 aa, Artificial Sequence
  source: /note="Description of Artificial Sequence: Synthetic peptide"
GVPACSRAHV

SEQ ID NO: 9304 - protein, 10 aa, Artificial Sequence
  source: /note="Description of Artificial Sequence: Synthetic peptide"
SARLLTHVSM

SEQ ID NO: 9305 - protein, 10 aa, Artificial Sequence
  source: /note="Description of Artificial Sequence: Synthetic peptide"
PTWSARLLTR

SEQ ID NO: 9306 - protein, 10 aa, Artificial Sequence
  source: /note="Description of Artificial Sequence: Synthetic peptide"
HVPTWSARLL

SEQ ID NO: 9307 - protein, 10 aa, Artificial Sequence
  source: /note="Description of Artificial Sequence: Synthetic peptide"
ARLLTHVSMW

SEQ ID NO: 9308 - protein, 10 aa, Artificial Sequence
  source: /note="Description of Artificial Sequence: Synthetic peptide"
LTHVSMWSAH

SEQ ID NO: 9309 - protein, 10 aa, Artificial Sequence
  source: /note="Description of Artificial Sequence: Synthetic peptide"
THVSMWSAHL

SEQ ID NO: 9310 - protein, 10 aa, Artificial Sequence
  source: /note="Description of Artificial Sequence: Synthetic peptide"
VSMWSAHLLM

SEQ ID NO: 9311 - protein, 10 aa, Artificial Sequence
  source: /note="Description of Artificial Sequence: Synthetic peptide"
VPTCSHVPMW

SEQ ID NO: 9312 - protein, 10 aa, Artificial Sequence
  source: /note="Description of Artificial Sequence: Synthetic peptide"
VPMWSATCSH

SEQ ID NO: 9313 - protein, 9 aa, Artificial Sequence
  source: /note="Description of Artificial Sequence: Synthetic peptide"
HTCPRGVPA

SEQ ID NO: 9314 - protein, 9 aa, Artificial Sequence
  source: /note="Description of Artificial Sequence: Synthetic peptide"
CPPAHTCPR

SEQ ID NO: 9315 - protein, 9 aa, Artificial Sequence
  source: /note="Description of Artificial Sequence: Synthetic peptide"
RGVPACSHV

SEQ ID NO: 9316 - protein, 9 aa, Artificial Sequence
  source: /note="Description of Artificial Sequence: Synthetic peptide"
HTCPRGVPA

SEQ ID NO: 9317 - protein, 9 aa, Artificial Sequence
  source: /note="Description of Artificial Sequence: Synthetic peptide"
CPPAHTCPR

SEQ ID NO: 9318 - protein, 9 aa, Artificial Sequence
  source: /note="Description of Artificial Sequence: Synthetic peptide"
RGVPACSHV

SEQ ID NO: 9319 - protein, 9 aa, Artificial Sequence
  source: /note="Description of Artificial Sequence: Synthetic peptide"
FLSCRPSQT

SEQ ID NO: 9320 - protein, 9 aa, Artificial Sequence
  source: /note="Description of Artificial Sequence: Synthetic peptide"
TLLPYILLM

SEQ ID NO: 9321 - protein, 9 aa, Artificial Sequence
  source: /note="Description of Artificial Sequence: Synthetic peptide"
LLPYILLMV

SEQ ID NO: 9322 - protein, 9 aa, Artificial Sequence
  source: /note="Description of Artificial Sequence: Synthetic peptide"
CLPAHTCPC

SEQ ID NO: 9323 - protein, 9 aa, Artificial Sequence
  source: /note="Description of Artificial Sequence: Synthetic peptide"
HMCRCGVPA

SEQ ID NO: 9324 - protein, 9 aa, Artificial Sequence
  source: /note="Description of Artificial Sequence: Synthetic peptide"
WSARLLTHV

SEQ ID NO: 9325 - protein, 9 aa, Artificial Sequence
  source: /note="Description of Artificial Sequence: Synthetic peptide"
GSVGFLSCR

SEQ ID NO: 9326 - protein, 9 aa, Artificial Sequence
  source: /note="Description of Artificial Sequence: Synthetic peptide"
VFACSHVPM

SEQ ID NO: 9327 - protein, 9 aa, Artificial Sequence
  source: /note="Description of Artificial Sequence: Synthetic peptide"
RLLTHVPMW

SEQ ID NO: 9328 - protein, 9 aa, Artificial Sequence
  source: /note="Description of Artificial Sequence: Synthetic peptide"
PWHGGSVGF

SEQ ID NO: 9329 - protein, 9 aa, Artificial Sequence
  source: /note="Description of Artificial Sequence: Synthetic peptide"
PYILLMVAF

SEQ ID NO: 9330 - protein, 9 aa, Artificial Sequence
  source: /note="Description of Artificial Sequence: Synthetic peptide"
HTCPCGVFA

SEQ ID NO: 9331 - protein, 9 aa, Artificial Sequence
  source: /note="Description of Artificial Sequence: Synthetic peptide"
SARLLTRAI

SEQ ID NO: 9332 - protein, 9 aa, Artificial Sequence
  source: /note="Description of Artificial Sequence: Synthetic peptide"
LTRAHVECL

SEQ ID NO: 9333 - protein, 9 aa, Artificial Sequence
  source: /note="Description of Artificial Sequence: Synthetic peptide"
RAHVECLPA

SEQ ID NO: 9334 - protein, 9 aa, Artificial Sequence
  source: /note="Description of Artificial Sequence: Synthetic peptide"
MWSARLLTH

SEQ ID NO: 9335 - protein, 9 aa, Artificial Sequence
  source: /note="Description of Artificial Sequence: Synthetic peptide"
RPSQTLLPY

SEQ ID NO: 9336 - protein, 9 aa, Artificial Sequence
  source: /note="Description of Artificial Sequence: Synthetic peptide"
FACSHVPMR

SEQ ID NO: 9337 - protein, 9 aa, Artificial Sequence
  source: /note="Description of Artificial Sequence: Synthetic peptide"
IWSARLLTR

SEQ ID NO: 9338 - protein, 9 aa, Artificial Sequence
  source: /note="Description of Artificial Sequence: Synthetic peptide"
DVECPPAHV

SEQ ID NO: 9339 - protein, 9 aa, Artificial Sequence
  source: /note="Description of Artificial Sequence: Synthetic peptide"
HVPIWSARL

SEQ ID NO: 9340 - protein, 9 aa, Artificial Sequence
  source: /note="Description of Artificial Sequence: Synthetic peptide"
QTLLPYILL

SEQ ID NO: 9341 - protein, 9 aa, Artificial Sequence
  source: /note="Description of Artificial Sequence: Synthetic peptide"
VPACSRADV

SEQ ID NO: 9342 - protein, 9 aa, Artificial Sequence
  source: /note="Description of Artificial Sequence: Synthetic peptide"
VPIWSARLL

SEQ ID NO: 9343 - protein, 9 aa, Artificial Sequence
  source: /note="Description of Artificial Sequence: Synthetic peptide"
LPAHTRAHV

SEQ ID NO: 9344 - protein, 9 aa, Artificial Sequence
  source: /note="Description of Artificial Sequence: Synthetic peptide"
AHTCPCGVF

SEQ ID NO: 9345 - protein, 9 aa, Artificial Sequence
  source: /note="Description of Artificial Sequence: Synthetic peptide"
RAIVECPPA

SEQ ID NO: 9346 - protein, 9 aa, Artificial Sequence
  source: /note="Description of Artificial Sequence: Synthetic peptide"
ARLLTHVPM

SEQ ID NO: 9347 - protein, 9 aa, Artificial Sequence
  source: /note="Description of Artificial Sequence: Synthetic peptide"
AHVECLPAH

SEQ ID NO: 9348 - protein, 9 aa, Artificial Sequence
  source: /note="Description of Artificial Sequence: Synthetic peptide"
LSCRPSQTL

SEQ ID NO: 9349 - protein, 9 aa, Artificial Sequence
  source: /note="Description of Artificial Sequence: Synthetic peptide"
SQTLLPYIL

SEQ ID NO: 9350 - protein, 9 aa, Artificial Sequence
  source: /note="Description of Artificial Sequence: Synthetic peptide"
LPYILLMVA

SEQ ID NO: 9351 - protein, 9 aa, Artificial Sequence
  source: /note="Description of Artificial Sequence: Synthetic peptide"
CPPAHVPIW

SEQ ID NO: 9352 - protein, 9 aa, Artificial Sequence
  source: /note="Description of Artificial Sequence: Synthetic peptide"
CPPAHTKPW

SEQ ID NO: 9353 - protein, 10 aa, Artificial Sequence
  source: /note="Description of Artificial Sequence: Synthetic peptide"
LLTRAHVECL

SEQ ID NO: 9354 - protein, 10 aa, Artificial Sequence
  source: /note="Description of Artificial Sequence: Synthetic peptide"
CLPAHTRAHV

SEQ ID NO: 9355 - protein, 10 aa, Artificial Sequence
  source: /note="Description of Artificial Sequence: Synthetic peptide"
FLSCRPSQTL

SEQ ID NO: 9356 - protein, 10 aa, Artificial Sequence
  source: /note="Description of Artificial Sequence: Synthetic peptide"
TLLPYILLMV

SEQ ID NO: 9357 - protein, 10 aa, Artificial Sequence
  source: /note="Description of Artificial Sequence: Synthetic peptide"
LLPYILLMVA

SEQ ID NO: 9358 - protein, 10 aa, Artificial Sequence
  source: /note="Description of Artificial Sequence: Synthetic peptide"
LLTRADVECL

SEQ ID NO: 9359 - protein, 10 aa, Artificial Sequence
  source: /note="Description of Artificial Sequence: Synthetic peptide"
HVECPPAHTK

SEQ ID NO: 9360 - protein, 10 aa, Artificial Sequence
  source: /note="Description of Artificial Sequence: Synthetic peptide"
GVFACSHVPM

SEQ ID NO: 9361 - protein, 10 aa, Artificial Sequence
  source: /note="Description of Artificial Sequence: Synthetic peptide"
SARLLTRADA

SEQ ID NO: 9362 - protein, 10 aa, Artificial Sequence
  source: /note="Description of Artificial Sequence: Synthetic peptide"
SARLLTRAIV

SEQ ID NO: 9363 - protein, 10 aa, Artificial Sequence
  source: /note="Description of Artificial Sequence: Synthetic peptide"
SARLLTHVPM

SEQ ID NO: 9364 - protein, 10 aa, Artificial Sequence
  source: /note="Description of Artificial Sequence: Synthetic peptide"
HTKPWHGGSV

SEQ ID NO: 9365 - protein, 10 aa, Artificial Sequence
  source: /note="Description of Artificial Sequence: Synthetic peptide"
VFACSHVPMR

SEQ ID NO: 9366 - protein, 10 aa, Artificial Sequence
  source: /note="Description of Artificial Sequence: Synthetic peptide"
PAHVPIWSAR

SEQ ID NO: 9367 - protein, 10 aa, Artificial Sequence
  source: /note="Description of Artificial Sequence: Synthetic peptide"
PIWSARLLTR

SEQ ID NO: 9368 - protein, 10 aa, Artificial Sequence
  source: /note="Description of Artificial Sequence: Synthetic peptide"
HVECLPAHTR

SEQ ID NO: 9369 - protein, 10 aa, Artificial Sequence
  source: /note="Description of Artificial Sequence: Synthetic peptide"
HVPIWSARLL

SEQ ID NO: 9370 - protein, 10 aa, Artificial Sequence
  source: /note="Description of Artificial Sequence: Synthetic peptide"
WSARLLTRAI

SEQ ID NO: 9371 - protein, 10 aa, Artificial Sequence
  source: /note="Description of Artificial Sequence: Synthetic peptide"
KPWHGGSVGF

SEQ ID NO: 9372 - protein, 10 aa, Artificial Sequence
  source: /note="Description of Artificial Sequence: Synthetic peptide"
RPSQTLLPYI

SEQ ID NO: 9373 - protein, 10 aa, Artificial Sequence
  source: /note="Description of Artificial Sequence: Synthetic peptide"
LPYILLMVAF

SEQ ID NO: 9374 - protein, 10 aa, Artificial Sequence
  source: /note="Description of Artificial Sequence: Synthetic peptide"
SRADVGCPPA

SEQ ID NO: 9375 - protein, 10 aa, Artificial Sequence
  source: /note="Description of Artificial Sequence: Synthetic peptide"
ADVGCPPAHM

SEQ ID NO: 9376 - protein, 10 aa, Artificial Sequence
  source: /note="Description of Artificial Sequence: Synthetic peptide"
AHMCRCGVPA

SEQ ID NO: 9377 - protein, 10 aa, Artificial Sequence
  source: /note="Description of Artificial Sequence: Synthetic peptide"
VECPPAHVPI

SEQ ID NO: 9378 - protein, 10 aa, Artificial Sequence
  source: /note="Description of Artificial Sequence: Synthetic peptide"
AHVPIWSARL

SEQ ID NO: 9379 - protein, 10 aa, Artificial Sequence
  source: /note="Description of Artificial Sequence: Synthetic peptide"
RAIVECPPAH

SEQ ID NO: 9380 - protein, 10 aa, Artificial Sequence
  source: /note="Description of Artificial Sequence: Synthetic peptide"
ARLLTHVPMW

SEQ ID NO: 9381 - protein, 10 aa, Artificial Sequence
  source: /note="Description of Artificial Sequence: Synthetic peptide"
RAHVECLPAH

SEQ ID NO: 9382 - protein, 10 aa, Artificial Sequence
  source: /note="Description of Artificial Sequence: Synthetic peptide"
LSCRPSQTLL

SEQ ID NO: 9383 - protein, 10 aa, Artificial Sequence
  source: /note="Description of Artificial Sequence: Synthetic peptide"
CRPSQTLLPY

SEQ ID NO: 9384 - protein, 10 aa, Artificial Sequence
  source: /note="Description of Artificial Sequence: Synthetic peptide"
SQTLLPYILL

SEQ ID NO: 9385 - protein, 10 aa, Artificial Sequence
  source: /note="Description of Artificial Sequence: Synthetic peptide"
VECLPAHTRA

SEQ ID NO: 9386 - protein, 10 aa, Artificial Sequence
  source: /note="Description of Artificial Sequence: Synthetic peptide"
VECPPAHTHA

SEQ ID NO: 9387 - protein, 10 aa, Artificial Sequence
  source: /note="Description of Artificial Sequence: Synthetic peptide"
LPAHTCPCGV

SEQ ID NO: 9388 - protein, 10 aa, Artificial Sequence
  source: /note="Description of Artificial Sequence: Synthetic peptide"
CPPAHTHADV

SEQ ID NO: 9389 - protein, 9 aa, Artificial Sequence
  source: /note="Description of Artificial Sequence: Synthetic peptide"
TWSARLLTR

SEQ ID NO: 9390 - protein, 9 aa, Artificial Sequence
  source: /note="Description of Artificial Sequence: Synthetic peptide"
VPTWSARLL

SEQ ID NO: 9391 - protein, 10 aa, Artificial Sequence
  source: /note="Description of Artificial Sequence: Synthetic peptide"
PTWSARLLTR

SEQ ID NO: 9392 - protein, 10 aa, Artificial Sequence
  source: /note="Description of Artificial Sequence: Synthetic peptide"
HVPTWSARLL

SEQ ID NO: 9393 - protein, 9 aa, Artificial Sequence
  source: /note="Description of Artificial Sequence: Synthetic peptide"
APYKHGWPC

SEQ ID NO: 9394 - protein, 9 aa, Artificial Sequence
  source: /note="Description of Artificial Sequence: Synthetic peptide"
YKHGWPCSA

SEQ ID NO: 9395 - protein, 9 aa, Artificial Sequence
  source: /note="Description of Artificial Sequence: Synthetic peptide"
WPCSACPPS

SEQ ID NO: 9396 - protein, 10 aa, Artificial Sequence
  source: /note="Description of Artificial Sequence: Synthetic peptide"
WPCSACPPSF

SEQ ID NO: 9397 - protein, 10 aa, Artificial Sequence
  source: /note="Description of Artificial Sequence: Synthetic peptide"
YKHGWPCSAC

SEQ ID NO: 9398 - protein, 9 aa, Artificial Sequence
  source: /note="Description of Artificial Sequence: Synthetic peptide"
EPALEKQAL

SEQ ID NO: 9399 - protein, 9 aa, Artificial Sequence
  source: /note="Description of Artificial Sequence: Synthetic peptide"
AESRAEPAL

SEQ ID NO: 9400 - protein, 10 aa, Artificial Sequence
  source: /note="Description of Artificial Sequence: Synthetic peptide"
RLAESRAEPA

SEQ ID NO: 9401 - protein, 10 aa, Artificial Sequence
  source: /note="Description of Artificial Sequence: Synthetic peptide"
ESRAEPALEK

SEQ ID NO: 9402 - protein, 10 aa, Artificial Sequence
  source: /note="Description of Artificial Sequence: Synthetic peptide"
AEPALEKQAL

SEQ ID NO: 9403 - protein, 9 aa, Artificial Sequence
  source: /note="Description of Artificial Sequence: Synthetic peptide"
YLRVHGVVV

SEQ ID NO: 9404 - protein, 9 aa, Artificial Sequence
  source: /note="Description of Artificial Sequence: Synthetic peptide"
GYLRVHGVV

SEQ ID NO: 9405 - protein, 9 aa, Artificial Sequence
  source: /note="Description of Artificial Sequence: Synthetic peptide"
RVHGVVVPM

SEQ ID NO: 9406 - protein, 10 aa, Artificial Sequence
  source: /note="Description of Artificial Sequence: Synthetic peptide"
RVHGVVVPMV

SEQ ID NO: 9407 - protein, 10 aa, Artificial Sequence
  source: /note="Description of Artificial Sequence: Synthetic peptide"
LVGYLRVHGV

SEQ ID NO: 9408 - protein, 10 aa, Artificial Sequence
  source: /note="Description of Artificial Sequence: Synthetic peptide"
GYLRVHGVVV

SEQ ID NO: 9409 - protein, 10 aa, Artificial Sequence
  source: /note="Description of Artificial Sequence: Synthetic peptide"
LRVHGVVVPM

SEQ ID NO: 9410 - protein, 9 aa, Artificial Sequence
  source: /note="Description of Artificial Sequence: Synthetic peptide"
LEESLKNTL

SEQ ID NO: 9411 - protein, 9 aa, Artificial Sequence
  source: /note="Description of Artificial Sequence: Synthetic peptide"
ASALHPLLR

SEQ ID NO: 9412 - protein, 9 aa, Artificial Sequence
  source: /note="Description of Artificial Sequence: Synthetic peptide"
ALHPLLRLF

SEQ ID NO: 9413 - protein, 9 aa, Artificial Sequence
  source: /note="Description of Artificial Sequence: Synthetic peptide"
NASALHPLL

SEQ ID NO: 9414 - protein, 9 aa, Artificial Sequence
  source: /note="Description of Artificial Sequence: Synthetic peptide"
HPLLRLFSL

SEQ ID NO: 9415 - protein, 10 aa, Artificial Sequence
  source: /note="Description of Artificial Sequence: Synthetic peptide"
SALHPLLRLF

SEQ ID NO: 9416 - protein, 10 aa, Artificial Sequence
  source: /note="Description of Artificial Sequence: Synthetic peptide"
NASALHPLLR

SEQ ID NO: 9417 - protein, 10 aa, Artificial Sequence
  source: /note="Description of Artificial Sequence: Synthetic peptide"
VPNASALHPL

SEQ ID NO: 9418 - protein, 9 aa, Artificial Sequence
  source: /note="Description of Artificial Sequence: Synthetic peptide"
NYRGGQYLL

SEQ ID NO: 9419 - protein, 9 aa, Artificial Sequence
  source: /note="Description of Artificial Sequence: Synthetic peptide"
MPNYRGGQY

SEQ ID NO: 9420 - protein, 9 aa, Artificial Sequence
  source: /note="Description of Artificial Sequence: Synthetic peptide"
YEMPNYRGG

SEQ ID NO: 9421 - protein, 10 aa, Artificial Sequence
  source: /note="Description of Artificial Sequence: Synthetic peptide"
EMPNYRGGQY

SEQ ID NO: 9422 - protein, 10 aa, Artificial Sequence
  source: /note="Description of Artificial Sequence: Synthetic peptide"
GQYLLRPGEY

SEQ ID NO: 9423 - protein, 10 aa, Artificial Sequence
  source: /note="Description of Artificial Sequence: Synthetic peptide"
NYRGGQYLLR

SEQ ID NO: 9424 - protein, 10 aa, Artificial Sequence
  source: /note="Description of Artificial Sequence: Synthetic peptide"
MPNYRGGQYL

SEQ ID NO: 9425 - protein, 9 aa, Artificial Sequence
  source: /note="Description of Artificial Sequence: Synthetic peptide"
RYHDWGVQM

SEQ ID NO: 9426 - protein, 9 aa, Artificial Sequence
  source: /note="Description of Artificial Sequence: Synthetic peptide"
GVQMPKSAL

SEQ ID NO: 9427 - protein, 10 aa, Artificial Sequence
  source: /note="Description of Artificial Sequence: Synthetic peptide"
RRYHDWGVQM

SEQ ID NO: 9428 - protein, 10 aa, Artificial Sequence
  source: /note="Description of Artificial Sequence: Synthetic peptide"
WGVQMPKSAL

SEQ ID NO: 9429 - protein, 9 aa, Artificial Sequence
  source: /note="Description of Artificial Sequence: Synthetic peptide"
SWSSGKKNK

SEQ ID NO: 9430 - protein, 9 aa, Artificial Sequence
  source: /note="Description of Artificial Sequence: Synthetic peptide"
SACNIMLLK

SEQ ID NO: 9431 - protein, 9 aa, Artificial Sequence
  source: /note="Description of Artificial Sequence: Synthetic peptide"
GAVSACNIM

SEQ ID NO: 9432 - protein, 10 aa, Artificial Sequence
  source: /note="Description of Artificial Sequence: Synthetic peptide"
AVSACNIMLL

SEQ ID NO: 9433 - protein, 10 aa, Artificial Sequence
  source: /note="Description of Artificial Sequence: Synthetic peptide"
VSACNIMLLK

SEQ ID NO: 9434 - protein, 10 aa, Artificial Sequence
  source: /note="Description of Artificial Sequence: Synthetic peptide"
SACNIMLLKK

SEQ ID NO: 9435 - protein, 10 aa, Artificial Sequence
  source: /note="Description of Artificial Sequence: Synthetic peptide"
HTGAVSACNI

SEQ ID NO: 9436 - protein, 9 aa, Artificial Sequence
  source: /note="Description of Artificial Sequence: Synthetic peptide"
VLREGLSSL

SEQ ID NO: 9437 - protein, 9 aa, Artificial Sequence
  source: /note="Description of Artificial Sequence: Synthetic peptide"
EGLSSLHTR

SEQ ID NO: 9438 - protein, 9 aa, Artificial Sequence
  source: /note="Description of Artificial Sequence: Synthetic peptide"
REGLSSLHT

SEQ ID NO: 9439 - protein, 9 aa, Artificial Sequence
  source: /note="Description of Artificial Sequence: Synthetic peptide"
ATRPGGWNR

SEQ ID NO: 9440 - protein, 9 aa, Artificial Sequence
  source: /note="Description of Artificial Sequence: Synthetic peptide"
RAIATRPGG

SEQ ID NO: 9441 - protein, 9 aa, Artificial Sequence
  source: /note="Description of Artificial Sequence: Synthetic peptide"
EWGLGPPAR

SEQ ID NO: 9442 - protein, 9 aa, Artificial Sequence
  source: /note="Description of Artificial Sequence: Synthetic peptide"
IEWGLGPPA

SEQ ID NO: 9443 - protein, 10 aa, Artificial Sequence
  source: /note="Description of Artificial Sequence: Synthetic peptide"
ATRPGGWNRM

SEQ ID NO: 9444 - protein, 10 aa, Artificial Sequence
  source: /note="Description of Artificial Sequence: Synthetic peptide"
IATRPGGWNR

SEQ ID NO: 9445 - protein, 10 aa, Artificial Sequence
  source: /note="Description of Artificial Sequence: Synthetic peptide"
RAIATRPGGW

SEQ ID NO: 9446 - protein, 10 aa, Artificial Sequence
  source: /note="Description of Artificial Sequence: Synthetic peptide"
IEWGLGPPAR

SEQ ID NO: 9447 - protein, 9 aa, Artificial Sequence
  source: /note="Description of Artificial Sequence: Synthetic peptide"
FMFFCDVDI

SEQ ID NO: 9448 - protein, 9 aa, Artificial Sequence
  source: /note="Description of Artificial Sequence: Synthetic peptide"
EVFMFFCDV

SEQ ID NO: 9449 - protein, 9 aa, Artificial Sequence
  source: /note="Description of Artificial Sequence: Synthetic peptide"
RAWDKGEVF

SEQ ID NO: 9450 - protein, 9 aa, Artificial Sequence
  source: /note="Description of Artificial Sequence: Synthetic peptide"
GEVFMFFCD

SEQ ID NO: 9451 - protein, 10 aa, Artificial Sequence
  source: /note="Description of Artificial Sequence: Synthetic peptide"
AWDKGEVFMF

SEQ ID NO: 9452 - protein, 10 aa, Artificial Sequence
  source: /note="Description of Artificial Sequence: Synthetic peptide"
VFMFFCDVDI

SEQ ID NO: 9453 - protein, 10 aa, Artificial Sequence
  source: /note="Description of Artificial Sequence: Synthetic peptide"
RAWDKGEVFM

SEQ ID NO: 9454 - protein, 10 aa, Artificial Sequence
  source: /note="Description of Artificial Sequence: Synthetic peptide"
FMFFCDVDIY

SEQ ID NO: 9455 - protein, 10 aa, Artificial Sequence
  source: /note="Description of Artificial Sequence: Synthetic peptide"
ARAWDKGEVF

SEQ ID NO: 9456 - protein, 10 aa, Artificial Sequence
  source: /note="Description of Artificial Sequence: Synthetic peptide"
GEVFMFFCDV

SEQ ID NO: 9457 - protein, 9 aa, Artificial Sequence
  source: /note="Description of Artificial Sequence: Synthetic peptide"
SLLLIESQL

SEQ ID NO: 9458 - protein, 9 aa, Artificial Sequence
  source: /note="Description of Artificial Sequence: Synthetic peptide"
LIESQLEPV

SEQ ID NO: 9459 - protein, 9 aa, Artificial Sequence
  source: /note="Description of Artificial Sequence: Synthetic peptide"
SQLEPVRFL

SEQ ID NO: 9460 - protein, 9 aa, Artificial Sequence
  source: /note="Description of Artificial Sequence: Synthetic peptide"
QLEPVRFLR

SEQ ID NO: 9461 - protein, 10 aa, Artificial Sequence
  source: /note="Description of Artificial Sequence: Synthetic peptide"
LLIESQLEPV

SEQ ID NO: 9462 - protein, 10 aa, Artificial Sequence
  source: /note="Description of Artificial Sequence: Synthetic peptide"
SQLEPVRFLR

SEQ ID NO: 9463 - protein, 10 aa, Artificial Sequence
  source: /note="Description of Artificial Sequence: Synthetic peptide"
ISLLLIESQL

SEQ ID NO: 9464 - protein, 10 aa, Artificial Sequence
  source: /note="Description of Artificial Sequence: Synthetic peptide"
IESQLEPVRF

SEQ ID NO: 9465 - protein, 9 aa, Artificial Sequence
  source: /note="Description of Artificial Sequence: Synthetic peptide"
QYLNSLNCV

SEQ ID NO: 9466 - protein, 9 aa, Artificial Sequence
  source: /note="Description of Artificial Sequence: Synthetic peptide"
FPEQYLNSL

SEQ ID NO: 9467 - protein, 10 aa, Artificial Sequence
  source: /note="Description of Artificial Sequence: Synthetic peptide"
GFPEQYLNSL

SEQ ID NO: 9468 - protein, 10 aa, Artificial Sequence
  source: /note="Description of Artificial Sequence: Synthetic peptide"
QYLNSLNCVW

SEQ ID NO: 9469 - protein, 10 aa, Artificial Sequence
  source: /note="Description of Artificial Sequence: Synthetic peptide"
ILSPGFPEQY

SEQ ID NO: 9470 - protein, 10 aa, Artificial Sequence
  source: /note="Description of Artificial Sequence: Synthetic peptide"
EQYLNSLNCV

SEQ ID NO: 9471 - protein, 9 aa, Artificial Sequence
  source: /note="Description of Artificial Sequence: Synthetic peptide"
LRFECKFGF

SEQ ID NO: 9472 - protein, 9 aa, Artificial Sequence
  source: /note="Description of Artificial Sequence: Synthetic peptide"
FECKFGFEL

SEQ ID NO: 9473 - protein, 10 aa, Artificial Sequence
  source: /note="Description of Artificial Sequence: Synthetic peptide"
RFECKFGFEL

SEQ ID NO: 9474 - protein, 10 aa, Artificial Sequence
  source: /note="Description of Artificial Sequence: Synthetic peptide"
VLRFECKFGF

SEQ ID NO: 9475 - protein, 10 aa, Artificial Sequence
  source: /note="Description of Artificial Sequence: Synthetic peptide"
RDVLRFECKF

SEQ ID NO: 9476 - protein, 10 aa, Artificial Sequence
  source: /note="Description of Artificial Sequence: Synthetic peptide"
FECKFGFELI

SEQ ID NO: 9477 - protein, 9 aa, Artificial Sequence
  source: /note="Description of Artificial Sequence: Synthetic peptide"
LNYDVLEVY

SEQ ID NO: 9478 - protein, 9 aa, Artificial Sequence
  source: /note="Description of Artificial Sequence: Synthetic peptide"
EVYDGPNLL

SEQ ID NO: 9479 - protein, 9 aa, Artificial Sequence
  source: /note="Description of Artificial Sequence: Synthetic peptide"
LEVYDGPNL

SEQ ID NO: 9480 - protein, 10 aa, Artificial Sequence
  source: /note="Description of Artificial Sequence: Synthetic peptide"
ELNYDVLEVY

SEQ ID NO: 9481 - protein, 10 aa, Artificial Sequence
  source: /note="Description of Artificial Sequence: Synthetic peptide"
EVYDGPNLLS

SEQ ID NO: 9482 - protein, 10 aa, Artificial Sequence
  source: /note="Description of Artificial Sequence: Synthetic peptide"
LEVYDGPNLL

SEQ ID NO: 9483 - protein, 10 aa, Artificial Sequence
  source: /note="Description of Artificial Sequence: Synthetic peptide"
YDGPNLLSPL

SEQ ID NO: 9484 - protein, 9 aa, Artificial Sequence
  source: /note="Description of Artificial Sequence: Synthetic peptide"
NSLNCKWTV

SEQ ID NO: 9485 - protein, 9 aa, Artificial Sequence
  source: /note="Description of Artificial Sequence: Synthetic peptide"
YPNSLNCKW

SEQ ID NO: 9486 - protein, 10 aa, Artificial Sequence
  source: /note="Description of Artificial Sequence: Synthetic peptide"
SLNCKWTVDV

SEQ ID NO: 9487 - protein, 10 aa, Artificial Sequence
  source: /note="Description of Artificial Sequence: Synthetic peptide"
FYPNSLNCKW

SEQ ID NO: 9488 - protein, 10 aa, Artificial Sequence
  source: /note="Description of Artificial Sequence: Synthetic peptide"
KWTVDVTHGK

SEQ ID NO: 9489 - protein, 10 aa, Artificial Sequence
  source: /note="Description of Artificial Sequence: Synthetic peptide"
EFYPNSLNCK

SEQ ID NO: 9490 - protein, 9 aa, Artificial Sequence
  source: /note="Description of Artificial Sequence: Synthetic peptide"
AHGFKVYYK

SEQ ID NO: 9491 - protein, 10 aa, Artificial Sequence
  source: /note="Description of Artificial Sequence: Synthetic peptide"
SAHGFKVYYK

SEQ ID NO: 9492 - protein, 10 aa, Artificial Sequence
  source: /note="Description of Artificial Sequence: Synthetic peptide"
HGFKVYYKEL

SEQ ID NO: 9493 - protein, 9 aa, Artificial Sequence
  source: /note="Description of Artificial Sequence: Synthetic peptide"
YEELHSSSC

SEQ ID NO: 9494 - protein, 10 aa, Artificial Sequence
  source: /note="Description of Artificial Sequence: Synthetic peptide"
HSSSCGNPGV

SEQ ID NO: 9495 - protein, 9 aa, Artificial Sequence
  source: /note="Description of Artificial Sequence: Synthetic peptide"
FTTSGFFCA

SEQ ID NO: 9496 - protein, 9 aa, Artificial Sequence
  source: /note="Description of Artificial Sequence: Synthetic peptide"
AQLSRLSTK

SEQ ID NO: 9497 - protein, 9 aa, Artificial Sequence
  source: /note="Description of Artificial Sequence: Synthetic peptide"
GFFCAQLSR

SEQ ID NO: 9498 - protein, 9 aa, Artificial Sequence
  source: /note="Description of Artificial Sequence: Synthetic peptide"
LSRLSTKGV

SEQ ID NO: 9499 - protein, 10 aa, Artificial Sequence
  source: /note="Description of Artificial Sequence: Synthetic peptide"
QLSRLSTKGV

SEQ ID NO: 9500 - protein, 10 aa, Artificial Sequence
  source: /note="Description of Artificial Sequence: Synthetic peptide"
SGFFCAQLSR

SEQ ID NO: 9501 - protein, 10 aa, Artificial Sequence
  source: /note="Description of Artificial Sequence: Synthetic peptide"
CAQLSRLSTK

SEQ ID NO: 9502 - protein, 10 aa, Artificial Sequence
  source: /note="Description of Artificial Sequence: Synthetic peptide"
TTSGFFCAQL

SEQ ID NO: 9503 - protein, 10 aa, Artificial Sequence
  source: /note="Description of Artificial Sequence: Synthetic peptide"
AQLSRLSTKG

SEQ ID NO: 9504 - protein, 9 aa, Artificial Sequence
  source: /note="Description of Artificial Sequence: Synthetic peptide"
VVFSCDTGY

SEQ ID NO: 9505 - protein, 10 aa, Artificial Sequence
  source: /note="Description of Artificial Sequence: Synthetic peptide"
VVFSCDTGYH

SEQ ID NO: 9506 - protein, 10 aa, Artificial Sequence
  source: /note="Description of Artificial Sequence: Synthetic peptide"
KTKVVFSCDT

SEQ ID NO: 9507 - protein, 10 aa, Artificial Sequence
  source: /note="Description of Artificial Sequence: Synthetic peptide"
KVVFSCDTGY

SEQ ID NO: 9508 - protein, 10 aa, Artificial Sequence
  source: /note="Description of Artificial Sequence: Synthetic peptide"
FSCDTGYHGL

SEQ ID NO: 9509 - protein, 10 aa, Artificial Sequence
  source: /note="Description of Artificial Sequence: Synthetic peptide"
DTGYHGLGPA

SEQ ID NO: 9510 - protein, 9 aa, Artificial Sequence
  source: /note="Description of Artificial Sequence: Synthetic peptide"
SESENRCLA

SEQ ID NO: 9511 - protein, 9 aa, Artificial Sequence
  source: /note="Description of Artificial Sequence: Synthetic peptide"
SENRCLAGH

SEQ ID NO: 9512 - protein, 10 aa, Artificial Sequence
  source: /note="Description of Artificial Sequence: Synthetic peptide"
VTAEAGSGNA

SEQ ID NO: 9513 - protein, 10 aa, Artificial Sequence
  source: /note="Description of Artificial Sequence: Synthetic peptide"
AEAGSGNAQA

SEQ ID NO: 9514 - protein, 9 aa, Artificial Sequence
  source: /note="Description of Artificial Sequence: Synthetic peptide"
EEAAEEPAA

SEQ ID NO: 9515 - protein, 10 aa, Artificial Sequence
  source: /note="Description of Artificial Sequence: Synthetic peptide"
AEEPAAEEPT

SEQ ID NO: 9516 - protein, 9 aa, Artificial Sequence
  source: /note="Description of Artificial Sequence: Synthetic peptide"
VSLQSENIY

SEQ ID NO: 9517 - protein, 9 aa, Artificial Sequence
  source: /note="Description of Artificial Sequence: Synthetic peptide"
NLQTQQVSL

SEQ ID NO: 9518 - protein, 10 aa, Artificial Sequence
  source: /note="Description of Artificial Sequence: Synthetic peptide"
HIKNLQTQQV

SEQ ID NO: 9519 - protein, 10 aa, Artificial Sequence
  source: /note="Description of Artificial Sequence: Synthetic peptide"
QVSLQSENIY

SEQ ID NO: 9520 - protein, 10 aa, Artificial Sequence
  source: /note="Description of Artificial Sequence: Synthetic peptide"
KNLQTQQVSL

SEQ ID NO: 9521 - protein, 10 aa, Artificial Sequence
  source: /note="Description of Artificial Sequence: Synthetic peptide"
QQVSLQSENI

SEQ ID NO: 9522 - protein, 10 aa, Artificial Sequence
  source: /note="Description of Artificial Sequence: Synthetic peptide"
VSLQSENIYF

SEQ ID NO: 9523 - protein, 9 aa, Artificial Sequence
  source: /note="Description of Artificial Sequence: Synthetic peptide"
RANCVIQRR

SEQ ID NO: 9524 - protein, 9 aa, Artificial Sequence
  source: /note="Description of Artificial Sequence: Synthetic peptide"
KPKRANCVI

SEQ ID NO: 9525 - protein, 10 aa, Artificial Sequence
  source: /note="Description of Artificial Sequence: Synthetic peptide"
KQRKPKRANC

SEQ ID NO: 9526 - protein, 10 aa, Artificial Sequence
  source: /note="Description of Artificial Sequence: Synthetic peptide"
RANCVIQRRA

SEQ ID NO: 9527 - protein, 9 aa, Artificial Sequence
  source: /note="Description of Artificial Sequence: Synthetic peptide"
RANCVIQRR

SEQ ID NO: 9528 - protein, 9 aa, Artificial Sequence
  source: /note="Description of Artificial Sequence: Synthetic peptide"
KPKRANCVI

SEQ ID NO: 9529 - protein, 10 aa, Artificial Sequence
  source: /note="Description of Artificial Sequence: Synthetic peptide"
KQRKPKRANC

SEQ ID NO: 9530 - protein, 10 aa, Artificial Sequence
  source: /note="Description of Artificial Sequence: Synthetic peptide"
RANCVIQRRA

SEQ ID NO: 9531 - protein, 9 aa, Artificial Sequence
  source: /note="Description of Artificial Sequence: Synthetic peptide"
ILQKHGKNV

SEQ ID NO: 9532 - protein, 9 aa, Artificial Sequence
  source: /note="Description of Artificial Sequence: Synthetic peptide"
KHGKNVPKY

SEQ ID NO: 9533 - protein, 10 aa, Artificial Sequence
  source: /note="Description of Artificial Sequence: Synthetic peptide"
KIHILQKHGK

SEQ ID NO: 9534 - protein, 10 aa, Artificial Sequence
  source: /note="Description of Artificial Sequence: Synthetic peptide"
LQKHGKNVPK

SEQ ID NO: 9535 - protein, 10 aa, Artificial Sequence
  source: /note="Description of Artificial Sequence: Synthetic peptide"
QKHGKNVPKY

SEQ ID NO: 9536 - protein, 9 aa, Artificial Sequence
  source: /note="Description of Artificial Sequence: Synthetic peptide"
KLVVFTASM

SEQ ID NO: 9537 - protein, 9 aa, Artificial Sequence
  source: /note="Description of Artificial Sequence: Synthetic peptide"
VVSQWYKLV

SEQ ID NO: 9538 - protein, 9 aa, Artificial Sequence
  source: /note="Description of Artificial Sequence: Synthetic peptide"
SQWYKLVVF

SEQ ID NO: 9539 - protein, 9 aa, Artificial Sequence
  source: /note="Description of Artificial Sequence: Synthetic peptide"
WYKLVVFTA

SEQ ID NO: 9540 - protein, 9 aa, Artificial Sequence
  source: /note="Description of Artificial Sequence: Synthetic peptide"
EVVSQWYKL

SEQ ID NO: 9541 - protein, 9 aa, Artificial Sequence
  source: /note="Description of Artificial Sequence: Synthetic peptide"
YKLVVFTAS

SEQ ID NO: 9542 - protein, 10 aa, Artificial Sequence
  source: /note="Description of Artificial Sequence: Synthetic peptide"
FLEVVSQWYK

SEQ ID NO: 9543 - protein, 10 aa, Artificial Sequence
  source: /note="Description of Artificial Sequence: Synthetic peptide"
VSQWYKLVVF

SEQ ID NO: 9544 - protein, 10 aa, Artificial Sequence
  source: /note="Description of Artificial Sequence: Synthetic peptide"
EVVSQWYKLV

SEQ ID NO: 9545 - protein, 10 aa, Artificial Sequence
  source: /note="Description of Artificial Sequence: Synthetic peptide"
YKLVVFTASM

SEQ ID NO: 9546 - protein, 10 aa, Artificial Sequence
  source: /note="Description of Artificial Sequence: Synthetic peptide"
LEVVSQWYKL

SEQ ID NO: 9547 - protein, 10 aa, Artificial Sequence
  source: /note="Description of Artificial Sequence: Synthetic peptide"
SQWYKLVVFT

SEQ ID NO: 9548 - protein, 10 aa, Artificial Sequence
  source: /note="Description of Artificial Sequence: Synthetic peptide"
RMKAPAKKNP

SEQ ID NO: 9549 - protein, 9 aa, Artificial Sequence
  source: /note="Description of Artificial Sequence: Synthetic peptide"
IMRTYTYEI

SEQ ID NO: 9550 - protein, 9 aa, Artificial Sequence
  source: /note="Description of Artificial Sequence: Synthetic peptide"
YTYEILLWT

SEQ ID NO: 9551 - protein, 9 aa, Artificial Sequence
  source: /note="Description of Artificial Sequence: Synthetic peptide"
ILLWTTSRV

SEQ ID NO: 9552 - protein, 9 aa, Artificial Sequence
  source: /note="Description of Artificial Sequence: Synthetic peptide"
TYTYEILLW

SEQ ID NO: 9553 - protein, 9 aa, Artificial Sequence
  source: /note="Description of Artificial Sequence: Synthetic peptide"
TYEILLWTT

SEQ ID NO: 9554 - protein, 9 aa, Artificial Sequence
  source: /note="Description of Artificial Sequence: Synthetic peptide"
RTYTYEILL

SEQ ID NO: 9555 - protein, 9 aa, Artificial Sequence
  source: /note="Description of Artificial Sequence: Synthetic peptide"
EILLWTTSR

SEQ ID NO: 9556 - protein, 9 aa, Artificial Sequence
  source: /note="Description of Artificial Sequence: Synthetic peptide"
MRTYTYEIL

SEQ ID NO: 9557 - protein, 9 aa, Artificial Sequence
  source: /note="Description of Artificial Sequence: Synthetic peptide"
YEILLWTTS

SEQ ID NO: 9558 - protein, 10 aa, Artificial Sequence
  source: /note="Description of Artificial Sequence: Synthetic peptide"
NIMRTYTYEI

SEQ ID NO: 9559 - protein, 10 aa, Artificial Sequence
  source: /note="Description of Artificial Sequence: Synthetic peptide"
YTYEILLWTT

SEQ ID NO: 9560 - protein, 10 aa, Artificial Sequence
  source: /note="Description of Artificial Sequence: Synthetic peptide"
ILLWTTSRVL

SEQ ID NO: 9561 - protein, 10 aa, Artificial Sequence
  source: /note="Description of Artificial Sequence: Synthetic peptide"
IMRTYTYEIL

SEQ ID NO: 9562 - protein, 10 aa, Artificial Sequence
  source: /note="Description of Artificial Sequence: Synthetic peptide"
RTYTYEILLW

SEQ ID NO: 9563 - protein, 10 aa, Artificial Sequence
  source: /note="Description of Artificial Sequence: Synthetic peptide"
EILLWTTSRV

SEQ ID NO: 9564 - protein, 10 aa, Artificial Sequence
  source: /note="Description of Artificial Sequence: Synthetic peptide"
MRTYTYEILL

SEQ ID NO: 9565 - protein, 10 aa, Artificial Sequence
  source: /note="Description of Artificial Sequence: Synthetic peptide"
YEILLWTTSR

SEQ ID NO: 9566 - protein, 9 aa, Artificial Sequence
  source: /note="Description of Artificial Sequence: Synthetic peptide"
QQSYLDSRI

SEQ ID NO: 9567 - protein, 9 aa, Artificial Sequence
  source: /note="Description of Artificial Sequence: Synthetic peptide"
RIHSGATTT

SEQ ID NO: 9568 - protein, 10 aa, Artificial Sequence
  source: /note="Description of Artificial Sequence: Synthetic peptide"
YLDSRIHSGA

SEQ ID NO: 9569 - protein, 10 aa, Artificial Sequence
  source: /note="Description of Artificial Sequence: Synthetic peptide"
RIHSGATTTA

SEQ ID NO: 9570 - protein, 10 aa, Artificial Sequence
  source: /note="Description of Artificial Sequence: Synthetic peptide"
QQQSYLDSRI

SEQ ID NO: 9571 - protein, 10 aa, Artificial Sequence
  source: /note="Description of Artificial Sequence: Synthetic peptide"
QQSYLDSRIH

SEQ ID NO: 9572 - protein, 9 aa, Artificial Sequence
  source: /note="Description of Artificial Sequence: Synthetic peptide"
QQQSYLDSV

SEQ ID NO: 9573 - protein, 9 aa, Artificial Sequence
  source: /note="Description of Artificial Sequence: Synthetic peptide"
YLDSVIHSG

SEQ ID NO: 9574 - protein, 9 aa, Artificial Sequence
  source: /note="Description of Artificial Sequence: Synthetic peptide"
QQSYLDSVI

SEQ ID NO: 9575 - protein, 10 aa, Artificial Sequence
  source: /note="Description of Artificial Sequence: Synthetic peptide"
WQQQSYLDSV

SEQ ID NO: 9576 - protein, 10 aa, Artificial Sequence
  source: /note="Description of Artificial Sequence: Synthetic peptide"
YLDSVIHSGA

SEQ ID NO: 9577 - protein, 10 aa, Artificial Sequence
  source: /note="Description of Artificial Sequence: Synthetic peptide"
VIHSGATTTA

SEQ ID NO: 9578 - protein, 10 aa, Artificial Sequence
  source: /note="Description of Artificial Sequence: Synthetic peptide"
QQQSYLDSVI

SEQ ID NO: 9579 - protein, 10 aa, Artificial Sequence
  source: /note="Description of Artificial Sequence: Synthetic peptide"
QQSYLDSVIH

SEQ ID NO: 9580 - protein, 9 aa, Artificial Sequence
  source: /note="Description of Artificial Sequence: Synthetic peptide"
YLDSGIPSG

SEQ ID NO: 9581 - protein, 9 aa, Artificial Sequence
  source: /note="Description of Artificial Sequence: Synthetic peptide"
IPSGATTTA

SEQ ID NO: 9582 - protein, 10 aa, Artificial Sequence
  source: /note="Description of Artificial Sequence: Synthetic peptide"
YLDSGIPSGA

SEQ ID NO: 9583 - protein, 9 aa, Artificial Sequence
  source: /note="Description of Artificial Sequence: Synthetic peptide"
YLDSGIHAG

SEQ ID NO: 9584 - protein, 9 aa, Artificial Sequence
  source: /note="Description of Artificial Sequence: Synthetic peptide"
IHAGATTTA

SEQ ID NO: 9585 - protein, 10 aa, Artificial Sequence
  source: /note="Description of Artificial Sequence: Synthetic peptide"
YLDSGIHAGA

SEQ ID NO: 9586 - protein, 10 aa, Artificial Sequence
  source: /note="Description of Artificial Sequence: Synthetic peptide"
GIHAGATTTA

SEQ ID NO: 9587 - protein, 10 aa, Artificial Sequence
  source: /note="Description of Artificial Sequence: Synthetic peptide"
AGATTTAPSL

SEQ ID NO: 9588 - protein, 10 aa, Artificial Sequence
  source: /note="Description of Artificial Sequence: Synthetic peptide"
YLDSGIHCGA

SEQ ID NO: 9589 - protein, 10 aa, Artificial Sequence
  source: /note="Description of Artificial Sequence: Synthetic peptide"
GIHCGATTTA

SEQ ID NO: 9590 - protein, 9 aa, Artificial Sequence
  source: /note="Description of Artificial Sequence: Synthetic peptide"
YLDSGIHFG

SEQ ID NO: 9591 - protein, 9 aa, Artificial Sequence
  source: /note="Description of Artificial Sequence: Synthetic peptide"
SYLDSGIHF

SEQ ID NO: 9592 - protein, 9 aa, Artificial Sequence
  source: /note="Description of Artificial Sequence: Synthetic peptide"
IHFGATTTA

SEQ ID NO: 9593 - protein, 10 aa, Artificial Sequence
  source: /note="Description of Artificial Sequence: Synthetic peptide"
YLDSGIHFGA

SEQ ID NO: 9594 - protein, 10 aa, Artificial Sequence
  source: /note="Description of Artificial Sequence: Synthetic peptide"
GIHFGATTTA

SEQ ID NO: 9595 - protein, 10 aa, Artificial Sequence
  source: /note="Description of Artificial Sequence: Synthetic peptide"
QSYLDSGIHF

SEQ ID NO: 9596 - protein, 10 aa, Artificial Sequence
  source: /note="Description of Artificial Sequence: Synthetic peptide"
IHFGATTTAP

SEQ ID NO: 9597 - protein, 10 aa, Artificial Sequence
  source: /note="Description of Artificial Sequence: Synthetic peptide"
FGATTTAPSL

SEQ ID NO: 9598 - protein, 10 aa, Artificial Sequence
  source: /note="Description of Artificial Sequence: Synthetic peptide"
VQNCLWTLRK

SEQ ID NO: 9599 - protein, 9 aa, Artificial Sequence
  source: /note="Description of Artificial Sequence: Synthetic peptide"
ATAPSLSGK

SEQ ID NO: 9600 - protein, 9 aa, Artificial Sequence
  source: /note="Description of Artificial Sequence: Synthetic peptide"
GATATAPSL

SEQ ID NO: 9601 - protein, 10 aa, Artificial Sequence
  source: /note="Description of Artificial Sequence: Synthetic peptide"
GIHSGATATA

SEQ ID NO: 9602 - protein, 10 aa, Artificial Sequence
  source: /note="Description of Artificial Sequence: Synthetic peptide"
TATAPSLSGK

SEQ ID NO: 9603 - protein, 10 aa, Artificial Sequence
  source: /note="Description of Artificial Sequence: Synthetic peptide"
SGATATAPSL

SEQ ID NO: 9604 - protein, 9 aa, Artificial Sequence
  source: /note="Description of Artificial Sequence: Synthetic peptide"
ITAPSLSGK

SEQ ID NO: 9605 - protein, 9 aa, Artificial Sequence
  source: /note="Description of Artificial Sequence: Synthetic peptide"
SGIHSGATI

SEQ ID NO: 9606 - protein, 10 aa, Artificial Sequence
  source: /note="Description of Artificial Sequence: Synthetic peptide"
TITAPSLSGK

SEQ ID NO: 9607 - protein, 10 aa, Artificial Sequence
  source: /note="Description of Artificial Sequence: Synthetic peptide"
SGATITAPSL

SEQ ID NO: 9608 - protein, 9 aa, Artificial Sequence
  source: /note="Description of Artificial Sequence: Synthetic peptide"
TTAPPLSGK

SEQ ID NO: 9609 - protein, 9 aa, Artificial Sequence
  source: /note="Description of Artificial Sequence: Synthetic peptide"
GATTTAPPL

SEQ ID NO: 9610 - protein, 10 aa, Artificial Sequence
  source: /note="Description of Artificial Sequence: Synthetic peptide"
TTTAPPLSGK

SEQ ID NO: 9611 - protein, 10 aa, Artificial Sequence
  source: /note="Description of Artificial Sequence: Synthetic peptide"
SGATTTAPPL

SEQ ID NO: 9612 - protein, 9 aa, Artificial Sequence
  source: /note="Description of Artificial Sequence: Synthetic peptide"
YLNSGIHSG

SEQ ID NO: 9613 - protein, 9 aa, Artificial Sequence
  source: /note="Description of Artificial Sequence: Synthetic peptide"
QQSYLNSGI

SEQ ID NO: 9614 - protein, 9 aa, Artificial Sequence
  source: /note="Description of Artificial Sequence: Synthetic peptide"
WQQQSYLNS

SEQ ID NO: 9615 - protein, 9 aa, Artificial Sequence
  source: /note="Description of Artificial Sequence: Synthetic peptide"
QQQSYLNSG

SEQ ID NO: 9616 - protein, 10 aa, Artificial Sequence
  source: /note="Description of Artificial Sequence: Synthetic peptide"
YLNSGIHSGA

SEQ ID NO: 9617 - protein, 10 aa, Artificial Sequence
  source: /note="Description of Artificial Sequence: Synthetic peptide"
QQQSYLNSGI

SEQ ID NO: 9618 - protein, 10 aa, Artificial Sequence
  source: /note="Description of Artificial Sequence: Synthetic peptide"
WQQQSYLNSG

SEQ ID NO: 9619 - protein, 10 aa, Artificial Sequence
  source: /note="Description of Artificial Sequence: Synthetic peptide"
QQSYLNSGIH

SEQ ID NO: 9620 - protein, 9 aa, Artificial Sequence
  source: /note="Description of Artificial Sequence: Synthetic peptide"
YLYSGIHSG

SEQ ID NO: 9621 - protein, 9 aa, Artificial Sequence
  source: /note="Description of Artificial Sequence: Synthetic peptide"
QQSYLYSGI

SEQ ID NO: 9622 - protein, 9 aa, Artificial Sequence
  source: /note="Description of Artificial Sequence: Synthetic peptide"
HWQQQSYLY

SEQ ID NO: 9623 - protein, 9 aa, Artificial Sequence
  source: /note="Description of Artificial Sequence: Synthetic peptide"
WQQQSYLYS

SEQ ID NO: 9624 - protein, 9 aa, Artificial Sequence
  source: /note="Description of Artificial Sequence: Synthetic peptide"
QQQSYLYSG

SEQ ID NO: 9625 - protein, 9 aa, Artificial Sequence
  source: /note="Description of Artificial Sequence: Synthetic peptide"
QSYLYSGIH

SEQ ID NO: 9626 - protein, 10 aa, Artificial Sequence
  source: /note="Description of Artificial Sequence: Synthetic peptide"
YLYSGIHSGA

SEQ ID NO: 9627 - protein, 10 aa, Artificial Sequence
  source: /note="Description of Artificial Sequence: Synthetic peptide"
QQQSYLYSGI

SEQ ID NO: 9628 - protein, 10 aa, Artificial Sequence
  source: /note="Description of Artificial Sequence: Synthetic peptide"
SHWQQQSYLY

SEQ ID NO: 9629 - protein, 10 aa, Artificial Sequence
  source: /note="Description of Artificial Sequence: Synthetic peptide"
WQQQSYLYSG

SEQ ID NO: 9630 - protein, 10 aa, Artificial Sequence
  source: /note="Description of Artificial Sequence: Synthetic peptide"
QQSYLYSGIH

SEQ ID NO: 9631 - protein, 9 aa, Artificial Sequence
  source: /note="Description of Artificial Sequence: Synthetic peptide"
YLGSGIHSG

SEQ ID NO: 9632 - protein, 9 aa, Artificial Sequence
  source: /note="Description of Artificial Sequence: Synthetic peptide"
WQQQSYLGS

SEQ ID NO: 9633 - protein, 9 aa, Artificial Sequence
  source: /note="Description of Artificial Sequence: Synthetic peptide"
QQQSYLGSG

SEQ ID NO: 9634 - protein, 9 aa, Artificial Sequence
  source: /note="Description of Artificial Sequence: Synthetic peptide"
QQSYLGSGI

SEQ ID NO: 9635 - protein, 9 aa, Artificial Sequence
  source: /note="Description of Artificial Sequence: Synthetic peptide"
QSYLGSGIH

SEQ ID NO: 9636 - protein, 10 aa, Artificial Sequence
  source: /note="Description of Artificial Sequence: Synthetic peptide"
YLGSGIHSGA

SEQ ID NO: 9637 - protein, 10 aa, Artificial Sequence
  source: /note="Description of Artificial Sequence: Synthetic peptide"
WQQQSYLGSG

SEQ ID NO: 9638 - protein, 10 aa, Artificial Sequence
  source: /note="Description of Artificial Sequence: Synthetic peptide"
QQQSYLGSGI

SEQ ID NO: 9639 - protein, 10 aa, Artificial Sequence
  source: /note="Description of Artificial Sequence: Synthetic peptide"
QQSYLGSGIH

SEQ ID NO: 9640 - protein, 9 aa, Artificial Sequence
  source: /note="Description of Artificial Sequence: Synthetic peptide"
QQSYLVSGI

SEQ ID NO: 9641 - protein, 9 aa, Artificial Sequence
  source: /note="Description of Artificial Sequence: Synthetic peptide"
YLVSGIHSG

SEQ ID NO: 9642 - protein, 9 aa, Artificial Sequence
  source: /note="Description of Artificial Sequence: Synthetic peptide"
LVSGIHSGA

SEQ ID NO: 9643 - protein, 9 aa, Artificial Sequence
  source: /note="Description of Artificial Sequence: Synthetic peptide"
HWQQQSYLV

SEQ ID NO: 9644 - protein, 9 aa, Artificial Sequence
  source: /note="Description of Artificial Sequence: Synthetic peptide"
WQQQSYLVS

SEQ ID NO: 9645 - protein, 9 aa, Artificial Sequence
  source: /note="Description of Artificial Sequence: Synthetic peptide"
QQQSYLVSG

SEQ ID NO: 9646 - protein, 9 aa, Artificial Sequence
  source: /note="Description of Artificial Sequence: Synthetic peptide"
QSYLVSGIH

SEQ ID NO: 9647 - protein, 10 aa, Artificial Sequence
  source: /note="Description of Artificial Sequence: Synthetic peptide"
YLVSGIHSGA

SEQ ID NO: 9648 - protein, 10 aa, Artificial Sequence
  source: /note="Description of Artificial Sequence: Synthetic peptide"
QQQSYLVSGI

SEQ ID NO: 9649 - protein, 10 aa, Artificial Sequence
  source: /note="Description of Artificial Sequence: Synthetic peptide"
SHWQQQSYLV

SEQ ID NO: 9650 - protein, 10 aa, Artificial Sequence
  source: /note="Description of Artificial Sequence: Synthetic peptide"
WQQQSYLVSG

SEQ ID NO: 9651 - protein, 10 aa, Artificial Sequence
  source: /note="Description of Artificial Sequence: Synthetic peptide"
QQSYLVSGIH

SEQ ID NO: 9652 - protein, 9 aa, Artificial Sequence
  source: /note="Description of Artificial Sequence: Synthetic peptide"
YLDPGIHSG

SEQ ID NO: 9653 - protein, 9 aa, Artificial Sequence
  source: /note="Description of Artificial Sequence: Synthetic peptide"
WQQQSYLDP

SEQ ID NO: 9654 - protein, 9 aa, Artificial Sequence
  source: /note="Description of Artificial Sequence: Synthetic peptide"
QQQSYLDPG

SEQ ID NO: 9655 - protein, 9 aa, Artificial Sequence
  source: /note="Description of Artificial Sequence: Synthetic peptide"
QQSYLDPGI

SEQ ID NO: 9656 - protein, 10 aa, Artificial Sequence
  source: /note="Description of Artificial Sequence: Synthetic peptide"
YLDPGIHSGA

SEQ ID NO: 9657 - protein, 10 aa, Artificial Sequence
  source: /note="Description of Artificial Sequence: Synthetic peptide"
WQQQSYLDPG

SEQ ID NO: 9658 - protein, 10 aa, Artificial Sequence
  source: /note="Description of Artificial Sequence: Synthetic peptide"
QQQSYLDPGI

SEQ ID NO: 9659 - protein, 10 aa, Artificial Sequence
  source: /note="Description of Artificial Sequence: Synthetic peptide"
QQSYLDPGIH

SEQ ID NO: 9660 - protein, 9 aa, Artificial Sequence
  source: /note="Description of Artificial Sequence: Synthetic peptide"
YLDYGIHSG

SEQ ID NO: 9661 - protein, 9 aa, Artificial Sequence
  source: /note="Description of Artificial Sequence: Synthetic peptide"
WQQQSYLDY

SEQ ID NO: 9662 - protein, 9 aa, Artificial Sequence
  source: /note="Description of Artificial Sequence: Synthetic peptide"
QQSYLDYGI

SEQ ID NO: 9663 - protein, 10 aa, Artificial Sequence
  source: /note="Description of Artificial Sequence: Synthetic peptide"
YLDYGIHSGA

SEQ ID NO: 9664 - protein, 10 aa, Artificial Sequence
  source: /note="Description of Artificial Sequence: Synthetic peptide"
HWQQQSYLDY

SEQ ID NO: 9665 - protein, 10 aa, Artificial Sequence
  source: /note="Description of Artificial Sequence: Synthetic peptide"
QQQSYLDYGI

SEQ ID NO: 9666 - protein, 10 aa, Artificial Sequence
  source: /note="Description of Artificial Sequence: Synthetic peptide"
QQSYLDYGIH

SEQ ID NO: 9667 - protein, 9 aa, Artificial Sequence
  source: /note="Description of Artificial Sequence: Synthetic peptide"
YLDCGIHSG

SEQ ID NO: 9668 - protein, 9 aa, Artificial Sequence
  source: /note="Description of Artificial Sequence: Synthetic peptide"
WQQQSYLDC

SEQ ID NO: 9669 - protein, 9 aa, Artificial Sequence
  source: /note="Description of Artificial Sequence: Synthetic peptide"
QQSYLDCGI

SEQ ID NO: 9670 - protein, 10 aa, Artificial Sequence
  source: /note="Description of Artificial Sequence: Synthetic peptide"
YLDCGIHSGA

SEQ ID NO: 9671 - protein, 10 aa, Artificial Sequence
  source: /note="Description of Artificial Sequence: Synthetic peptide"
QQQSYLDCGI

SEQ ID NO: 9672 - protein, 10 aa, Artificial Sequence
  source: /note="Description of Artificial Sequence: Synthetic peptide"
QQSYLDCGIH

SEQ ID NO: 9673 - protein, 9 aa, Artificial Sequence
  source: /note="Description of Artificial Sequence: Synthetic peptide"
YLDFGIHSG

SEQ ID NO: 9674 - protein, 9 aa, Artificial Sequence
  source: /note="Description of Artificial Sequence: Synthetic peptide"
WQQQSYLDF

SEQ ID NO: 9675 - protein, 9 aa, Artificial Sequence
  source: /note="Description of Artificial Sequence: Synthetic peptide"
QQSYLDFGI

SEQ ID NO: 9676 - protein, 9 aa, Artificial Sequence
  source: /note="Description of Artificial Sequence: Synthetic peptide"
QSYLDFGIH

SEQ ID NO: 9677 - protein, 10 aa, Artificial Sequence
  source: /note="Description of Artificial Sequence: Synthetic peptide"
YLDFGIHSGA

SEQ ID NO: 9678 - protein, 10 aa, Artificial Sequence
  source: /note="Description of Artificial Sequence: Synthetic peptide"
HWQQQSYLDF

SEQ ID NO: 9679 - protein, 10 aa, Artificial Sequence
  source: /note="Description of Artificial Sequence: Synthetic peptide"
QQQSYLDFGI

SEQ ID NO: 9680 - protein, 10 aa, Artificial Sequence
  source: /note="Description of Artificial Sequence: Synthetic peptide"
QQSYLDFGIH

SEQ ID NO: 9681 - protein, 9 aa, Artificial Sequence
  source: /note="Description of Artificial Sequence: Synthetic peptide"
KIAIKTVMV

SEQ ID NO: 9682 - protein, 9 aa, Artificial Sequence
  source: /note="Description of Artificial Sequence: Synthetic peptide"
KLLPEPCGI

SEQ ID NO: 9683 - protein, 9 aa, Artificial Sequence
  source: /note="Description of Artificial Sequence: Synthetic peptide"
AIKTVMVCL

SEQ ID NO: 9684 - protein, 9 aa, Artificial Sequence
  source: /note="Description of Artificial Sequence: Synthetic peptide"
LVIWTLLKL

SEQ ID NO: 9685 - protein, 9 aa, Artificial Sequence
  source: /note="Description of Artificial Sequence: Synthetic peptide"
RLVIWTLLK

SEQ ID NO: 9686 - protein, 9 aa, Artificial Sequence
  source: /note="Description of Artificial Sequence: Synthetic peptide"
KTVMVCLPL

SEQ ID NO: 9687 - protein, 9 aa, Artificial Sequence
  source: /note="Description of Artificial Sequence: Synthetic peptide"
IFHPMTQSK

SEQ ID NO: 9688 - protein, 9 aa, Artificial Sequence
  source: /note="Description of Artificial Sequence: Synthetic peptide"
QSKWRLWTM

SEQ ID NO: 9689 - protein, 9 aa, Artificial Sequence
  source: /note="Description of Artificial Sequence: Synthetic peptide"
KWRLWTMHC

SEQ ID NO: 9690 - protein, 9 aa, Artificial Sequence
  source: /note="Description of Artificial Sequence: Synthetic peptide"
EPCGIFHPM

SEQ ID NO: 9691 - protein, 9 aa, Artificial Sequence
  source: /note="Description of Artificial Sequence: Synthetic peptide"
NKIAIKTVM

SEQ ID NO: 9692 - protein, 9 aa, Artificial Sequence
  source: /note="Description of Artificial Sequence: Synthetic peptide"
FERLVIWTL

SEQ ID NO: 9693 - protein, 9 aa, Artificial Sequence
  source: /note="Description of Artificial Sequence: Synthetic peptide"
LLPEPCGIF

SEQ ID NO: 9694 - protein, 9 aa, Artificial Sequence
  source: /note="Description of Artificial Sequence: Synthetic peptide"
SKWRLWTMH

SEQ ID NO: 9695 - protein, 9 aa, Artificial Sequence
  source: /note="Description of Artificial Sequence: Synthetic peptide"
WRLWTMHCM

SEQ ID NO: 9696 - protein, 9 aa, Artificial Sequence
  source: /note="Description of Artificial Sequence: Synthetic peptide"
LPEPCGIFH

SEQ ID NO: 9697 - protein, 10 aa, Artificial Sequence
  source: /note="Description of Artificial Sequence: Synthetic peptide"
RLVIWTLLKL

SEQ ID NO: 9698 - protein, 10 aa, Artificial Sequence
  source: /note="Description of Artificial Sequence: Synthetic peptide"
LVIWTLLKLL

SEQ ID NO: 9699 - protein, 10 aa, Artificial Sequence
  source: /note="Description of Artificial Sequence: Synthetic peptide"
GIFHPMTQSK

SEQ ID NO: 9700 - protein, 10 aa, Artificial Sequence
  source: /note="Description of Artificial Sequence: Synthetic peptide"
CFERLVIWTL

SEQ ID NO: 9701 - protein, 10 aa, Artificial Sequence
  source: /note="Description of Artificial Sequence: Synthetic peptide"
KLLPEPCGIF

SEQ ID NO: 9702 - protein, 10 aa, Artificial Sequence
  source: /note="Description of Artificial Sequence: Synthetic peptide"
IFHPMTQSKW

SEQ ID NO: 9703 - protein, 10 aa, Artificial Sequence
  source: /note="Description of Artificial Sequence: Synthetic peptide"
KWRLWTMHCM

SEQ ID NO: 9704 - protein, 10 aa, Artificial Sequence
  source: /note="Description of Artificial Sequence: Synthetic peptide"
HPMTQSKWRL

SEQ ID NO: 9705 - protein, 10 aa, Artificial Sequence
  source: /note="Description of Artificial Sequence: Synthetic peptide"
TQSKWRLWTM

SEQ ID NO: 9706 - protein, 10 aa, Artificial Sequence
  source: /note="Description of Artificial Sequence: Synthetic peptide"
IAIKTVMVCL

SEQ ID NO: 9707 - protein, 10 aa, Artificial Sequence
  source: /note="Description of Artificial Sequence: Synthetic peptide"
IKTVMVCLPL

SEQ ID NO: 9708 - protein, 10 aa, Artificial Sequence
  source: /note="Description of Artificial Sequence: Synthetic peptide"
FERLVIWTLL

SEQ ID NO: 9709 - protein, 10 aa, Artificial Sequence
  source: /note="Description of Artificial Sequence: Synthetic peptide"
LPLCDCFERL

SEQ ID NO: 9710 - protein, 10 aa, Artificial Sequence
  source: /note="Description of Artificial Sequence: Synthetic peptide"
PEPCGIFHPM

SEQ ID NO: 9711 - protein, 9 aa, Artificial Sequence
  source: /note="Description of Artificial Sequence: Synthetic peptide"
FLSIKKRAA

SEQ ID NO: 9712 - protein, 9 aa, Artificial Sequence
  source: /note="Description of Artificial Sequence: Synthetic peptide"
KWFAFLSIK

SEQ ID NO: 9713 - protein, 9 aa, Artificial Sequence
  source: /note="Description of Artificial Sequence: Synthetic peptide"
WFAFLSIKK

SEQ ID NO: 9714 - protein, 9 aa, Artificial Sequence
  source: /note="Description of Artificial Sequence: Synthetic peptide"
LSIKKRAAR

SEQ ID NO: 9715 - protein, 9 aa, Artificial Sequence
  source: /note="Description of Artificial Sequence: Synthetic peptide"
FAFLSIKKR

SEQ ID NO: 9716 - protein, 9 aa, Artificial Sequence
  source: /note="Description of Artificial Sequence: Synthetic peptide"
YKWFAFLSI

SEQ ID NO: 9717 - protein, 9 aa, Artificial Sequence
  source: /note="Description of Artificial Sequence: Synthetic peptide"
NDYKWFAFL

SEQ ID NO: 9718 - protein, 10 aa, Artificial Sequence
  source: /note="Description of Artificial Sequence: Synthetic peptide"
KWFAFLSIKK

SEQ ID NO: 9719 - protein, 10 aa, Artificial Sequence
  source: /note="Description of Artificial Sequence: Synthetic peptide"
DYKWFAFLSI

SEQ ID NO: 9720 - protein, 10 aa, Artificial Sequence
  source: /note="Description of Artificial Sequence: Synthetic peptide"
WFAFLSIKKR

SEQ ID NO: 9721 - protein, 10 aa, Artificial Sequence
  source: /note="Description of Artificial Sequence: Synthetic peptide"
FLSIKKRAAR

SEQ ID NO: 9722 - protein, 9 aa, Artificial Sequence
  source: /note="Description of Artificial Sequence: Synthetic peptide"
GLLQPVGPL

SEQ ID NO: 9723 - protein, 9 aa, Artificial Sequence
  source: /note="Description of Artificial Sequence: Synthetic peptide"
HLREEWYLV

SEQ ID NO: 9724 - protein, 9 aa, Artificial Sequence
  source: /note="Description of Artificial Sequence: Synthetic peptide"
HSRLRHGLL

SEQ ID NO: 9725 - protein, 9 aa, Artificial Sequence
  source: /note="Description of Artificial Sequence: Synthetic peptide"
RLRHGLLQP

SEQ ID NO: 9726 - protein, 9 aa, Artificial Sequence
  source: /note="Description of Artificial Sequence: Synthetic peptide"
QQRQVQHLR

SEQ ID NO: 9727 - protein, 9 aa, Artificial Sequence
  source: /note="Description of Artificial Sequence: Synthetic peptide"
VQHLREEWY

SEQ ID NO: 9728 - protein, 9 aa, Artificial Sequence
  source: /note="Description of Artificial Sequence: Synthetic peptide"
QPVGPLHPL

SEQ ID NO: 9729 - protein, 9 aa, Artificial Sequence
  source: /note="Description of Artificial Sequence: Synthetic peptide"
IGIGTPPPV

SEQ ID NO: 9730 - protein, 9 aa, Artificial Sequence
  source: /note="Description of Artificial Sequence: Synthetic peptide"
LRHGLLQPV

SEQ ID NO: 9731 - protein, 9 aa, Artificial Sequence
  source: /note="Description of Artificial Sequence: Synthetic peptide"
LQTAGHRLL

SEQ ID NO: 9732 - protein, 9 aa, Artificial Sequence
  source: /note="Description of Artificial Sequence: Synthetic peptide"
VQQRQVQHL

SEQ ID NO: 9733 - protein, 9 aa, Artificial Sequence
  source: /note="Description of Artificial Sequence: Synthetic peptide"
RQVQHLREE

SEQ ID NO: 9734 - protein, 10 aa, Artificial Sequence
  source: /note="Description of Artificial Sequence: Synthetic peptide"
RLRHGLLQPV

SEQ ID NO: 9735 - protein, 10 aa, Artificial Sequence
  source: /note="Description of Artificial Sequence: Synthetic peptide"
VLHSRLRHGL

SEQ ID NO: 9736 - protein, 10 aa, Artificial Sequence
  source: /note="Description of Artificial Sequence: Synthetic peptide"
HSRLRHGLLQ

SEQ ID NO: 9737 - protein, 10 aa, Artificial Sequence
  source: /note="Description of Artificial Sequence: Synthetic peptide"
QVQHLREEWY

SEQ ID NO: 9738 - protein, 10 aa, Artificial Sequence
  source: /note="Description of Artificial Sequence: Synthetic peptide"
EIGIGTPPPV

SEQ ID NO: 9739 - protein, 10 aa, Artificial Sequence
  source: /note="Description of Artificial Sequence: Synthetic peptide"
TPPPVLHSRL

SEQ ID NO: 9740 - protein, 10 aa, Artificial Sequence
  source: /note="Description of Artificial Sequence: Synthetic peptide"
HPLQTAGHRL

SEQ ID NO: 9741 - protein, 10 aa, Artificial Sequence
  source: /note="Description of Artificial Sequence: Synthetic peptide"
IGIGTPPPVL

SEQ ID NO: 9742 - protein, 10 aa, Artificial Sequence
  source: /note="Description of Artificial Sequence: Synthetic peptide"
LQPVGPLHPL

SEQ ID NO: 9743 - protein, 10 aa, Artificial Sequence
  source: /note="Description of Artificial Sequence: Synthetic peptide"
RQVQHLREEW

SEQ ID NO: 9744 - protein, 10 aa, Artificial Sequence
  source: /note="Description of Artificial Sequence: Synthetic peptide"
VQHLREEWYL

SEQ ID NO: 9745 - protein, 10 aa, Artificial Sequence
  source: /note="Description of Artificial Sequence: Synthetic peptide"
GEIGIGTPPP

SEQ ID NO: 9746 - protein, 9 aa, Artificial Sequence
  source: /note="Description of Artificial Sequence: Synthetic peptide"
LQAPPMHSL

SEQ ID NO: 9747 - protein, 9 aa, Artificial Sequence
  source: /note="Description of Artificial Sequence: Synthetic peptide"
PQNLQAPPM

SEQ ID NO: 9748 - protein, 10 aa, Artificial Sequence
  source: /note="Description of Artificial Sequence: Synthetic peptide"
NLQAPPMHSL

SEQ ID NO: 9749 - protein, 10 aa, Artificial Sequence
  source: /note="Description of Artificial Sequence: Synthetic peptide"
QTPGIAPQNL

SEQ ID NO: 9750 - protein, 10 aa, Artificial Sequence
  source: /note="Description of Artificial Sequence: Synthetic peptide"
APQNLQAPPM

SEQ ID NO: 9751 - protein, 10 aa, Artificial Sequence
  source: /note="Description of Artificial Sequence: Synthetic peptide"
LQAPPMHSLH

SEQ ID NO: 9752 - protein, 9 aa, Artificial Sequence
  source: /note="Description of Artificial Sequence: Synthetic peptide"
CGKNKQVVL

SEQ ID NO: 9753 - protein, 10 aa, Artificial Sequence
  source: /note="Description of Artificial Sequence: Synthetic peptide"
KLAARLEEEC

SEQ ID NO: 9754 - protein, 10 aa, Artificial Sequence
  source: /note="Description of Artificial Sequence: Synthetic peptide"
AARLEEECGK

SEQ ID NO: 9755 - protein, 9 aa, Artificial Sequence
  source: /note="Description of Artificial Sequence: Synthetic peptide"
ILTCPYGSI

SEQ ID NO: 9756 - protein, 9 aa, Artificial Sequence
  source: /note="Description of Artificial Sequence: Synthetic peptide"
LTCPYGSIK

SEQ ID NO: 9757 - protein, 9 aa, Artificial Sequence
  source: /note="Description of Artificial Sequence: Synthetic peptide"
CGGILTCPY

SEQ ID NO: 9758 - protein, 10 aa, Artificial Sequence
  source: /note="Description of Artificial Sequence: Synthetic peptide"
ILTCPYGSIK

SEQ ID NO: 9759 - protein, 9 aa, Artificial Sequence
  source: /note="Description of Artificial Sequence: Synthetic peptide"
TMRSPHWPQ

SEQ ID NO: 9760 - protein, 9 aa, Artificial Sequence
  source: /note="Description of Artificial Sequence: Synthetic peptide"
IFHSDNGTM

SEQ ID NO: 9761 - protein, 10 aa, Artificial Sequence
  source: /note="Description of Artificial Sequence: Synthetic peptide"
TMRSPHWPQN

SEQ ID NO: 9762 - protein, 10 aa, Artificial Sequence
  source: /note="Description of Artificial Sequence: Synthetic peptide"
IFHSDNGTMR

SEQ ID NO: 9763 - protein, 10 aa, Artificial Sequence
  source: /note="Description of Artificial Sequence: Synthetic peptide"
GIFHSDNGTM

SEQ ID NO: 9764 - protein, 10 aa, Artificial Sequence
  source: /note="Description of Artificial Sequence: Synthetic peptide"
MRSPHWPQNF

SEQ ID NO: 9765 - protein, 9 aa, Artificial Sequence
  source: /note="Description of Artificial Sequence: Synthetic peptide"
KASMISKLK

SEQ ID NO: 9766 - protein, 9 aa, Artificial Sequence
  source: /note="Description of Artificial Sequence: Synthetic peptide"
DAKASMISK

SEQ ID NO: 9767 - protein, 9 aa, Artificial Sequence
  source: /note="Description of Artificial Sequence: Synthetic peptide"
AKASMISKL

SEQ ID NO: 9768 - protein, 10 aa, Artificial Sequence
  source: /note="Description of Artificial Sequence: Synthetic peptide"
SASDDAKASM

SEQ ID NO: 9769 - protein, 9 aa, Artificial Sequence
  source: /note="Description of Artificial Sequence: Synthetic peptide"
ASGNTYAFY

SEQ ID NO: 9770 - protein, 9 aa, Artificial Sequence
  source: /note="Description of Artificial Sequence: Synthetic peptide"
FASGNTYAF

SEQ ID NO: 9771 - protein, 9 aa, Artificial Sequence
  source: /note="Description of Artificial Sequence: Synthetic peptide"
YAFYVRDTL

SEQ ID NO: 9772 - protein, 10 aa, Artificial Sequence
  source: /note="Description of Artificial Sequence: Synthetic peptide"
FASGNTYAFY

SEQ ID NO: 9773 - protein, 10 aa, Artificial Sequence
  source: /note="Description of Artificial Sequence: Synthetic peptide"
EFASGNTYAF

SEQ ID NO: 9774 - protein, 10 aa, Artificial Sequence
  source: /note="Description of Artificial Sequence: Synthetic peptide"
TYAFYVRDTL

SEQ ID NO: 9775 - protein, 10 aa, Artificial Sequence
  source: /note="Description of Artificial Sequence: Synthetic peptide"
SGNTYAFYVR

SEQ ID NO: 9776 - protein, 9 aa, Artificial Sequence
  source: /note="Description of Artificial Sequence: Synthetic peptide"
CLPTEFCEA

SEQ ID NO: 9777 - protein, 9 aa, Artificial Sequence
  source: /note="Description of Artificial Sequence: Synthetic peptide"
LPTEFCEAL

SEQ ID NO: 9778 - protein, 9 aa, Artificial Sequence
  source: /note="Description of Artificial Sequence: Synthetic peptide"
EALDRFSSF

SEQ ID NO: 9779 - protein, 9 aa, Artificial Sequence
  source: /note="Description of Artificial Sequence: Synthetic peptide"
CEALDRFSS

SEQ ID NO: 9780 - protein, 10 aa, Artificial Sequence
  source: /note="Description of Artificial Sequence: Synthetic peptide"
CLPTEFCEAL

SEQ ID NO: 9781 - protein, 10 aa, Artificial Sequence
  source: /note="Description of Artificial Sequence: Synthetic peptide"
EALDRFSSFY

SEQ ID NO: 9782 - protein, 10 aa, Artificial Sequence
  source: /note="Description of Artificial Sequence: Synthetic peptide"
TEFCEALDRF

SEQ ID NO: 9783 - protein, 10 aa, Artificial Sequence
  source: /note="Description of Artificial Sequence: Synthetic peptide"
CEALDRFSSF

SEQ ID NO: 9784 - protein, 9 aa, Artificial Sequence
  source: /note="Description of Artificial Sequence: Synthetic peptide"
LPAPPSFSV

SEQ ID NO: 9785 - protein, 9 aa, Artificial Sequence
  source: /note="Description of Artificial Sequence: Synthetic peptide"
APQPGGAGF

SEQ ID NO: 9786 - protein, 9 aa, Artificial Sequence
  source: /note="Description of Artificial Sequence: Synthetic peptide"
GSLPAPPSF

SEQ ID NO: 9787 - protein, 9 aa, Artificial Sequence
  source: /note="Description of Artificial Sequence: Synthetic peptide"
QPGGAGFQY

SEQ ID NO: 9788 - protein, 10 aa, Artificial Sequence
  source: /note="Description of Artificial Sequence: Synthetic peptide"
SLPAPPSFSV

SEQ ID NO: 9789 - protein, 10 aa, Artificial Sequence
  source: /note="Description of Artificial Sequence: Synthetic peptide"
FSVAPQPGGA

SEQ ID NO: 9790 - protein, 10 aa, Artificial Sequence
  source: /note="Description of Artificial Sequence: Synthetic peptide"
LPAPPSFSVA

SEQ ID NO: 9791 - protein, 10 aa, Artificial Sequence
  source: /note="Description of Artificial Sequence: Synthetic peptide"
RLNILERHAK

SEQ ID NO: 9792 - protein, 9 aa, Artificial Sequence
  source: /note="Description of Artificial Sequence: Synthetic peptide"
KSQRSRQNK

SEQ ID NO: 9793 - protein, 9 aa, Artificial Sequence
  source: /note="Description of Artificial Sequence: Synthetic peptide"
STESQSSSF

SEQ ID NO: 9794 - protein, 9 aa, Artificial Sequence
  source: /note="Description of Artificial Sequence: Synthetic peptide"
SQSSSFHSS

SEQ ID NO: 9795 - protein, 10 aa, Artificial Sequence
  source: /note="Description of Artificial Sequence: Synthetic peptide"
VSTESQSSSF

SEQ ID NO: 9796 - protein, 9 aa, Artificial Sequence
  source: /note="Description of Artificial Sequence: Synthetic peptide"
HHHQQQQQI

SEQ ID NO: 9797 - protein, 9 aa, Artificial Sequence
  source: /note="Description of Artificial Sequence: Synthetic peptide"
RQRRSRSGI

SEQ ID NO: 9798 - protein, 9 aa, Artificial Sequence
  source: /note="Description of Artificial Sequence: Synthetic peptide"
QRRSRSGIK

SEQ ID NO: 9799 - protein, 9 aa, Artificial Sequence
  source: /note="Description of Artificial Sequence: Synthetic peptide"
RSRSGIKGL

SEQ ID NO: 9800 - protein, 10 aa, Artificial Sequence
  source: /note="Description of Artificial Sequence: Synthetic peptide"
RSRSGIKGLK

SEQ ID NO: 9801 - protein, 10 aa, Artificial Sequence
  source: /note="Description of Artificial Sequence: Synthetic peptide"
RQRRSRSGIK

SEQ ID NO: 9802 - protein, 10 aa, Artificial Sequence
  source: /note="Description of Artificial Sequence: Synthetic peptide"
GIKGLKTTRK

SEQ ID NO: 9803 - protein, 10 aa, Artificial Sequence
  source: /note="Description of Artificial Sequence: Synthetic peptide"
RRSRSGIKGL

SEQ ID NO: 9804 - protein, 9 aa, Artificial Sequence
  source: /note="Description of Artificial Sequence: Synthetic peptide"
LPVDNHEKM

SEQ ID NO: 9805 - protein, 9 aa, Artificial Sequence
  source: /note="Description of Artificial Sequence: Synthetic peptide"
HEKMVIQLH

SEQ ID NO: 9806 - protein, 10 aa, Artificial Sequence
  source: /note="Description of Artificial Sequence: Synthetic peptide"
HEKMVIQLHL

SEQ ID NO: 9807 - protein, 10 aa, Artificial Sequence
  source: /note="Description of Artificial Sequence: Synthetic peptide"
LPVDNHEKMV

SEQ ID NO: 9808 - protein, 10 aa, Artificial Sequence
  source: /note="Description of Artificial Sequence: Synthetic peptide"
RYNPQGWLDI

SEQ ID NO: 9809 - protein, 9 aa, Artificial Sequence
  source: /note="Description of Artificial Sequence: Synthetic peptide"
IGRMHRLEL

SEQ ID NO: 9810 - protein, 9 aa, Artificial Sequence
  source: /note="Description of Artificial Sequence: Synthetic peptide"
MHRLELFPK

SEQ ID NO: 9811 - protein, 9 aa, Artificial Sequence
  source: /note="Description of Artificial Sequence: Synthetic peptide"
ELFPKPNEF

SEQ ID NO: 9812 - protein, 9 aa, Artificial Sequence
  source: /note="Description of Artificial Sequence: Synthetic peptide"
GRMHRLELF

SEQ ID NO: 9813 - protein, 10 aa, Artificial Sequence
  source: /note="Description of Artificial Sequence: Synthetic peptide"
RMHRLELFPK

SEQ ID NO: 9814 - protein, 10 aa, Artificial Sequence
  source: /note="Description of Artificial Sequence: Synthetic peptide"
LFPKPNEFTL

SEQ ID NO: 9815 - protein, 10 aa, Artificial Sequence
  source: /note="Description of Artificial Sequence: Synthetic peptide"
NIGRMHRLEL

SEQ ID NO: 9816 - protein, 10 aa, Artificial Sequence
  source: /note="Description of Artificial Sequence: Synthetic peptide"
IGRMHRLELF

SEQ ID NO: 9817 - protein, 10 aa, Artificial Sequence
  source: /note="Description of Artificial Sequence: Synthetic peptide"
LELFPKPNEF

SEQ ID NO: 9818 - protein, 9 aa, Artificial Sequence
  source: /note="Description of Artificial Sequence: Synthetic peptide"
HIMKHNHYI

SEQ ID NO: 9819 - protein, 9 aa, Artificial Sequence
  source: /note="Description of Artificial Sequence: Synthetic peptide"
YISRFGSKL

SEQ ID NO: 9820 - protein, 9 aa, Artificial Sequence
  source: /note="Description of Artificial Sequence: Synthetic peptide"
HYISRFGSK

SEQ ID NO: 9821 - protein, 9 aa, Artificial Sequence
  source: /note="Description of Artificial Sequence: Synthetic peptide"
ISRFGSKLG

SEQ ID NO: 9822 - protein, 9 aa, Artificial Sequence
  source: /note="Description of Artificial Sequence: Synthetic peptide"
KHNHYISRF

SEQ ID NO: 9823 - protein, 10 aa, Artificial Sequence
  source: /note="Description of Artificial Sequence: Synthetic peptide"
HYISRFGSKL

SEQ ID NO: 9824 - protein, 10 aa, Artificial Sequence
  source: /note="Description of Artificial Sequence: Synthetic peptide"
IMKHNHYISR

SEQ ID NO: 9825 - protein, 10 aa, Artificial Sequence
  source: /note="Description of Artificial Sequence: Synthetic peptide"
NHYISRFGSK

SEQ ID NO: 9826 - protein, 10 aa, Artificial Sequence
  source: /note="Description of Artificial Sequence: Synthetic peptide"
ISRFGSKLGL

SEQ ID NO: 9827 - protein, 10 aa, Artificial Sequence
  source: /note="Description of Artificial Sequence: Synthetic peptide"
MKHNHYISRF

SEQ ID NO: 9828 - protein, 10 aa, Artificial Sequence
  source: /note="Description of Artificial Sequence: Synthetic peptide"
FHIMKHNHYI

SEQ ID NO: 9829 - protein, 9 aa, Artificial Sequence
  source: /note="Description of Artificial Sequence: Synthetic peptide"
LLQQLEFSM

SEQ ID NO: 9830 - protein, 9 aa, Artificial Sequence
  source: /note="Description of Artificial Sequence: Synthetic peptide"
FSMPPGVKV

SEQ ID NO: 9831 - protein, 9 aa, Artificial Sequence
  source: /note="Description of Artificial Sequence: Synthetic peptide"
MPPGVKVDL

SEQ ID NO: 9832 - protein, 9 aa, Artificial Sequence
  source: /note="Description of Artificial Sequence: Synthetic peptide"
QQLEFSMPP

SEQ ID NO: 9833 - protein, 9 aa, Artificial Sequence
  source: /note="Description of Artificial Sequence: Synthetic peptide"
LEFSMPPGV

SEQ ID NO: 9834 - protein, 10 aa, Artificial Sequence
  source: /note="Description of Artificial Sequence: Synthetic peptide"
ILLQQLEFSM

SEQ ID NO: 9835 - protein, 10 aa, Artificial Sequence
  source: /note="Description of Artificial Sequence: Synthetic peptide"
QLEFSMPPGV

SEQ ID NO: 9836 - protein, 10 aa, Artificial Sequence
  source: /note="Description of Artificial Sequence: Synthetic peptide"
SMPPGVKVDL

SEQ ID NO: 9837 - protein, 10 aa, Artificial Sequence
  source: /note="Description of Artificial Sequence: Synthetic peptide"
LQQLEFSMPP

SEQ ID NO: 9838 - protein, 10 aa, Artificial Sequence
  source: /note="Description of Artificial Sequence: Synthetic peptide"
QQLEFSMPPG

SEQ ID NO: 9839 - protein, 9 aa, Artificial Sequence
  source: /note="Description of Artificial Sequence: Synthetic peptide"
ASAQLLEQV

SEQ ID NO: 9840 - protein, 9 aa, Artificial Sequence
  source: /note="Description of Artificial Sequence: Synthetic peptide"
HVNLASAQL

SEQ ID NO: 9841 - protein, 9 aa, Artificial Sequence
  source: /note="Description of Artificial Sequence: Synthetic peptide"
VNLASAQLL

SEQ ID NO: 9842 - protein, 9 aa, Artificial Sequence
  source: /note="Description of Artificial Sequence: Synthetic peptide"
SAQLLEQVM

SEQ ID NO: 9843 - protein, 10 aa, Artificial Sequence
  source: /note="Description of Artificial Sequence: Synthetic peptide"
LASAQLLEQV

SEQ ID NO: 9844 - protein, 10 aa, Artificial Sequence
  source: /note="Description of Artificial Sequence: Synthetic peptide"
HVNLASAQLL

SEQ ID NO: 9845 - protein, 10 aa, Artificial Sequence
  source: /note="Description of Artificial Sequence: Synthetic peptide"
MHVNLASAQL

SEQ ID NO: 9846 - protein, 10 aa, Artificial Sequence
  source: /note="Description of Artificial Sequence: Synthetic peptide"
ASAQLLEQVM

SEQ ID NO: 9847 - protein, 9 aa, Artificial Sequence
  source: /note="Description of Artificial Sequence: Synthetic peptide"
IAREELFLF

SEQ ID NO: 9848 - protein, 9 aa, Artificial Sequence
  source: /note="Description of Artificial Sequence: Synthetic peptide"
AREELFLFF

SEQ ID NO: 9849 - protein, 9 aa, Artificial Sequence
  source: /note="Description of Artificial Sequence: Synthetic peptide"
EELFLFFTT

SEQ ID NO: 9850 - protein, 9 aa, Artificial Sequence
  source: /note="Description of Artificial Sequence: Synthetic peptide"
GEGIAREEL

SEQ ID NO: 9851 - protein, 9 aa, Artificial Sequence
  source: /note="Description of Artificial Sequence: Synthetic peptide"
REELFLFFT

SEQ ID NO: 9852 - protein, 10 aa, Artificial Sequence
  source: /note="Description of Artificial Sequence: Synthetic peptide"
GIAREELFLF

SEQ ID NO: 9853 - protein, 10 aa, Artificial Sequence
  source: /note="Description of Artificial Sequence: Synthetic peptide"
IAREELFLFF

SEQ ID NO: 9854 - protein, 10 aa, Artificial Sequence
  source: /note="Description of Artificial Sequence: Synthetic peptide"
EELFLFFTTI

SEQ ID NO: 9855 - protein, 10 aa, Artificial Sequence
  source: /note="Description of Artificial Sequence: Synthetic peptide"
GEGIAREELF

SEQ ID NO: 9856 - protein, 10 aa, Artificial Sequence
  source: /note="Description of Artificial Sequence: Synthetic peptide"
REELFLFFTT

SEQ ID NO: 9857 - protein, 9 aa, Artificial Sequence
  source: /note="Description of Artificial Sequence: Synthetic peptide"
MGDQARMPY

SEQ ID NO: 9858 - protein, 9 aa, Artificial Sequence
  source: /note="Description of Artificial Sequence: Synthetic peptide"
RMPYTTAVI

SEQ ID NO: 9859 - protein, 9 aa, Artificial Sequence
  source: /note="Description of Artificial Sequence: Synthetic peptide"
QARMPYTTA

SEQ ID NO: 9860 - protein, 9 aa, Artificial Sequence
  source: /note="Description of Artificial Sequence: Synthetic peptide"
ARMPYTTAV

SEQ ID NO: 9861 - protein, 10 aa, Artificial Sequence
  source: /note="Description of Artificial Sequence: Synthetic peptide"
QARMPYTTAV

SEQ ID NO: 9862 - protein, 10 aa, Artificial Sequence
  source: /note="Description of Artificial Sequence: Synthetic peptide"
EMGDQARMPY

SEQ ID NO: 9863 - protein, 10 aa, Artificial Sequence
  source: /note="Description of Artificial Sequence: Synthetic peptide"
RPEMGDQARM

SEQ ID NO: 9864 - protein, 10 aa, Artificial Sequence
  source: /note="Description of Artificial Sequence: Synthetic peptide"
ARMPYTTAVI

SEQ ID NO: 9865 - protein, 10 aa, Artificial Sequence
  source: /note="Description of Artificial Sequence: Synthetic peptide"
RMPYTTAVIH

SEQ ID NO: 9866 - protein, 9 aa, Artificial Sequence
  source: /note="Description of Artificial Sequence: Synthetic peptide"
LGQDSPLEF

SEQ ID NO: 9867 - protein, 9 aa, Artificial Sequence
  source: /note="Description of Artificial Sequence: Synthetic peptide"
GQDSPLEFF

SEQ ID NO: 9868 - protein, 9 aa, Artificial Sequence
  source: /note="Description of Artificial Sequence: Synthetic peptide"
LEFFQHVSL

SEQ ID NO: 9869 - protein, 9 aa, Artificial Sequence
  source: /note="Description of Artificial Sequence: Synthetic peptide"
EFFQHVSLM

SEQ ID NO: 9870 - protein, 9 aa, Artificial Sequence
  source: /note="Description of Artificial Sequence: Synthetic peptide"
SPLEFFQHV

SEQ ID NO: 9871 - protein, 10 aa, Artificial Sequence
  source: /note="Description of Artificial Sequence: Synthetic peptide"
FFQHVSLMTL

SEQ ID NO: 9872 - protein, 10 aa, Artificial Sequence
  source: /note="Description of Artificial Sequence: Synthetic peptide"
DSPLEFFQHV

SEQ ID NO: 9873 - protein, 10 aa, Artificial Sequence
  source: /note="Description of Artificial Sequence: Synthetic peptide"
LLGQDSPLEF

SEQ ID NO: 9874 - protein, 10 aa, Artificial Sequence
  source: /note="Description of Artificial Sequence: Synthetic peptide"
LEFFQHVSLM

SEQ ID NO: 9875 - protein, 10 aa, Artificial Sequence
  source: /note="Description of Artificial Sequence: Synthetic peptide"
LGQDSPLEFF

SEQ ID NO: 9876 - protein, 9 aa, Artificial Sequence
  source: /note="Description of Artificial Sequence: Synthetic peptide"
SLRFSTDNA

SEQ ID NO: 9877 - protein, 9 aa, Artificial Sequence
  source: /note="Description of Artificial Sequence: Synthetic peptide"
RFSTDNASK

SEQ ID NO: 9878 - protein, 10 aa, Artificial Sequence
  source: /note="Description of Artificial Sequence: Synthetic peptide"
TDNASKRHPF

SEQ ID NO: 9879 - protein, 9 aa, Artificial Sequence
  source: /note="Description of Artificial Sequence: Synthetic peptide"
QTKGSGFPI

SEQ ID NO: 9880 - protein, 10 aa, Artificial Sequence
  source: /note="Description of Artificial Sequence: Synthetic peptide"
RLLQSTGQTK

SEQ ID NO: 9881 - protein, 10 aa, Artificial Sequence
  source: /note="Description of Artificial Sequence: Synthetic peptide"
GQTKGSGFPI

SEQ ID NO: 9882 - protein, 10 aa, Artificial Sequence
  source: /note="Description of Artificial Sequence: Synthetic peptide"
TKGSGFPIHL

SEQ ID NO: 9883 - protein, 9 aa, Artificial Sequence
  source: /note="Description of Artificial Sequence: Synthetic peptide"
CFSCRSAAK

SEQ ID NO: 9884 - protein, 9 aa, Artificial Sequence
  source: /note="Description of Artificial Sequence: Synthetic peptide"
FSCRSAAKR

SEQ ID NO: 9885 - protein, 9 aa, Artificial Sequence
  source: /note="Description of Artificial Sequence: Synthetic peptide"
RSAAKRDKW

SEQ ID NO: 9886 - protein, 10 aa, Artificial Sequence
  source: /note="Description of Artificial Sequence: Synthetic peptide"
KCFSCRSAAK

SEQ ID NO: 9887 - protein, 10 aa, Artificial Sequence
  source: /note="Description of Artificial Sequence: Synthetic peptide"
SCRSAAKRDK

SEQ ID NO: 9888 - protein, 10 aa, Artificial Sequence
  source: /note="Description of Artificial Sequence: Synthetic peptide"
CFSCRSAAKR

SEQ ID NO: 9889 - protein, 10 aa, Artificial Sequence
  source: /note="Description of Artificial Sequence: Synthetic peptide"
AKRDKWMENL

SEQ ID NO: 9890 - protein, 9 aa, Artificial Sequence
  source: /note="Description of Artificial Sequence: Synthetic peptide"
FESKCREQV

SEQ ID NO: 9891 - protein, 10 aa, Artificial Sequence
  source: /note="Description of Artificial Sequence: Synthetic peptide"
EALEFESKCR

SEQ ID NO: 9892 - protein, 9 aa, Artificial Sequence
  source: /note="Description of Artificial Sequence: Synthetic peptide"
KLREQVEQA

SEQ ID NO: 9893 - protein, 9 aa, Artificial Sequence
  source: /note="Description of Artificial Sequence: Synthetic peptide"
EALEFESKL

SEQ ID NO: 9894 - protein, 9 aa, Artificial Sequence
  source: /note="Description of Artificial Sequence: Synthetic peptide"
FESKLREQV

SEQ ID NO: 9895 - protein, 10 aa, Artificial Sequence
  source: /note="Description of Artificial Sequence: Synthetic peptide"
KLREQVEQAL

SEQ ID NO: 9896 - protein, 10 aa, Artificial Sequence
  source: /note="Description of Artificial Sequence: Synthetic peptide"
EALEFESKLR

SEQ ID NO: 9897 - protein, 10 aa, Artificial Sequence
  source: /note="Description of Artificial Sequence: Synthetic peptide"
QEALEFESKL

SEQ ID NO: 9898 - protein, 9 aa, Artificial Sequence
  source: /note="Description of Artificial Sequence: Synthetic peptide"
NLDSVSSIL

SEQ ID NO: 9899 - protein, 9 aa, Artificial Sequence
  source: /note="Description of Artificial Sequence: Synthetic peptide"
ILLQSTESK

SEQ ID NO: 9900 - protein, 10 aa, Artificial Sequence
  source: /note="Description of Artificial Sequence: Synthetic peptide"
NLDSVSSILL

SEQ ID NO: 9901 - protein, 10 aa, Artificial Sequence
  source: /note="Description of Artificial Sequence: Synthetic peptide"
ILLQSTESKL

SEQ ID NO: 9902 - protein, 10 aa, Artificial Sequence
  source: /note="Description of Artificial Sequence: Synthetic peptide"
SILLQSTESK

SEQ ID NO: 9903 - protein, 10 aa, Artificial Sequence
  source: /note="Description of Artificial Sequence: Synthetic peptide"
YDNLDSVSSI

SEQ ID NO: 9904 - protein, 9 aa, Artificial Sequence
  source: /note="Description of Artificial Sequence: Synthetic peptide"
KSFPEIYFL

SEQ ID NO: 9905 - protein, 9 aa, Artificial Sequence
  source: /note="Description of Artificial Sequence: Synthetic peptide"
SFPEIYFLG

SEQ ID NO: 9906 - protein, 9 aa, Artificial Sequence
  source: /note="Description of Artificial Sequence: Synthetic peptide"
QFKSFPEIY

SEQ ID NO: 9907 - protein, 9 aa, Artificial Sequence
  source: /note="Description of Artificial Sequence: Synthetic peptide"
FKSFPEIYF

SEQ ID NO: 9908 - protein, 10 aa, Artificial Sequence
  source: /note="Description of Artificial Sequence: Synthetic peptide"
QFKSFPEIYF

SEQ ID NO: 9909 - protein, 10 aa, Artificial Sequence
  source: /note="Description of Artificial Sequence: Synthetic peptide"
HQFKSFPEIY

SEQ ID NO: 9910 - protein, 10 aa, Artificial Sequence
  source: /note="Description of Artificial Sequence: Synthetic peptide"
FKSFPEIYFL

SEQ ID NO: 9911 - protein, 9 aa, Artificial Sequence
  source: /note="Description of Artificial Sequence: Synthetic peptide"
PVYAHIHPR

SEQ ID NO: 9912 - protein, 9 aa, Artificial Sequence
  source: /note="Description of Artificial Sequence: Synthetic peptide"
HIHPRDVEA

SEQ ID NO: 9913 - protein, 10 aa, Artificial Sequence
  source: /note="Description of Artificial Sequence: Synthetic peptide"
HIHPRDVEAI

SEQ ID NO: 9914 - protein, 10 aa, Artificial Sequence
  source: /note="Description of Artificial Sequence: Synthetic peptide"
VYAHIHPRDV

SEQ ID NO: 9915 - protein, 10 aa, Artificial Sequence
  source: /note="Description of Artificial Sequence: Synthetic peptide"
LPVYAHIHPR

SEQ ID NO: 9916 - protein, 9 aa, Artificial Sequence
  source: /note="Description of Artificial Sequence: Synthetic peptide"
LVSSRFVHL

SEQ ID NO: 9917 - protein, 9 aa, Artificial Sequence
  source: /note="Description of Artificial Sequence: Synthetic peptide"
SSRFVHLSW

SEQ ID NO: 9918 - protein, 9 aa, Artificial Sequence
  source: /note="Description of Artificial Sequence: Synthetic peptide"
VLVSSRFVH

SEQ ID NO: 9919 - protein, 9 aa, Artificial Sequence
  source: /note="Description of Artificial Sequence: Synthetic peptide"
VHLSWRPPA

SEQ ID NO: 9920 - protein, 10 aa, Artificial Sequence
  source: /note="Description of Artificial Sequence: Synthetic peptide"
VLVSSRFVHL

SEQ ID NO: 9921 - protein, 10 aa, Artificial Sequence
  source: /note="Description of Artificial Sequence: Synthetic peptide"
FVHLSWRPPA

SEQ ID NO: 9922 - protein, 10 aa, Artificial Sequence
  source: /note="Description of Artificial Sequence: Synthetic peptide"
HLSWRPPAEA

SEQ ID NO: 9923 - protein, 10 aa, Artificial Sequence
  source: /note="Description of Artificial Sequence: Synthetic peptide"
SSRFVHLSWR

SEQ ID NO: 9924 - protein, 10 aa, Artificial Sequence
  source: /note="Description of Artificial Sequence: Synthetic peptide"
VSSRFVHLSW

SEQ ID NO: 9925 - protein, 9 aa, Artificial Sequence
  source: /note="Description of Artificial Sequence: Synthetic peptide"
SPPRRARPC

SEQ ID NO: 9926 - protein, 9 aa, Artificial Sequence
  source: /note="Description of Artificial Sequence: Synthetic peptide"
KLFHSEYPY

SEQ ID NO: 9927 - protein, 9 aa, Artificial Sequence
  source: /note="Description of Artificial Sequence: Synthetic peptide"
LFHSEYPYK

SEQ ID NO: 9928 - protein, 9 aa, Artificial Sequence
  source: /note="Description of Artificial Sequence: Synthetic peptide"
NFHVETKLF

SEQ ID NO: 9929 - protein, 9 aa, Artificial Sequence
  source: /note="Description of Artificial Sequence: Synthetic peptide"
ETKLFHSEY

SEQ ID NO: 9930 - protein, 10 aa, Artificial Sequence
  source: /note="Description of Artificial Sequence: Synthetic peptide"
KLFHSEYPYK

SEQ ID NO: 9931 - protein, 10 aa, Artificial Sequence
  source: /note="Description of Artificial Sequence: Synthetic peptide"
NNFHVETKLF

SEQ ID NO: 9932 - protein, 10 aa, Artificial Sequence
  source: /note="Description of Artificial Sequence: Synthetic peptide"
VETKLFHSEY

SEQ ID NO: 9933 - protein, 10 aa, Artificial Sequence
  source: /note="Description of Artificial Sequence: Synthetic peptide"
TKLFHSEYPY

SEQ ID NO: 9934 - protein, 9 aa, Artificial Sequence
  source: /note="Description of Artificial Sequence: Synthetic peptide"
YLKLGDFGL

SEQ ID NO: 9935 - protein, 9 aa, Artificial Sequence
  source: /note="Description of Artificial Sequence: Synthetic peptide"
CEYPDGTKY

SEQ ID NO: 9936 - protein, 9 aa, Artificial Sequence
  source: /note="Description of Artificial Sequence: Synthetic peptide"
TKYLKLGDF

SEQ ID NO: 9937 - protein, 10 aa, Artificial Sequence
  source: /note="Description of Artificial Sequence: Synthetic peptide"
YLKLGDFGLA

SEQ ID NO: 9938 - protein, 10 aa, Artificial Sequence
  source: /note="Description of Artificial Sequence: Synthetic peptide"
KYLKLGDFGL

SEQ ID NO: 9939 - protein, 10 aa, Artificial Sequence
  source: /note="Description of Artificial Sequence: Synthetic peptide"
YPDGTKYLKL

SEQ ID NO: 9940 - protein, 10 aa, Artificial Sequence
  source: /note="Description of Artificial Sequence: Synthetic peptide"
CEYPDGTKYL

SEQ ID NO: 9941 - protein, 9 aa, Artificial Sequence
  source: /note="Description of Artificial Sequence: Synthetic peptide"
RLFILSHMH

SEQ ID NO: 9942 - protein, 9 aa, Artificial Sequence
  source: /note="Description of Artificial Sequence: Synthetic peptide"
RAGTARLFI

SEQ ID NO: 9943 - protein, 9 aa, Artificial Sequence
  source: /note="Description of Artificial Sequence: Synthetic peptide"
ARLFILSHM

SEQ ID NO: 9944 - protein, 10 aa, Artificial Sequence
  source: /note="Description of Artificial Sequence: Synthetic peptide"
ILSHMHSDHT

SEQ ID NO: 9945 - protein, 10 aa, Artificial Sequence
  source: /note="Description of Artificial Sequence: Synthetic peptide"
GTARLFILSH

SEQ ID NO: 9946 - protein, 10 aa, Artificial Sequence
  source: /note="Description of Artificial Sequence: Synthetic peptide"
RAGTARLFIL

SEQ ID NO: 9947 - protein, 10 aa, Artificial Sequence
  source: /note="Description of Artificial Sequence: Synthetic peptide"
TARLFILSHM

SEQ ID NO: 9948 - protein, 10 aa, Artificial Sequence
  source: /note="Description of Artificial Sequence: Synthetic peptide"
RRAGTARLFI

SEQ ID NO: 9949 - protein, 9 aa, Artificial Sequence
  source: /note="Description of Artificial Sequence: Synthetic peptide"
RLQKGYTPL

SEQ ID NO: 9950 - protein, 9 aa, Artificial Sequence
  source: /note="Description of Artificial Sequence: Synthetic peptide"
FLQYRRLQK

SEQ ID NO: 9951 - protein, 9 aa, Artificial Sequence
  source: /note="Description of Artificial Sequence: Synthetic peptide"
LQKGYTPLM

SEQ ID NO: 9952 - protein, 9 aa, Artificial Sequence
  source: /note="Description of Artificial Sequence: Synthetic peptide"
QYRRLQKGY

SEQ ID NO: 9953 - protein, 9 aa, Artificial Sequence
  source: /note="Description of Artificial Sequence: Synthetic peptide"
LQYRRLQKG

SEQ ID NO: 9954 - protein, 10 aa, Artificial Sequence
  source: /note="Description of Artificial Sequence: Synthetic peptide"
RLQKGYTPLM

SEQ ID NO: 9955 - protein, 10 aa, Artificial Sequence
  source: /note="Description of Artificial Sequence: Synthetic peptide"
AFLQYRRLQK

SEQ ID NO: 9956 - protein, 10 aa, Artificial Sequence
  source: /note="Description of Artificial Sequence: Synthetic peptide"
LQYRRLQKGY

SEQ ID NO: 9957 - protein, 10 aa, Artificial Sequence
  source: /note="Description of Artificial Sequence: Synthetic peptide"
RRLQKGYTPL

SEQ ID NO: 9958 - protein, 9 aa, Artificial Sequence
  source: /note="Description of Artificial Sequence: Synthetic peptide"
LLLGKIWPP

SEQ ID NO: 9959 - protein, 9 aa, Artificial Sequence
  source: /note="Description of Artificial Sequence: Synthetic peptide"
LLGKIWPPF

SEQ ID NO: 9960 - protein, 9 aa, Artificial Sequence
  source: /note="Description of Artificial Sequence: Synthetic peptide"
KIWPPFPVF

SEQ ID NO: 9961 - protein, 9 aa, Artificial Sequence
  source: /note="Description of Artificial Sequence: Synthetic peptide"
PFPVFHQFL

SEQ ID NO: 9962 - protein, 9 aa, Artificial Sequence
  source: /note="Description of Artificial Sequence: Synthetic peptide"
GKIWPPFPV

SEQ ID NO: 9963 - protein, 9 aa, Artificial Sequence
  source: /note="Description of Artificial Sequence: Synthetic peptide"
PPFPVFHQF

SEQ ID NO: 9964 - protein, 10 aa, Artificial Sequence
  source: /note="Description of Artificial Sequence: Synthetic peptide"
LLLGKIWPPF

SEQ ID NO: 9965 - protein, 10 aa, Artificial Sequence
  source: /note="Description of Artificial Sequence: Synthetic peptide"
LGKIWPPFPV

SEQ ID NO: 9966 - protein, 10 aa, Artificial Sequence
  source: /note="Description of Artificial Sequence: Synthetic peptide"
KIWPPFPVFH

SEQ ID NO: 9967 - protein, 10 aa, Artificial Sequence
  source: /note="Description of Artificial Sequence: Synthetic peptide"
GKIWPPFPVF

SEQ ID NO: 9968 - protein, 10 aa, Artificial Sequence
  source: /note="Description of Artificial Sequence: Synthetic peptide"
WPPFPVFHQF

SEQ ID NO: 9969 - protein, 9 aa, Artificial Sequence
  source: /note="Description of Artificial Sequence: Synthetic peptide"
SLSCALPSV

SEQ ID NO: 9970 - protein, 9 aa, Artificial Sequence
  source: /note="Description of Artificial Sequence: Synthetic peptide"
VLARWNLPM

SEQ ID NO: 9971 - protein, 9 aa, Artificial Sequence
  source: /note="Description of Artificial Sequence: Synthetic peptide"
ILPSWNSAV

SEQ ID NO: 9972 - protein, 9 aa, Artificial Sequence
  source: /note="Description of Artificial Sequence: Synthetic peptide"
CGFPCLSPK

SEQ ID NO: 9973 - protein, 9 aa, Artificial Sequence
  source: /note="Description of Artificial Sequence: Synthetic peptide"
CALPSVLAR

SEQ ID NO: 9974 - protein, 9 aa, Artificial Sequence
  source: /note="Description of Artificial Sequence: Synthetic peptide"
CSGPGNTSK

SEQ ID NO: 9975 - protein, 9 aa, Artificial Sequence
  source: /note="Description of Artificial Sequence: Synthetic peptide"
ASCRNQKLK

SEQ ID NO: 9976 - protein, 9 aa, Artificial Sequence
  source: /note="Description of Artificial Sequence: Synthetic peptide"
ALPSVLARW

SEQ ID NO: 9977 - protein, 9 aa, Artificial Sequence
  source: /note="Description of Artificial Sequence: Synthetic peptide"
SWNSAVCGF

SEQ ID NO: 9978 - protein, 9 aa, Artificial Sequence
  source: /note="Description of Artificial Sequence: Synthetic peptide"
SAKKSTWFH

SEQ ID NO: 9979 - protein, 9 aa, Artificial Sequence
  source: /note="Description of Artificial Sequence: Synthetic peptide"
GSRSEASCR

SEQ ID NO: 9980 - protein, 9 aa, Artificial Sequence
  source: /note="Description of Artificial Sequence: Synthetic peptide"
INSAKKSTW

SEQ ID NO: 9981 - protein, 9 aa, Artificial Sequence
  source: /note="Description of Artificial Sequence: Synthetic peptide"
AKKSTWFHV

SEQ ID NO: 9982 - protein, 9 aa, Artificial Sequence
  source: /note="Description of Artificial Sequence: Synthetic peptide"
KKSTWFHVT

SEQ ID NO: 9983 - protein, 9 aa, Artificial Sequence
  source: /note="Description of Artificial Sequence: Synthetic peptide"
FHVTSGTSL

SEQ ID NO: 9984 - protein, 9 aa, Artificial Sequence
  source: /note="Description of Artificial Sequence: Synthetic peptide"
SGTSLSCAL

SEQ ID NO: 9985 - protein, 9 aa, Artificial Sequence
  source: /note="Description of Artificial Sequence: Synthetic peptide"
LSCALPSVL

SEQ ID NO: 9986 - protein, 9 aa, Artificial Sequence
  source: /note="Description of Artificial Sequence: Synthetic peptide"
LKRDISENW

SEQ ID NO: 9987 - protein, 9 aa, Artificial Sequence
  source: /note="Description of Artificial Sequence: Synthetic peptide"
KQINIILPS

SEQ ID NO: 9988 - protein, 9 aa, Artificial Sequence
  source: /note="Description of Artificial Sequence: Synthetic peptide"
SAVCGFPCL

SEQ ID NO: 9989 - protein, 9 aa, Artificial Sequence
  source: /note="Description of Artificial Sequence: Synthetic peptide"
LPSWNSAVC

SEQ ID NO: 9990 - protein, 10 aa, Artificial Sequence
  source: /note="Description of Artificial Sequence: Synthetic peptide"
SLSCALPSVL

SEQ ID NO: 9991 - protein, 10 aa, Artificial Sequence
  source: /note="Description of Artificial Sequence: Synthetic peptide"
VLARWNLPMC

SEQ ID NO: 9992 - protein, 10 aa, Artificial Sequence
  source: /note="Description of Artificial Sequence: Synthetic peptide"
IILPSWNSAV

SEQ ID NO: 9993 - protein, 10 aa, Artificial Sequence
  source: /note="Description of Artificial Sequence: Synthetic peptide"
ILPSWNSAVC

SEQ ID NO: 9994 - protein, 10 aa, Artificial Sequence
  source: /note="Description of Artificial Sequence: Synthetic peptide"
CLSPKLSRGL

SEQ ID NO: 9995 - protein, 10 aa, Artificial Sequence
  source: /note="Description of Artificial Sequence: Synthetic peptide"
RSEASCRNQK

SEQ ID NO: 9996 - protein, 10 aa, Artificial Sequence
  source: /note="Description of Artificial Sequence: Synthetic peptide"
CALPSVLARW

SEQ ID NO: 9997 - protein, 10 aa, Artificial Sequence
  source: /note="Description of Artificial Sequence: Synthetic peptide"
KQINIILPSW

SEQ ID NO: 9998 - protein, 10 aa, Artificial Sequence
  source: /note="Description of Artificial Sequence: Synthetic peptide"
SAKKSTWFHV

SEQ ID NO: 9999 - protein, 10 aa, Artificial Sequence
  source: /note="Description of Artificial Sequence: Synthetic peptide"
SVLARWNLPM

SEQ ID NO: 10000 - protein, 10 aa, Artificial Sequence
  source: /note="Description of Artificial Sequence: Synthetic peptide"
SWRPTCCEQR

SEQ ID NO: 10001 - protein, 10 aa, Artificial Sequence
  source: /note="Description of Artificial Sequence: Synthetic peptide"
STWFHVTSGT

SEQ ID NO: 10002 - protein, 10 aa, Artificial Sequence
  source: /note="Description of Artificial Sequence: Synthetic peptide"
TSLSCALPSV

SEQ ID NO: 10003 - protein, 10 aa, Artificial Sequence
  source: /note="Description of Artificial Sequence: Synthetic peptide"
NIILPSWNSA

SEQ ID NO: 10004 - protein, 10 aa, Artificial Sequence
  source: /note="Description of Artificial Sequence: Synthetic peptide"
NSAVCGFPCL

SEQ ID NO: 10005 - protein, 10 aa, Artificial Sequence
  source: /note="Description of Artificial Sequence: Synthetic peptide"
LPSVLARWNL

SEQ ID NO: 10006 - protein, 10 aa, Artificial Sequence
  source: /note="Description of Artificial Sequence: Synthetic peptide"
WNKKQINIIL

SEQ ID NO: 10007 - protein, 10 aa, Artificial Sequence
  source: /note="Description of Artificial Sequence: Synthetic peptide"
RINSAKKSTW

SEQ ID NO: 10008 - protein, 10 aa, Artificial Sequence
  source: /note="Description of Artificial Sequence: Synthetic peptide"
INSAKKSTWF

SEQ ID NO: 10009 - protein, 10 aa, Artificial Sequence
  source: /note="Description of Artificial Sequence: Synthetic peptide"
WFHVTSGTSL

SEQ ID NO: 10010 - protein, 10 aa, Artificial Sequence
  source: /note="Description of Artificial Sequence: Synthetic peptide"
SEASCRNQKL

SEQ ID NO: 10011 - protein, 10 aa, Artificial Sequence
  source: /note="Description of Artificial Sequence: Synthetic peptide"
KLKRDISENW

SEQ ID NO: 10012 - protein, 10 aa, Artificial Sequence
  source: /note="Description of Artificial Sequence: Synthetic peptide"
CGFPCLSPKL

SEQ ID NO: 10013 - protein, 10 aa, Artificial Sequence
  source: /note="Description of Artificial Sequence: Synthetic peptide"
CEQRGSRSEA

SEQ ID NO: 10014 - protein, 9 aa, Artificial Sequence
  source: /note="Description of Artificial Sequence: Synthetic peptide"
AEQCNIMRL

SEQ ID NO: 10015 - protein, 10 aa, Artificial Sequence
  source: /note="Description of Artificial Sequence: Synthetic peptide"
SQACAEQCNI

SEQ ID NO: 10016 - protein, 10 aa, Artificial Sequence
  source: /note="Description of Artificial Sequence: Synthetic peptide"
AEQCNIMRLV

SEQ ID NO: 10017 - protein, 9 aa, Artificial Sequence
  source: /note="Description of Artificial Sequence: Synthetic peptide"
LLHATTRQA

SEQ ID NO: 10018 - protein, 9 aa, Artificial Sequence
  source: /note="Description of Artificial Sequence: Synthetic peptide"
TTRQAAGIR

SEQ ID NO: 10019 - protein, 9 aa, Artificial Sequence
  source: /note="Description of Artificial Sequence: Synthetic peptide"
QMLLHATTR

SEQ ID NO: 10020 - protein, 9 aa, Artificial Sequence
  source: /note="Description of Artificial Sequence: Synthetic peptide"
YQMLLHATT

SEQ ID NO: 10021 - protein, 9 aa, Artificial Sequence
  source: /note="Description of Artificial Sequence: Synthetic peptide"
LHATTRQAA

SEQ ID NO: 10022 - protein, 10 aa, Artificial Sequence
  source: /note="Description of Artificial Sequence: Synthetic peptide"
MLLHATTRQA

SEQ ID NO: 10023 - protein, 10 aa, Artificial Sequence
  source: /note="Description of Artificial Sequence: Synthetic peptide"
LLHATTRQAA

SEQ ID NO: 10024 - protein, 10 aa, Artificial Sequence
  source: /note="Description of Artificial Sequence: Synthetic peptide"
TTRQAAGIRL

SEQ ID NO: 10025 - protein, 10 aa, Artificial Sequence
  source: /note="Description of Artificial Sequence: Synthetic peptide"
YQMLLHATTR

SEQ ID NO: 10026 - protein, 10 aa, Artificial Sequence
  source: /note="Description of Artificial Sequence: Synthetic peptide"
LPYQMLLHAT

SEQ ID NO: 10027 - protein, 9 aa, Artificial Sequence
  source: /note="Description of Artificial Sequence: Synthetic peptide"
MRMRMTWRK

SEQ ID NO: 10028 - protein, 9 aa, Artificial Sequence
  source: /note="Description of Artificial Sequence: Synthetic peptide"
RWRAEWMRM

SEQ ID NO: 10029 - protein, 9 aa, Artificial Sequence
  source: /note="Description of Artificial Sequence: Synthetic peptide"
EWMRMRMTW

SEQ ID NO: 10030 - protein, 9 aa, Artificial Sequence
  source: /note="Description of Artificial Sequence: Synthetic peptide"
RAEWMRMRM

SEQ ID NO: 10031 - protein, 9 aa, Artificial Sequence
  source: /note="Description of Artificial Sequence: Synthetic peptide"
WMRMRMTWR

SEQ ID NO: 10032 - protein, 9 aa, Artificial Sequence
  source: /note="Description of Artificial Sequence: Synthetic peptide"
RMRMTWRKN

SEQ ID NO: 10033 - protein, 9 aa, Artificial Sequence
  source: /note="Description of Artificial Sequence: Synthetic peptide"
EEKRWRAEW

SEQ ID NO: 10034 - protein, 9 aa, Artificial Sequence
  source: /note="Description of Artificial Sequence: Synthetic peptide"
AEWMRMRMT

SEQ ID NO: 10035 - protein, 10 aa, Artificial Sequence
  source: /note="Description of Artificial Sequence: Synthetic peptide"
WMRMRMTWRK

SEQ ID NO: 10036 - protein, 10 aa, Artificial Sequence
  source: /note="Description of Artificial Sequence: Synthetic peptide"
RWRAEWMRMR

SEQ ID NO: 10037 - protein, 10 aa, Artificial Sequence
  source: /note="Description of Artificial Sequence: Synthetic peptide"
RMRMTWRKNT

SEQ ID NO: 10038 - protein, 10 aa, Artificial Sequence
  source: /note="Description of Artificial Sequence: Synthetic peptide"
EWMRMRMTWR

SEQ ID NO: 10039 - protein, 10 aa, Artificial Sequence
  source: /note="Description of Artificial Sequence: Synthetic peptide"
KRWRAEWMRM

SEQ ID NO: 10040 - protein, 10 aa, Artificial Sequence
  source: /note="Description of Artificial Sequence: Synthetic peptide"
WRAEWMRMRM

SEQ ID NO: 10041 - protein, 10 aa, Artificial Sequence
  source: /note="Description of Artificial Sequence: Synthetic peptide"
AEWMRMRMTW

SEQ ID NO: 10042 - protein, 10 aa, Artificial Sequence
  source: /note="Description of Artificial Sequence: Synthetic peptide"
DEEKRWRAEW

SEQ ID NO: 10043 - protein, 9 aa, Artificial Sequence
  source: /note="Description of Artificial Sequence: Synthetic peptide"
LLSAQFHQK

SEQ ID NO: 10044 - protein, 10 aa, Artificial Sequence
  source: /note="Description of Artificial Sequence: Synthetic peptide"
CLLSAQFHQK

SEQ ID NO: 10045 - protein, 9 aa, Artificial Sequence
  source: /note="Description of Artificial Sequence: Synthetic peptide"
VLNPCLPSI

SEQ ID NO: 10046 - protein, 9 aa, Artificial Sequence
  source: /note="Description of Artificial Sequence: Synthetic peptide"
SIMLTSHNM

SEQ ID NO: 10047 - protein, 9 aa, Artificial Sequence
  source: /note="Description of Artificial Sequence: Synthetic peptide"
ITVRGEMFV

SEQ ID NO: 10048 - protein, 9 aa, Artificial Sequence
  source: /note="Description of Artificial Sequence: Synthetic peptide"
KEITVRGEM

SEQ ID NO: 10049 - protein, 9 aa, Artificial Sequence
  source: /note="Description of Artificial Sequence: Synthetic peptide"
GEMFVLNPC

SEQ ID NO: 10050 - protein, 9 aa, Artificial Sequence
  source: /note="Description of Artificial Sequence: Synthetic peptide"
EMFVLNPCL

SEQ ID NO: 10051 - protein, 9 aa, Artificial Sequence
  source: /note="Description of Artificial Sequence: Synthetic peptide"
NPCLPSIML

SEQ ID NO: 10052 - protein, 9 aa, Artificial Sequence
  source: /note="Description of Artificial Sequence: Synthetic peptide"
LPSIMLTSH

SEQ ID NO: 10053 - protein, 10 aa, Artificial Sequence
  source: /note="Description of Artificial Sequence: Synthetic peptide"
FVLNPCLPSI

SEQ ID NO: 10054 - protein, 10 aa, Artificial Sequence
  source: /note="Description of Artificial Sequence: Synthetic peptide"
VLNPCLPSIM

SEQ ID NO: 10055 - protein, 10 aa, Artificial Sequence
  source: /note="Description of Artificial Sequence: Synthetic peptide"
EITVRGEMFV

SEQ ID NO: 10056 - protein, 10 aa, Artificial Sequence
  source: /note="Description of Artificial Sequence: Synthetic peptide"
KKEITVRGEM

SEQ ID NO: 10057 - protein, 10 aa, Artificial Sequence
  source: /note="Description of Artificial Sequence: Synthetic peptide"
KEITVRGEMF

SEQ ID NO: 10058 - protein, 10 aa, Artificial Sequence
  source: /note="Description of Artificial Sequence: Synthetic peptide"
GEMFVLNPCL

SEQ ID NO: 10059 - protein, 9 aa, Artificial Sequence
  source: /note="Description of Artificial Sequence: Synthetic peptide"
VAVFFWWSV

SEQ ID NO: 10060 - protein, 9 aa, Artificial Sequence
  source: /note="Description of Artificial Sequence: Synthetic peptide"
AVFFWWSVY

SEQ ID NO: 10061 - protein, 9 aa, Artificial Sequence
  source: /note="Description of Artificial Sequence: Synthetic peptide"
FWWSVYQEG

SEQ ID NO: 10062 - protein, 9 aa, Artificial Sequence
  source: /note="Description of Artificial Sequence: Synthetic peptide"
VKVAVFFWW

SEQ ID NO: 10063 - protein, 10 aa, Artificial Sequence
  source: /note="Description of Artificial Sequence: Synthetic peptide"
KVAVFFWWSV

SEQ ID NO: 10064 - protein, 10 aa, Artificial Sequence
  source: /note="Description of Artificial Sequence: Synthetic peptide"
VAVFFWWSVY

SEQ ID NO: 10065 - protein, 9 aa, Artificial Sequence
  source: /note="Description of Artificial Sequence: Synthetic peptide"
LGRGPKGDK

SEQ ID NO: 10066 - protein, 10 aa, Artificial Sequence
  source: /note="Description of Artificial Sequence: Synthetic peptide"
KGKRLGRGPK

SEQ ID NO: 10067 - protein, 10 aa, Artificial Sequence
  source: /note="Description of Artificial Sequence: Synthetic peptide"
RLGRGPKGDK

SEQ ID NO: 10068 - protein, 9 aa, Artificial Sequence
  source: /note="Description of Artificial Sequence: Synthetic peptide"
IYQGRLCAF

SEQ ID NO: 10069 - protein, 10 aa, Artificial Sequence
  source: /note="Description of Artificial Sequence: Synthetic peptide"
IYQGRLCAFC

SEQ ID NO: 10070 - protein, 10 aa, Artificial Sequence
  source: /note="Description of Artificial Sequence: Synthetic peptide"
CIYQGRLCAF

SEQ ID NO: 10071 - protein, 9 aa, Artificial Sequence
  source: /note="Description of Artificial Sequence: Synthetic peptide"
RGKKLVKRL

SEQ ID NO: 10072 - protein, 9 aa, Artificial Sequence
  source: /note="Description of Artificial Sequence: Synthetic peptide"
LVKRLSQSM

SEQ ID NO: 10073 - protein, 9 aa, Artificial Sequence
  source: /note="Description of Artificial Sequence: Synthetic peptide"
YEVRRGKKL

SEQ ID NO: 10074 - protein, 10 aa, Artificial Sequence
  source: /note="Description of Artificial Sequence: Synthetic peptide"
KLVKRLSQSM

SEQ ID NO: 10075 - protein, 10 aa, Artificial Sequence
  source: /note="Description of Artificial Sequence: Synthetic peptide"
EVRRGKKLVK

SEQ ID NO: 10076 - protein, 10 aa, Artificial Sequence
  source: /note="Description of Artificial Sequence: Synthetic peptide"
YEVRRGKKLV

SEQ ID NO: 10077 - protein, 9 aa, Artificial Sequence
  source: /note="Description of Artificial Sequence: Synthetic peptide"
KRQGISPAL

SEQ ID NO: 10078 - protein, 9 aa, Artificial Sequence
  source: /note="Description of Artificial Sequence: Synthetic peptide"
RQGISPALV

SEQ ID NO: 10079 - protein, 10 aa, Artificial Sequence
  source: /note="Description of Artificial Sequence: Synthetic peptide"
EKRQGISPAL

SEQ ID NO: 10080 - protein, 10 aa, Artificial Sequence
  source: /note="Description of Artificial Sequence: Synthetic peptide"
VEKRQGISPA

SEQ ID NO: 10081 - protein, 9 aa, Artificial Sequence
  source: /note="Description of Artificial Sequence: Synthetic peptide"
FMHKVHFPS

SEQ ID NO: 10082 - protein, 9 aa, Artificial Sequence
  source: /note="Description of Artificial Sequence: Synthetic peptide"
KVHFPSPQR

SEQ ID NO: 10083 - protein, 9 aa, Artificial Sequence
  source: /note="Description of Artificial Sequence: Synthetic peptide"
HFPSPQRPR

SEQ ID NO: 10084 - protein, 9 aa, Artificial Sequence
  source: /note="Description of Artificial Sequence: Synthetic peptide"
ISHFMHKVH

SEQ ID NO: 10085 - protein, 9 aa, Artificial Sequence
  source: /note="Description of Artificial Sequence: Synthetic peptide"
SHFMHKVHF

SEQ ID NO: 10086 - protein, 10 aa, Artificial Sequence
  source: /note="Description of Artificial Sequence: Synthetic peptide"
KVHFPSPQRP

SEQ ID NO: 10087 - protein, 10 aa, Artificial Sequence
  source: /note="Description of Artificial Sequence: Synthetic peptide"
ISHFMHKVHF

SEQ ID NO: 10088 - protein, 10 aa, Artificial Sequence
  source: /note="Description of Artificial Sequence: Synthetic peptide"
FMHKVHFPSP

SEQ ID NO: 10089 - protein, 9 aa, Artificial Sequence
  source: /note="Description of Artificial Sequence: Synthetic peptide"
RFKQQTPSQ

SEQ ID NO: 10090 - protein, 9 aa, Artificial Sequence
  source: /note="Description of Artificial Sequence: Synthetic peptide"
KQQTPSQTH

SEQ ID NO: 10091 - protein, 10 aa, Artificial Sequence
  source: /note="Description of Artificial Sequence: Synthetic peptide"
RFKQQTPSQT

SEQ ID NO: 10092 - protein, 10 aa, Artificial Sequence
  source: /note="Description of Artificial Sequence: Synthetic peptide"
KQQTPSQTHK

SEQ ID NO: 10093 - protein, 10 aa, Artificial Sequence
  source: /note="Description of Artificial Sequence: Synthetic peptide"
FKQQTPSQTH

SEQ ID NO: 10094 - protein, 9 aa, Artificial Sequence
  source: /note="Description of Artificial Sequence: Synthetic peptide"
FECQNLEKL

SEQ ID NO: 10095 - protein, 9 aa, Artificial Sequence
  source: /note="Description of Artificial Sequence: Synthetic peptide"
LEKLTTVQI

SEQ ID NO: 10096 - protein, 10 aa, Artificial Sequence
  source: /note="Description of Artificial Sequence: Synthetic peptide"
CQNLEKLTTV

SEQ ID NO: 10097 - protein, 10 aa, Artificial Sequence
  source: /note="Description of Artificial Sequence: Synthetic peptide"
MTFECQNLEK

SEQ ID NO: 10098 - protein, 9 aa, Artificial Sequence
  source: /note="Description of Artificial Sequence: Synthetic peptide"
ILHKYMQRV

SEQ ID NO: 10099 - protein, 9 aa, Artificial Sequence
  source: /note="Description of Artificial Sequence: Synthetic peptide"
KSEVCILHK

SEQ ID NO: 10100 - protein, 9 aa, Artificial Sequence
  source: /note="Description of Artificial Sequence: Synthetic peptide"
CILHKYMQR

SEQ ID NO: 10101 - protein, 9 aa, Artificial Sequence
  source: /note="Description of Artificial Sequence: Synthetic peptide"
KYMQRVLKV

SEQ ID NO: 10102 - protein, 9 aa, Artificial Sequence
  source: /note="Description of Artificial Sequence: Synthetic peptide"
HKYMQRVLK

SEQ ID NO: 10103 - protein, 9 aa, Artificial Sequence
  source: /note="Description of Artificial Sequence: Synthetic peptide"
SEVCILHKY

SEQ ID NO: 10104 - protein, 9 aa, Artificial Sequence
  source: /note="Description of Artificial Sequence: Synthetic peptide"
LHKYMQRVL

SEQ ID NO: 10105 - protein, 10 aa, Artificial Sequence
  source: /note="Description of Artificial Sequence: Synthetic peptide"
KSEVCILHKY

SEQ ID NO: 10106 - protein, 10 aa, Artificial Sequence
  source: /note="Description of Artificial Sequence: Synthetic peptide"
CILHKYMQRV

SEQ ID NO: 10107 - protein, 10 aa, Artificial Sequence
  source: /note="Description of Artificial Sequence: Synthetic peptide"
ILHKYMQRVL

SEQ ID NO: 10108 - protein, 10 aa, Artificial Sequence
  source: /note="Description of Artificial Sequence: Synthetic peptide"
LHKYMQRVLK

SEQ ID NO: 10109 - protein, 10 aa, Artificial Sequence
  source: /note="Description of Artificial Sequence: Synthetic peptide"
KYMQRVLKVR

SEQ ID NO: 10110 - protein, 10 aa, Artificial Sequence
  source: /note="Description of Artificial Sequence: Synthetic peptide"
SEVCILHKYM

SEQ ID NO: 10111 - protein, 10 aa, Artificial Sequence
  source: /note="Description of Artificial Sequence: Synthetic peptide"
HKYMQRVLKV

SEQ ID NO: 10112 - protein, 9 aa, Artificial Sequence
  source: /note="Description of Artificial Sequence: Synthetic peptide"
EKWAHLSPL

SEQ ID NO: 10113 - protein, 9 aa, Artificial Sequence
  source: /note="Description of Artificial Sequence: Synthetic peptide"
WAHLSPLEF

SEQ ID NO: 10114 - protein, 9 aa, Artificial Sequence
  source: /note="Description of Artificial Sequence: Synthetic peptide"
LEFSQLQKY

SEQ ID NO: 10115 - protein, 10 aa, Artificial Sequence
  source: /note="Description of Artificial Sequence: Synthetic peptide"
HLSPLEFSQL

SEQ ID NO: 10116 - protein, 10 aa, Artificial Sequence
  source: /note="Description of Artificial Sequence: Synthetic peptide"
KWAHLSPLEF

SEQ ID NO: 10117 - protein, 10 aa, Artificial Sequence
  source: /note="Description of Artificial Sequence: Synthetic peptide"
QEKWAHLSPL

SEQ ID NO: 10118 - protein, 10 aa, Artificial Sequence
  source: /note="Description of Artificial Sequence: Synthetic peptide"
LEFSQLQKYA

SEQ ID NO: 10119 - protein, 9 aa, Artificial Sequence
  source: /note="Description of Artificial Sequence: Synthetic peptide"
ALLEALGTT

SEQ ID NO: 10120 - protein, 9 aa, Artificial Sequence
  source: /note="Description of Artificial Sequence: Synthetic peptide"
ALGTTGFQA

SEQ ID NO: 10121 - protein, 9 aa, Artificial Sequence
  source: /note="Description of Artificial Sequence: Synthetic peptide"
NYRALLEAL

SEQ ID NO: 10122 - protein, 9 aa, Artificial Sequence
  source: /note="Description of Artificial Sequence: Synthetic peptide"
LEALGTTGF

SEQ ID NO: 10123 - protein, 10 aa, Artificial Sequence
  source: /note="Description of Artificial Sequence: Synthetic peptide"
EALGTTGFQA

SEQ ID NO: 10124 - protein, 10 aa, Artificial Sequence
  source: /note="Description of Artificial Sequence: Synthetic peptide"
LLEALGTTGF

SEQ ID NO: 10125 - protein, 10 aa, Artificial Sequence
  source: /note="Description of Artificial Sequence: Synthetic peptide"
VNYRALLEAL

SEQ ID NO: 10126 - protein, 9 aa, Artificial Sequence
  source: /note="Description of Artificial Sequence: Synthetic peptide"
CLAPGLTKT

SEQ ID NO: 10127 - protein, 9 aa, Artificial Sequence
  source: /note="Description of Artificial Sequence: Synthetic peptide"
LTKTSFSRM

SEQ ID NO: 10128 - protein, 9 aa, Artificial Sequence
  source: /note="Description of Artificial Sequence: Synthetic peptide"
GLTKTSFSR

SEQ ID NO: 10129 - protein, 9 aa, Artificial Sequence
  source: /note="Description of Artificial Sequence: Synthetic peptide"
APGLTKTSF

SEQ ID NO: 10130 - protein, 9 aa, Artificial Sequence
  source: /note="Description of Artificial Sequence: Synthetic peptide"
TKTSFSRML

SEQ ID NO: 10131 - protein, 10 aa, Artificial Sequence
  source: /note="Description of Artificial Sequence: Synthetic peptide"
GLTKTSFSRM

SEQ ID NO: 10132 - protein, 10 aa, Artificial Sequence
  source: /note="Description of Artificial Sequence: Synthetic peptide"
LTKTSFSRML

SEQ ID NO: 10133 - protein, 10 aa, Artificial Sequence
  source: /note="Description of Artificial Sequence: Synthetic peptide"
LAPGLTKTSF

SEQ ID NO: 10134 - protein, 10 aa, Artificial Sequence
  source: /note="Description of Artificial Sequence: Synthetic peptide"
TKTSFSRMLW

SEQ ID NO: 10135 - protein, 9 aa, Artificial Sequence
  source: /note="Description of Artificial Sequence: Synthetic peptide"
TQLAFEYQR

SEQ ID NO: 10136 - protein, 9 aa, Artificial Sequence
  source: /note="Description of Artificial Sequence: Synthetic peptide"
VVRATQLAF

SEQ ID NO: 10137 - protein, 9 aa, Artificial Sequence
  source: /note="Description of Artificial Sequence: Synthetic peptide"
RATQLAFEY

SEQ ID NO: 10138 - protein, 9 aa, Artificial Sequence
  source: /note="Description of Artificial Sequence: Synthetic peptide"
EVVRATQLA

SEQ ID NO: 10139 - protein, 9 aa, Artificial Sequence
  source: /note="Description of Artificial Sequence: Synthetic peptide"
EEVVRATQL

SEQ ID NO: 10140 - protein, 10 aa, Artificial Sequence
  source: /note="Description of Artificial Sequence: Synthetic peptide"
ATQLAFEYQR

SEQ ID NO: 10141 - protein, 10 aa, Artificial Sequence
  source: /note="Description of Artificial Sequence: Synthetic peptide"
VVRATQLAFE

SEQ ID NO: 10142 - protein, 10 aa, Artificial Sequence
  source: /note="Description of Artificial Sequence: Synthetic peptide"
VRATQLAFEY

SEQ ID NO: 10143 - protein, 10 aa, Artificial Sequence
  source: /note="Description of Artificial Sequence: Synthetic peptide"
QLAFEYQRQF

SEQ ID NO: 10144 - protein, 10 aa, Artificial Sequence
  source: /note="Description of Artificial Sequence: Synthetic peptide"
EVVRATQLAF

SEQ ID NO: 10145 - protein, 10 aa, Artificial Sequence
  source: /note="Description of Artificial Sequence: Synthetic peptide"
EEVVRATQLA

SEQ ID NO: 10146 - protein, 9 aa, Artificial Sequence
  source: /note="Description of Artificial Sequence: Synthetic peptide"
GEGYNYTGM

SEQ ID NO: 10147 - protein, 10 aa, Artificial Sequence
  source: /note="Description of Artificial Sequence: Synthetic peptide"
FMCEVQGEGY

SEQ ID NO: 10148 - protein, 10 aa, Artificial Sequence
  source: /note="Description of Artificial Sequence: Synthetic peptide"
CEVQGEGYNY

SEQ ID NO: 10149 - protein, 9 aa, Artificial Sequence
  source: /note="Description of Artificial Sequence: Synthetic peptide"
MMEDMNLNK

SEQ ID NO: 10150 - protein, 9 aa, Artificial Sequence
  source: /note="Description of Artificial Sequence: Synthetic peptide"
LNKEKKAPL

SEQ ID NO: 10151 - protein, 10 aa, Artificial Sequence
  source: /note="Description of Artificial Sequence: Synthetic peptide"
KMMEDMNLNK

SEQ ID NO: 10152 - protein, 10 aa, Artificial Sequence
  source: /note="Description of Artificial Sequence: Synthetic peptide"
KEKKAPLRNK

SEQ ID NO: 10153 - protein, 10 aa, Artificial Sequence
  source: /note="Description of Artificial Sequence: Synthetic peptide"
NLNKEKKAPL

SEQ ID NO: 10154 - protein, 9 aa, Artificial Sequence
  source: /note="Description of Artificial Sequence: Synthetic peptide"
RLKFLGDAI

SEQ ID NO: 10155 - protein, 9 aa, Artificial Sequence
  source: /note="Description of Artificial Sequence: Synthetic peptide"
ITDCYQRLK

SEQ ID NO: 10156 - protein, 9 aa, Artificial Sequence
  source: /note="Description of Artificial Sequence: Synthetic peptide"
LKFLGDAIL

SEQ ID NO: 10157 - protein, 10 aa, Artificial Sequence
  source: /note="Description of Artificial Sequence: Synthetic peptide"
ITDCYQRLKF

SEQ ID NO: 10158 - protein, 10 aa, Artificial Sequence
  source: /note="Description of Artificial Sequence: Synthetic peptide"
RLKFLGDAIL

SEQ ID NO: 10159 - protein, 10 aa, Artificial Sequence
  source: /note="Description of Artificial Sequence: Synthetic peptide"
TITDCYQRLK

SEQ ID NO: 10160 - protein, 10 aa, Artificial Sequence
  source: /note="Description of Artificial Sequence: Synthetic peptide"
KFLGDAILDY

SEQ ID NO: 10161 - protein, 10 aa, Artificial Sequence
  source: /note="Description of Artificial Sequence: Synthetic peptide"
YQRLKFLGDA

SEQ ID NO: 10162 - protein, 9 aa, Artificial Sequence
  source: /note="Description of Artificial Sequence: Synthetic peptide"
SISKCHAFI

SEQ ID NO: 10163 - protein, 9 aa, Artificial Sequence
  source: /note="Description of Artificial Sequence: Synthetic peptide"
RLSISKCHA

SEQ ID NO: 10164 - protein, 9 aa, Artificial Sequence
  source: /note="Description of Artificial Sequence: Synthetic peptide"
ISKCHAFIL

SEQ ID NO: 10165 - protein, 9 aa, Artificial Sequence
  source: /note="Description of Artificial Sequence: Synthetic peptide"
LSISKCHAF

SEQ ID NO: 10166 - protein, 9 aa, Artificial Sequence
  source: /note="Description of Artificial Sequence: Synthetic peptide"
MQRLSISKC

SEQ ID NO: 10167 - protein, 9 aa, Artificial Sequence
  source: /note="Description of Artificial Sequence: Synthetic peptide"
KCHAFILVF

SEQ ID NO: 10168 - protein, 10 aa, Artificial Sequence
  source: /note="Description of Artificial Sequence: Synthetic peptide"
SISKCHAFIL

SEQ ID NO: 10169 - protein, 10 aa, Artificial Sequence
  source: /note="Description of Artificial Sequence: Synthetic peptide"
ISKCHAFILV

SEQ ID NO: 10170 - protein, 10 aa, Artificial Sequence
  source: /note="Description of Artificial Sequence: Synthetic peptide"
LSISKCHAFI

SEQ ID NO: 10171 - protein, 10 aa, Artificial Sequence
  source: /note="Description of Artificial Sequence: Synthetic peptide"
RLSISKCHAF

SEQ ID NO: 10172 - protein, 10 aa, Artificial Sequence
  source: /note="Description of Artificial Sequence: Synthetic peptide"
MQRLSISKCH

SEQ ID NO: 10173 - protein, 10 aa, Artificial Sequence
  source: /note="Description of Artificial Sequence: Synthetic peptide"
SKCHAFILVF

SEQ ID NO: 10174 - protein, 9 aa, Artificial Sequence
  source: /note="Description of Artificial Sequence: Synthetic peptide"
YTHFTSPIK

SEQ ID NO: 10175 - protein, 9 aa, Artificial Sequence
  source: /note="Description of Artificial Sequence: Synthetic peptide"
HFTSPIKRY

SEQ ID NO: 10176 - protein, 9 aa, Artificial Sequence
  source: /note="Description of Artificial Sequence: Synthetic peptide"
FTSPIKRYA

SEQ ID NO: 10177 - protein, 9 aa, Artificial Sequence
  source: /note="Description of Artificial Sequence: Synthetic peptide"
SPIKRYADV

SEQ ID NO: 10178 - protein, 9 aa, Artificial Sequence
  source: /note="Description of Artificial Sequence: Synthetic peptide"
IKRYADVIV

SEQ ID NO: 10179 - protein, 9 aa, Artificial Sequence
  source: /note="Description of Artificial Sequence: Synthetic peptide"
KRYADVIVH

SEQ ID NO: 10180 - protein, 10 aa, Artificial Sequence
  source: /note="Description of Artificial Sequence: Synthetic peptide"
YTHFTSPIKR

SEQ ID NO: 10181 - protein, 10 aa, Artificial Sequence
  source: /note="Description of Artificial Sequence: Synthetic peptide"
IYTHFTSPIK

SEQ ID NO: 10182 - protein, 10 aa, Artificial Sequence
  source: /note="Description of Artificial Sequence: Synthetic peptide"
SPIKRYADVI

SEQ ID NO: 10183 - protein, 10 aa, Artificial Sequence
  source: /note="Description of Artificial Sequence: Synthetic peptide"
THFTSPIKRY

SEQ ID NO: 10184 - protein, 10 aa, Artificial Sequence
  source: /note="Description of Artificial Sequence: Synthetic peptide"
IKRYADVIVH

SEQ ID NO: 10185 - protein, 9 aa, Artificial Sequence
  source: /note="Description of Artificial Sequence: Synthetic peptide"
FLALTVGLA

SEQ ID NO: 10186 - protein, 9 aa, Artificial Sequence
  source: /note="Description of Artificial Sequence: Synthetic peptide"
ALTVGLAYI

SEQ ID NO: 10187 - protein, 9 aa, Artificial Sequence
  source: /note="Description of Artificial Sequence: Synthetic peptide"
LTVGLAYIV

SEQ ID NO: 10188 - protein, 9 aa, Artificial Sequence
  source: /note="Description of Artificial Sequence: Synthetic peptide"
WFLALTVGL

SEQ ID NO: 10189 - protein, 9 aa, Artificial Sequence
  source: /note="Description of Artificial Sequence: Synthetic peptide"
LALTVGLAY

SEQ ID NO: 10190 - protein, 10 aa, Artificial Sequence
  source: /note="Description of Artificial Sequence: Synthetic peptide"
FLALTVGLAY

SEQ ID NO: 10191 - protein, 10 aa, Artificial Sequence
  source: /note="Description of Artificial Sequence: Synthetic peptide"
ALTVGLAYIV

SEQ ID NO: 10192 - protein, 10 aa, Artificial Sequence
  source: /note="Description of Artificial Sequence: Synthetic peptide"
LAYIVCINPK

SEQ ID NO: 10193 - protein, 10 aa, Artificial Sequence
  source: /note="Description of Artificial Sequence: Synthetic peptide"
FWFLALTVGL

SEQ ID NO: 10194 - protein, 10 aa, Artificial Sequence
  source: /note="Description of Artificial Sequence: Synthetic peptide"
LALTVGLAYI

SEQ ID NO: 10195 - protein, 9 aa, Artificial Sequence
  source: /note="Description of Artificial Sequence: Synthetic peptide"
RSSHPFECY

SEQ ID NO: 10196 - protein, 9 aa, Artificial Sequence
  source: /note="Description of Artificial Sequence: Synthetic peptide"
HPFECYDAE

SEQ ID NO: 10197 - protein, 10 aa, Artificial Sequence
  source: /note="Description of Artificial Sequence: Synthetic peptide"
CYDAEYKKLF

SEQ ID NO: 10198 - protein, 10 aa, Artificial Sequence
  source: /note="Description of Artificial Sequence: Synthetic peptide"
HPFECYDAEY

SEQ ID NO: 10199 - protein, 10 aa, Artificial Sequence
  source: /note="Description of Artificial Sequence: Synthetic peptide"
FRSSHPFECY

SEQ ID NO: 10200 - protein, 9 aa, Artificial Sequence
  source: /note="Description of Artificial Sequence: Synthetic peptide"
NTAEALSLS

SEQ ID NO: 10201 - protein, 9 aa, Artificial Sequence
  source: /note="Description of Artificial Sequence: Synthetic peptide"
EALSLSASV

SEQ ID NO: 10202 - protein, 9 aa, Artificial Sequence
  source: /note="Description of Artificial Sequence: Synthetic peptide"
LNTAEALSL

SEQ ID NO: 10203 - protein, 9 aa, Artificial Sequence
  source: /note="Description of Artificial Sequence: Synthetic peptide"
AEALSLSAS

SEQ ID NO: 10204 - protein, 9 aa, Artificial Sequence
  source: /note="Description of Artificial Sequence: Synthetic peptide"
LSLSASVGL

SEQ ID NO: 10205 - protein, 10 aa, Artificial Sequence
  source: /note="Description of Artificial Sequence: Synthetic peptide"
ALSLSASVGL

SEQ ID NO: 10206 - protein, 10 aa, Artificial Sequence
  source: /note="Description of Artificial Sequence: Synthetic peptide"
SLSASVGLSV

SEQ ID NO: 10207 - protein, 10 aa, Artificial Sequence
  source: /note="Description of Artificial Sequence: Synthetic peptide"
QLNTAEALSL

SEQ ID NO: 10208 - protein, 10 aa, Artificial Sequence
  source: /note="Description of Artificial Sequence: Synthetic peptide"
NTAEALSLSA

SEQ ID NO: 10209 - protein, 10 aa, Artificial Sequence
  source: /note="Description of Artificial Sequence: Synthetic peptide"
WQLNTAEALS

SEQ ID NO: 10210 - protein, 10 aa, Artificial Sequence
  source: /note="Description of Artificial Sequence: Synthetic peptide"
AEALSLSASV

SEQ ID NO: 10211 - protein, 9 aa, Artificial Sequence
  source: /note="Description of Artificial Sequence: Synthetic peptide"
EIFQHCDCA

SEQ ID NO: 10212 - protein, 10 aa, Artificial Sequence
  source: /note="Description of Artificial Sequence: Synthetic peptide"
FQHCDCAKGL

SEQ ID NO: 10213 - protein, 10 aa, Artificial Sequence
  source: /note="Description of Artificial Sequence: Synthetic peptide"
LEIFQHCDCA

SEQ ID NO: 10214 - protein, 9 aa, Artificial Sequence
  source: /note="Description of Artificial Sequence: Synthetic peptide"
RVRLDSMVL

SEQ ID NO: 10215 - protein, 9 aa, Artificial Sequence
  source: /note="Description of Artificial Sequence: Synthetic peptide"
RDRVRLDSM

SEQ ID NO: 10216 - protein, 9 aa, Artificial Sequence
  source: /note="Description of Artificial Sequence: Synthetic peptide"
VRLDSMVLL

SEQ ID NO: 10217 - protein, 9 aa, Artificial Sequence
  source: /note="Description of Artificial Sequence: Synthetic peptide"
REDRDRVRL

SEQ ID NO: 10218 - protein, 10 aa, Artificial Sequence
  source: /note="Description of Artificial Sequence: Synthetic peptide"
RVRLDSMVLL

SEQ ID NO: 10219 - protein, 10 aa, Artificial Sequence
  source: /note="Description of Artificial Sequence: Synthetic peptide"
EIREDRDRVR

SEQ ID NO: 10220 - protein, 10 aa, Artificial Sequence
  source: /note="Description of Artificial Sequence: Synthetic peptide"
KEIREDRDRV

SEQ ID NO: 10221 - protein, 10 aa, Artificial Sequence
  source: /note="Description of Artificial Sequence: Synthetic peptide"
RSVSNSTQTT

SEQ ID NO: 10222 - protein, 9 aa, Artificial Sequence
  source: /note="Description of Artificial Sequence: Synthetic peptide"
NVKDIAPDK

SEQ ID NO: 10223 - protein, 9 aa, Artificial Sequence
  source: /note="Description of Artificial Sequence: Synthetic peptide"
RSRRTAARV

SEQ ID NO: 10224 - protein, 9 aa, Artificial Sequence
  source: /note="Description of Artificial Sequence: Synthetic peptide"
RTAARVNSP

SEQ ID NO: 10225 - protein, 10 aa, Artificial Sequence
  source: /note="Description of Artificial Sequence: Synthetic peptide"
RSRRTAARVN

SEQ ID NO: 10226 - protein, 10 aa, Artificial Sequence
  source: /note="Description of Artificial Sequence: Synthetic peptide"
RTAARVNSPE

SEQ ID NO: 10227 - protein, 9 aa, Artificial Sequence
  source: /note="Description of Artificial Sequence: Synthetic peptide"
GVIDLKGSF

SEQ ID NO: 10228 - protein, 10 aa, Artificial Sequence
  source: /note="Description of Artificial Sequence: Synthetic peptide"
NAKPGVIDLK

SEQ ID NO: 10229 - protein, 10 aa, Artificial Sequence
  source: /note="Description of Artificial Sequence: Synthetic peptide"
DLKGSFNDKR

SEQ ID NO: 10230 - protein, 9 aa, Artificial Sequence
  source: /note="Description of Artificial Sequence: Synthetic peptide"
WTRPGSTAV

SEQ ID NO: 10231 - protein, 9 aa, Artificial Sequence
  source: /note="Description of Artificial Sequence: Synthetic peptide"
TAAPRHLPK

SEQ ID NO: 10232 - protein, 9 aa, Artificial Sequence
  source: /note="Description of Artificial Sequence: Synthetic peptide"
ATSKPWGMR

SEQ ID NO: 10233 - protein, 9 aa, Artificial Sequence
  source: /note="Description of Artificial Sequence: Synthetic peptide"
VARMGRSPA

SEQ ID NO: 10234 - protein, 9 aa, Artificial Sequence
  source: /note="Description of Artificial Sequence: Synthetic peptide"
TSKPWGMRR

SEQ ID NO: 10235 - protein, 9 aa, Artificial Sequence
  source: /note="Description of Artificial Sequence: Synthetic peptide"
PVAPPAWTR

SEQ ID NO: 10236 - protein, 9 aa, Artificial Sequence
  source: /note="Description of Artificial Sequence: Synthetic peptide"
QVPQDDWGV

SEQ ID NO: 10237 - protein, 9 aa, Artificial Sequence
  source: /note="Description of Artificial Sequence: Synthetic peptide"
QSPDASPPV

SEQ ID NO: 10238 - protein, 9 aa, Artificial Sequence
  source: /note="Description of Artificial Sequence: Synthetic peptide"
STPGAPSLA

SEQ ID NO: 10239 - protein, 9 aa, Artificial Sequence
  source: /note="Description of Artificial Sequence: Synthetic peptide"
SPAAGCGAA

SEQ ID NO: 10240 - protein, 9 aa, Artificial Sequence
  source: /note="Description of Artificial Sequence: Synthetic peptide"
KPWGMRRAE

SEQ ID NO: 10241 - protein, 9 aa, Artificial Sequence
  source: /note="Description of Artificial Sequence: Synthetic peptide"
VPSPLDSSA

SEQ ID NO: 10242 - protein, 9 aa, Artificial Sequence
  source: /note="Description of Artificial Sequence: Synthetic peptide"
ARMGRSPAA

SEQ ID NO: 10243 - protein, 9 aa, Artificial Sequence
  source: /note="Description of Artificial Sequence: Synthetic peptide"
RMGRSPAAG

SEQ ID NO: 10244 - protein, 9 aa, Artificial Sequence
  source: /note="Description of Artificial Sequence: Synthetic peptide"
GAAATSKPW

SEQ ID NO: 10245 - protein, 9 aa, Artificial Sequence
  source: /note="Description of Artificial Sequence: Synthetic peptide"
MRRAETQTA

SEQ ID NO: 10246 - protein, 9 aa, Artificial Sequence
  source: /note="Description of Artificial Sequence: Synthetic peptide"
RRAETQTAA

SEQ ID NO: 10247 - protein, 9 aa, Artificial Sequence
  source: /note="Description of Artificial Sequence: Synthetic peptide"
TQTAAPRHL

SEQ ID NO: 10248 - protein, 9 aa, Artificial Sequence
  source: /note="Description of Artificial Sequence: Synthetic peptide"
KQSPDASPP

SEQ ID NO: 10249 - protein, 9 aa, Artificial Sequence
  source: /note="Description of Artificial Sequence: Synthetic peptide"
GSTPGAPSL

SEQ ID NO: 10250 - protein, 9 aa, Artificial Sequence
  source: /note="Description of Artificial Sequence: Synthetic peptide"
LATAVPSPL

SEQ ID NO: 10251 - protein, 9 aa, Artificial Sequence
  source: /note="Description of Artificial Sequence: Synthetic peptide"
SPPVAPPAW

SEQ ID NO: 10252 - protein, 10 aa, Artificial Sequence
  source: /note="Description of Artificial Sequence: Synthetic peptide"
LQVPQDDWGV

SEQ ID NO: 10253 - protein, 10 aa, Artificial Sequence
  source: /note="Description of Artificial Sequence: Synthetic peptide"
KQSPDASPPV

SEQ ID NO: 10254 - protein, 10 aa, Artificial Sequence
  source: /note="Description of Artificial Sequence: Synthetic peptide"
SLATAVPSPL

SEQ ID NO: 10255 - protein, 10 aa, Artificial Sequence
  source: /note="Description of Artificial Sequence: Synthetic peptide"
QTAAPRHLPK

SEQ ID NO: 10256 - protein, 10 aa, Artificial Sequence
  source: /note="Description of Artificial Sequence: Synthetic peptide"
ATSKPWGMRR

SEQ ID NO: 10257 - protein, 10 aa, Artificial Sequence
  source: /note="Description of Artificial Sequence: Synthetic peptide"
VARMGRSPAA

SEQ ID NO: 10258 - protein, 10 aa, Artificial Sequence
  source: /note="Description of Artificial Sequence: Synthetic peptide"
TSKPWGMRRA

SEQ ID NO: 10259 - protein, 10 aa, Artificial Sequence
  source: /note="Description of Artificial Sequence: Synthetic peptide"
GMRRAETQTA

SEQ ID NO: 10260 - protein, 10 aa, Artificial Sequence
  source: /note="Description of Artificial Sequence: Synthetic peptide"
RAETQTAAPR

SEQ ID NO: 10261 - protein, 10 aa, Artificial Sequence
  source: /note="Description of Artificial Sequence: Synthetic peptide"
VSHPGSTPGA

SEQ ID NO: 10262 - protein, 10 aa, Artificial Sequence
  source: /note="Description of Artificial Sequence: Synthetic peptide"
DWGVTPPVAR

SEQ ID NO: 10263 - protein, 10 aa, Artificial Sequence
  source: /note="Description of Artificial Sequence: Synthetic peptide"
VTPPVARMGR

SEQ ID NO: 10264 - protein, 10 aa, Artificial Sequence
  source: /note="Description of Artificial Sequence: Synthetic peptide"
DASPPVAPPA

SEQ ID NO: 10265 - protein, 10 aa, Artificial Sequence
  source: /note="Description of Artificial Sequence: Synthetic peptide"
SPAAGCGAAA

SEQ ID NO: 10266 - protein, 10 aa, Artificial Sequence
  source: /note="Description of Artificial Sequence: Synthetic peptide"
KPWGMRRAET

SEQ ID NO: 10267 - protein, 10 aa, Artificial Sequence
  source: /note="Description of Artificial Sequence: Synthetic peptide"
VPSPLDSSAM

SEQ ID NO: 10268 - protein, 10 aa, Artificial Sequence
  source: /note="Description of Artificial Sequence: Synthetic peptide"
WGVTPPVARM

SEQ ID NO: 10269 - protein, 10 aa, Artificial Sequence
  source: /note="Description of Artificial Sequence: Synthetic peptide"
CGAAATSKPW

SEQ ID NO: 10270 - protein, 10 aa, Artificial Sequence
  source: /note="Description of Artificial Sequence: Synthetic peptide"
MRRAETQTAA

SEQ ID NO: 10271 - protein, 9 aa, Artificial Sequence
  source: /note="Description of Artificial Sequence: Synthetic peptide"
VTCAHGPCF

SEQ ID NO: 10272 - protein, 10 aa, Artificial Sequence
  source: /note="Description of Artificial Sequence: Synthetic peptide"
CEVSGVTCAH

SEQ ID NO: 10273 - protein, 10 aa, Artificial Sequence
  source: /note="Description of Artificial Sequence: Synthetic peptide"
GVTCAHGPCF

SEQ ID NO: 10274 - protein, 10 aa, Artificial Sequence
  source: /note="Description of Artificial Sequence: Synthetic peptide"
GLVEVLYQGS

SEQ ID NO: 10275 - protein, 10 aa, Artificial Sequence
  source: /note="Description of Artificial Sequence: Synthetic peptide"
RCRGLVEVLY

SEQ ID NO: 10276 - protein, 9 aa, Artificial Sequence
  source: /note="Description of Artificial Sequence: Synthetic peptide"
ISHRINTGK

SEQ ID NO: 10277 - protein, 9 aa, Artificial Sequence
  source: /note="Description of Artificial Sequence: Synthetic peptide"
RINTGKASI

SEQ ID NO: 10278 - protein, 9 aa, Artificial Sequence
  source: /note="Description of Artificial Sequence: Synthetic peptide"
NTGKASIPL

SEQ ID NO: 10279 - protein, 10 aa, Artificial Sequence
  source: /note="Description of Artificial Sequence: Synthetic peptide"
AISHRINTGK

SEQ ID NO: 10280 - protein, 10 aa, Artificial Sequence
  source: /note="Description of Artificial Sequence: Synthetic peptide"
NTGKASIPLK

SEQ ID NO: 10281 - protein, 10 aa, Artificial Sequence
  source: /note="Description of Artificial Sequence: Synthetic peptide"
HRINTGKASI

SEQ ID NO: 10282 - protein, 9 aa, Artificial Sequence
  source: /note="Description of Artificial Sequence: Synthetic peptide"
TGRTGRIHV

SEQ ID NO: 10283 - protein, 9 aa, Artificial Sequence
  source: /note="Description of Artificial Sequence: Synthetic peptide"
HVLSFKTGI

SEQ ID NO: 10284 - protein, 9 aa, Artificial Sequence
  source: /note="Description of Artificial Sequence: Synthetic peptide"
TGRIHVLSF

SEQ ID NO: 10285 - protein, 10 aa, Artificial Sequence
  source: /note="Description of Artificial Sequence: Synthetic peptide"
TGRIHVLSFK

SEQ ID NO: 10286 - protein, 10 aa, Artificial Sequence
  source: /note="Description of Artificial Sequence: Synthetic peptide"
RTGRIHVLSF

SEQ ID NO: 10287 - protein, 10 aa, Artificial Sequence
  source: /note="Description of Artificial Sequence: Synthetic peptide"
RIHVLSFKTG

SEQ ID NO: 10288 - protein, 10 aa, Artificial Sequence
  source: /note="Description of Artificial Sequence: Synthetic peptide"
IHVLSFKTGI

SEQ ID NO: 10289 - protein, 9 aa, Artificial Sequence
  source: /note="Description of Artificial Sequence: Synthetic peptide"
HLRTGPGQV

SEQ ID NO: 10290 - protein, 10 aa, Artificial Sequence
  source: /note="Description of Artificial Sequence: Synthetic peptide"
HLRTGPGQVR

SEQ ID NO: 10291 - protein, 9 aa, Artificial Sequence
  source: /note="Description of Artificial Sequence: Synthetic peptide"
ALVGAASGT

SEQ ID NO: 10292 - protein, 9 aa, Artificial Sequence
  source: /note="Description of Artificial Sequence: Synthetic peptide"
GTSAGGSSR

SEQ ID NO: 10293 - protein, 9 aa, Artificial Sequence
  source: /note="Description of Artificial Sequence: Synthetic peptide"
GPRERCSPA

SEQ ID NO: 10294 - protein, 10 aa, Artificial Sequence
  source: /note="Description of Artificial Sequence: Synthetic peptide"
GPRERCSPAG

SEQ ID NO: 10295 - protein, 10 aa, Artificial Sequence
  source: /note="Description of Artificial Sequence: Synthetic peptide"
EEIDKHRRRF

SEQ ID NO: 10296 - protein, 9 aa, Artificial Sequence
  source: /note="Description of Artificial Sequence: Synthetic peptide"
KALGLLFVV

SEQ ID NO: 10297 - protein, 9 aa, Artificial Sequence
  source: /note="Description of Artificial Sequence: Synthetic peptide"
LAKALGLLF

SEQ ID NO: 10298 - protein, 9 aa, Artificial Sequence
  source: /note="Description of Artificial Sequence: Synthetic peptide"
AKALGLLFV

SEQ ID NO: 10299 - protein, 10 aa, Artificial Sequence
  source: /note="Description of Artificial Sequence: Synthetic peptide"
LAKALGLLFV

SEQ ID NO: 10300 - protein, 10 aa, Artificial Sequence
  source: /note="Description of Artificial Sequence: Synthetic peptide"
FVVTNCGEGM

SEQ ID NO: 10301 - protein, 10 aa, Artificial Sequence
  source: /note="Description of Artificial Sequence: Synthetic peptide"
DLAKALGLLF

SEQ ID NO: 10302 - protein, 10 aa, Artificial Sequence
  source: /note="Description of Artificial Sequence: Synthetic peptide"
AKALGLLFVV

SEQ ID NO: 10303 - protein, 9 aa, Artificial Sequence
  source: /note="Description of Artificial Sequence: Synthetic peptide"
QIDASVLSV

SEQ ID NO: 10304 - protein, 9 aa, Artificial Sequence
  source: /note="Description of Artificial Sequence: Synthetic peptide"
EFNQIDASV

SEQ ID NO: 10305 - protein, 9 aa, Artificial Sequence
  source: /note="Description of Artificial Sequence: Synthetic peptide"
DEFNQIDAS

SEQ ID NO: 10306 - protein, 10 aa, Artificial Sequence
  source: /note="Description of Artificial Sequence: Synthetic peptide"
NQIDASVLSV

SEQ ID NO: 10307 - protein, 10 aa, Artificial Sequence
  source: /note="Description of Artificial Sequence: Synthetic peptide"
DEFNQIDASV

SEQ ID NO: 10308 - protein, 9 aa, Artificial Sequence
  source: /note="Description of Artificial Sequence: Synthetic peptide"
KKICVRSAV

SEQ ID NO: 10309 - protein, 9 aa, Artificial Sequence
  source: /note="Description of Artificial Sequence: Synthetic peptide"
CVRSAVEQW

SEQ ID NO: 10310 - protein, 10 aa, Artificial Sequence
  source: /note="Description of Artificial Sequence: Synthetic peptide"
CVRSAVEQWL

SEQ ID NO: 10311 - protein, 10 aa, Artificial Sequence
  source: /note="Description of Artificial Sequence: Synthetic peptide"
LVLPKKICVR

SEQ ID NO: 10312 - protein, 10 aa, Artificial Sequence
  source: /note="Description of Artificial Sequence: Synthetic peptide"
LPKKICVRSA

SEQ ID NO: 10313 - protein, 9 aa, Artificial Sequence
  source: /note="Description of Artificial Sequence: Synthetic peptide"
SLFQKDKLL

SEQ ID NO: 10314 - protein, 9 aa, Artificial Sequence
  source: /note="Description of Artificial Sequence: Synthetic peptide"
NVCRSLFQK

SEQ ID NO: 10315 - protein, 9 aa, Artificial Sequence
  source: /note="Description of Artificial Sequence: Synthetic peptide"
LFQKDKLLF

SEQ ID NO: 10316 - protein, 9 aa, Artificial Sequence
  source: /note="Description of Artificial Sequence: Synthetic peptide"
QKDKLLFSL

SEQ ID NO: 10317 - protein, 10 aa, Artificial Sequence
  source: /note="Description of Artificial Sequence: Synthetic peptide"
FQKDKLLFSL

SEQ ID NO: 10318 - protein, 10 aa, Artificial Sequence
  source: /note="Description of Artificial Sequence: Synthetic peptide"
SLFQKDKLLF

SEQ ID NO: 10319 - protein, 9 aa, Artificial Sequence
  source: /note="Description of Artificial Sequence: Synthetic peptide"
VATLGSILY

SEQ ID NO: 10320 - protein, 9 aa, Artificial Sequence
  source: /note="Description of Artificial Sequence: Synthetic peptide"
TLGSILYFL

SEQ ID NO: 10321 - protein, 9 aa, Artificial Sequence
  source: /note="Description of Artificial Sequence: Synthetic peptide"
ATLGSILYF

SEQ ID NO: 10322 - protein, 9 aa, Artificial Sequence
  source: /note="Description of Artificial Sequence: Synthetic peptide"
RPVATLGSI

SEQ ID NO: 10323 - protein, 9 aa, Artificial Sequence
  source: /note="Description of Artificial Sequence: Synthetic peptide"
EEYRPVATL

SEQ ID NO: 10324 - protein, 10 aa, Artificial Sequence
  source: /note="Description of Artificial Sequence: Synthetic peptide"
PVATLGSILY

SEQ ID NO: 10325 - protein, 10 aa, Artificial Sequence
  source: /note="Description of Artificial Sequence: Synthetic peptide"
ATLGSILYFL

SEQ ID NO: 10326 - protein, 10 aa, Artificial Sequence
  source: /note="Description of Artificial Sequence: Synthetic peptide"
TLGSILYFLI

SEQ ID NO: 10327 - protein, 10 aa, Artificial Sequence
  source: /note="Description of Artificial Sequence: Synthetic peptide"
RPVATLGSIL

SEQ ID NO: 10328 - protein, 10 aa, Artificial Sequence
  source: /note="Description of Artificial Sequence: Synthetic peptide"
REEYRPVATL

SEQ ID NO: 10329 - protein, 10 aa, Artificial Sequence
  source: /note="Description of Artificial Sequence: Synthetic peptide"
VATLGSILYF

SEQ ID NO: 10330 - protein, 9 aa, Artificial Sequence
  source: /note="Description of Artificial Sequence: Synthetic peptide"
LFQKQDRYK

SEQ ID NO: 10331 - protein, 9 aa, Artificial Sequence
  source: /note="Description of Artificial Sequence: Synthetic peptide"
SLFQKQDRY

SEQ ID NO: 10332 - protein, 9 aa, Artificial Sequence
  source: /note="Description of Artificial Sequence: Synthetic peptide"
KQDRYKRNF

SEQ ID NO: 10333 - protein, 10 aa, Artificial Sequence
  source: /note="Description of Artificial Sequence: Synthetic peptide"
SLFQKQDRYK

SEQ ID NO: 10334 - protein, 10 aa, Artificial Sequence
  source: /note="Description of Artificial Sequence: Synthetic peptide"
TSLFQKQDRY

SEQ ID NO: 10335 - protein, 10 aa, Artificial Sequence
  source: /note="Description of Artificial Sequence: Synthetic peptide"
LFQKQDRYKR

SEQ ID NO: 10336 - protein, 10 aa, Artificial Sequence
  source: /note="Description of Artificial Sequence: Synthetic peptide"
QKQDRYKRNF

SEQ ID NO: 10337 - protein, 9 aa, Artificial Sequence
  source: /note="Description of Artificial Sequence: Synthetic peptide"
NTLEAIHKR

SEQ ID NO: 10338 - protein, 10 aa, Artificial Sequence
  source: /note="Description of Artificial Sequence: Synthetic peptide"
AIHKRIHSSH

SEQ ID NO: 10339 - protein, 10 aa, Artificial Sequence
  source: /note="Description of Artificial Sequence: Synthetic peptide"
NTLEAIHKRI

SEQ ID NO: 10340 - protein, 10 aa, Artificial Sequence
  source: /note="Description of Artificial Sequence: Synthetic peptide"
HKRIHSSHTI

SEQ ID NO: 10341 - protein, 9 aa, Artificial Sequence
  source: /note="Description of Artificial Sequence: Synthetic peptide"
ESESSLHLV

SEQ ID NO: 10342 - protein, 9 aa, Artificial Sequence
  source: /note="Description of Artificial Sequence: Synthetic peptide"
LLEESESSL

SEQ ID NO: 10343 - protein, 9 aa, Artificial Sequence
  source: /note="Description of Artificial Sequence: Synthetic peptide"
ESSLHLVIR

SEQ ID NO: 10344 - protein, 9 aa, Artificial Sequence
  source: /note="Description of Artificial Sequence: Synthetic peptide"
EESESSLHL

SEQ ID NO: 10345 - protein, 9 aa, Artificial Sequence
  source: /note="Description of Artificial Sequence: Synthetic peptide"
SESSLHLVI

SEQ ID NO: 10346 - protein, 10 aa, Artificial Sequence
  source: /note="Description of Artificial Sequence: Synthetic peptide"
SLLEESESSL

SEQ ID NO: 10347 - protein, 10 aa, Artificial Sequence
  source: /note="Description of Artificial Sequence: Synthetic peptide"
LEESESSLHL

SEQ ID NO: 10348 - protein, 10 aa, Artificial Sequence
  source: /note="Description of Artificial Sequence: Synthetic peptide"
EESESSLHLV

SEQ ID NO: 10349 - protein, 9 aa, Artificial Sequence
  source: /note="Description of Artificial Sequence: Synthetic peptide"
LQKCDILEL

SEQ ID NO: 10350 - protein, 10 aa, Artificial Sequence
  source: /note="Description of Artificial Sequence: Synthetic peptide"
NLQKCDILEL

SEQ ID NO: 10351 - protein, 10 aa, Artificial Sequence
  source: /note="Description of Artificial Sequence: Synthetic peptide"
SLKEKVNLQK

SEQ ID NO: 10352 - protein, 10 aa, Artificial Sequence
  source: /note="Description of Artificial Sequence: Synthetic peptide"
LQKCDILELK

SEQ ID NO: 10353 - protein, 9 aa, Artificial Sequence
  source: /note="Description of Artificial Sequence: Synthetic peptide"
EKHVEVQTL

SEQ ID NO: 10354 - protein, 10 aa, Artificial Sequence
  source: /note="Description of Artificial Sequence: Synthetic peptide"
HVEVQTLANR

SEQ ID NO: 10355 - protein, 10 aa, Artificial Sequence
  source: /note="Description of Artificial Sequence: Synthetic peptide"
GEKHVEVQTL

SEQ ID NO: 10356 - protein, 10 aa, Artificial Sequence
  source: /note="Description of Artificial Sequence: Synthetic peptide"
VEVQTLANRM

SEQ ID NO: 10357 - protein, 10 aa, Artificial Sequence
  source: /note="Description of Artificial Sequence: Synthetic peptide"
ANNKADMVLK

SEQ ID NO: 10358 - protein, 10 aa, Artificial Sequence
  source: /note="Description of Artificial Sequence: Synthetic peptide"
QVANNKADMV

SEQ ID NO: 10359 - protein, 10 aa, Artificial Sequence
  source: /note="Description of Artificial Sequence: Synthetic peptide"
LQVANNKADM

SEQ ID NO: 10360 - protein, 10 aa, Artificial Sequence
  source: /note="Description of Artificial Sequence: Synthetic peptide"
KELQVANNKA

SEQ ID NO: 10361 - protein, 9 aa, Artificial Sequence
  source: /note="Description of Artificial Sequence: Synthetic peptide"
IQTWNIAGL

SEQ ID NO: 10362 - protein, 9 aa, Artificial Sequence
  source: /note="Description of Artificial Sequence: Synthetic peptide"
GEAVTIQTW

SEQ ID NO: 10363 - protein, 10 aa, Artificial Sequence
  source: /note="Description of Artificial Sequence: Synthetic peptide"
TIQTWNIAGL

SEQ ID NO: 10364 - protein, 10 aa, Artificial Sequence
  source: /note="Description of Artificial Sequence: Synthetic peptide"
EAVTIQTWNI

SEQ ID NO: 10365 - protein, 9 aa, Artificial Sequence
  source: /note="Description of Artificial Sequence: Synthetic peptide"
NIDFKELAY

SEQ ID NO: 10366 - protein, 9 aa, Artificial Sequence
  source: /note="Description of Artificial Sequence: Synthetic peptide"
RFEGINIDF

SEQ ID NO: 10367 - protein, 9 aa, Artificial Sequence
  source: /note="Description of Artificial Sequence: Synthetic peptide"
SKRFEGINI

SEQ ID NO: 10368 - protein, 10 aa, Artificial Sequence
  source: /note="Description of Artificial Sequence: Synthetic peptide"
RFEGINIDFK

SEQ ID NO: 10369 - protein, 10 aa, Artificial Sequence
  source: /note="Description of Artificial Sequence: Synthetic peptide"
INIDFKELAY

SEQ ID NO: 10370 - protein, 10 aa, Artificial Sequence
  source: /note="Description of Artificial Sequence: Synthetic peptide"
KRFEGINIDF

SEQ ID NO: 10371 - protein, 9 aa, Artificial Sequence
  source: /note="Description of Artificial Sequence: Synthetic peptide"
SVRLRFLQN

SEQ ID NO: 10372 - protein, 9 aa, Artificial Sequence
  source: /note="Description of Artificial Sequence: Synthetic peptide"
RLRFLQNTE

SEQ ID NO: 10373 - protein, 9 aa, Artificial Sequence
  source: /note="Description of Artificial Sequence: Synthetic peptide"
QALESVRLR

SEQ ID NO: 10374 - protein, 9 aa, Artificial Sequence
  source: /note="Description of Artificial Sequence: Synthetic peptide"
QQALESVRL

SEQ ID NO: 10375 - protein, 9 aa, Artificial Sequence
  source: /note="Description of Artificial Sequence: Synthetic peptide"
ALESVRLRF

SEQ ID NO: 10376 - protein, 9 aa, Artificial Sequence
  source: /note="Description of Artificial Sequence: Synthetic peptide"
LESVRLRFL

SEQ ID NO: 10377 - protein, 10 aa, Artificial Sequence
  source: /note="Description of Artificial Sequence: Synthetic peptide"
SVRLRFLQNT

SEQ ID NO: 10378 - protein, 10 aa, Artificial Sequence
  source: /note="Description of Artificial Sequence: Synthetic peptide"
RLRFLQNTEG

SEQ ID NO: 10379 - protein, 10 aa, Artificial Sequence
  source: /note="Description of Artificial Sequence: Synthetic peptide"
QALESVRLRF

SEQ ID NO: 10380 - protein, 9 aa, Artificial Sequence
  source: /note="Description of Artificial Sequence: Synthetic peptide"
NPKDSHLLL

SEQ ID NO: 10381 - protein, 9 aa, Artificial Sequence
  source: /note="Description of Artificial Sequence: Synthetic peptide"
SHLLLGGCY

SEQ ID NO: 10382 - protein, 10 aa, Artificial Sequence
  source: /note="Description of Artificial Sequence: Synthetic peptide"
LEFNPKDSHL

SEQ ID NO: 10383 - protein, 9 aa, Artificial Sequence
  source: /note="Description of Artificial Sequence: Synthetic peptide"
RVWMYQNSV

SEQ ID NO: 10384 - protein, 9 aa, Artificial Sequence
  source: /note="Description of Artificial Sequence: Synthetic peptide"
RLAARVWMY

SEQ ID NO: 10385 - protein, 9 aa, Artificial Sequence
  source: /note="Description of Artificial Sequence: Synthetic peptide"
MYQNSVLQK

SEQ ID NO: 10386 - protein, 9 aa, Artificial Sequence
  source: /note="Description of Artificial Sequence: Synthetic peptide"
VWMYQNSVL

SEQ ID NO: 10387 - protein, 9 aa, Artificial Sequence
  source: /note="Description of Artificial Sequence: Synthetic peptide"
REKKKRLAA

SEQ ID NO: 10388 - protein, 9 aa, Artificial Sequence
  source: /note="Description of Artificial Sequence: Synthetic peptide"
KKRLAARVW

SEQ ID NO: 10389 - protein, 9 aa, Artificial Sequence
  source: /note="Description of Artificial Sequence: Synthetic peptide"
KRLAARVWM

SEQ ID NO: 10390 - protein, 9 aa, Artificial Sequence
  source: /note="Description of Artificial Sequence: Synthetic peptide"
WMYQNSVLQ

SEQ ID NO: 10391 - protein, 10 aa, Artificial Sequence
  source: /note="Description of Artificial Sequence: Synthetic peptide"
WMYQNSVLQK

SEQ ID NO: 10392 - protein, 10 aa, Artificial Sequence
  source: /note="Description of Artificial Sequence: Synthetic peptide"
KKRLAARVWM

SEQ ID NO: 10393 - protein, 10 aa, Artificial Sequence
  source: /note="Description of Artificial Sequence: Synthetic peptide"
RVWMYQNSVL

SEQ ID NO: 10394 - protein, 10 aa, Artificial Sequence
  source: /note="Description of Artificial Sequence: Synthetic peptide"
MYQNSVLQKK

SEQ ID NO: 10395 - protein, 10 aa, Artificial Sequence
  source: /note="Description of Artificial Sequence: Synthetic peptide"
KRLAARVWMY

SEQ ID NO: 10396 - protein, 10 aa, Artificial Sequence
  source: /note="Description of Artificial Sequence: Synthetic peptide"
YQNSVLQKKM

SEQ ID NO: 10397 - protein, 10 aa, Artificial Sequence
  source: /note="Description of Artificial Sequence: Synthetic peptide"
KKKRLAARVW

SEQ ID NO: 10398 - protein, 10 aa, Artificial Sequence
  source: /note="Description of Artificial Sequence: Synthetic peptide"
ARVWMYQNSV

SEQ ID NO: 10399 - protein, 9 aa, Artificial Sequence
  source: /note="Description of Artificial Sequence: Synthetic peptide"
NAHGDFLKK

SEQ ID NO: 10400 - protein, 9 aa, Artificial Sequence
  source: /note="Description of Artificial Sequence: Synthetic peptide"
KNRAYEVLK

SEQ ID NO: 10401 - protein, 9 aa, Artificial Sequence
  source: /note="Description of Artificial Sequence: Synthetic peptide"
LKKNRAYEV

SEQ ID NO: 10402 - protein, 9 aa, Artificial Sequence
  source: /note="Description of Artificial Sequence: Synthetic peptide"
KKNRAYEVL

SEQ ID NO: 10403 - protein, 10 aa, Artificial Sequence
  source: /note="Description of Artificial Sequence: Synthetic peptide"
FLKKNRAYEV

SEQ ID NO: 10404 - protein, 10 aa, Artificial Sequence
  source: /note="Description of Artificial Sequence: Synthetic peptide"
GDFLKKNRAY

SEQ ID NO: 10405 - protein, 10 aa, Artificial Sequence
  source: /note="Description of Artificial Sequence: Synthetic peptide"
LKKNRAYEVL

SEQ ID NO: 10406 - protein, 10 aa, Artificial Sequence
  source: /note="Description of Artificial Sequence: Synthetic peptide"
EQREKKKEEL

SEQ ID NO: 10407 - protein, 10 aa, Artificial Sequence
  source: /note="Description of Artificial Sequence: Synthetic peptide"
KKKEELASTA

SEQ ID NO: 10408 - protein, 9 aa, Artificial Sequence
  source: /note="Description of Artificial Sequence: Synthetic peptide"
PIINYPQLK

SEQ ID NO: 10409 - protein, 9 aa, Artificial Sequence
  source: /note="Description of Artificial Sequence: Synthetic peptide"
KNELFCNIY

SEQ ID NO: 10410 - protein, 9 aa, Artificial Sequence
  source: /note="Description of Artificial Sequence: Synthetic peptide"
YPQLKNELF

SEQ ID NO: 10411 - protein, 9 aa, Artificial Sequence
  source: /note="Description of Artificial Sequence: Synthetic peptide"
LKNELFCNI

SEQ ID NO: 10412 - protein, 10 aa, Artificial Sequence
  source: /note="Description of Artificial Sequence: Synthetic peptide"
QLKNELFCNI

SEQ ID NO: 10413 - protein, 10 aa, Artificial Sequence
  source: /note="Description of Artificial Sequence: Synthetic peptide"
NYPQLKNELF

SEQ ID NO: 10414 - protein, 10 aa, Artificial Sequence
  source: /note="Description of Artificial Sequence: Synthetic peptide"
KNELFCNIYY

SEQ ID NO: 10415 - protein, 10 aa, Artificial Sequence
  source: /note="Description of Artificial Sequence: Synthetic peptide"
INYPQLKNEL

SEQ ID NO: 10416 - protein, 10 aa, Artificial Sequence
  source: /note="Description of Artificial Sequence: Synthetic peptide"
LKNELFCNIY

SEQ ID NO: 10417 - protein, 9 aa, Artificial Sequence
  source: /note="Description of Artificial Sequence: Synthetic peptide"
KFIKIDQAW

SEQ ID NO: 10418 - protein, 9 aa, Artificial Sequence
  source: /note="Description of Artificial Sequence: Synthetic peptide"
FIKIDQAWK

SEQ ID NO: 10419 - protein, 9 aa, Artificial Sequence
  source: /note="Description of Artificial Sequence: Synthetic peptide"
IKIDQAWKI

SEQ ID NO: 10420 - protein, 10 aa, Artificial Sequence
  source: /note="Description of Artificial Sequence: Synthetic peptide"
FIKIDQAWKI

SEQ ID NO: 10421 - protein, 10 aa, Artificial Sequence
  source: /note="Description of Artificial Sequence: Synthetic peptide"
KFIKIDQAWK

SEQ ID NO: 10422 - protein, 10 aa, Artificial Sequence
  source: /note="Description of Artificial Sequence: Synthetic peptide"
QKFIKIDQAW

SEQ ID NO: 10423 - protein, 10 aa, Artificial Sequence
  source: /note="Description of Artificial Sequence: Synthetic peptide"
IKIDQAWKIL

SEQ ID NO: 10424 - protein, 10 aa, Artificial Sequence
  source: /note="Description of Artificial Sequence: Synthetic peptide"
VIANGEDTTV

SEQ ID NO: 10425 - protein, 9 aa, Artificial Sequence
  source: /note="Description of Artificial Sequence: Synthetic peptide"
LVKMDFDEK

SEQ ID NO: 10426 - protein, 10 aa, Artificial Sequence
  source: /note="Description of Artificial Sequence: Synthetic peptide"
FPFELVKMDF

SEQ ID NO: 10427 - protein, 9 aa, Artificial Sequence
  source: /note="Description of Artificial Sequence: Synthetic peptide"
LLLGAPNPI

SEQ ID NO: 10428 - protein, 9 aa, Artificial Sequence
  source: /note="Description of Artificial Sequence: Synthetic peptide"
CSRGGSSLL

SEQ ID NO: 10429 - protein, 9 aa, Artificial Sequence
  source: /note="Description of Artificial Sequence: Synthetic peptide"
SRGGSSLLL

SEQ ID NO: 10430 - protein, 9 aa, Artificial Sequence
  source: /note="Description of Artificial Sequence: Synthetic peptide"
NPIPAWTPE

SEQ ID NO: 10431 - protein, 9 aa, Artificial Sequence
  source: /note="Description of Artificial Sequence: Synthetic peptide"
IPAWTPERV

SEQ ID NO: 10432 - protein, 10 aa, Artificial Sequence
  source: /note="Description of Artificial Sequence: Synthetic peptide"
SLLLGAPNPI

SEQ ID NO: 10433 - protein, 10 aa, Artificial Sequence
  source: /note="Description of Artificial Sequence: Synthetic peptide"
LLGAPNPIPA

SEQ ID NO: 10434 - protein, 10 aa, Artificial Sequence
  source: /note="Description of Artificial Sequence: Synthetic peptide"
CSRGGSSLLL

SEQ ID NO: 10435 - protein, 10 aa, Artificial Sequence
  source: /note="Description of Artificial Sequence: Synthetic peptide"
NPIPAWTPER

SEQ ID NO: 10436 - protein, 10 aa, Artificial Sequence
  source: /note="Description of Artificial Sequence: Synthetic peptide"
LGAPNPIPAW

SEQ ID NO: 10437 - protein, 9 aa, Artificial Sequence
  source: /note="Description of Artificial Sequence: Synthetic peptide"
FPSQELDNL

SEQ ID NO: 10438 - protein, 9 aa, Artificial Sequence
  source: /note="Description of Artificial Sequence: Synthetic peptide"
GLIEKNIKL

SEQ ID NO: 10439 - protein, 9 aa, Artificial Sequence
  source: /note="Description of Artificial Sequence: Synthetic peptide"
KLFFSGSAK

SEQ ID NO: 10440 - protein, 9 aa, Artificial Sequence
  source: /note="Description of Artificial Sequence: Synthetic peptide"
IEKNIKLFF

SEQ ID NO: 10441 - protein, 9 aa, Artificial Sequence
  source: /note="Description of Artificial Sequence: Synthetic peptide"
IKLFFSGSA

SEQ ID NO: 10442 - protein, 10 aa, Artificial Sequence
  source: /note="Description of Artificial Sequence: Synthetic peptide"
NIKLFFSGSA

SEQ ID NO: 10443 - protein, 10 aa, Artificial Sequence
  source: /note="Description of Artificial Sequence: Synthetic peptide"
GLIEKNIKLF

SEQ ID NO: 10444 - protein, 9 aa, Artificial Sequence
  source: /note="Description of Artificial Sequence: Synthetic peptide"
KLNLLHKFL

SEQ ID NO: 10445 - protein, 9 aa, Artificial Sequence
  source: /note="Description of Artificial Sequence: Synthetic peptide"
KEKLNLLHK

SEQ ID NO: 10446 - protein, 9 aa, Artificial Sequence
  source: /note="Description of Artificial Sequence: Synthetic peptide"
EKLNLLHKF

SEQ ID NO: 10447 - protein, 10 aa, Artificial Sequence
  source: /note="Description of Artificial Sequence: Synthetic peptide"
LLHKFLQTEI

SEQ ID NO: 10448 - protein, 10 aa, Artificial Sequence
  source: /note="Description of Artificial Sequence: Synthetic peptide"
KEKLNLLHKF

SEQ ID NO: 10449 - protein, 9 aa, Artificial Sequence
  source: /note="Description of Artificial Sequence: Synthetic peptide"
QIKEIFCPK

SEQ ID NO: 10450 - protein, 9 aa, Artificial Sequence
  source: /note="Description of Artificial Sequence: Synthetic peptide"
RIGQIKEIF

SEQ ID NO: 10451 - protein, 10 aa, Artificial Sequence
  source: /note="Description of Artificial Sequence: Synthetic peptide"
GQIKEIFCPK

SEQ ID NO: 10452 - protein, 10 aa, Artificial Sequence
  source: /note="Description of Artificial Sequence: Synthetic peptide"
QIKEIFCPKK

SEQ ID NO: 10453 - protein, 10 aa, Artificial Sequence
  source: /note="Description of Artificial Sequence: Synthetic peptide"
APEPYRIGQI

SEQ ID NO: 10454 - protein, 10 aa, Artificial Sequence
  source: /note="Description of Artificial Sequence: Synthetic peptide"
YRIGQIKEIF

SEQ ID NO: 10455 - protein, 9 aa, Artificial Sequence
  source: /note="Description of Artificial Sequence: Synthetic peptide"
VTNPQPMGK

SEQ ID NO: 10456 - protein, 9 aa, Artificial Sequence
  source: /note="Description of Artificial Sequence: Synthetic peptide"
TTVTNPQPM

SEQ ID NO: 10457 - protein, 9 aa, Artificial Sequence
  source: /note="Description of Artificial Sequence: Synthetic peptide"
QPMGKQGRV

SEQ ID NO: 10458 - protein, 10 aa, Artificial Sequence
  source: /note="Description of Artificial Sequence: Synthetic peptide"
TVTNPQPMGK

SEQ ID NO: 10459 - protein, 10 aa, Artificial Sequence
  source: /note="Description of Artificial Sequence: Synthetic peptide"
QPMGKQGRVL

SEQ ID NO: 10460 - protein, 10 aa, Artificial Sequence
  source: /note="Description of Artificial Sequence: Synthetic peptide"
STTVTNPQPM

SEQ ID NO: 10461 - protein, 9 aa, Artificial Sequence
  source: /note="Description of Artificial Sequence: Synthetic peptide"
HLLHDARPK

SEQ ID NO: 10462 - protein, 9 aa, Artificial Sequence
  source: /note="Description of Artificial Sequence: Synthetic peptide"
FYHLLHDAR

SEQ ID NO: 10463 - protein, 9 aa, Artificial Sequence
  source: /note="Description of Artificial Sequence: Synthetic peptide"
FEFYHLLHD

SEQ ID NO: 10464 - protein, 10 aa, Artificial Sequence
  source: /note="Description of Artificial Sequence: Synthetic peptide"
EFYHLLHDAR

SEQ ID NO: 10465 - protein, 10 aa, Artificial Sequence
  source: /note="Description of Artificial Sequence: Synthetic peptide"
FEFYHLLHDA

SEQ ID NO: 10466 - protein, 9 aa, Artificial Sequence
  source: /note="Description of Artificial Sequence: Synthetic peptide"
VSNMSCLAR

SEQ ID NO: 10467 - protein, 9 aa, Artificial Sequence
  source: /note="Description of Artificial Sequence: Synthetic peptide"
NMSCLARQR

SEQ ID NO: 10468 - protein, 9 aa, Artificial Sequence
  source: /note="Description of Artificial Sequence: Synthetic peptide"
DVSNMSCLA

SEQ ID NO: 10469 - protein, 10 aa, Artificial Sequence
  source: /note="Description of Artificial Sequence: Synthetic peptide"
YTDVSNMSCL

SEQ ID NO: 10470 - protein, 10 aa, Artificial Sequence
  source: /note="Description of Artificial Sequence: Synthetic peptide"
NMSCLARQRL

SEQ ID NO: 10471 - protein, 10 aa, Artificial Sequence
  source: /note="Description of Artificial Sequence: Synthetic peptide"
CLARQRLLGR

SEQ ID NO: 10472 - protein, 10 aa, Artificial Sequence
  source: /note="Description of Artificial Sequence: Synthetic peptide"
DVSNMSCLAR

SEQ ID NO: 10473 - protein, 10 aa, Artificial Sequence
  source: /note="Description of Artificial Sequence: Synthetic peptide"
SNMSCLARQR

SEQ ID NO: 10474 - protein, 9 aa, Artificial Sequence
  source: /note="Description of Artificial Sequence: Synthetic peptide"
YTDVSNMSH

SEQ ID NO: 10475 - protein, 9 aa, Artificial Sequence
  source: /note="Description of Artificial Sequence: Synthetic peptide"
VSNMSHLAR

SEQ ID NO: 10476 - protein, 9 aa, Artificial Sequence
  source: /note="Description of Artificial Sequence: Synthetic peptide"
MSHLARQRL

SEQ ID NO: 10477 - protein, 9 aa, Artificial Sequence
  source: /note="Description of Artificial Sequence: Synthetic peptide"
NMSHLARQR

SEQ ID NO: 10478 - protein, 9 aa, Artificial Sequence
  source: /note="Description of Artificial Sequence: Synthetic peptide"
DVSNMSHLA

SEQ ID NO: 10479 - protein, 10 aa, Artificial Sequence
  source: /note="Description of Artificial Sequence: Synthetic peptide"
YTDVSNMSHL

SEQ ID NO: 10480 - protein, 10 aa, Artificial Sequence
  source: /note="Description of Artificial Sequence: Synthetic peptide"
HLARQRLLGR

SEQ ID NO: 10481 - protein, 10 aa, Artificial Sequence
  source: /note="Description of Artificial Sequence: Synthetic peptide"
MSHLARQRLL

SEQ ID NO: 10482 - protein, 10 aa, Artificial Sequence
  source: /note="Description of Artificial Sequence: Synthetic peptide"
DVSNMSHLAR

SEQ ID NO: 10483 - protein, 10 aa, Artificial Sequence
  source: /note="Description of Artificial Sequence: Synthetic peptide"
SNMSHLARQR

SEQ ID NO: 10484 - protein, 10 aa, Artificial Sequence
  source: /note="Description of Artificial Sequence: Synthetic peptide"
NMSHLARQRL

SEQ ID NO: 10485 - protein, 9 aa, Artificial Sequence
  source: /note="Description of Artificial Sequence: Synthetic peptide"
VMPKLFWET

SEQ ID NO: 10486 - protein, 9 aa, Artificial Sequence
  source: /note="Description of Artificial Sequence: Synthetic peptide"
KLFWETRTR

SEQ ID NO: 10487 - protein, 9 aa, Artificial Sequence
  source: /note="Description of Artificial Sequence: Synthetic peptide"
MPKLFWETR

SEQ ID NO: 10488 - protein, 9 aa, Artificial Sequence
  source: /note="Description of Artificial Sequence: Synthetic peptide"
TPVMPKLFW

SEQ ID NO: 10489 - protein, 10 aa, Artificial Sequence
  source: /note="Description of Artificial Sequence: Synthetic peptide"
VMPKLFWETR

SEQ ID NO: 10490 - protein, 9 aa, Artificial Sequence
  source: /note="Description of Artificial Sequence: Synthetic peptide"
KLYCLIKIV

SEQ ID NO: 10491 - protein, 9 aa, Artificial Sequence
  source: /note="Description of Artificial Sequence: Synthetic peptide"
IQKLYCLIK

SEQ ID NO: 10492 - protein, 9 aa, Artificial Sequence
  source: /note="Description of Artificial Sequence: Synthetic peptide"
IKIVHSDLF

SEQ ID NO: 10493 - protein, 10 aa, Artificial Sequence
  source: /note="Description of Artificial Sequence: Synthetic peptide"
CLIKIVHSDL

SEQ ID NO: 10494 - protein, 10 aa, Artificial Sequence
  source: /note="Description of Artificial Sequence: Synthetic peptide"
TIQKLYCLIK

SEQ ID NO: 10495 - protein, 10 aa, Artificial Sequence
  source: /note="Description of Artificial Sequence: Synthetic peptide"
LIKIVHSDLF

SEQ ID NO: 10496 - protein, 10 aa, Artificial Sequence
  source: /note="Description of Artificial Sequence: Synthetic peptide"
IQKLYCLIKI

SEQ ID NO: 10497 - protein, 9 aa, Artificial Sequence
  source: /note="Description of Artificial Sequence: Synthetic peptide"
LIVDVNKPI

SEQ ID NO: 10498 - protein, 10 aa, Artificial Sequence
  source: /note="Description of Artificial Sequence: Synthetic peptide"
ELIVDVNKPI

SEQ ID NO: 10499 - protein, 10 aa, Artificial Sequence
  source: /note="Description of Artificial Sequence: Synthetic peptide"
WKSERYELIV

SEQ ID NO: 10500 - protein, 10 aa, Artificial Sequence
  source: /note="Description of Artificial Sequence: Synthetic peptide"
SERYELIVDV

SEQ ID NO: 10501 - protein, 10 aa, Artificial Sequence
  source: /note="Description of Artificial Sequence: Synthetic peptide"
VIKEGWLHKA

SEQ ID NO: 10502 - protein, 10 aa, Artificial Sequence
  source: /note="Description of Artificial Sequence: Synthetic peptide"
GVIKEGWLHK

SEQ ID NO: 10503 - protein, 10 aa, Artificial Sequence
  source: /note="Description of Artificial Sequence: Synthetic peptide"
KEGWLHKANV

SEQ ID NO: 10504 - protein, 9 aa, Artificial Sequence
  source: /note="Description of Artificial Sequence: Synthetic peptide"
TWCETGISF

SEQ ID NO: 10505 - protein, 9 aa, Artificial Sequence
  source: /note="Description of Artificial Sequence: Synthetic peptide"
QETWCETGI

SEQ ID NO: 10506 - protein, 9 aa, Artificial Sequence
  source: /note="Description of Artificial Sequence: Synthetic peptide"
VEQETWCET

SEQ ID NO: 10507 - protein, 9 aa, Artificial Sequence
  source: /note="Description of Artificial Sequence: Synthetic peptide"
CETGISFVT

SEQ ID NO: 10508 - protein, 10 aa, Artificial Sequence
  source: /note="Description of Artificial Sequence: Synthetic peptide"
ETWCETGISF

SEQ ID NO: 10509 - protein, 10 aa, Artificial Sequence
  source: /note="Description of Artificial Sequence: Synthetic peptide"
CETGISFVTS

SEQ ID NO: 10510 - protein, 9 aa, Artificial Sequence
  source: /note="Description of Artificial Sequence: Synthetic peptide"
KTSTIALFK

SEQ ID NO: 10511 - protein, 10 aa, Artificial Sequence
  source: /note="Description of Artificial Sequence: Synthetic peptide"
ILDPDKTSTI

SEQ ID NO: 10512 - protein, 10 aa, Artificial Sequence
  source: /note="Description of Artificial Sequence: Synthetic peptide"
KTSTIALFKA

SEQ ID NO: 10513 - protein, 10 aa, Artificial Sequence
  source: /note="Description of Artificial Sequence: Synthetic peptide"
DPDKTSTIAL

SEQ ID NO: 10514 - protein, 9 aa, Artificial Sequence
  source: /note="Description of Artificial Sequence: Synthetic peptide"
HYLNLNLFL

SEQ ID NO: 10515 - protein, 9 aa, Artificial Sequence
  source: /note="Description of Artificial Sequence: Synthetic peptide"
AQAGPPPLK

SEQ ID NO: 10516 - protein, 9 aa, Artificial Sequence
  source: /note="Description of Artificial Sequence: Synthetic peptide"
RAVRRVWER

SEQ ID NO: 10517 - protein, 9 aa, Artificial Sequence
  source: /note="Description of Artificial Sequence: Synthetic peptide"
GPPPLKRAV

SEQ ID NO: 10518 - protein, 9 aa, Artificial Sequence
  source: /note="Description of Artificial Sequence: Synthetic peptide"
AAQAGPPPL

SEQ ID NO: 10519 - protein, 9 aa, Artificial Sequence
  source: /note="Description of Artificial Sequence: Synthetic peptide"
LKRAVRRVW

SEQ ID NO: 10520 - protein, 10 aa, Artificial Sequence
  source: /note="Description of Artificial Sequence: Synthetic peptide"
AAQAGPPPLK

SEQ ID NO: 10521 - protein, 10 aa, Artificial Sequence
  source: /note="Description of Artificial Sequence: Synthetic peptide"
AVRRVWERPR

SEQ ID NO: 10522 - protein, 10 aa, Artificial Sequence
  source: /note="Description of Artificial Sequence: Synthetic peptide"
RVWERPRHCL

SEQ ID NO: 10523 - protein, 9 aa, Artificial Sequence
  source: /note="Description of Artificial Sequence: Synthetic peptide"
SAYWQHITW

SEQ ID NO: 10524 - protein, 9 aa, Artificial Sequence
  source: /note="Description of Artificial Sequence: Synthetic peptide"
YWQHITWQH

SEQ ID NO: 10525 - protein, 9 aa, Artificial Sequence
  source: /note="Description of Artificial Sequence: Synthetic peptide"
WQHSTGQLY

SEQ ID NO: 10526 - protein, 9 aa, Artificial Sequence
  source: /note="Description of Artificial Sequence: Synthetic peptide"
WQHITWQHS

SEQ ID NO: 10527 - protein, 10 aa, Artificial Sequence
  source: /note="Description of Artificial Sequence: Synthetic peptide"
RSAYWQHITW

SEQ ID NO: 10528 - protein, 10 aa, Artificial Sequence
  source: /note="Description of Artificial Sequence: Synthetic peptide"
YWQHITWQHS

SEQ ID NO: 10529 - protein, 10 aa, Artificial Sequence
  source: /note="Description of Artificial Sequence: Synthetic peptide"
TWQHSTGQLY

SEQ ID NO: 10530 - protein, 10 aa, Artificial Sequence
  source: /note="Description of Artificial Sequence: Synthetic peptide"
WQHITWQHST

SEQ ID NO: 10531 - protein, 10 aa, Artificial Sequence
  source: /note="Description of Artificial Sequence: Synthetic peptide"
ITWQHSTGQL

SEQ ID NO: 10532 - protein, 9 aa, Artificial Sequence
  source: /note="Description of Artificial Sequence: Synthetic peptide"
APQDSEATL

SEQ ID NO: 10533 - protein, 9 aa, Artificial Sequence
  source: /note="Description of Artificial Sequence: Synthetic peptide"
MEAPQDSEA

SEQ ID NO: 10534 - protein, 10 aa, Artificial Sequence
  source: /note="Description of Artificial Sequence: Synthetic peptide"
MEAPQDSEAT

SEQ ID NO: 10535 - protein, 9 aa, Artificial Sequence
  source: /note="Description of Artificial Sequence: Synthetic peptide"
ASESFSSDK

SEQ ID NO: 10536 - protein, 9 aa, Artificial Sequence
  source: /note="Description of Artificial Sequence: Synthetic peptide"
KEADLELQA

SEQ ID NO: 10537 - protein, 10 aa, Artificial Sequence
  source: /note="Description of Artificial Sequence: Synthetic peptide"
QASESFSSDK

SEQ ID NO: 10538 - protein, 10 aa, Artificial Sequence
  source: /note="Description of Artificial Sequence: Synthetic peptide"
KEADLELQAL

SEQ ID NO: 10539 - protein, 10 aa, Artificial Sequence
  source: /note="Description of Artificial Sequence: Synthetic peptide"
SESFSSDKEA

SEQ ID NO: 10540 - protein, 9 aa, Artificial Sequence
  source: /note="Description of Artificial Sequence: Synthetic peptide"
SLPLIQERL

SEQ ID NO: 10541 - protein, 9 aa, Artificial Sequence
  source: /note="Description of Artificial Sequence: Synthetic peptide"
QYHLSLPLI

SEQ ID NO: 10542 - protein, 9 aa, Artificial Sequence
  source: /note="Description of Artificial Sequence: Synthetic peptide"
LSLPLIQER

SEQ ID NO: 10543 - protein, 9 aa, Artificial Sequence
  source: /note="Description of Artificial Sequence: Synthetic peptide"
DQYHLSLPL

SEQ ID NO: 10544 - protein, 9 aa, Artificial Sequence
  source: /note="Description of Artificial Sequence: Synthetic peptide"
GELDQYHLS

SEQ ID NO: 10545 - protein, 10 aa, Artificial Sequence
  source: /note="Description of Artificial Sequence: Synthetic peptide"
HLSLPLIQER

SEQ ID NO: 10546 - protein, 10 aa, Artificial Sequence
  source: /note="Description of Artificial Sequence: Synthetic peptide"
GELDQYHLSL

SEQ ID NO: 10547 - protein, 10 aa, Artificial Sequence
  source: /note="Description of Artificial Sequence: Synthetic peptide"
LDQYHLSLPL

SEQ ID NO: 10548 - protein, 10 aa, Artificial Sequence
  source: /note="Description of Artificial Sequence: Synthetic peptide"
DQYHLSLPLI

SEQ ID NO: 10549 - protein, 10 aa, Artificial Sequence
  source: /note="Description of Artificial Sequence: Synthetic peptide"
LSLPLIQERL

SEQ ID NO: 10550 - protein, 9 aa, Artificial Sequence
  source: /note="Description of Artificial Sequence: Synthetic peptide"
TENGDRTPA

SEQ ID NO: 10551 - protein, 9 aa, Artificial Sequence
  source: /note="Description of Artificial Sequence: Synthetic peptide"
WLWPLLAVC

SEQ ID NO: 10552 - protein, 9 aa, Artificial Sequence
  source: /note="Description of Artificial Sequence: Synthetic peptide"
GWWLWPLLA

SEQ ID NO: 10553 - protein, 9 aa, Artificial Sequence
  source: /note="Description of Artificial Sequence: Synthetic peptide"
WWLWPLLAV

SEQ ID NO: 10554 - protein, 9 aa, Artificial Sequence
  source: /note="Description of Artificial Sequence: Synthetic peptide"
LLAVCTADF

SEQ ID NO: 10555 - protein, 9 aa, Artificial Sequence
  source: /note="Description of Artificial Sequence: Synthetic peptide"
SGWWLWPLL

SEQ ID NO: 10556 - protein, 9 aa, Artificial Sequence
  source: /note="Description of Artificial Sequence: Synthetic peptide"
LAVCTADFF

SEQ ID NO: 10557 - protein, 9 aa, Artificial Sequence
  source: /note="Description of Artificial Sequence: Synthetic peptide"
WPLLAVCTA

SEQ ID NO: 10558 - protein, 10 aa, Artificial Sequence
  source: /note="Description of Artificial Sequence: Synthetic peptide"
WLWPLLAVCT

SEQ ID NO: 10559 - protein, 10 aa, Artificial Sequence
  source: /note="Description of Artificial Sequence: Synthetic peptide"
WSGWWLWPLL

SEQ ID NO: 10560 - protein, 10 aa, Artificial Sequence
  source: /note="Description of Artificial Sequence: Synthetic peptide"
GWWLWPLLAV

SEQ ID NO: 10561 - protein, 10 aa, Artificial Sequence
  source: /note="Description of Artificial Sequence: Synthetic peptide"
LAVCTADFFR

SEQ ID NO: 10562 - protein, 10 aa, Artificial Sequence
  source: /note="Description of Artificial Sequence: Synthetic peptide"
LLAVCTADFF

SEQ ID NO: 10563 - protein, 9 aa, Artificial Sequence
  source: /note="Description of Artificial Sequence: Synthetic peptide"
EVEDSILQY

SEQ ID NO: 10564 - protein, 9 aa, Artificial Sequence
  source: /note="Description of Artificial Sequence: Synthetic peptide"
ILQYAAWGV

SEQ ID NO: 10565 - protein, 9 aa, Artificial Sequence
  source: /note="Description of Artificial Sequence: Synthetic peptide"
VEDSILQYA

SEQ ID NO: 10566 - protein, 9 aa, Artificial Sequence
  source: /note="Description of Artificial Sequence: Synthetic peptide"
NPPEVEDSI

SEQ ID NO: 10567 - protein, 10 aa, Artificial Sequence
  source: /note="Description of Artificial Sequence: Synthetic peptide"
SILQYAAWGV

SEQ ID NO: 10568 - protein, 10 aa, Artificial Sequence
  source: /note="Description of Artificial Sequence: Synthetic peptide"
EVEDSILQYA

SEQ ID NO: 10569 - protein, 10 aa, Artificial Sequence
  source: /note="Description of Artificial Sequence: Synthetic peptide"
PEVEDSILQY

SEQ ID NO: 10570 - protein, 10 aa, Artificial Sequence
  source: /note="Description of Artificial Sequence: Synthetic peptide"
VEDSILQYAA

SEQ ID NO: 10571 - protein, 9 aa, Artificial Sequence
  source: /note="Description of Artificial Sequence: Synthetic peptide"
FSERYFGLH

SEQ ID NO: 10572 - protein, 9 aa, Artificial Sequence
  source: /note="Description of Artificial Sequence: Synthetic peptide"
AFSERYFGL

SEQ ID NO: 10573 - protein, 9 aa, Artificial Sequence
  source: /note="Description of Artificial Sequence: Synthetic peptide"
ASAFSERYF

SEQ ID NO: 10574 - protein, 9 aa, Artificial Sequence
  source: /note="Description of Artificial Sequence: Synthetic peptide"
ERYFGLHGL

SEQ ID NO: 10575 - protein, 10 aa, Artificial Sequence
  source: /note="Description of Artificial Sequence: Synthetic peptide"
SAFSERYFGL

SEQ ID NO: 10576 - protein, 10 aa, Artificial Sequence
  source: /note="Description of Artificial Sequence: Synthetic peptide"
YASAFSERYF

SEQ ID NO: 10577 - protein, 10 aa, Artificial Sequence
  source: /note="Description of Artificial Sequence: Synthetic peptide"
SERYFGLHGL

SEQ ID NO: 10578 - protein, 9 aa, Artificial Sequence
  source: /note="Description of Artificial Sequence: Synthetic peptide"
RKRIGTVRI

SEQ ID NO: 10579 - protein, 9 aa, Artificial Sequence
  source: /note="Description of Artificial Sequence: Synthetic peptide"
IGTVRIASY

SEQ ID NO: 10580 - protein, 9 aa, Artificial Sequence
  source: /note="Description of Artificial Sequence: Synthetic peptide"
TVRIASYDY

SEQ ID NO: 10581 - protein, 9 aa, Artificial Sequence
  source: /note="Description of Artificial Sequence: Synthetic peptide"
KRIGTVRIA

SEQ ID NO: 10582 - protein, 10 aa, Artificial Sequence
  source: /note="Description of Artificial Sequence: Synthetic peptide"
GTVRIASYDY

SEQ ID NO: 10583 - protein, 10 aa, Artificial Sequence
  source: /note="Description of Artificial Sequence: Synthetic peptide"
RERKRIGTVR

SEQ ID NO: 10584 - protein, 10 aa, Artificial Sequence
  source: /note="Description of Artificial Sequence: Synthetic peptide"
RIGTVRIASY

SEQ ID NO: 10585 - protein, 10 aa, Artificial Sequence
  source: /note="Description of Artificial Sequence: Synthetic peptide"
TVRIASYDYH

SEQ ID NO: 10586 - protein, 10 aa, Artificial Sequence
  source: /note="Description of Artificial Sequence: Synthetic peptide"
RKRIGTVRIA

SEQ ID NO: 10587 - protein, 9 aa, Artificial Sequence
  source: /note="Description of Artificial Sequence: Synthetic peptide"
LTSKLFSYK

SEQ ID NO: 10588 - protein, 9 aa, Artificial Sequence
  source: /note="Description of Artificial Sequence: Synthetic peptide"
LLTSKLFSY

SEQ ID NO: 10589 - protein, 9 aa, Artificial Sequence
  source: /note="Description of Artificial Sequence: Synthetic peptide"
GNLLTSKLF

SEQ ID NO: 10590 - protein, 9 aa, Artificial Sequence
  source: /note="Description of Artificial Sequence: Synthetic peptide"
SKLFSYKDF

SEQ ID NO: 10591 - protein, 10 aa, Artificial Sequence
  source: /note="Description of Artificial Sequence: Synthetic peptide"
KLFSYKDFDT

SEQ ID NO: 10592 - protein, 10 aa, Artificial Sequence
  source: /note="Description of Artificial Sequence: Synthetic peptide"
LLTSKLFSYK

SEQ ID NO: 10593 - protein, 10 aa, Artificial Sequence
  source: /note="Description of Artificial Sequence: Synthetic peptide"
NLLTSKLFSY

SEQ ID NO: 10594 - protein, 10 aa, Artificial Sequence
  source: /note="Description of Artificial Sequence: Synthetic peptide"
IGNLLTSKLF

SEQ ID NO: 10595 - protein, 9 aa, Artificial Sequence
  source: /note="Description of Artificial Sequence: Synthetic peptide"
LIALCISNL

SEQ ID NO: 10596 - protein, 9 aa, Artificial Sequence
  source: /note="Description of Artificial Sequence: Synthetic peptide"
CISNLFFML

SEQ ID NO: 10597 - protein, 9 aa, Artificial Sequence
  source: /note="Description of Artificial Sequence: Synthetic peptide"
IALCISNLF

SEQ ID NO: 10598 - protein, 9 aa, Artificial Sequence
  source: /note="Description of Artificial Sequence: Synthetic peptide"
LFFMLPWQF

SEQ ID NO: 10599 - protein, 9 aa, Artificial Sequence
  source: /note="Description of Artificial Sequence: Synthetic peptide"
ALCISNLFF

SEQ ID NO: 10600 - protein, 9 aa, Artificial Sequence
  source: /note="Description of Artificial Sequence: Synthetic peptide"
LCISNLFFM

SEQ ID NO: 10601 - protein, 9 aa, Artificial Sequence
  source: /note="Description of Artificial Sequence: Synthetic peptide"
SNLFFMLPW

SEQ ID NO: 10602 - protein, 10 aa, Artificial Sequence
  source: /note="Description of Artificial Sequence: Synthetic peptide"
SLIALCISNL

SEQ ID NO: 10603 - protein, 10 aa, Artificial Sequence
  source: /note="Description of Artificial Sequence: Synthetic peptide"
ALCISNLFFM

SEQ ID NO: 10604 - protein, 10 aa, Artificial Sequence
  source: /note="Description of Artificial Sequence: Synthetic peptide"
IALCISNLFF

SEQ ID NO: 10605 - protein, 10 aa, Artificial Sequence
  source: /note="Description of Artificial Sequence: Synthetic peptide"
NLFFMLPWQF

SEQ ID NO: 10606 - protein, 10 aa, Artificial Sequence
  source: /note="Description of Artificial Sequence: Synthetic peptide"
LIALCISNLF

SEQ ID NO: 10607 - protein, 10 aa, Artificial Sequence
  source: /note="Description of Artificial Sequence: Synthetic peptide"
ISNLFFMLPW

SEQ ID NO: 10608 - protein, 9 aa, Artificial Sequence
  source: /note="Description of Artificial Sequence: Synthetic peptide"
CTFMGIVNL

SEQ ID NO: 10609 - protein, 10 aa, Artificial Sequence
  source: /note="Description of Artificial Sequence: Synthetic peptide"
CTFMGIVNLF

SEQ ID NO: 10610 - protein, 10 aa, Artificial Sequence
  source: /note="Description of Artificial Sequence: Synthetic peptide"
SWYCTFMGIV

SEQ ID NO: 10611 - protein, 9 aa, Artificial Sequence
  source: /note="Description of Artificial Sequence: Synthetic peptide"
APGFTHPPL

SEQ ID NO: 10612 - protein, 10 aa, Artificial Sequence
  source: /note="Description of Artificial Sequence: Synthetic peptide"
MLTAAPGFTH

SEQ ID NO: 10613 - protein, 9 aa, Artificial Sequence
  source: /note="Description of Artificial Sequence: Synthetic peptide"
HAQSCRSRA

SEQ ID NO: 10614 - protein, 9 aa, Artificial Sequence
  source: /note="Description of Artificial Sequence: Synthetic peptide"
RSRAACAPD

SEQ ID NO: 10615 - protein, 9 aa, Artificial Sequence
  source: /note="Description of Artificial Sequence: Synthetic peptide"
AQSCRSRAA

SEQ ID NO: 10616 - protein, 10 aa, Artificial Sequence
  source: /note="Description of Artificial Sequence: Synthetic peptide"
RSRAACAPDT

SEQ ID NO: 10617 - protein, 10 aa, Artificial Sequence
  source: /note="Description of Artificial Sequence: Synthetic peptide"
RAACAPDTSL

SEQ ID NO: 10618 - protein, 10 aa, Artificial Sequence
  source: /note="Description of Artificial Sequence: Synthetic peptide"
AQSCRSRAAC

SEQ ID NO: 10619 - protein, 9 aa, Artificial Sequence
  source: /note="Description of Artificial Sequence: Synthetic peptide"
FLIYCLALN

SEQ ID NO: 10620 - protein, 9 aa, Artificial Sequence
  source: /note="Description of Artificial Sequence: Synthetic peptide"
IYCLALNSR

SEQ ID NO: 10621 - protein, 9 aa, Artificial Sequence
  source: /note="Description of Artificial Sequence: Synthetic peptide"
TPLFLIYCL

SEQ ID NO: 10622 - protein, 10 aa, Artificial Sequence
  source: /note="Description of Artificial Sequence: Synthetic peptide"
FLIYCLALNS

SEQ ID NO: 10623 - protein, 10 aa, Artificial Sequence
  source: /note="Description of Artificial Sequence: Synthetic peptide"
ITPLFLIYCL

SEQ ID NO: 10624 - protein, 10 aa, Artificial Sequence
  source: /note="Description of Artificial Sequence: Synthetic peptide"
LIYCLALNSR

SEQ ID NO: 10625 - protein, 10 aa, Artificial Sequence
  source: /note="Description of Artificial Sequence: Synthetic peptide"
TPLFLIYCLA

SEQ ID NO: 10626 - protein, 9 aa, Artificial Sequence
  source: /note="Description of Artificial Sequence: Synthetic peptide"
AISVPGVRR

SEQ ID NO: 10627 - protein, 9 aa, Artificial Sequence
  source: /note="Description of Artificial Sequence: Synthetic peptide"
KAISVPGVR

SEQ ID NO: 10628 - protein, 9 aa, Artificial Sequence
  source: /note="Description of Artificial Sequence: Synthetic peptide"
GVRRASSKG

SEQ ID NO: 10629 - protein, 9 aa, Artificial Sequence
  source: /note="Description of Artificial Sequence: Synthetic peptide"
YKAISVPGV

SEQ ID NO: 10630 - protein, 10 aa, Artificial Sequence
  source: /note="Description of Artificial Sequence: Synthetic peptide"
KAISVPGVRR

SEQ ID NO: 10631 - protein, 10 aa, Artificial Sequence
  source: /note="Description of Artificial Sequence: Synthetic peptide"
LYKAISVPGV

SEQ ID NO: 10632 - protein, 9 aa, Artificial Sequence
  source: /note="Description of Artificial Sequence: Synthetic peptide"
FTDSLQALI

SEQ ID NO: 10633 - protein, 9 aa, Artificial Sequence
  source: /note="Description of Artificial Sequence: Synthetic peptide"
SLQALIDWL

SEQ ID NO: 10634 - protein, 9 aa, Artificial Sequence
  source: /note="Description of Artificial Sequence: Synthetic peptide"
FSGQFTDSL

SEQ ID NO: 10635 - protein, 9 aa, Artificial Sequence
  source: /note="Description of Artificial Sequence: Synthetic peptide"
GQFTDSLQA

SEQ ID NO: 10636 - protein, 10 aa, Artificial Sequence
  source: /note="Description of Artificial Sequence: Synthetic peptide"
FTDSLQALID

SEQ ID NO: 10637 - protein, 10 aa, Artificial Sequence
  source: /note="Description of Artificial Sequence: Synthetic peptide"
SLQALIDWLY

SEQ ID NO: 10638 - protein, 10 aa, Artificial Sequence
  source: /note="Description of Artificial Sequence: Synthetic peptide"
GQFTDSLQAL

SEQ ID NO: 10639 - protein, 10 aa, Artificial Sequence
  source: /note="Description of Artificial Sequence: Synthetic peptide"
QFTDSLQALI

SEQ ID NO: 10640 - protein, 9 aa, Artificial Sequence
  source: /note="Description of Artificial Sequence: Synthetic peptide"
WMGNVESYL

SEQ ID NO: 10641 - protein, 9 aa, Artificial Sequence
  source: /note="Description of Artificial Sequence: Synthetic peptide"
MGNVESYLK

SEQ ID NO: 10642 - protein, 10 aa, Artificial Sequence
  source: /note="Description of Artificial Sequence: Synthetic peptide"
YLKEQGQVPL

SEQ ID NO: 10643 - protein, 10 aa, Artificial Sequence
  source: /note="Description of Artificial Sequence: Synthetic peptide"
WMGNVESYLK

SEQ ID NO: 10644 - protein, 10 aa, Artificial Sequence
  source: /note="Description of Artificial Sequence: Synthetic peptide"
DWMGNVESYL

SEQ ID NO: 10645 - protein, 10 aa, Artificial Sequence
  source: /note="Description of Artificial Sequence: Synthetic peptide"
ESYLKEQGQV

SEQ ID NO: 10646 - protein, 10 aa, Artificial Sequence
  source: /note="Description of Artificial Sequence: Synthetic peptide"
LDWMGNVESY

SEQ ID NO: 10647 - protein, 9 aa, Artificial Sequence
  source: /note="Description of Artificial Sequence: Synthetic peptide"
LMFFFVGTR

SEQ ID NO: 10648 - protein, 9 aa, Artificial Sequence
  source: /note="Description of Artificial Sequence: Synthetic peptide"
GTRTSTSEK

SEQ ID NO: 10649 - protein, 9 aa, Artificial Sequence
  source: /note="Description of Artificial Sequence: Synthetic peptide"
ELMFFFVGT

SEQ ID NO: 10650 - protein, 9 aa, Artificial Sequence
  source: /note="Description of Artificial Sequence: Synthetic peptide"
RKEELMFFF

SEQ ID NO: 10651 - protein, 9 aa, Artificial Sequence
  source: /note="Description of Artificial Sequence: Synthetic peptide"
EELMFFFVG

SEQ ID NO: 10652 - protein, 9 aa, Artificial Sequence
  source: /note="Description of Artificial Sequence: Synthetic peptide"
KEELMFFFV

SEQ ID NO: 10653 - protein, 10 aa, Artificial Sequence
  source: /note="Description of Artificial Sequence: Synthetic peptide"
LMFFFVGTRT

SEQ ID NO: 10654 - protein, 10 aa, Artificial Sequence
  source: /note="Description of Artificial Sequence: Synthetic peptide"
ELMFFFVGTR

SEQ ID NO: 10655 - protein, 10 aa, Artificial Sequence
  source: /note="Description of Artificial Sequence: Synthetic peptide"
SRKEELMFFF

SEQ ID NO: 10656 - protein, 10 aa, Artificial Sequence
  source: /note="Description of Artificial Sequence: Synthetic peptide"
FFFVGTRTST

SEQ ID NO: 10657 - protein, 10 aa, Artificial Sequence
  source: /note="Description of Artificial Sequence: Synthetic peptide"
EELMFFFVGT

SEQ ID NO: 10658 - protein, 10 aa, Artificial Sequence
  source: /note="Description of Artificial Sequence: Synthetic peptide"
KEELMFFFVG

SEQ ID NO: 10659 - protein, 9 aa, Artificial Sequence
  source: /note="Description of Artificial Sequence: Synthetic peptide"
FLSKDELFT

SEQ ID NO: 10660 - protein, 9 aa, Artificial Sequence
  source: /note="Description of Artificial Sequence: Synthetic peptide"
GFLSKDELF

SEQ ID NO: 10661 - protein, 9 aa, Artificial Sequence
  source: /note="Description of Artificial Sequence: Synthetic peptide"
LFTMMRSFI

SEQ ID NO: 10662 - protein, 9 aa, Artificial Sequence
  source: /note="Description of Artificial Sequence: Synthetic peptide"
ELFTMMRSF

SEQ ID NO: 10663 - protein, 9 aa, Artificial Sequence
  source: /note="Description of Artificial Sequence: Synthetic peptide"
LSKDELFTM

SEQ ID NO: 10664 - protein, 9 aa, Artificial Sequence
  source: /note="Description of Artificial Sequence: Synthetic peptide"
SKDELFTMM

SEQ ID NO: 10665 - protein, 9 aa, Artificial Sequence
  source: /note="Description of Artificial Sequence: Synthetic peptide"
DELFTMMRS

SEQ ID NO: 10666 - protein, 10 aa, Artificial Sequence
  source: /note="Description of Artificial Sequence: Synthetic peptide"
FLSKDELFTM

SEQ ID NO: 10667 - protein, 10 aa, Artificial Sequence
  source: /note="Description of Artificial Sequence: Synthetic peptide"
ELFTMMRSFI

SEQ ID NO: 10668 - protein, 10 aa, Artificial Sequence
  source: /note="Description of Artificial Sequence: Synthetic peptide"
NGFLSKDELF

SEQ ID NO: 10669 - protein, 10 aa, Artificial Sequence
  source: /note="Description of Artificial Sequence: Synthetic peptide"
LSKDELFTMM

SEQ ID NO: 10670 - protein, 10 aa, Artificial Sequence
  source: /note="Description of Artificial Sequence: Synthetic peptide"
DELFTMMRSF

SEQ ID NO: 10671 - protein, 9 aa, Artificial Sequence
  source: /note="Description of Artificial Sequence: Synthetic peptide"
ALLHPEAQL

SEQ ID NO: 10672 - protein, 9 aa, Artificial Sequence
  source: /note="Description of Artificial Sequence: Synthetic peptide"
SLSPPAEGA

SEQ ID NO: 10673 - protein, 9 aa, Artificial Sequence
  source: /note="Description of Artificial Sequence: Synthetic peptide"
GAAFGGVGK

SEQ ID NO: 10674 - protein, 9 aa, Artificial Sequence
  source: /note="Description of Artificial Sequence: Synthetic peptide"
GPPSPSPAV

SEQ ID NO: 10675 - protein, 9 aa, Artificial Sequence
  source: /note="Description of Artificial Sequence: Synthetic peptide"
SPPAEGAAF

SEQ ID NO: 10676 - protein, 9 aa, Artificial Sequence
  source: /note="Description of Artificial Sequence: Synthetic peptide"
EPTQGSIPM

SEQ ID NO: 10677 - protein, 9 aa, Artificial Sequence
  source: /note="Description of Artificial Sequence: Synthetic peptide"
IPMDRPLAW

SEQ ID NO: 10678 - protein, 9 aa, Artificial Sequence
  source: /note="Description of Artificial Sequence: Synthetic peptide"
RPLAWPSPT

SEQ ID NO: 10679 - protein, 9 aa, Artificial Sequence
  source: /note="Description of Artificial Sequence: Synthetic peptide"
VGKQVGLAM

SEQ ID NO: 10680 - protein, 9 aa, Artificial Sequence
  source: /note="Description of Artificial Sequence: Synthetic peptide"
KQVGLAMGA

SEQ ID NO: 10681 - protein, 9 aa, Artificial Sequence
  source: /note="Description of Artificial Sequence: Synthetic peptide"
PEAQLGVPL

SEQ ID NO: 10682 - protein, 9 aa, Artificial Sequence
  source: /note="Description of Artificial Sequence: Synthetic peptide"
AQLGVPLIS

SEQ ID NO: 10683 - protein, 9 aa, Artificial Sequence
  source: /note="Description of Artificial Sequence: Synthetic peptide"
GSIPMDRPL

SEQ ID NO: 10684 - protein, 9 aa, Artificial Sequence
  source: /note="Description of Artificial Sequence: Synthetic peptide"
LAWPSPTTP

SEQ ID NO: 10685 - protein, 9 aa, Artificial Sequence
  source: /note="Description of Artificial Sequence: Synthetic peptide"
AEGAAFGGV

SEQ ID NO: 10686 - protein, 10 aa, Artificial Sequence
  source: /note="Description of Artificial Sequence: Synthetic peptide"
AMGALLHPEA

SEQ ID NO: 10687 - protein, 10 aa, Artificial Sequence
  source: /note="Description of Artificial Sequence: Synthetic peptide"
LLHPEAQLGV

SEQ ID NO: 10688 - protein, 10 aa, Artificial Sequence
  source: /note="Description of Artificial Sequence: Synthetic peptide"
AVAVSLSPPA

SEQ ID NO: 10689 - protein, 10 aa, Artificial Sequence
  source: /note="Description of Artificial Sequence: Synthetic peptide"
SLSPPAEGAA

SEQ ID NO: 10690 - protein, 10 aa, Artificial Sequence
  source: /note="Description of Artificial Sequence: Synthetic peptide"
KQVGLAMGAL

SEQ ID NO: 10691 - protein, 10 aa, Artificial Sequence
  source: /note="Description of Artificial Sequence: Synthetic peptide"
LISEPTQGSI

SEQ ID NO: 10692 - protein, 10 aa, Artificial Sequence
  source: /note="Description of Artificial Sequence: Synthetic peptide"
STRSDGGQGA

SEQ ID NO: 10693 - protein, 10 aa, Artificial Sequence
  source: /note="Description of Artificial Sequence: Synthetic peptide"
RSGPPSPSPA

SEQ ID NO: 10694 - protein, 10 aa, Artificial Sequence
  source: /note="Description of Artificial Sequence: Synthetic peptide"
SPSPAVAVSL

SEQ ID NO: 10695 - protein, 10 aa, Artificial Sequence
  source: /note="Description of Artificial Sequence: Synthetic peptide"
HPEAQLGVPL

SEQ ID NO: 10696 - protein, 10 aa, Artificial Sequence
  source: /note="Description of Artificial Sequence: Synthetic peptide"
RPLAWPSPTT

SEQ ID NO: 10697 - protein, 10 aa, Artificial Sequence
  source: /note="Description of Artificial Sequence: Synthetic peptide"
LSPPAEGAAF

SEQ ID NO: 10698 - protein, 10 aa, Artificial Sequence
  source: /note="Description of Artificial Sequence: Synthetic peptide"
GVGKQVGLAM

SEQ ID NO: 10699 - protein, 10 aa, Artificial Sequence
  source: /note="Description of Artificial Sequence: Synthetic peptide"
SEPTQGSIPM

SEQ ID NO: 10700 - protein, 10 aa, Artificial Sequence
  source: /note="Description of Artificial Sequence: Synthetic peptide"
PEAQLGVPLI

SEQ ID NO: 10701 - protein, 10 aa, Artificial Sequence
  source: /note="Description of Artificial Sequence: Synthetic peptide"
AEGAAFGGVG

SEQ ID NO: 10702 - protein, 9 aa, Artificial Sequence
  source: /note="Description of Artificial Sequence: Synthetic peptide"
SMDQDFGGV

SEQ ID NO: 10703 - protein, 10 aa, Artificial Sequence
  source: /note="Description of Artificial Sequence: Synthetic peptide"
KSMDQDFGGV

SEQ ID NO: 10704 - protein, 10 aa, Artificial Sequence
  source: /note="Description of Artificial Sequence: Synthetic peptide"
SMDQDFGGVK

SEQ ID NO: 10705 - protein, 10 aa, Artificial Sequence
  source: /note="Description of Artificial Sequence: Synthetic peptide"
HLFTVHDWDK

SEQ ID NO: 10706 - protein, 10 aa, Artificial Sequence
  source: /note="Description of Artificial Sequence: Synthetic peptide"
TVHDWDKNFK

SEQ ID NO: 10707 - protein, 10 aa, Artificial Sequence
  source: /note="Description of Artificial Sequence: Synthetic peptide"
HDWDKNFKAL

SEQ ID NO: 10708 - protein, 9 aa, Artificial Sequence
  source: /note="Description of Artificial Sequence: Synthetic peptide"
HHQPHHHPR

SEQ ID NO: 10709 - protein, 9 aa, Artificial Sequence
  source: /note="Description of Artificial Sequence: Synthetic peptide"
LVVPHHQPH

SEQ ID NO: 10710 - protein, 9 aa, Artificial Sequence
  source: /note="Description of Artificial Sequence: Synthetic peptide"
SPDTLVVPH

SEQ ID NO: 10711 - protein, 9 aa, Artificial Sequence
  source: /note="Description of Artificial Sequence: Synthetic peptide"
LPPSPDTLV

SEQ ID NO: 10712 - protein, 10 aa, Artificial Sequence
  source: /note="Description of Artificial Sequence: Synthetic peptide"
QLPPSPDTLV

SEQ ID NO: 10713 - protein, 10 aa, Artificial Sequence
  source: /note="Description of Artificial Sequence: Synthetic peptide"
AQLPPSPDTL

SEQ ID NO: 10714 - protein, 10 aa, Artificial Sequence
  source: /note="Description of Artificial Sequence: Synthetic peptide"
LPPSPDTLVV

SEQ ID NO: 10715 - protein, 9 aa, Artificial Sequence
  source: /note="Description of Artificial Sequence: Synthetic peptide"
TQIPRTSRW

SEQ ID NO: 10716 - protein, 9 aa, Artificial Sequence
  source: /note="Description of Artificial Sequence: Synthetic peptide"
DTQIPRTSR

SEQ ID NO: 10717 - protein, 10 aa, Artificial Sequence
  source: /note="Description of Artificial Sequence: Synthetic peptide"
RGKKDTQIPR

SEQ ID NO: 10718 - protein, 9 aa, Artificial Sequence
  source: /note="Description of Artificial Sequence: Synthetic peptide"
KEGCTGDLV

SEQ ID NO: 10719 - protein, 10 aa, Artificial Sequence
  source: /note="Description of Artificial Sequence: Synthetic peptide"
CLKEGCTGDL

SEQ ID NO: 10720 - protein, 9 aa, Artificial Sequence
  source: /note="Description of Artificial Sequence: Synthetic peptide"
NLKMLSSAA

SEQ ID NO: 10721 - protein, 9 aa, Artificial Sequence
  source: /note="Description of Artificial Sequence: Synthetic peptide"
LKMLSSAAS

SEQ ID NO: 10722 - protein, 9 aa, Artificial Sequence
  source: /note="Description of Artificial Sequence: Synthetic peptide"
KMLSSAASP

SEQ ID NO: 10723 - protein, 10 aa, Artificial Sequence
  source: /note="Description of Artificial Sequence: Synthetic peptide"
MLSSAASPDI

SEQ ID NO: 10724 - protein, 10 aa, Artificial Sequence
  source: /note="Description of Artificial Sequence: Synthetic peptide"
LKMLSSAASP

SEQ ID NO: 10725 - protein, 9 aa, Artificial Sequence
  source: /note="Description of Artificial Sequence: Synthetic peptide"
ITVKKQELK

SEQ ID NO: 10726 - protein, 9 aa, Artificial Sequence
  source: /note="Description of Artificial Sequence: Synthetic peptide"
IVKNNSNNK

SEQ ID NO: 10727 - protein, 9 aa, Artificial Sequence
  source: /note="Description of Artificial Sequence: Synthetic peptide"
KQELKEAVK

SEQ ID NO: 10728 - protein, 9 aa, Artificial Sequence
  source: /note="Description of Artificial Sequence: Synthetic peptide"
KKQELKEAV

SEQ ID NO: 10729 - protein, 9 aa, Artificial Sequence
  source: /note="Description of Artificial Sequence: Synthetic peptide"
QELKEAVKF

SEQ ID NO: 10730 - protein, 9 aa, Artificial Sequence
  source: /note="Description of Artificial Sequence: Synthetic peptide"
KEAVKFSIV

SEQ ID NO: 10731 - protein, 9 aa, Artificial Sequence
  source: /note="Description of Artificial Sequence: Synthetic peptide"
CGIQPGLPI

SEQ ID NO: 10732 - protein, 10 aa, Artificial Sequence
  source: /note="Description of Artificial Sequence: Synthetic peptide"
SIVKNNSNNK

SEQ ID NO: 10733 - protein, 10 aa, Artificial Sequence
  source: /note="Description of Artificial Sequence: Synthetic peptide"
ELKEAVKFSI

SEQ ID NO: 10734 - protein, 10 aa, Artificial Sequence
  source: /note="Description of Artificial Sequence: Synthetic peptide"
KQELKEAVKF

SEQ ID NO: 10735 - protein, 10 aa, Artificial Sequence
  source: /note="Description of Artificial Sequence: Synthetic peptide"
CGIQPGLPIL

SEQ ID NO: 10736 - protein, 9 aa, Artificial Sequence
  source: /note="Description of Artificial Sequence: Synthetic peptide"
RAAKQQRKK

SEQ ID NO: 10737 - protein, 9 aa, Artificial Sequence
  source: /note="Description of Artificial Sequence: Synthetic peptide"
KQQRKKMEK

SEQ ID NO: 10738 - protein, 10 aa, Artificial Sequence
  source: /note="Description of Artificial Sequence: Synthetic peptide"
RAAKQQRKKM

SEQ ID NO: 10739 - protein, 9 aa, Artificial Sequence
  source: /note="Description of Artificial Sequence: Synthetic peptide"
ALNEPTIGY

SEQ ID NO: 10740 - protein, 9 aa, Artificial Sequence
  source: /note="Description of Artificial Sequence: Synthetic peptide"
PTIGYGFQR

SEQ ID NO: 10741 - protein, 9 aa, Artificial Sequence
  source: /note="Description of Artificial Sequence: Synthetic peptide"
NEPTIGYGF

SEQ ID NO: 10742 - protein, 10 aa, Artificial Sequence
  source: /note="Description of Artificial Sequence: Synthetic peptide"
IGYGFQRLQK

SEQ ID NO: 10743 - protein, 10 aa, Artificial Sequence
  source: /note="Description of Artificial Sequence: Synthetic peptide"
GYGFQRLQKV

SEQ ID NO: 10744 - protein, 10 aa, Artificial Sequence
  source: /note="Description of Artificial Sequence: Synthetic peptide"
TALNEPTIGY

SEQ ID NO: 10745 - protein, 10 aa, Artificial Sequence
  source: /note="Description of Artificial Sequence: Synthetic peptide"
LNEPTIGYGF

SEQ ID NO: 10746 - protein, 9 aa, Artificial Sequence
  source: /note="Description of Artificial Sequence: Synthetic peptide"
GLLLWQSWV

SEQ ID NO: 10747 - protein, 9 aa, Artificial Sequence
  source: /note="Description of Artificial Sequence: Synthetic peptide"
LLWQSWVEL

SEQ ID NO: 10748 - protein, 9 aa, Artificial Sequence
  source: /note="Description of Artificial Sequence: Synthetic peptide"
WQSWVELKK

SEQ ID NO: 10749 - protein, 10 aa, Artificial Sequence
  source: /note="Description of Artificial Sequence: Synthetic peptide"
LLLWQSWVEL

SEQ ID NO: 10750 - protein, 10 aa, Artificial Sequence
  source: /note="Description of Artificial Sequence: Synthetic peptide"
LLWQSWVELK

SEQ ID NO: 10751 - protein, 10 aa, Artificial Sequence
  source: /note="Description of Artificial Sequence: Synthetic peptide"
WQSWVELKKM

SEQ ID NO: 10752 - protein, 9 aa, Artificial Sequence
  source: /note="Description of Artificial Sequence: Synthetic peptide"
KMHPKETSS

SEQ ID NO: 10753 - protein, 10 aa, Artificial Sequence
  source: /note="Description of Artificial Sequence: Synthetic peptide"
KMHPKETSSV

SEQ ID NO: 10754 - protein, 9 aa, Artificial Sequence
  source: /note="Description of Artificial Sequence: Synthetic peptide"
NGRSRWNTF

SEQ ID NO: 10755 - protein, 10 aa, Artificial Sequence
  source: /note="Description of Artificial Sequence: Synthetic peptide"
NPLPNGRSRW

SEQ ID NO: 10756 - protein, 10 aa, Artificial Sequence
  source: /note="Description of Artificial Sequence: Synthetic peptide"
LLKRDPGNEV

SEQ ID NO: 10757 - protein, 10 aa, Artificial Sequence
  source: /note="Description of Artificial Sequence: Synthetic peptide"
SMNQVKLLKR

SEQ ID NO: 10758 - protein, 9 aa, Artificial Sequence
  source: /note="Description of Artificial Sequence: Synthetic peptide"
KAMSRFCEA

SEQ ID NO: 10759 - protein, 9 aa, Artificial Sequence
  source: /note="Description of Artificial Sequence: Synthetic peptide"
VWEKAMSRF

SEQ ID NO: 10760 - protein, 9 aa, Artificial Sequence
  source: /note="Description of Artificial Sequence: Synthetic peptide"
LVWEKAMSR

SEQ ID NO: 10761 - protein, 9 aa, Artificial Sequence
  source: /note="Description of Artificial Sequence: Synthetic peptide"
AKLVWEKAM

SEQ ID NO: 10762 - protein, 9 aa, Artificial Sequence
  source: /note="Description of Artificial Sequence: Synthetic peptide"
WEKAMSRFC

SEQ ID NO: 10763 - protein, 10 aa, Artificial Sequence
  source: /note="Description of Artificial Sequence: Synthetic peptide"
KLVWEKAMSR

SEQ ID NO: 10764 - protein, 10 aa, Artificial Sequence
  source: /note="Description of Artificial Sequence: Synthetic peptide"
LVWEKAMSRF

SEQ ID NO: 10765 - protein, 10 aa, Artificial Sequence
  source: /note="Description of Artificial Sequence: Synthetic peptide"
CAKLVWEKAM

SEQ ID NO: 10766 - protein, 9 aa, Artificial Sequence
  source: /note="Description of Artificial Sequence: Synthetic peptide"
HLLTFCCYL

SEQ ID NO: 10767 - protein, 9 aa, Artificial Sequence
  source: /note="Description of Artificial Sequence: Synthetic peptide"
LTFCCYLEL

SEQ ID NO: 10768 - protein, 9 aa, Artificial Sequence
  source: /note="Description of Artificial Sequence: Synthetic peptide"
SLALHLLTF

SEQ ID NO: 10769 - protein, 9 aa, Artificial Sequence
  source: /note="Description of Artificial Sequence: Synthetic peptide"
TFCCYLELR

SEQ ID NO: 10770 - protein, 9 aa, Artificial Sequence
  source: /note="Description of Artificial Sequence: Synthetic peptide"
LHLLTFCCY

SEQ ID NO: 10771 - protein, 10 aa, Artificial Sequence
  source: /note="Description of Artificial Sequence: Synthetic peptide"
LLTFCCYLEL

SEQ ID NO: 10772 - protein, 10 aa, Artificial Sequence
  source: /note="Description of Artificial Sequence: Synthetic peptide"
SLALHLLTFC

SEQ ID NO: 10773 - protein, 10 aa, Artificial Sequence
  source: /note="Description of Artificial Sequence: Synthetic peptide"
LTFCCYLELR

SEQ ID NO: 10774 - protein, 10 aa, Artificial Sequence
  source: /note="Description of Artificial Sequence: Synthetic peptide"
LSLALHLLTF

SEQ ID NO: 10775 - protein, 10 aa, Artificial Sequence
  source: /note="Description of Artificial Sequence: Synthetic peptide"
ALHLLTFCCY

SEQ ID NO: 10776 - protein, 9 aa, Artificial Sequence
  source: /note="Description of Artificial Sequence: Synthetic peptide"
LSFLLVWDY

SEQ ID NO: 10777 - protein, 9 aa, Artificial Sequence
  source: /note="Description of Artificial Sequence: Synthetic peptide"
LLVWDYIGI

SEQ ID NO: 10778 - protein, 9 aa, Artificial Sequence
  source: /note="Description of Artificial Sequence: Synthetic peptide"
SFLLVWDYI

SEQ ID NO: 10779 - protein, 9 aa, Artificial Sequence
  source: /note="Description of Artificial Sequence: Synthetic peptide"
WDYIGINMA

SEQ ID NO: 10780 - protein, 10 aa, Artificial Sequence
  source: /note="Description of Artificial Sequence: Synthetic peptide"
FLLVWDYIGI

SEQ ID NO: 10781 - protein, 10 aa, Artificial Sequence
  source: /note="Description of Artificial Sequence: Synthetic peptide"
LLSFLLVWDY

(The sequence listing continues in the following parts.)

What is claimed is:

1. A method of treating cancer in a subject in need thereof comprising administering to the subject a pharmaceutical composition comprising:
   (i) a polypeptide comprising at least one amino acid sequence comprising at least 8 contiguous amino acids of: PPLQHGHRHGLEPCSMLTGPPARVPAVPFDLHFCRSSIMKPKRDGYMFLKAES KIMFATLQRSSLWCLCSNH (residues 26-97 of SEQ ID NO: 1297); or
   (ii) a nucleic acid encoding the polypeptide; and
   a pharmaceutically acceptable carrier.

2. The method of claim 1, wherein the at least 8 contiguous amino acids binds to an HLA protein in the subject.

3. The method of claim 1, wherein the polypeptide comprises at least two distinct amino acid sequences.

4. The method of claim 3, wherein the polypeptide comprises at most 20 distinct amino acid sequences.

5. The method of claim 1, wherein the polypeptide is from 8 to 50 amino acids in length.

6. The method of claim 1, wherein the at least 8 contiguous amino acids binds to a protein expressed by an HLA-A, HLA-B or HLA-C allele of the subject with a KD of less than 500 nM.

7. The method of claim 1, wherein the pharmaceutical composition is an immunogenic composition or a vaccine composition.

8. The method of claim 7, wherein the pharmaceutical composition further comprises an immunomodulator or adjuvant.

9. The method of claim 8, wherein the immunomodulator or adjuvant is poly(I:C).

10. The method of claim 1, further comprising administering an additional cancer therapy to the subject.

11. The method of claim 10, wherein the additional therapy is a checkpoint inhibitor; or wherein the additional therapy is surgery, chemotherapy, a targeted therapy, or a combination thereof.

12. The method of claim 1, wherein the cancer is breast cancer.

13. The method of claim 1, wherein the subject has a GATA3 frameshift mutation.

14. The method of claim 13, wherein the GATA3 frameshift mutation is a GATA3:p.H434 frameshift mutation.

15. The method of claim 12, wherein the breast cancer is non-metastatic breast cancer.

16. The method of claim 12, wherein the breast cancer is metastatic breast cancer.

17. The method of claim 12, wherein the breast cancer is HER-2-positive breast cancer.

18. The method of claim 12, wherein the breast cancer is a stage I breast cancer, stage II breast cancer, stage IIA breast cancer or operable stage IIC breast cancer.

19. The method of claim 1, wherein the polypeptide comprises an amino acid sequence ESKIMFATL (SEQ ID NOs: 13457, 13526, 13595, 13661, 13717, 13772, 33585).

20. The method of claim 1, wherein the polypeptide comprises an amino acid sequence FATLQRSSL (SEQ ID NOs: 13454, 13523, 13592, 13658, 13714, 13769, 33527).

21. The method of claim 1, wherein the polypeptide comprises an amino acid sequence FLKAESKIM (SEQ ID NOs: 13438, 13507, 13576, 13643, 13700, 13754, 33542).

22. The method of claim 1, wherein the polypeptide comprises an amino acid sequence FLKAESKIMF (SEQ ID NOs: 13488, 13559, 13628, 13687, 13741, 13796).

23. The method of claim 1, wherein the polypeptide comprises an amino acid sequence GPPARVPAV (SEQ ID NOs: 13452, 13521, 13590, 13656, 13712, 13767, 33554).

24. The method of claim 1, wherein the polypeptide comprises an amino acid sequence IMKPKRDGYM (SEQ ID NOs: 13477, 13548, 13617, 13679, 13734, 13789).

25. The method of claim 1, wherein the polypeptide comprises an amino acid sequence KIMFATLQR (SEQ ID NOs: 13441, 13510, 13579, 13646, 13703, 13757, 33513).

26. The method of claim 1, wherein the polypeptide comprises an amino acid sequence KPKRDGYMF (SEQ ID NOs: 13453, 13522, 13591, 13657, 13713, 13768, 33555).

27. The method of claim 1, wherein the polypeptide comprises an amino acid sequence KPKRDGYMFL (SEQ ID NOs: 13485, 13556, 13625, 13684, 13738, 13793, 33556).

28. The method of claim 1, wherein the polypeptide comprises an amino acid sequence LHFCRSSIM (SEQ ID NOs: 13456, 13525, 13594, 13660, 13716, 13771).

29. The method of claim 1, wherein the polypeptide comprises an amino acid sequence MFATLQRSSL (SEQ ID NOs: 13487, 13558, 13627, 13686, 13740, 13795).

30. The method of claim 1, wherein the polypeptide comprises an amino acid sequence MFLKAESKI (SEQ ID NOs: 13444, 13513, 13582, 13649, 13706, 13760, 33726).

31. The method of claim 1, wherein the polypeptide comprises an amino acid sequence MLTGPPARV (SEQ ID NOs: 13437, 13506, 13575, 13642, 13699, 13753, 33517).

32. The method of claim 1, wherein the polypeptide comprises an amino acid sequence SMLTGPPARV (SEQ ID NOs: 13471, 13541, 13610, 13672, 13728, 13783, 33521).

33. The method of claim 1, wherein the polypeptide comprises an amino acid sequence TLQRSSLWCL (SEQ ID NOs: 13473, 13543, 13612, 13674, 13730, 13785, 33523).

34. The method of claim 1, wherein the polypeptide comprises an amino acid sequence YMFLKAESK (SEQ ID NOs: 13440, 13509, 13578, 13645, 13702, 13756, 33520).

35. The method of claim 1, wherein the polypeptide comprises an amino acid sequence YMFLKAESKI (SEQ ID NOs: 13472, 13542, 13611, 13673, 13729, 13784, 33522).

* * * * *